United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 39

SEQ ID NO: 173071 - protein, 159 aa, Glycine max
  Coding DNA Sequence Number=SeqID_56293
  Gene Ontology: Mol. function=phosphoribosyl-AMP cyclohydrolase activity; Cellular component=nucleus; Biological process=amino acid biosynthetic process
  Homolog annotation: Hit_ID=Q8PLG5; Match level="QueryCoverage=100%, HitCoverage=77%, E-value=3e-50, Identity=66%"; Hit description =Histidine biosynthesis bifunctional protein hisIE [Includes: Phosphoribosyl-AMP ...
  Homolog annotation: Hit description=cyclohydrolase (EC 3.5.4.19) (PRA- CH); Phosphoribosyl-ATP pyrophosphatase (EC 3.6.1.31) (PRA-PH)]
MALFQHRPRILQRQPARAQQHQQVVQQVRSLAQQRLVILRHRRQGGLHALLAHLLRDAADAALEQARGVAARWPLRLAHRHQLAQPAKEVLRRAIEAALRTGVTGRPGRACHHQQRIGIAVHADRLHHQHVAGLLALGPQPLLAAAEERHVPDRQGGRQ

SEQ ID NO: 173072 - protein, 227 aa, Glycine max
  Coding DNA Sequence Number=SeqID_56294
  Gene Ontology: Mol. function=endoribonuclease activity; Cellular component=lysosome; Biological process=RNA catabolic process
  Homolog annotation: Hit_ID=Q1S6Z0; Match level="QueryCoverage=89%, HitCoverage=89%, E-value=1e-106, Identity=83%"; Hit description =Ribonuclease T2
  Pfam annotation: Domain name=Ribonuclease_T2; Domain location=27-216; Score=353.2; E_value=4.3e-103; Accession=PF00445.9; Description =Ribonuclease T2 family
MELKESILIKLLLLLPFFSVLCASPDFNFFYFVQQWPGSYCDTQKSCCYPTTGKPAADFGIHGLWPNYNDGTYPSNCDPNNPFNPSGISDLTSSLQSNWPTLACPSSDGITFWTHEWDKHGTCSESVLKQHDYFEAALNLRQKANLLQALTNAGIQPDGQSYSLSDIKEAIKNGIGYAPFIECNVDSSGNSQLYQVYLCVNTSGSDFMECPVFPRSKCGSDIEFPSF

SEQ ID NO: 173073 - protein, 66 aa, Glycine max
  Coding DNA Sequence Number=SeqID_56295
MSHGRLYQKRVKNALTRRSRIVLGDGQISGQIQRQRQIEVNSNVATVCCALSFLAFRYLGTDASRG

SEQ ID NO: 173074 - protein, 101 aa, Glycine max
  Coding DNA Sequence Number=SeqID_56296
MQSKFQSQMQSQGLALPPEPEEEFMRDPQPFTIFPLLHVQVKVGVEEVRDVDAPIPIPTKEVKLVGQTPNTFLAWPTHLVKRLSEQGAEGPAKPADRPNHE

SEQ ID NO: 173075 - protein, 156 aa, Glycine max
  Coding DNA Sequence Number=SeqID_56297
  Homolog annotation: Hit_ID=Q1RXW3; Match level="QueryCoverage=99%, HitCoverage=24%, E-value=4e-08, Identity=28%"; Hit description=Zinc finger, CCHC-type
  Pfam annotation: Domain name=zf-CCHC; Domain location=84-101; Score =22.5; E_value=0.00019; Accession=PF00098.13; Description=Zinc knuckle
MSLANLFGKLQEHEMELMRLNQHEENDKKKKGIALKASSSIQEEKDDDFSFFVKRFNKFLRNKGNQRRTNFNPKKKGEDSPSIPKCYECNQPGHLRVDFPSFKKKMEKSNKKNFKDKKAKKTYITWKDNDIDSSGDSENEVVNLSLMAKNYDIEEE

SEQ ID NO: 173076 - protein, 133 aa, Glycine max
  Coding DNA Sequence Number=SeqID_56298
  Gene Ontology: Mol. function=CTP synthase activity; Cellular component=cytoplasm; Biological process=pyrimidine nucleotide biosynthetic process
  Homolog annotation: Hit_ID=Q4K813; Match level="QueryCoverage=99%, HitCoverage=56%, E-value=1e-34, Identity=56%"; Hit description=CTP synthase domain protein
YAVVEYARNVLGWEDAGHAETDPDARWVIAPLACSLVEQRGEVTFEPGSRIAQAYGALQSNEGYHCNFGVNAEFSEALATRNLRITSWDLEGDVRGVELTDHPFFVATLFQSERAALQNRLSPLVVAWLQAAR

SEQ ID NO: 173077 - protein, 147 aa, Glycine max
  Coding DNA Sequence Number=SeqID_56299
  Subcellular localization annotation: CTP_CleavageSite=93; ConfidenceScore=5.61e-01
MNSLPSAVHVSSTFESGAPRIHCLANFASSPFSTFIRSPMNLLPSVVHVTSTFDAVHVSSTFESGAPRIHCLAKFANSPFSSFIRSPMNSLPRAVHVYSTFESGAPRIDRLALFANSPFSTFIQSPMNLLPSVVHVSSTFEFWSPAN

SEQ ID NO: 173078 - protein, 661 aa, Glycine max
  Coding DNA Sequence Number=SeqID_56300
  Gene Ontology: Mol. function=RNA-directed DNA polymerase activity; Cellular component=chromatin; Biological process=chromatin assembly or disassembly
  Pfam annotation: Domain name=RVP_2; Domain location=133-270; Score= -53.1; E_value=0.014; Accession=PF08284.2; Description=Retroviral aspartyl protease
  Pfam module annotation: Pfam domain module=RVP_2::RVT_1; Domain location=133-270::381-550
MASFYMDGPTLSWYQWMTRNRFILSWLTLLQALESRLYPELRREVQALQPLSLPQVVALAKLQEEKLHDRRRHGLPPASPPISPLPPSTARPLWVVGHRCRPRLHFLIADDDADSFDTSAPPSPGVVSEPFHHQDQLNVPQISLNALTGMPTPKMFRIYGTIARHQVMILVDGGSTHNFIQARLAVFLHLDQVPTATMRVMIGKNITIDCDTKCPLVPILIQGHSFSVDLYQLPIGGTDIVLGVQWFKLLGSVTTDYASLTMSFNYLKQPISLHADIPLCPSLASAQQQKRFSQTHGISALYHLTHIPDPAHLANPVTTPPTSSSHPALAHLLHRYEAIFQEPHQLPPPRNITHRIHLLLNTNPVNVTTMLEADMIRPSHNPFSSPVLLIKKKDDNWRCCVNYRALNAVTIKDHFPMPMINELLDEISHASWFSKLDLWQGFHHIRMHDEDIPKTAFCTHQGHYEFMVMPFGLSNAPSTFQATMNDLLRSFLQKFVAVFFDDILVYSSSFPTHLDHLEAVFSTLLKGSFFLRRSKCIITEQCLNYLGHIISLQGVAPDSEKIQAMTQWPIPMSTFDLQSFLVLTGFYRKFIKNYATTAVPLTILLCKDKFSWSPEAQATFQQLKYLMTQAPILATSDFTVPFTLETDASGTTIEAVLLQQS

SEQ ID NO: 173079 - protein, 139 aa, Glycine max
  Coding DNA Sequence Number=SeqID_56301
MEEENEREREGGAWKLKENREKTYHMGNFLEKQGRLLKINSNKIKESRRFKRRLKICKSLKKSIKRRSTWLNHWTQRSNALWGSLQEMEFASWHNHWTLRSNILWVSLQEVGLPLGVIIEHKGGRSFGVHCKRWDCLLV

SEQ ID NO: 173080 - protein, 99 aa, Glycine max
  Coding DNA Sequence Number=SeqID_56302
MIKEALVIKELANFENPTDRVLAVEARGVELHMRLGGVGGWGEGVRRWLCRGRRVDGDRHKVLEHGIHFGVHGGLCLDKGNVVLGESGLALGQGGLDLG

SEQ ID NO: 173081 - protein, 608 aa, Glycine max
  Coding DNA Sequence Number=SeqID_56303
  Gene Ontology: Mol. function=metal ion binding; Cellular component =intracellular; Biological process=thiamin biosynthetic process
  Homolog annotation: Hit_ID=Q1S6Y8; Match level="QueryCoverage=99%, HitCoverage=99%, E-value=0.0, Identity=79%"; Hit description =Tetratricopeptide-like helical
  Pfam annotation: Domain name=PPR; Domain location=101-135; Score =21.2; E_value=0.0037; Accession=PF01535.11; Description=PPR repeat
  Pfam annotation: Domain name=PPR; Domain location=136-169; Score=9.2; E_value=0.61; Accession=PF01535.11; Description=PPR repeat
  Pfam annotation: Domain name=PPR; Domain location=202-236; Score =42.1; E_value=1.9e-09; Accession=PF01535.11; Description=PPR repeat
  Pfam annotation: Domain name=PPR; Domain location=303-337; Score =33.5; E_value=7.5e-07; Accession=PF01535.11; Description=PPR repeat
  Pfam annotation: Domain name=PPR; Domain location=338-372; Score=9.2; E_value=0.61; Accession=PF01535.11; Description=PPR repeat
  Pfam annotation: Domain name=PPR; Domain location=374-407; Score =13.3; E_value=0.2; Accession=PF01535.11; Description=PPR repeat
  Pfam annotation: Domain name=PPR; Domain location=440-473; Score=2.5; E_value=3.8; Accession=PF01535.11; Description=PPR repeat
  Pfam module annotation: Pfam domain module=PPR::PPR::PPR::PPR::PPR::PP R::PPR; Domain location=101-135::136-169::202-236::303-337::338 -372::374-407::440-473
MATTPILQCVSHSLTKLNTEAPRHEPNTAALEPPSSSILSLIPKCTSLRELKQIQAYTIKTHQNNPTVLTKLINFCTSNPTIASMDHAHRMFDKIPQPDIVLFNTMARGYARFDDPLRAILLCSQVLCSGLLPDDYTFSSLLKACARLKALEEGKQLHCLAVKLGVGDNMYVCPTLINMYTACNDVDAARRVFDKIGEPCVVAYNAIITSCARNSRPNEALALFRELQESGLKPTDVTMLVALSSCALLGALDLGRWIHEYVKKNGFDQYVKVNTALIDMYAKCGSLDDAVSVFKDMPRRDTQAWSAMIVAYATHGHGSQAISMLREMKKAKVQPDEITFLGILYACSHTGLVEEGYEYFHSMTHEYGIVPSIKHYGCMIDLLGRAGRLEEACKFIDELPIKPTPILWRTLLSSCSSHGNVEMAKLVIQRIFELDDSHGGDYVILSNLCARNGRWDDVNHLRKMMVDKGALKVPGCSSIEVNNVVHEFFSGDGVHSTSTILHHALDELVKELKLAGYVPDTSLVFYADIEDEEKEIVLRYHSEKLAITYGLLNTPPGTTIRVVKNLRVCVDCHNAAKFISLIFGRQIILRDVQRFHHFKDGKCSCGDY

SEQ ID NO: 173082 - protein, 65 aa, Glycine max
  Coding DNA Sequence Number=SeqID_56304
METCFGVVEDVASNNIGVGVLLVEGDAEFVKDMKDSGSEAIAQILKVDGGSHGEEVVKGKTRDRG

SEQ ID NO: 173083 - protein, 296 aa, Glycine max
  Coding DNA Sequence Number=SeqID_56305
  Gene Ontology: Mol. function=DNA binding; Cellular component=nucleus; Biological process=regulation of transcription
  Homolog annotation: Hit_ID=Q9LHF0; Match level="QueryCoverage=69%, HitCoverage=63%, E-value=4e-22, Identity=68%"; Hit description =Arabidopsis thaliana genomic DNA, chromosome 3, P1 clone: MYI13
  Pfam annotation: Domain name=ZF-HD_dimer; Domain location=46-107; Score=133.7; E_value=5e-37; Accession=PF04770.3; Description=ZF-HD protein dimerisation region
MDLTKDTNTLDTNSQTPPQPFTTNGSLKDHHHHHPTTVSPPQQPPSTAVAYKECLKNHAASIGGHALDGCGEFMPSSFSNPNEPRSLTCAACGCHRNFHRRRDTPENHHRSNSRPNFLSFYHSPPPSRHGAGPSSSPSPSPMSSPSPPPISHHFPPSSHHFQGPIPAHGLLGLGNEHHHHMSFNFNSSSHWNPENSGGKKRHRTKFSHEQKEKMHNFAEKLGWRMQKGDEGLVQDFCKEIGVSRGVFKVWMHNNKNTSGRKKSLEPGERINGTGSDSTDNNNNHPYNTNSTNDDTH

SEQ ID NO: 173084 - protein, 179 aa, Glycine max
  Coding DNA Sequence Number=SeqID_56306
  Gene Ontology: Mol. function=RNA-directed DNA polymerase activity; Cellular component=chromatin; Biological process=RNA-dependent DNA replication
  Homolog annotation: Hit_ID=Q1T2D5; Match level="QueryCoverage=79%, HitCoverage=9%, E-value=5e-36, Identity=48%"; Hit description=Chromo
EDDPALQLDPPDEVETAGDPSLQDHHLSYNALKGSSGLGIMKFQGSINGLGVQILLDSGSSDNFLQPRLAQCLKLPVEPIPNLQVLVVNGNALTAEGLIQDLEVKIQGHTLKLPVYLLPVSGADLVLGAAWLATIGPDLSDYSTLTLKFYLVFDVPSGLPPRRTHNHSIPLVEGAKGSD

SEQ ID NO: 173085 - protein, 49 aa, Glycine max
  Coding DNA Sequence Number=SeqID_56307
SKKTTKGKGGKRFWKSIVVGFKTPREAIEVMDLSHLMLRDVFLKSNKLV

SEQ ID NO: 173086 - protein, 248 aa, Glycine max
  Coding DNA Sequence Number=SeqID_56308
MGVIELCVEVDIAGAFALNVKNSLLSCGNNIVGNESKVQRFVTNLDEDSDDDDYMIYNSYVEDSSDEEEDINDISDTDEEGGSEIAFWESASNYSNINWSHPDEEDIRGFDMGSTFNIGQELFVGMEFESKNAVKKCTATPIIQVDDTFLYGKYRETLLMTTTQDGNGHVLPLAFAVVEGETLTAWPWFLAHLREHVTDKDDICLISNRHVMKQIQKNQEKACSHIVRIYDIQRTMFEVEEAYNPMSQ

SEQ ID NO: 173087 - protein, 47 aa, Glycine max
  Coding DNA Sequence Number=SeqID_56309
MAQYVVLREFEQKIAPTDMTQYLFSCYSNSLRIAVGTTAQCHMSASR

SEQ ID NO: 173088 - protein, 89 aa, Glycine max
  Coding DNA Sequence Number=SeqID_56310
MEGSKKILTGKKEAAGKGGVMQVREQHVFSIYKRRRRRRSKEYCARGVGATSLCVYLRHYALCSTCALHPMPILTKSGCATAAVATHCA

SEQ ID NO: 173089 - protein, 97 aa, Glycine max
  Coding DNA Sequence Number=SeqID_56311
MYPMPSFLWRHRVVIKSGGVRGRGGGEEEEVVSVIGESGEQKRNCDWWCHNHAHNNNAITYKFEAEEVARIDPGDGGGGSTRRKEGVSGGGGGHEHD

SEQ ID NO: 173090 - protein, 197 aa, Glycine max
  Coding DNA Sequence Number=SeqID_56312
  Gene Ontology: Mol. function=zinc ion binding
  Homolog annotation: Hit_ID=Q0KIL9; Match level="QueryCoverage=83%, HitCoverage=91%, E-value=1e-30, Identity=46%"; Hit description=Zinc finger protein, putative
MGCLLPRYQTQASCIGIQDSLEFYMHPYQPGYTAPPPRPNPEETTIDIGGGWTISGTPLDLRDPRLLAIAEAERQFLDAEYDEYAASNASGAAFCRSAALILMALLLLRHALSVSDGDNSDDDPSSFFSLFLLRAAGFLLPCYIMAWAISILQRRRQRQEAAALAATQVAFVLQSGQRRGLQFAIAPGPPTLHQEQV

SEQ ID NO: 173091 - protein, 271 aa, Glycine max
  Coding DNA Sequence Number=SeqID_56313
  Gene Ontology: Mol. function=DNA binding; Biological process=DNA integration
  Homolog annotation: Hit_ID=Q1SKW6; Match level="QueryCoverage=69%, HitCoverage=34%, E-value=1e-30, Identity=39%"; Hit description =Integrase, catalytic region
PTENEKKDCKTLCLLHQNIDTTNFDTIEVATTVKEAWEILEKCHAGAEKLTKVVGKTFLCSLDLRKKYGNFANECHNNNNQQRKFDNEAHLAQDNDFSSDPIVFMVTPNFDLGNFETWYLDSGCSNYMTIHREWLIDFDGTKKSKVRFADNITMPVEGVGNVIIKRKNGKFAMISGVLYVPNMKNNLLSVTTIRNGLRFEKKDSRVVYAQERVEKPKSPRVENSRNHHRGWHVLVAPLVQGPAARGSQGAMVAQRANGDGNTPTLPWDNDK

SEQ ID NO: 173092 - protein, 108 aa, Glycine max
  Coding DNA Sequence Number=SeqID_56314
MVFHPSRTTILLLFVGFLISIQTENVLGLRSSEIALRHSHKDQRILLQNQHTLKATKELSNTEKNSANANKGLDPSKKNSANFNQEFDPNQSSKRRVPRGSDPIHNRI

SEQ ID NO: 173093 - protein, 247 aa, Glycine max
  Coding DNA Sequence Number=SeqID_56315
MEQFMKAMFYCKHLLILCNGREKTTMVKALHDQTQISIWLMVPSGGLHAICNRHDLKGTSNYHNSTDMAEFSLFINSMDVNEVSSTGKRFLWFSSDGKSMGKVTMKNGIRKWILLGYYLNSMISCVQQSIKTTFNQRIDQKSKELEDLDSLIMEGSTHNEQDSWIWLLDPISGFSVAATYKLVQNALAQEHNPTQHGSTYNKLWDCMAPSKVTIHGLALTQQQTSNSGPAAKKEYSNSGSTFTMLFL

SEQ ID NO: 173094 - protein, 89 aa, Glycine max
  Coding DNA Sequence Number=SeqID_56316
MSFLQIVTILLNRPCAGEEIQLHSPSGNPQILLEETIVHLGCQQQGANLLPLDLVPNASNIQRKYLYGVSSFNLEMTWGRQSFSSMKRI

SEQ ID NO: 173095 - protein, 104 aa, Glycine max
  Coding DNA Sequence Number=SeqID_56317
  Subcellular localization annotation: CTP_CleavageSite=59; ConfidenceScore=5.43e-01
MASSMWHNYRNALVALVFITKRKRRLRSRRWGKVTYVFISSRRNKNRWSYRFVRFWGVRDEGALKERLNNIYIKGTKMFVNRPKYGKQRAQLKHFQRGKRPIMN

SEQ ID NO: 173096 - protein, 245 aa, Glycine max
  Coding DNA Sequence Number=SeqID_56318
KSIGARPIAQYDTRIFHSFEAWTRYIDNVIGRHILDKRKVEIYNIELDEFKAELERRNFHKRLTNLADSSIDLALVKDLNTFLETPVVLAEGESLPAYTRYCRMPTDIREIEAALCILGRGFGLNAEGHPRKILRKNLTNLAQLDMNVGALISGHITSMAQSNSSRLGFPGLITTLWARRARARPAEAPSTSVAPPPACTLAAPSTPSSTDFQHSIPSVEQFNEWVAWPGTQPPLHRKDEGITAQ

SEQ ID NO: 173097 - protein, 137 aa, Glycine max
  Coding DNA Sequence Number=SeqID_56319
  Subcellular localization annotation: CTP_CleavageSite=82; ConfidenceScore=5.44e-01
MNCVFVHVSSTFEFGAMRSDCLVQFSVLNLFRSPMNCVFVHVSSTFEFGAMRSDCLVQFSILNVFRSPMNCVFINMSSIFVLGAMRSDCLVQFSILNLFRSPVNYVFIHVSSTFEFGAMRNDCFVQFSIFYPFFGAP

SEQ ID NO: 173098 - protein, 61 aa, Glycine max
  Coding DNA Sequence Number=SeqID_56320
MAHPPRLPYDPWVRWDIVCLLRVKKQKEQKEVETKQFQSDDAQRREKNLSDPRRDVFLSLN

SEQ ID NO: 173099 - protein, 59 aa, Glycine max
  Coding DNA Sequence Number=SeqID_56321
MVGCDPKGTFSVGAKLSRSRIFFGFLSDSPYEVASLFVDDSPPSMGIMVFVPYGVQWYA

SEQ ID NO: 173100 - protein, 116 aa, Glycine max
  Coding DNA Sequence Number=SeqID_56322
  Gene Ontology: Mol. function=RNA-directed DNA polymerase activity; Cellular component=chromatin; Biological process=RNA-dependent DNA replication
MALYKALYERRCRTPLCWLEPRENLTLGSEVVQQTTEKVKLIQERMRIAQSRRKNNQDKRRKDLKFENIHDPSHVVELDDVQVKENLTYKPLPLRIEDRQTKHLIGKEISLVKVIW

SEQ ID NO: 173101 - protein, 169 aa, Glycine max
  Coding DNA Sequence Number=SeqID_56323
MAALRGVALPTQGVGTLPRQEQRVPREAKLPLVVLRVVEIIYSKANSEEELLHAPFTSQILHIVKVPLSPFIEFLKLTTCTLLRERDSGHNPSIGVESLYPCSAGLSLPSMLHSFPPIAALMVYDHRAESGASLGMLSSSSLYGGYGSFLMGDNGYGSMSSYATKLYGG

SEQ ID NO: 173102 - protein, 82 aa, Glycine max; identical to SEQ ID NO: 148288
  Coding DNA Sequence Number=SeqID_56324

SEQ ID NO: 173103 - protein, 117 aa, Glycine max
  Coding DNA Sequence Number=SeqID_56325
  Gene Ontology: Mol. function=aminoacyl-tRNA ligase activity; Cellular component=mitochondrion; Biological process=cysteinyl-tRNA aminoacylation
  Homolog annotation: Hit_ID=O82267; Match level="QueryCoverage=93%, HitCoverage=22%, E-value=2e-31, Identity=56%"; Hit description =Putative cysteinyl-tRNA synthetase
  Pfam annotation: Domain name=tRNA-synt_1e; Domain location=1-117; Score=-168.6; E_value=3.5e-05; Accession=PF01406.10; Description =tRNA synthetases class I (C)
MDDLQCETPSKESRVSENLNKIKDRITQIINNGYAYEVDGNVFYVDDKCPNYGMLSRQRLAHNTAGEKVVVGSRKCHPTDFALWKAAKLGEPSKDNPWDLGGPGWHMECSLEGLVSP

SEQ ID NO: 173104 - protein, 98 aa, Glycine max
  Coding DNA Sequence Number=SeqID_56326
MVSEVFCFRVSCFILKLFMVLHGGVDSATSPRFAALSPDSRGCVASPTSDDLVADVVLWMNWREAVAVLVYATALWYFFERVGYNFLSFVTKVFANKL

SEQ ID NO: 173105 - protein, 76 aa, Glycine max
  Coding DNA Sequence Number=SeqID_56327
MLLNNNGSSPISYARLISTLTCYAFPSRRSFLEDEMADKVIEFGDHEGLGSSEDELSCSEFGNGVLETVQARFGMC

SEQ ID NO: 173106 - protein, 147 aa, Glycine max
  Coding DNA Sequence Number=SeqID_56328
  Gene Ontology: Biological process=heat acclimation
  Homolog annotation: Hit_ID=Q9FNK5; Match level="QueryCoverage=55%, HitCoverage=20%, E-value=5e-12, Identity=48%"; Hit description =Arabidopsis thaliana genomic DNA, chromosome 5, P1 clone:MCL19
MAPIAASPSAPPAAPSSCGVEGDYGPNDVQFEVAIGVEGVSDASIVTARELDPEETNLVEVLEDLGWGVVGDAAVKVFVGTDGEGGGGRRGCGSGSGDGGRGVFGTEELAEGLNGFHDSAKDEAEEVLERVVVGGGRGGGTIAVRDH

SEQ ID NO: 173107 - protein, 42 aa, Glycine max
  Coding DNA Sequence Number=SeqID_56329
MTADSGRRLEQLLGKMHKLLEDNFLVLALRTRLLLHLGVLIA

SEQ ID NO: 173108 - protein, 428 aa, Glycine max
  Coding DNA Sequence Number=SeqID_56330
  Homolog annotation: Hit_ID=Q6AVI7; Match level="QueryCoverage=51%, HitCoverage=46%, E-value=3e-48, Identity=47%"; Hit description =Putative glycine rich protein
MESVPTIVYYDGDMISSSERILFEYPSGSQVIRISENISLDALRKTIMDAIQGSPKASLNVNKEQEEVLRSKPSILALIDELDKLRQPLATALSEELQINDTSSQNPHHETEIENETLAESSGSIEPNSNSRNDVVVEDLLNFLYFGSLFDVKSDFVSTMLTRTHERGCCLTYDYVIDDATDLLGEKDLDSISALRGLLVSRPADSSFSHKSVLHCCVEHAKLWLAKSEQPIRPDADVTYAALREKLNNIMSSEYFTTTPEMKAPVEVAVAAAGGNYVSFHVPVHGFVVPVEVEQPVFQSQEKVISVYGCTECCWEESLPDDVVANFIINLLFAGNETTTKTMLFAVYFLTQCPIAMKQLLDEHDCFVVPFLSAVHLDENVYIGALYINPWRWMEPENEEKRNWRTSPFYAPFGGGARFCPGAELARL

SEQ ID NO: 173109 - protein, 251 aa, Glycine max
  Coding DNA Sequence Number=SeqID_56331
  Homolog annotation: Hit_ID=O04892; Match level="QueryCoverage=38%, HitCoverage=23%, E-value=8e-28, Identity=58%"; Hit description =Cytochrome P450 like_TBP
IAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGVDPKGTGEARLIALCARTPKGNRPAHPGNGSAGGRVQRLEEHRTSRASGRWNNVGKGSRQNGSVTSGKGLALRAGHGGPSPEPVGCRWTARAASAARAGRRVPVGGRIGNGPFGASSPGVEQSTQNCALNVKVKKFNQARVNGGSNYDSLK

SEQ ID NO: 173110 - protein, 433 aa, Glycine max
  Coding DNA Sequence Number=SeqID_56332
  Gene Ontology: Mol. function=hydrolase activity
  Homolog annotation: Hit_ID=Q1S6W0; Match level="QueryCoverage=46%, HitCoverage=58%, E-value=6e-68, Identity=57%"; Hit description =Nucleoside phosphatase GDA1/CD39
SDEGVYAWVVANYALDTLGGDPLETTGIIELGGASAQNAAQDSLKEALVLGEFNLASQSLQKGLRIDPCTPTGYSYNVESWKFPPSSESEKNQYQSTVQARGNFSECRSVALTLLQKGKGMHWRMEIIVMCCNPIISRIADMQHAQAYLSKLMNAGKEFCGKDWLRLKKKYVSHDEEDLLRYCFSSAYIVALLHDSLGIALDDERESDGGTAFFLLKLDLKIYLFSVHGLQCMWVRAVGKAQSPNSIGYWHLTPLNHQANAVVTATISHFSISLVEDINKGLIGLSKVGSYFGVGSLEICKSLGCLTAERDDALLVKWRVKVANQVGSIPLDWALGAFILQTAADADIKNHNWIATIFSDESHTLLSIIGIFIVLLTAWSISRWRKPQLKTIYDLEKGRYIITRVGHASGGAQIVNHWILDAVYGVTLAEELV

SEQ ID NO: 173111 - protein, 83 aa, Glycine max
  Coding DNA Sequence Number=SeqID_56333
  Subcellular localization annotation: CTP_CleavageSite=39; ConfidenceScore=5.29e-01
MTYLMHLINNMIFAISSRLAFMLPIASTSTTWMLAISTMASNYSSILVQPSLLSELSWVFVHLPIVSYLELEDYVMRDVITTR

SEQ ID NO: 173112 - protein, 117 aa, Glycine max
  Coding DNA Sequence Number=SeqID_56334
  Gene Ontology: Mol. function=chlorophyll binding; Cellular component =integral to membrane; Biological process=photosynthetic electron transport
  Homolog annotation: Hit_ID=P56777; Match level="QueryCoverage=86%, HitCoverage=30%, E-value=5e-33, Identity=50%"; Hit description =Photosystem II P680 chlorophyll A apoprotein
MALYELAVFDPSDPVLDPMWRQGMFVIPFMTRLGITNSWGGWNITGGTITNPGIWSYEGVACFGFGAFHVTGLYGPGIWVSDPYGLTGRIQSVNPAWGVEAFCRCWNYVVWFSNNPY

SEQ ID NO: 173113 - protein, 115 aa, Glycine max
  Coding DNA Sequence Number=SeqID_56335
MGGGAWPFLVGGAICLEFPSKRESSARVDYVPAPLYTPAPSLLPIEWSGEVFGLRRREPAEGSLSMPHNQIDPRTCLFIYRREGGDDHGAPCARPPRPRDKHKPRRFVRQGTQIC

SEQ ID NO: 173114 - protein, 60 aa, Glycine max
  Coding DNA Sequence Number=SeqID_56336
  Gene Ontology: Mol. function=structural constituent of ribosome; Cellular component=ribonucleoprotein complex; Biological process =translation
  Homolog annotation: Hit_ID=Q42351; Match level="QueryCoverage=86%, HitCoverage=44%, E-value=6e-23, Identity=94%"; Hit description=60S ribosomal protein L34-1
  Pfam annotation: Domain name=Ribosomal_L34e; Domain location=5-59; Score=41.9; E_value=2.2e-09; Accession=PF01199.8; Description =Ribosomal protein L34e
  Subcellular localization annotation: CTP_CleavageSite=38; ConfidenceScore=5.03e-01
MVQRLTYRKRHSYATKSNQHRVVKTPGGKLVYQTTKKRASGPKCPVTGKRIQGCSAVHFF

SEQ ID NO: 173115 - protein, 514 aa, Glycine max
  Coding DNA Sequence Number=SeqID_56337
  Gene Ontology: Mol. function=RNA-directed DNA polymerase activity; Cellular component=chromatin; Biological process=chromatin assembly or disassembly
MVDATRNHVLKCEIEDRMENHLSSKIDERFMEMAASMQQTLHDSLTQSLALSMLQQMQDLLHNNSNDANHSPTEGNPIRGLLNLTVVVYDTKLNMSIVRGFQWTIQQTKFTSDMLLIPLGCCDLVLGVKWLMEFYVKGRRHVLRGAFTGLKTVKKQQLGKAMLTGVHLSILQVCDGQRGLLNSLTTQAVDKEVSHVVVKLLDEFSDLFQEPSGLPPSRPGVGPISKRPYRYAKQQKYEIDKLVQEYLSTSIIQNSSSPFASLVVLVGKKDGSWRLCVDYTILNKHTVKNKFPIPLVDDLLDELVGSSIFSKIDLRSGYNQVRMDPADVYKTAFKTHAGHFEYLVMPFGLTNAPAIFQGLMNLVFKKFLRKFLLVFFDDILVYNCSLEDHLLHLHKVLVTIRANSLFAKRNKCYFGVSKIEYLGHFISKEGVSTDPAKVHAIDQWPLPQNLKQLRGFLGLTGYYRRFVKGYGGIAKPLTNMLQKDNFIWTDVAKLAFQQLKKKLIEAPVLALPDF

SEQ ID NO: 173116 - protein, 95 aa, Glycine max
  Coding DNA Sequence Number=SeqID_56338
  Homolog annotation: Hit_ID=Q42351; Match level="QueryCoverage=43%, HitCoverage=35%, E-value=4e-15, Identity=95%"; Hit description=60S ribosomal protein L34-1
  Pfam annotation: Domain name=Ribosomal_L34e; Domain location=1-78; Score=61.2; E_value=3.3e-15; Accession=PF01199.8; Description =Ribosomal protein L34e
MGMCLKHHLAKLITEPLRKCERAESSTLIPHLRPAEYKRSRLPRNRRTVNRAYGGVLSGSAVRERIIRAFLVEEQKIVKKVLKIQKAKEKQASKA

SEQ ID NO: 173117 - protein, 164 aa, Glycine max
  Coding DNA Sequence Number=SeqID_56339
  Gene Ontology: Biological process=heat acclimation
  Homolog annotation: Hit_ID=Q9FNK5; Match level="QueryCoverage=92%, HitCoverage=54%, E-value=1e-17, Identity=52%"; Hit description =Arabidopsis thaliana genomic DNA, chromosome 5, P1 clone:MCL19
MSGGGSVEGAYGPNNAQFEVPVGVEGVSDALIVAARELDPEEENLVEVLEDLGWGVVGDAVVKVFVGIDGEGGGGGRECGSGSGDRGRKAFGTQELVEGLNGFHDSVEDEAEEVLERASVGGGRRGGTVVVRDQVVDADNDIFDLRDEGVEAALALSRMREHKE

SEQ ID NO: 173118 - protein, 175 aa, Glycine max
  Coding DNA Sequence Number=SeqID_56340
MTLMCLERHFRDVFVRHVYLMETLTKDWRRKGIVAKLNESDFKQQLNLFLQFNFLAVGVASMKIFSISEKECAEFWWFCVLVKAQGSGNRAQLAKPVYPENNVGSTDGHCVEAKVGSIGLVKAKGISLEGMWVIRHQKRVRVFNIILDYEEMEMGLTTVVVLLGAQVGKENSVVE

SEQ ID NO: 173119 - protein, 211 aa, Glycine max
  Coding DNA Sequence Number=SeqID_56341
  Gene Ontology: Mol. function=glutathione transferase activity; Cellular component=cytoplasm; Biological process=auxin mediated signaling pathway
  Homolog annotation: Hit_ID=Q9FQF1; Match level="QueryCoverage=98%, HitCoverage=100%, E-value=1e-90, Identity=74%"; Hit description =Glutathione S-transferase GST 7
  Pfam annotation: Domain name=DUF1694; Domain location=1-113; Score= -52.3; E_value=0.04; Accession=PF07997.2; Description=Protein of unknown function (DUF1694)
  Pfam annotation: Domain name=GST_C; Domain location=69-181; Score =47.6; E_value=4.2e-11; Accession=PF00043.15; Description=Glutathione S-transferase, C-terminal domain
  Pfam annotation: Domain name=GST_N; Domain location=6-79; Score=79.3; E_value=1.2e-20; Accession=PF02798.10; Description=Glutathione S -transferase, N-terminal domain
  Pfam module annotation: Pfam domain module=DUF1694::GST_C::GST_N; Domain location=1-113::69-181::6-79
MANNQEEVILLGAVGSPYVCRVKIALKLKEVQYKFLEENLANKSELLLKSNPVHKKVPVFIHNEKPIAESLVIVEYIDETWKNNPILPSDPYQRSLASVFTADEKEREKNVDQSFEALQFLENELKDKKFFREEEFGLVDISGIFVAFWIPIVQEVVGLKLLNSEKFPKLNKWCEEFTNHPVVKEVLPPRDTLFAFFKTIFERLRISKIGS

SEQ ID NO: 173120 - protein, 267 aa, Glycine max
  Coding DNA Sequence Number=SeqID_56342
  Gene Ontology: Mol. function=chromatin binding; Cellular component =chromatin; Biological process=chromatin assembly or disassembly
  Pfam annotation: Domain name=Chromo; Domain location=204-255; Score =14.7; E_value=0.018; Accession=PF00385.14; Description='chromo' (CHRromatin Organisation MOdifier
  Pfam annotation: Domain name=rve; Domain location=1-123; Score=-11.6; E_value=0.055; Accession=PF00665.16; Description=Integrase core domain
  Pfam module annotation: Pfam domain module=Chromo::rve; Domain location=204-255::1-123
MDFIMGLPQSHGFTTILVVVDRFSKGAHFGALPPHHSAYKVATLFMDIFCKLHGFPRSIISDREPIFISLFWRELFRLSGTELRFSTVAITIRRYIQQTSPVPSIIIARLFSDGSHDFYDLVYVCPLPYRQTYVCPYYTKISKRFYGPFPITDKVGPVAYHFELPMDSKIHHVFHISLLKAHKGPSPTQTATLPPIQTENHPVVEPLSFLDWKWDHLTTTPSCMVLVQWNGLTPEDASWEEWTTLHNAYDLEDDVEFPREGFVSNSN

SEQ ID NO: 173121 - protein, 225 aa, Glycine max
  Coding DNA Sequence Number=SeqID_56343
  Gene Ontology: Mol. function=glutathione transferase activity; Cellular component=cytoplasm; Biological process=auxin mediated signaling pathway
  Homolog annotation: Hit_ID=P32110; Match level="QueryCoverage=99%, HitCoverage=100%, E-value=1e-116, Identity=91%"; Hit description =Probable glutathione S-transferase
  Pfam annotation: Domain name=GST_C; Domain location=99-198; Score =88.2; E_value=2.4e-23; Accession=PF00043.15; Description=Glutathione S-transferase, C-terminal domain
  Pfam annotation: Domain name=GST_N; Domain location=6-79; Score=81.3; E_value=2.9e-21; Accession=PF02798.10; Description=Glutathione S -transferase, N-terminal domain
  Pfam module annotation: Pfam domain module=GST_C::GST_N; Domain location=99-198::6-79
MASSHEEVTLLGAIASAFACRVKIALKLKGVKYKYVEENLRNKSELLLKSNPVHKKIPVFVHNEKPIAESLVIVEYIDETWKNNPILPSDPYQRSLARFWSKFIDDKIVGAVSKSVFTVDEKEREKNVEETYEALQFLENELKDKKFFGGEEFGLVDIAAVFIAFWIPIFQEIAGLQLFTSEKFPILYKWSQEFLNHPFVHEVLPPRDPLFAYFKARYESLSASK

SEQ ID NO: 173122 - protein, 408 aa, Glycine max
  Coding DNA Sequence Number=SeqID_56344
  Gene Ontology: Mol. function=oxidoreductase activity, acting on the CH-OH group of donors, NAD or NADP as acceptor; Cellular component =cytoplasm; Biological process=leucine biosynthetic process
  Homolog annotation: Hit_ID=Q3DXF0; Match level="QueryCoverage=81%, HitCoverage=99%, E-value=2e-87, Identity=55%"; Hit description=3 -isopropylmalate dehydrogenase
  Subcellular localization annotation: CTP_CleavageSite=81; ConfidenceScore=5.54e-01
MARLYRRCPMGQRSLASTASVAAAVLTAWPLAARSAVNTPSSSTACTAASTAAASASRPSEWRSSIAALKIVAYGLAMPLPAMSGAEPWMGSEADGSRPSEPASIEASSVRMSPNMFSVTITSYSRGLASRCMAIESTSWCSRATSGNSSRPMRAATSRHRREVSSTLALSTEAEGTAQHAFDLGHGVAAQVAGAVGVAGLVAEVDATGQFAHHHEVHALQQLGLDGRGVQRGFMGAHRAQVGIQAQRLADCQQALFRADLGIRVGPLRAAHGAQQHGVGGLAGSQRRRRQRFAVAVDGNATDIVLAEGEGVIEASGDGLQDGNRGGGHFRADAITRQDNNFSVHAHSRNVRFQGHGPTDTPTGRHLPAGRSARSRPAGRNRRGPRGCAVRARPHRWSARRPGAASAP

SEQ ID NO: 173123 - protein, 715 aa, Glycine max
  Coding DNA Sequence Number=SeqID_56345
  Gene Ontology: Mol. function=guanyl-nucleotide exchange factor activity
  Homolog annotation: Hit_ID=Q93ZY2; Match level="QueryCoverage=60%, HitCoverage=77%, E-value=1e-134, Identity=57%"; Hit description=Rop guanine nucleotide exchange factor 1
  Pfam annotation: Domain name=DUF315; Domain location=118-585; Score =776.0; E_value=2.3e-230; Accession=PF03759.4; Description=Domain of unknown function (DUF315)
  Subcellular localization annotation: CTP_CleavageSite=29; ConfidenceScore=5.25e-01
MDSTFTQQEVREQTQQHQHQKKHCGPLVRLSRRSTNPNPFSILVFWVSKSLRSLCFRVQLSQQGFCLRRIQYHHGMVINTPVLHASSSSSEEEEEGKASHAAMEGLSLAEKSTEAVEESNKGIENGSKRETFADLIEEKGRESSFSSEFLSSETTHGEHSRSSTEDSSSSPSVGWPVQEIAASDCASPHGSEDGEKKHLVLENKEFEKRVSALPEVEMMKERFAKLLLGEDMSGCGNGVTTALAISNAITNLCATLFGQLWRLEPLRSEKKAMWRREIEWFLSVSDHIVELTPNWQTFPDGSKLEVMTCRPRSDLYVNLPALRKLDNMLLEILDSFVNTEFWYIDQGVLAPDADGPSSFRQALQRQEEKWWLPVPRVPPCGLNENSRKQLQHKRDSTNQILKAAMAINSITLAEMDIPESYLESLPKNARVSLGDVIYRYITSDHFSPECLLACLDLSSEHQAIEIANRAEASMYIWRKRTNSKPASISARSSSRTSWEMVKDLMVDADKRDLFAERAESLLLSLKQRFPGLPQTALDMSKIQYNKDIGKAILESYSRVLESLAFNMVARIDDVLYVDDLTKNLDKISSLSKVGVVTHKSISVPHSVPIPGTPYKSAFGTPTLSPAHGISSPAKLGKSPLINDSSLPQRGSGIKKSLTDFLSIDPKGKESGSSIEKQVPESNTLDEVTTCETDVESSDCTEGGASPSILDRKWHV

SEQ ID NO: 173124 - protein, 226 aa, Glycine max
  Coding DNA Sequence Number=SeqID_56346
  Gene Ontology: Mol. function=glutathione transferase activity; Cellular component=cytoplasm; Biological process=auxin mediated signaling pathway
  Homolog annotation: Hit_ID=Q9FQF0; Match level="QueryCoverage=97%, HitCoverage=98%, E-value=1e-100, Identity=79%"; Hit description =Glutathione S-transferase GST 8
  Pfam annotation: Domain name=GST_C; Domain location=99-198; Score =79.1; E_value=1.4e-20; Accession=PF00043.15; Description=Glutathione S-transferase, C-terminal domain
  Pfam annotation: Domain name=GST_N; Domain location=6-79; Score=76.5; E_value=8.7e-20; Accession=PF02798.10; Description=Glutathione S -transferase, N-terminal domain
  Pfam module annotation: Pfam domain module=GST_C::GST_N; Domain location=99-198::6-79
MATNQEEVSLLGVVGSPFVCRVQIALKLKGIQYKFFEENLVNKSELLLKYNPVHKKVPVFVHNEKPIAESLVIVEYIDETWKNNPILPSDPYQRALARFWSKFIDDKIGGAVWKSVFTVDEKEREKNVEESLEALQFLESEIKGKKFFGGEEFGMVDIAAIFIAFWVPMVQEIAGLELFTSEKFPKLYNWSQEFMSHPVVKEVLPPRDPLFAFFKARYESLLADSK

SEQ ID NO: 173125 - protein, 100 aa, Glycine max
  Coding DNA Sequence Number=SeqID_56347
  Gene Ontology: Mol. function=transcription factor activity; Biological process=regulation of transcription, DNA-dependent
  Homolog annotation: Hit_ID=Q3SV09; Match level="QueryCoverage=99%, HitCoverage=32%, E-value=5e-23, Identity=56%"; Hit description =Trancriptional regulatory protein, LysR family
  Pfam annotation: Domain name=HTH_1; Domain location=4-63; Score=39.8; E_value=9.7e-09; Accession=PF00126.17; Description=Bacterial regulatory helix-turn-helix protein, lysR family
MQDLNDLQLFALVVRHGGFAAAERASGEAKSKLSKRVARLEASYGARLIERSTRSFRVTDIGRDVYRQCEAIIERLEATDAIVARARDEVSGCLRISSPP

SEQ ID NO: 173126 - protein, 137 aa, Glycine max
  Coding DNA Sequence Number=SeqID_56348
  Pfam annotation: Domain name=DUF1471; Domain location=1-81; Score =27.9; E_value=2.9e-06; Accession=PF07338.3; Description=Protein of unknown function (DUF1471)
MLLGAFVFSGATVAATQINSQQADALTPRQVITVSGAANLSDAEKMLADKTAKAGARYYKIIAIRGRGVDFTLRHAIALIRVIISAHADDKVTVQAAAGGDGAALPLWRAGPALALVSTLGVGRASRVICWTGTFSE

SEQ ID NO: 173127 - protein, 52 aa, Glycine max; identical to SEQ ID NO: 125481
  Coding DNA Sequence Number=SeqID_56349

SEQ ID NO: 173128 - protein, 85 aa, Glycine max
  Coding DNA Sequence Number=SeqID_56350
MVIFSHGVATEDKEEEVRGAMGGFLGKLEEESFLEKLEGATYTPPIAKLTPMPKYMKIQWVASLRSKEESFLEKLEGCYSHPSNS

SEQ ID NO: 173129 - protein, 127 aa, Glycine max
  Coding DNA Sequence Number=SeqID_56351
MVVGETEGPPKCLAWVYHQLLALQWYIRGKARSWLDCGGEFHVPPPWVERHFNEYGSGVIEILIGNVCHIGWCIVGRPAIWWEGMLVLNLRIMGGRPYFPNLCLLSYPNFVRGPFLDDMRPFFGPCE

SEQ ID NO: 173130 - protein, 143 aa, Glycine max
  Coding DNA Sequence Number=SeqID_56352
  Gene Ontology: Mol. function=RNA-directed DNA polymerase activity; Biological process=RNA-dependent DNA replication
  Homolog annotation: Hit_ID=Q1RTD3; Match level="QueryCoverage=91%, HitCoverage=19%, E-value=1e-10, Identity=31%"; Hit description=IMP dehydrogenase/GMP reductase
MESLNDKMEDESEFFVYSKRWQGIQEVINLVKVYASCNLVNKRGIWEKLVSLKRSMGESLWCVVGNFNVVRRREEEVKRSEKGSQQGGRKMEELNSFINKMELIDTPLVGMKFTWVRAGGNAMSRIDRILVSMEWLQFWPNAI

SEQ ID NO: 173131 - protein, 73 aa, Glycine max
  Coding DNA Sequence Number=SeqID_56353
MVMEDTMDEILVSIGAIHVAKNVECYWGNSAKAKYVEWMGMDLNEENKYVVREVYDSLIMEGNVEDAEFYQQI

SEQ ID NO: 173132 - protein, 164 aa, Glycine max
  Coding DNA Sequence Number=SeqID_56354
  Gene Ontology: Mol. function=RNA-directed DNA polymerase activity; Biological process=RNA-dependent DNA replication
MEVSLTQKDLRQGNPLALFLFLVVAEGLSGLIRNNLVGTHVDQRKVLSFAKILNCTTMTIPFIYLGLPVEADAMKVSTWQPMIDKMKRKLTPWRMRHLSFRGRISLVKFVLSLYYISFFKVTKKVLDILNQIQRNFLWGAKGEENKVAWVRWEVVGSSVKNDGL

SEQ ID NO: 173133 - protein, 135 aa, Glycine max
  Coding DNA Sequence Number=SeqID_56355
  Homolog annotation: Hit_ID=Q86AI8; Match level="QueryCoverage=90%, HitCoverage=24%, E-value=2e-07, Identity=37%"; Hit description =Similar to Homo sapiens (Human). Mucin 2
MTGPLDESISCFLIRVDPWGYTPSPWVLVTLTVRGLHVLALRGLHVLTIRGLHALTSRGLHVLALRGLHALTLGTSYPHRQRTTRPRLERTTRPHHQRAARPYLQRTISPRLERATRPHLGYYLPSPSEDYTSSP

SEQ ID NO: 173134 - protein, 101 aa, Glycine max
  Coding DNA Sequence Number=SeqID_56356
  Subcellular localization annotation: CTP_CleavageSite=65; ConfidenceScore=5.30e-01
MDPKHLNYCTPTKSPSILSSSPSLTNNIGVGGSDFSSPKVEPMILLTNYSTGTKPKRQKNAHSVRLMHQDVCPNKIVHCWKLVLRQPDGSLLVKLLWRLDL

SEQ ID NO: 173135 - protein, 193 aa, Glycine max
  Coding DNA Sequence Number=SeqID_56357
MEGLVDLAAIHAFLAFHHGKESPVDAILAMYDTFDRGGEKSGARIVCCALALYVWLVSHLFLQEGRKNRDSIFIRRMSKGSLDGTRGCINYNPVLAIRQLGYLMRGVPSDESITPFIARGFSDHNVRDRELRGSSNGSIGGYHKWLRVRTQGLDWLPNLKTVRDDEVKASEESDEVQALKAELERARVVEEKF

SEQ ID NO: 173136 - protein, 127 aa, Glycine max
  Coding DNA Sequence Number=SeqID_56358
METTKSTQQALQSVEIQVGELAEAVTQFMSRREKSFVEAEAQEKSPVKEHESREKDKEKNEEQAQQQWEKYSTVENQQENILQINDLPHQMIVKKGRQGEHEEIFMEFLAKRRNFKEDVFFVTFTPP

SEQ ID NO: 173137 - protein, 312 aa, Glycine max
  Coding DNA Sequence Number=SeqID_56359
  Subcellular localization annotation: CTP_CleavageSite=71; ConfidenceScore=5.42e-01
MNSYRETLMPPKAKNSSGGGGRSSKGTILALPEPNTKKASSTFSGSSTQKSKLEESSTQDSPKPITTKQIVANYVWSIQTLQALKEMGLTKVLRLAKKTWAEMASKSDDDSEIELQKQIQIAKKTKTVNNPEGKQTMMESEYWDKNPFKATAKAFLQGFHYKPTSLNKTRKFYEFILVDTNSVSIKHFKDSKDPNPNTHSTIQILKIWEDRKHQAIFTPVKTRFCQMMDSIRHIKSNSRPSQNLSQLVAFLASSKSKESLAKNLKEVLHLLQQEEESITKKEVESPEENDDQDDNPFYQNEDYCFGISLEDD

SEQ ID NO: 173138 - protein, 50 aa, Glycine max
  Coding DNA Sequence Number=SeqID_56360
MDNDDDIFQGLDRAASLLNGCWFFTGIFHNKYGAYEILGVRVIGSERSWI

SEQ ID NO: 173139 - protein, 183 aa, Glycine max
  Coding DNA Sequence Number=SeqID_56361
  Subcellular localization annotation: CTP_CleavageSite=55; ConfidenceScore=5.23e-01
MEGRKKMGSSSFTSELFGSNQFQKSAASGIFESMFPPPSKVLGRESLRSEVCEKTANERWSSKIGIPDYISKGSDGETQSTTHKDMSSIYQEQRLQPCQLSSSIHYGGQDICSCPKSTQDSGYNSLLYKKDGVEDDLGSNLWQGKTGSLLLRSHLPKDMLLKVYEFLIALAKWYSIPVNRRIV

SEQ ID NO: 173140 - protein, 219 aa, Glycine max
  Coding DNA Sequence Number=SeqID_56362
  Pfam annotation: Domain name=Tryp_alpha_amyl; Domain location=30-112; Score=36.1; E_value=1.2e-07; Accession=PF00234.12; Description =Protease inhibitorseed storageLTP f
MEGCVKKLLCLVGFVVLVSTIGGVESAGECGKSTTPDNEAYKLAPCASAAQDENASVSQSCCAQVKKIGQNPSCLCAVLLSNTAKMAGVNPQVAVTIPKRCNLANRPVGYKCGPVRGNFLASMEYKDATMTKVKNLSRWHKLKEPTLAETVTATEGKKEEEGRGDREGGHGGGRRKKQRMRIEGGGGEEKRRRKVRRGEGEEKEKGSVGWEKEVYFGVG

SEQ ID NO: 173141 - protein, 152 aa, Glycine max
  Coding DNA Sequence Number=SeqID_56363
PAGAERPVVHVDSATGKADGPHRKKLRTYLGIVARDKVDVMYENWKKAEFEIPEALDNRTKKNLTRKWALAADQDGVDDTVCEKYDISKEKWAQFCQTRRDPSWEDVWKKAQAIQKQNTAPHAEKMKKKLEEAVQSGSVDGMIDPSSPVRRH

SEQ ID NO: 173142 - protein, 86 aa, Glycine max
  Coding DNA Sequence Number=SeqID_56364
  Gene Ontology: Mol. function=glutathione transferase activity
  Homolog annotation: Hit_ID=Q9FQF1; Match level="QueryCoverage=81%, HitCoverage=32%, E-value=5e-21, Identity=68%"; Hit description =Glutathione S-transferase GST 7
MAASHEEVTLLGFRGSAFISRVVFPAWNVVFKVDEKECEKNVEETFEALQFHENELKDKKFFGGEEFGLVDIVVVYIAFWVPIVKK

SEQ ID NO: 173143 - protein, 222 aa, Glycine max
  Coding DNA Sequence Number=SeqID_56365
  Gene Ontology: Mol. function=glutathione transferase activity; Cellular component=cytoplasm; Biological process=auxin mediated signaling pathway
  Homolog annotation: Hit_ID=Q9FQF0; Match level="QueryCoverage=99%, HitCoverage=92%, E-value=6e-86, Identity=72%"; Hit description =Glutathione S-transferase GST 8
  Pfam annotation: Domain name=GST_C; Domain location=117-211; Score =58.4; E_value=2.4e-14; Accession=PF00043.15; Description=Glutathione S-transferase, C-terminal domain
  Pfam annotation: Domain name=GST_N; Domain location=6-79; Score=80.8; E_value=4.3e-21; Accession=PF02798.10; Description=Glutathione S -transferase, N-terminal domain
  Pfam module annotation: Pfam domain module=GST_C::GST_N; Domain location=117-211::6-79
MASSHEEVTLLGAIASAFACRVKIALKLKGVKYKYVEENLRNKSELLLKSNPVHKKIPVFIHNEKPIAESLVIVEYIDETWKNNPILPSDLTKEPWLVSGPNSLMTSIVCVRKNMLESMLIVDVARESVFTVDEKEREKNVTETYEGLQFLENELKDKKFFGGEEVGLVDIAGVYIAFWVPFIQEIAGLKLLTSEKFPKLYKWSQEFVNHPVVKESLPPRDP

SEQ ID NO: 173144 - protein, 152 aa, Glycine max
  Coding DNA Sequence Number=SeqID_56366
  Pfam annotation: Domain name=zf-CCHC; Domain location=80-97; Score =19.4; E_value=0.00063; Accession=PF00098.13; Description=Zinc knuckle
MELMRLNQHEENDKKNKGIELQASSSIQEESNKEDLNEIEENDDFRFFVKGFNKFLRNKGNQRRSNFNSKKKREDSSLVPKCYECDLPGHLRFDCPIFKRRMEKSDKKNFKDKKEEKAYITWEDDDMDLSSDSEIEIINLGLMAKDYESGEE

SEQ ID NO: 173145 - protein, 176 aa, Glycine max
  Coding DNA Sequence Number=SeqID_56367
DGIHYSEVQNIPIVIDQSLFFSLTKLPIQGVPFEGTLVDDWKFDYSSLDACRMVCNDQADMTGRLLVGSTTHLVQYQMHKALWANAPLPYPHLVTLFLHHFNIPLDDEPFVKVKRSFSIGASVVTSFGYWKDVDGQWVHKQNLPLSILGERTPSPPPQRADSSSVLTEFLTKLHGL

SEQ ID NO: 173146 - protein, 295 aa, Glycine max
  Coding DNA Sequence Number=SeqID_56368
  Gene Ontology: Mol. function=transferase activity, transferring glycosyl groups; Biological process=metabolic process
  Homolog annotation: Hit_ID=UPI00005F9452; Match level="QueryCoverage =100%, HitCoverage=92%, E-value=1e-104, Identity=65%"; Hit description=COG0547: Anthranilate phosphoribosyltransferase
  Pfam annotation: Domain name=Glycos_trans_3N; Domain location=2-71; Score=73.8; E_value=5.4e-19; Accession=PF02885.7; Description =Glycosyl transferase family, helical bundle domain
MDYTKIIKEIGRGKNHARDLDRQTAFELYQAMLAGEVPELELGGILIALRIKGEAEEEMLGFYQAMQQQVLPLQAPQGRPLPVVLPSYNGARKQANLTPLLALLLAKVGLPVVVHGVLDDSTRVTSAEIFRALGLPWSEQAVHAQQRLDNGEAVFMPVSTLSAPLARQLGLRWRMGVRNSAHTLAKLATPFGEQDALRLASVSHPEYVGRVASFFRQIGARGLLMHGTEGEAYANPLRCPQIHYIAGGEQRVLLERTLQDETPTLPAAKDAETTARWTERCLAGEVAIPQAIQRQ

SEQ ID NO: 173147 - protein, 157 aa, Glycine max
  Coding DNA Sequence Number=SeqID_56369
MCKSAACDYVDNLSHGSALEVLPKAKNGVWRVKLLIDPRQLEEILSKQVNTEALIEKMRMAAQLHVLLLLFLLQGAQAQLQVLRKKAFSMLAKFSLTNIGSIYHTLTRPSVSKNSVISWWTRLSILPGAEAALSLRLKQGNCPLITSASSLVALMIG

SEQ ID NO: 173148 - protein, 121 aa, Glycine max
  Coding DNA Sequence Number=SeqID_56370
  Gene Ontology: Mol. function=oxidoreductase activity; Cellular component=membrane; Biological process=electron transport
  Homolog annotation: Hit_ID=O81077; Match level="QueryCoverage=85%, HitCoverage=27%, E-value=8e-37, Identity=58%"; Hit description =Putative cytochrome P450
MYYQQHTDSQVVDNLIGVIFAAHDTTTSALTWVLKYLHDNTNLLEAVTVIQETLRSASILSFTFKEAVTDVELEGYTIPKGWKVLPLFRSIHHSTDFFPQSEKFDPSRFEKLRLRHITTSK

SEQ ID NO: 173149 - protein, 120 aa, Glycine max
  Coding DNA Sequence Number=SeqID_56371
MTSTNKCSMLIGELRSGSSRLIDLNDYIRNLHKKGLLDALSFCEYCLFMSELLVTAFCRPSSNNYFFTQAVAPPKVEVWALSPNFPVEKEAFLPIMPNKNGSFSFKGKYNEVTNVIANVV

SEQ ID NO: 173150 - protein, 123 aa, Glycine max
  Coding DNA Sequence Number=SeqID_56372
MEDDQGTERTGSKVDIFRTITQWNFKGSWKGNLGNIQNHTKLIEKENTGSTEAISDQGEEALMEKEKGTQGLEQSSCQYRKTGIEMCPKGDNKAVKTGCTVPEEAISDQRNETLIEKKEETRG

SEQ ID NO: 173151 - protein, 74 aa, Glycine max
  Coding DNA Sequence Number=SeqID_56373
MENQMGKFIYLRIEMKGIKMKRLALQMKLWKRQIQTLTSSREVPRRRGVEWKEKRLGYVAGLSKIEGFNGEQRR

SEQ ID NO: 173152 - protein, 254 aa, Glycine max
  Coding DNA Sequence Number=SeqID_56374
SRPKDTDIFGKGTDANISGKGACGDVIHFLLSCFDSYGYQMRLFRSVGSKDAHISGKGADADNSENGAEDADISVKGADADIFGKGTDANISGKGAGGDVIHCLLSCFDSYGYQMRLFRSVDRKTLTSLERVQPEDAEISGKRAANATFSLCRMKDAHISGKGADADNSENGAEDADISVKGADTDIFGKGTDANISGKGAGGDVIHCLLSCFDSYGYQMRLFRSVDRKTLTSLERVQSRPKDADIFGKGAGYD

SEQ ID NO: 173153 - protein, 85 aa, Glycine max
  Coding DNA Sequence Number=SeqID_56375
  Subcellular localization annotation: CTP_CleavageSite=26; ConfidenceScore=5.19e-01
MSSPRRVGFFTMKLFSGPSKPEASLVAGSDDKSPNPLHRLTTQMKNRYATNNGTTSTLESDAIQKIANHLDLSLMSEDEKLNKSF

SEQ ID NO: 173154 - protein, 136 aa, Glycine max
  Coding DNA Sequence Number=SeqID_56376
MPQTVPVNHYSDPEGQHNRIRILWCYPMLITGGTTRPVKDRSASPAEGTSRPVHTGGGPIDPTQAGITAAAGTRLALQWILVKGFRLYSFQLPESMSPVLLFIVTTSPCQDWVICAPAAFLGCGSRFSGSLSGIEP

SEQ ID NO: 173155 - protein, 125 aa, Glycine max
  Coding DNA Sequence Number=SeqID_56377
  Gene Ontology: Cellular component=proteasome regulatory particle (sensu Eukaryota); Biological process=proteolysis
  Homolog annotation: Hit_ID=Q0GEA1; Match level="QueryCoverage=98%, HitCoverage=35%, E-value=5e-37, Identity=66%"; Hit description=26S proteasome regulatory particle non-ATPase subunit 12
MDPKLKEVSQLFDRFKASFIRNDFDTCSNLLSQLKVKSIMEHITAGSWMIDLLVTHPSSMIEGMVLLTGFRSLPPLFADTPNAVHELTIARDIYEHAVVLSVKNEDQDAFERDFFQLKPYYTDAW

SEQ ID NO: 173156 - protein, 68 aa, Glycine max
  Coding DNA Sequence Number=SeqID_56378
MPWMRTPHCCAHLHPNNNAKQPMRSRTSQTLTVVHDTAKLLRQDDRSKRRLDCAVELIGEDLAVVVGI

SEQ ID NO: 173157 - protein, 218 aa, Glycine max
  Coding DNA Sequence Number=SeqID_56379
  Gene Ontology: Mol. function=potassium channel activity; Cellular component=membrane of vacuole with cell cycle-independent morphology; Biological process=potassium ion transport
  Homolog annotation: Hit_ID=Q9SVV6; Match level="QueryCoverage=88%, HitCoverage=45%, E-value=1e-34, Identity=44%"; Hit description =Probable calcium-activated outward-rectifying potassium channel 6
  Pfam annotation: Domain name=Ion_trans_2; Domain location=147-212; Score=24.3; E_value=0.00043; Accession=PF07885.6; Description=Ion channel
MEKEPLLPYFSPRKKPQLCPLPEHDEIVLPMTPSEFKDRLIFGPSPSSASPRDPSPLADALTLSHNSPKCSSSNSQDYASSPLFDSQQKQQQLNSWLLDPNYESWRKTNLHRSKTAPAMAVISDFNPHSTVQRPKFASQSIVCQGVILLALYLALGVVIYWFNRHNFTATETHPIVDALYFCIVTMCTIGYGDITPNRESYVDGSEGKGGVRRMGSLI

SEQ ID NO: 173158 - protein, 110 aa, Glycine max
  Coding DNA Sequence Number=SeqID_56380
  Gene Ontology: Biological process=induction of apoptosis
  Homolog annotation: Hit_ID=Q7XJ37; Match level="QueryCoverage=92%, HitCoverage=79%, E-value=8e-24, Identity=58%"; Hit description =Apoptosis-related protein
  Pfam annotation: Domain name=dsDNA_bind; Domain location=9-110; Score= 72.5; E_value=1.3e-18; Accession=PF01984.10; Description=Double -stranded DNA-binding domain
MADPELEAIRQRRLQELMAGHGGVGNQQNSEQEKAQDDAKREAEERRQMMLSQILSAEARERLARIALVKPEKARGVEDFILRAAQMGQITEKIGEVLVVPFICSKLEHQ

SEQ ID NO: 173159 - protein, 34 aa, Glycine max
  Coding DNA Sequence Number=SeqID_56381
MEIGVQNPLEAPYGQILAANTQVETTPAPHPKKA

SEQ ID NO: 173160 - protein, 93 aa, Glycine max
  Coding DNA Sequence Number=SeqID_56382
MENLMLCFAFLDCSSSMAFAEYTEFWTCSKSEYVIYKLKEMGKVSEKDIMQCCQFEKGVSDSQVDGNFLLLGIGRDIRLSKTQAGDFPLTLLS

SEQ ID NO: 173161 - protein, 110 aa, Glycine max
  Coding DNA Sequence Number=SeqID_56383
AVEAPPPPHQADPAGSLGMERYLQQAANHRGQVQIHECLYQLSLSQQGQSFVPFGCSTLDQFRAEVGWPRDWPEVQAGEAPAEAPGDAEEARMDEEMTDLLGFLGGSGAT

SEQ ID NO: 173162 - protein, 78 aa, Glycine max
  Coding DNA Sequence Number=SeqID_56384
MESCWFGEFSNVTMLLCYLCFWTEEEGGGYGGGGWGLPVPEVLPKSPLEDGGTEKKTCFDEAGSMILLHMRLYKSNDS

SEQ ID NO: 173163 - protein, 358 aa, Glycine max
  Coding DNA Sequence Number=SeqID_56385
  Homolog annotation: Hit_ID=Q8VWJ2; Match level="QueryCoverage=27%, HitCoverage=30%, E-value=6e-41, Identity=83%"; Hit description =Probable WRKY transcription factor 28
  Pfam annotation: Domain name=WRKY; Domain location=185-244; Score =149.7; E_value=7.7e-42; Accession=PF03106.6; Description=WRKY DNA -binding domain
MSVEPKELYYQDLVLDPNINNQHQGTEAGSNNTMYEKHFSSTIIPSDSTAYDSSQAFDPSYMSLTECLQGGMDYNSLATSFGLSPSSSEVFSSVDGNQKPAVEGGDGGGGGGGSETLATLNSSVSSSSSEAGAEEDSGKSKKERQVKTEEGEENSKKGNKEKKKGEKKQKEPRFAFMTKSEVDHLEDGYRWRKYGQKAVKNSPYPRSYYRCTTQKCTVKKRVERSFQDPTTVITTYEGQHNHPVPTSLRGNAAAGMFTPSSLLATPTPLAAGSNFPQDLFLHMHHPHHQYHIHNNLFTTQSTTNTTTATTTTPSSFYSSYNNINNSLLHNQFLPPEYGLLQDIVPSMFHNKTGHHHQN

SEQ ID NO: 173164 - protein, 43 aa, Glycine max
  Coding DNA Sequence Number=SeqID_56386
MPADVGQEKMTDRGLKKKHDRMTPIEHFQIDIVQRKLLLFGIA

SEQ ID NO: 173165 - protein, 119 aa, Glycine max
  Coding DNA Sequence Number=SeqID_56387
MSTSSSTASTRIRYPIVRPPAIMQFRVAFHNNQRYLHFIINNGHPITHTKFGSNTMEQPTQYGSNNTEEDIFLQMDSQRKNAPPLQWDVVTPDRGIKDKSIVWPWYKFLKENDFHHGDE

SEQ ID NO: 173166 - protein, 89 aa, Glycine max
  Coding DNA Sequence Number=SeqID_56388
MKSKLMVVELASCMRGKTPAGDLAPMDLEIEVTCRRNNAEKRKRALQERIVSPSSERTLSSESSSSFPTNLRKFEVGESEANIMADNQP

SEQ ID NO: 173167 - protein, 137 aa, Glycine max
  Coding DNA Sequence Number=SeqID_56389
  Gene Ontology: Mol. function=RNA-directed DNA polymerase activity; Biological process=RNA-dependent DNA replication
  Homolog annotation: Hit_ID=Q1T5Q8; Match level="QueryCoverage=65%, HitCoverage=16%, E-value=8e-09, Identity=42%"; Hit description=RNA -directed DNA polymerase
MAGLLNGVVDYLSGRMYCWKTLRLIFKVLLYNKRTQIHGSGNKLTKRGVIFQNIDYSCAFYRATIGDSNHLFLSCAFTKIIWKIVFRWLGIDFVESLTGYECYLSNGFSTKMALSQGLYFFVVHEPVDVLLRRKRPF

SEQ ID NO: 173168 - protein, 85 aa, Glycine max
  Coding DNA Sequence Number=SeqID_56390
MAQVAWPGVPPFFLGAGEALVAQEPYIQVPEDPEDTLVEAAADDTPEAKAEAEETLVDTPMEAAEEGGTTEAGIDEDYVVYVTAA

SEQ ID NO: 173169 - protein, 113 aa, Glycine max
  Coding DNA Sequence Number=SeqID_56391
MASKKRRASSSRPHEPYDTSRFVSEVAWERNMEIAYSHYDEFLQELERRQWHRNLTRQMENHIDLALIMQSEGEDDQIRRRNTKCLLGDLGGTRAWGEGAPWKLLRKDLTTLA

SEQ ID NO: 173170 - protein, 96 aa, Glycine max
  Coding DNA Sequence Number=SeqID_56392
MEHKAYWALKFLNFDAGLSREKRKLQLLELEEMRLNAYESSRLYKQKEVKPYGSVELMDPQSTTPERSWTVNGKRLKLYHGGNIERLTTILHLQDP

SEQ ID NO: 173171 - protein, 92 aa, Glycine max
  Coding DNA Sequence Number=SeqID_56393
MASVLYIEGPAGARVGAESGGAGAGVRAGTEAKAEASEGALALRDPGNARLVVRLRDSKVSELDTTSLAMHRAVIRAGKPNLEALDWAIWEI

SEQ ID NO: 173172 - protein, 52 aa, Glycine max
  Coding DNA Sequence Number=SeqID_56394
MKINKRGKEDNLLGIAGIERKMQVRRYALSEFCSSDWSATSAKRVMARSTDK

SEQ ID NO: 173173 - protein, 80 aa, Glycine max
  Coding DNA Sequence Number=SeqID_56395
MKNGNEKGCGPHLVLVTDTNEYNVVSIQEEAEIVRGIKRRKFQVLWRKLMQKHEEKVLKKKLKIRTARLACKTGPVHLLA

SEQ ID NO: 173174 - protein, 114 aa, Glycine max
  Coding DNA Sequence Number=SeqID_56396
  Subcellular localization annotation: CTP_CleavageSite=16; ConfidenceScore=5.33e-01
MTFSMGSFKQVSPASRASNPFCNNIRGSRQPTGGDALLEMRLHDSQESPRPIVTLVRAPLPMAHSDPGVGEMCEWSNLDDYATLLAKQPENSQTSTTGVIHPRIQYQLFLPTKQ

SEQ ID NO: 173175 - protein, 91 aa, Glycine max
  Coding DNA Sequence Number=SeqID_56397
MDEAKENIQHELNYEKRRMVQDPDALTLINIQMEDFKNQRKFFGDPMSIREVGRKPPAEWWETYGDDHPELQKTNSKLVNQMLEDIPSNGE

SEQ ID NO: 173176 - protein, 186 aa, Glycine max
  Coding DNA Sequence Number=SeqID_56398
  Gene Ontology: Mol. function=DNA binding
  Homolog annotation: Hit_ID=Q1S5N2; Match level="QueryCoverage=65%, HitCoverage=28%, E-value=4e-32, Identity=53%"; Hit description=Viral capsid/hemagglutinin protein
  Pfam annotation: Domain name=DUF659; Domain location=79-185; Score =21.7; E_value=4e-09; Accession=PF04937.6; Description=Protein of unknown function (DUF 659)
MWNIVLTLQESLMKKSTFGIDERDEEDVEVGEKRKNTEAHINIARFYYLHAIPFNVAKSKVFAKMIESIAKHGSGLKKCSYHDIRVKYLKEEVKSRNTYLEAHRSTWKKTSLKGTMFLKSIDASIISKTTNKIFEMMDDIVEDVGKENIVQVVTRNAANYKAASRMLMGKKGQGFIGLLVQHTVLI

SEQ ID NO: 173177 - protein, 72 aa, Glycine max
  Coding DNA Sequence Number=SeqID_56399
MAESPQKQVKRMEMVVGSDLEWSPPLLLLLVMVLVLVATQSQAPRLQRPHPLQRNRVGLLARPPEHQTPPCL

SEQ ID NO: 173178 - protein, 90 aa, Glycine max
  Coding DNA Sequence Number=SeqID_56400
MAASGYDGSENVDQHDFVQVLCLVKMYHFDDACVCFTKDVDNYAFINKLKNLPTIFHETTYNLTIIDEQDFIDHVTKLHDAQKAELTNME

SEQ ID NO: 173179 - protein, 139 aa, Glycine max
  Coding DNA Sequence Number=SeqID_56401
  Gene Ontology: Mol. function=transcription regulator activity; Cellular component=nucleus; Biological process=negative regulation of gene expression, epigenetic
  Homolog annotation: Hit_ID=Q9LXN4; Match level="QueryCoverage=90%, HitCoverage=15%, E-value=2e-40, Identity=56%"; Hit description=WD repeat domain protein
  Pfam annotation: Domain name=Hira; Domain location=1-139; Score=39.4; E_value=1e-08; Accession=PF07569.2; Description=TUP1-like enhancer of split
MPTMMMGSAATFVDCDECWTLLLVTRKGSLYLWDLFNRTCLLQDSLTSLVASSPNSSGTIKVISVKLSKSGSPLVVLATRHAFLFDMNVKCWLRVADDFFPASNFSSSWSLGSIQSGELAALQLVVGLGPRFEMLLDTI

SEQ ID NO: 173180 - protein, 94 aa, Glycine max
  Coding DNA Sequence Number=SeqID_56402
MKSRKENVIPSIWWVLLLILVVSRLTTILTNSYFDLAPRVRIECTLFREYVDKLNASLLLEKVNGLICFGSVGYVILGSDLIYLDNMRLKETMV

SEQ ID NO: 173181 - protein, 73 aa, Glycine max
  Coding DNA Sequence Number=SeqID_56403
MEMGEYVEEEKDGVKCGGVQRRETEMSGLCTVLVGLEWGERERSKVLSCDWWRGFLRALRPHDRYKQAGGERN

SEQ ID NO: 173182 - protein, 144 aa, Glycine max
  Coding DNA Sequence Number=SeqID_56404
  Homolog annotation: Hit_ID=Q2QZ53; Match level="QueryCoverage=99%, HitCoverage=35%, E-value=1e-52, Identity=65%"; Hit description =Expressed protein
MTKAAHFVFTNGKPISLREQVAVALRRLGSGESLVTIGDSFGLNHSTVSQVTWRFVESMEERGLHHLRWPSTEVEMNAIKSKFEKIRGLPNCCGVIDATNITMCLPASEPYCNVWLDHKKNHSMVLQAIVDPDMRFRDIVTGWP

SEQ ID NO: 173183 - protein, 779 aa, Glycine max
  Coding DNA Sequence Number=SeqID_56405
  Homolog annotation: Hit_ID=Q7XDI4; Match level="QueryCoverage=98%, HitCoverage=81%, E-value=1e-122, Identity=32%"; Hit description =Expressed protein
  Pfam annotation: Domain name=DUF810; Domain location=1-779; Score =1119.1; E_value=0; Accession=PF05664.2; Description=Protein of unknown function (DUF810)
MESVVLPLELIQLFRSLDFPTQQEYEAWLRRNLKVLEAGLLLHPHLPLDKSDPSAQSLQHIIHRAFEKPMDIGKNGESMQTFRTVVMSLACRSSDGSISETCHWADGFPLNLWIYQTLLEACFDLHAESSVIEEVDEVLELIKKTWVMLGINEMLHNICFAWILFHRYVVTGQVENDLLFASSNLLAEVGKDTGGSKDPIYSKILRNTLSLILSWAEKGLLAYHHTFHNVLSAKILEDISHDYNRKKKDDVDYTRKLEKLDLSKHPSRKQNKAFPILSVLARDIIELAINEKAIFSPKLKRWHPLATGVAVATLHVCYGNELKKYVKGINELTPDAIEVLIAADKLEKDLVQIAVEDSVDSEDGGKSIIREMQPYEAEAVIATLVKSWINIRVDRLGEWVDRNVRQEVWNPGENKEGFAPSAVEVLRIIDDTLEAFFLLPIPMHADLLPELMSGLDKSLQQYILKATSGCGSRSSFIPTLPALTRCSTTSKTGVFKKKEKSQVTQRRKAHVGTTIGDNSIDITQMCVRINTMQRIRMELGVLEKRIVANLSSSRSTNADIANGVSLKFKLSASAAVEGIHQLCECIAYKIVFHELWHVIWDGLYVGEVASARIEPFLQELEQYLEIVSSTVHDKVRTRVIVKVMQASFDGFLLVLLAGGPSRAFSLQDSVIIEEDFKFLTGLFWSNGDGLPAELIEKHSTTVKGVLPLFRADTEHIIQQFSQLTMEMYGSTAKSRLPLPPTADQWSPTEPNTLLRVLCNRNDEAAAKFLKKNYNLPKKL

SEQ ID NO: 173184 - protein, 732 aa, Glycine max
  Coding DNA Sequence Number=SeqID_56406
  Gene Ontology: Mol. function=oligosaccharyl transferase activity; Cellular component=membrane; Biological process=protein amino acid glycosylation
  Homolog annotation: Hit_ID=Q1RX05; Match level="QueryCoverage=94%, HitCoverage=89%, E-value=0.0, Identity=81%"; Hit description =Oligosaccharyl transferase, STT3 subunit
  Pfam annotation: Domain name=C4dic_mal_tran; Domain location=201-504; Score=-82.8; E_value=0.029; Accession=PF03595.8; Description=C4 -dicarboxylate transportermalic acid transport protein
  Pfam annotation: Domain name=STT3; Domain location=1-665; Score =518.1; E_value=9.7e-153; Accession=PF02516.5; Description =Oligosaccharyl transferase STT3 subunit
  Pfam module annotation: Pfam domain module=C4dic_mal_tran::STT3; Domain location=201-504::1-665
VIKYESVIHEFDPYFNYRVTQFLTKNGIYDFWNWFDDRTWYPLGRVIGGTVYPGLTLTAGTLWWVLNSLNIPLSVETVCVFTAPIFSAFASWATYLLTKEVKGAGAGLTAAVLLAMVPSYISRSVAGSYDNEAVAIFALIFTFYLYIKTLNTGSLFYATLNSIAYFYMVCSWGGYTFIINLIPMHVLLCIVTGRYSSRLYIAYAPLVVLGTLLAALVPVVGFNAVMTSEHFASFLVFIIIHVVALVHYIKGILSPKMFKVAVALVVSVGLAVCCAMVAVLVALVASSPTKGWSGRSLSLLDPTYASKYIPIIASVSEHQPPTWPSYFMDINVLAFLVPAGIIACFSPLSDASSFVVLYIVTSVYFSGVMVRLMLVLAPAACILSGIALSQAFDVFTRSIKLQLPSLLGHSHVDAGEASSESVVTNDSMKSDKSEDTSKERTSKKSKKKEKEPVEKPPSKSQIKKRLLVLPLETSIIAIVLLVLLGAFYVVHSVWAAAEAYSAPSIVLTSHSHDGLHVFDDFREAYAWLSHNTEIDDKVASWWDYGYQTTAMANRTVIVDNNTWNNTHIATVGTAMSSPEKAAWEIFHSLDVKYVLVVFGGLVGYPSDDINKFLWMVRIGGGVFPHIKEPDYLRDGQYRIDSMATPTMLNCLMYKLSYYRFVETDGKAFDRVRRTEIGKKYFKLTHFEECYSALFLTNLPCVSLLMHSGVHNSPLDGSDLQVETTKEPDSRKD

SEQ ID NO: 173185 - protein, 104 aa, Glycine max
  Coding DNA Sequence Number=SeqID_56407
MKMFKPKVSKLHHNLSPASSHVSCLCNNGGFETLPRFHFPHPNGEFALYSVISHRDALHSIFSWVFFCVANGFHCLGCGDLEIDGRERRMGTKEMFKKQRWEQC

SEQ ID NO: 173186 - protein, 105 aa, Glycine max
  Coding DNA Sequence Number=SeqID_56408
MSPIKDGVVRVRARVWGLTEGRVVDVGDCDHKRFVVVGFGLDGVEGKEDGFKPCKGRWLRGVEAGEMDGTKERTTRRRWGPEERKVVRVFKHSCNQMRVRVKGIE

SEQ ID NO: 173187 - protein, 69 aa, Glycine max
  Coding DNA Sequence Number=SeqID_56409
  Homolog annotation: Hit_ID=Q1RX05; Match level="QueryCoverage=42%, HitCoverage=3%, E-value=1e-07, Identity=93%"; Hit description =Oligosaccharyl transferase, STT3 subunit
MRRNAYGEETDREGQNADEEKDEEREDVAEGVPDGVGGGAVKSLLEPRGELGCVSLRRLKRRYWVWFCG

SEQ ID NO: 173188 - protein, 42 aa, Glycine max
  Coding DNA Sequence Number=SeqID_56410
DVSAKANTNGAALSVDCRTSSGSDITLSSSDASSGLDIAFYI

SEQ ID NO: 173189 - protein, 107 aa, Glycine max
  Coding DNA Sequence Number=SeqID_56411
  Pfam annotation: Domain name=LRR_1; Domain location=2-24; Score=15.2; E_value=0.24; Accession=PF00560.23; Description=Leucine Rich Repeat
  Pfam annotation: Domain name=LRR_1; Domain location=31-53; Score=3.4; E_value=65; Accession=PF00560.23; Description=Leucine Rich Repeat
  Pfam annotation: Domain name=LRR_1; Domain location=55-77; Score=9.2; E_value=5.3; Accession=PF00560.23; Description=Leucine Rich Repeat
  Pfam annotation: Domain name=LRR_1; Domain location=79-100; Score =7.5; E_value=11; Accession=PF00560.23; Description=Leucine Rich Repeat
  Pfam module annotation: Pfam domain module=LRR_1::LRR_1::LRR_1::LRR _1; Domain location=2-24::31-53::55-77::79-100
MKLKKLVLAGNYLTGRIPNAFYGLNELLIFQLLIFELSSSSLSSSLPLTLGRLTSALKLDVSNNHLEGNLLNEFANLNNLTLMDLRNNRFTGGLTLMPPLHKALLSS

SEQ ID NO: 173190 - protein, 61 aa, Glycine max
  Coding DNA Sequence Number=SeqID_56412
MGGVYFFITKRPQTGASTVHVTRGTDAAHEGAAGSAPDAGASASALGATGGAPTTGATPGA

SEQ ID NO: 173191 - protein, 108 aa, Glycine max
  Coding DNA Sequence Number=SeqID_56413
MTTLVFACYRTLSLTDSERVCAGYHIGSLRVPTDLQVTIVKGGAVDKSEAFAPMYPQFVMRNSDLRSSCESSMITLVSTCQSDLGSPNDVVRIIVRCLRMLPDSRVVG

SEQ ID NO: 173192 - protein, 136 aa, Glycine max
  Coding DNA Sequence Number=SeqID_56414
  Gene Ontology: Mol. function=nucleic acid binding
  Homolog annotation: Hit_ID=Q1S9L7; Match level="QueryCoverage=81%, HitCoverage=62%, E-value=3e-33, Identity=65%"; Hit description=RNA -binding region RNP-1
  Pfam annotation: Domain name=RRM_1; Domain location=47-112; Score =45.7; E_value=1.6e-10; Accession=PF00076.12; Description=RNA recognition motif. (a.k.a. RRM, R
MAWAIPGGGRDRFRRDYPSRHEDNRGNGISGRDNRNSNSNNPPSRHLWVGNLSHNIVEEELAHHFLRYGPLENVAFQPGRSYAFINFRMDEDAIDALRALQGFPLAGNPLRIEFAKALLQNMHLTVKKSMAKSYFL

SEQ ID NO: 173193 - protein, 773 aa, Glycine max
  Coding DNA Sequence Number=SeqID_56415
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=98%, HitCoverage=59%, E-value=1e-180, Identity=39%"; Hit description =Chromo
  Pfam annotation: Domain name=Chromo; Domain location=732-772; Score =13.7; E_value=0.023; Accession=PF00385.14; Description='chromo' (CHRromatin Organisation MOdifier
  Pfam annotation: Domain name=rve; Domain location=476-602; Score= -9.2; E_value=0.035; Accession=PF00665.16; Description=Integrase core domain
  Pfam annotation: Domain name=zf-H2C2; Domain location=421-458; Score =12.3; E_value=0.0084; Accession=PF09337.1; Description=His(2)-Cys(2) zinc finger
  Pfam module annotation: Pfam domain module=Chromo::RVT_1::rve::zf -H2C2; Domain location=732-772::60-320::476-602::421-458
MEGTEEVQENRVKGEPQEVLESILEKFADVFKEPTGLPPPRAQRQVKELLANGHIRYSQSAYSSPVILVKKKNNKWRMCVDFRALNRVTILDKFPIPVIEELQGAKYFSKLDLTSRYHQVRMRTADIPKTTFRTHEGHYEYLDVGFFYDILVYSKGWQEHLQLLQQVLEVLRHNKLFARREKCTFGQEQVEYLGHIIFVQGVAVEPAKVKSVLGWPRPKNVKGVRGFLGLTSYYRKFIRDYAFDALKKRVTEAPVLRLPNFEEQFELEYDASRTGIGAILMQNCHPIAYFNQRSLKQLLSQRVLTGNQQNWLAKLMGYNFEIIYKPGNENKGADALSRSLEDAELTNMISYLEWLDWQQLTHEVQQDTHWKKVICDLRQDKEAHTGFSYNQGVLLYKGRLVVHEKSPWIQKLLEEFHSTPQAGHSGFYRTYRRLTSNLFWKGMKEDVKRFVQACDICQHQKYSATSPGGLLQPLPIPEQVWEDVSVDFITGLPCSRGYEAILVVVDRLTKYSHFVPLKHPYTAKGIVEIFVREVVRLHGVPKSLGTMLKMSTTYLPQTDGQTKAEFWINTTYHESIGTTPFAAVYGREPPKIIQCIPGEVRVESAQRELIDRDEALRQLKTFLLSAQDRMKTQADKHKKEREFEVGDMVFLKLKQHRHHSVIARISPKLSARYYGPFKILEKIGKVAYKLQLPPTSRIHPVFHVSLLKKAVGNYEAEADLPTGLDDDRADIIKPEAVLASRRVIKHGERLKQWLIQWKGKSVDEATWEDEISI

SEQ ID NO: 173194 - protein, 73 aa, Glycine max
  Coding DNA Sequence Number=SeqID_56416
MLLKIEYIYNLDRCYLVIMEAQDDNFKSKMLNGGGEDNGGSNGNGVSDGNYNNDCSVNGYNGDDTTIVVLAIE

SEQ ID NO: 173195 - protein, 484 aa, Glycine max
  Coding DNA Sequence Number=SeqID_56417
  Gene Ontology: Mol. function=RNA-directed DNA polymerase activity; Cellular component=chromatin; Biological process=chromatin assembly or disassembly
  Pfam annotation: Domain name=RVP_2; Domain location=391-484; Score= -33.5; E_value=0.00041; Accession=PF08284.2; Description=Retroviral aspartyl protease
  Pfam module annotation: Pfam domain module=RVP_2::Retrotrans_gag; Domain location=391-484::132-222
MEARMIQVEGELDWVRSSIEELRLKAAESKSIMDQLQKKSEQQTKLMEAISRGFRRNGDEDGGENSVGQKESEKPKASVSLKPLEGIALEEFRQSLKKVELPMFNGEDPAGWITRAEIYFRVHETSEEVKVNLAQLCMENETIYFFNALLSDYDELTWDDLKHELLEHYGGIGEGSVFEQLTSLQQTGGVEEYIKKFECLTSQIPRLHDEQCFAYFIHGLREEIRSRMRSLNVVSPMSHGRMMNAAKAIKLELSSHGRNWSEKKETRGSGGSYLGFRISSNVLARNNPRSFGGQGVVMGLAQMHQLTLEKKNRNWPRDRGTKHLAYQDLMERCRKGLCFKCGESYGAFHQCPMKQLRVILVGYMQAEFDGECSAMRLLSSQVEQIGDSRTMKMRGKVFDVPLFILVHSGASHNFISRKLVEAMGWKWEETRSMRILLGDGHKTLTCGVCHRLTVEVDACRFVVDTCLFDLEDIDLILGMAWLSS

SEQ ID NO: 173196 - protein, 127 aa, Glycine max
  Coding DNA Sequence Number=SeqID_56418
MADPLRGSPENYGKVAISDFAIKHKTTLKHTEHAADASPAEKATSSSTTRTCAPSCQFRTLARRERKLRFIEEEFIRAGFAVVTLERVVGIGSDEEGVGFGASETFDVVFYLRRVVRHNGWTNREVW

SEQ ID NO: 173197 - protein, 283 aa, Glycine max
  Coding DNA Sequence Number=SeqID_56419
  Gene Ontology: Mol. function=protein serine/threonine kinase activity; Cellular component=cyclin-dependent protein kinase holoenzyme complex; Biological process=protein amino acid phosphorylation
  Homolog annotation: Hit_ID=P29618; Match level="QueryCoverage=63%, HitCoverage=89%, E-value=1e-39, Identity=43%"; Hit description=Cell division control protein 2 homolog 1
  Pfam annotation: Domain name=Pkinase; Domain location=19-224; Score =29.0; E_value=2.7e-10; Accession=PF00069.15; Description=Protein kinase domain
  Pfam annotation: Domain name=Pkinase_Tyr; Domain location=18-224; Score=-122.3; E_value=5.7e-05; Accession=PF07714.7; Description =Protein tyrosine kinase
  Pfam module annotation: Pfam domain module=Pkinase::Pkinase_Tyr; Domain location=19-224::18-224
MHVFAPKWGAPRCGADGREDIGCGGGGRLRAGVPVPRRPHGRPRGHEADHDGQVEPGHSGADHPGSVAPQRAPPRQHREAAQGRVHREQSFMFQILSAVAYCHSRKVLHRDLKPSNVLINHSKRLIKLADFGLAREFADDFLYTEKLGTSWYRAPEILCHSRQYSTQVDLWSVGCIFAEMGLETFVTDLEPSGLNLLSMMLCLDPNLESRVSGAVIEMHSHSMVFHLDLGSKVSGAAIEMHSHSMILHLNLGESSKERFAFSILVVPRFVFWGQYGFLNSARH

SEQ ID NO: 173198 - protein, 62 aa, Glycine max
  Coding DNA Sequence Number=SeqID_56420
MAEEFLKGFVHQNGIAVITLDHPKDECSSFCQHFRVIGDGRKSINMQHFTVIDDGRKSINMQ

SEQ ID NO: 173199 - protein, 47 aa, Glycine max
  Coding DNA Sequence Number=SeqID_56421
MAEYVVKSKEKAPLKRIPMWPHKSKQALTNTDFRVWNINSVSRPSKD

SEQ ID NO: 173200 - protein, 137 aa, Glycine max
  Coding DNA Sequence Number=SeqID_56422
MGTVVGLKYNDEKKNKEGVEKENEKNDEVVTSEKVEEKVVSEEEKKKSNEQTTNKGKNIVNHLPIEHLPYPHALSKKDKERQYKTIIAWPGDRPIFQEKDEDMVDPVDYFIWRRLSSSTMTVKETELLRHDLQKFVK

SEQ ID NO: 173201 - protein, 61 aa, Glycine max
  Coding DNA Sequence Number=SeqID_56423
MTTEYTFEPNTGAMIGTMHELQANLEADNKSSPDRLKTQKGGLGKRTTAKLAGRVMQTTHA

SEQ ID NO: 173202 - protein, 163 aa, Glycine max
  Coding DNA Sequence Number=SeqID_56424
MGDPFKITRVEEAGDWKYSTRASLVMLRKIGCVKVEDGLGVALSARVRITVSRMIKRETQVFICLLVVQRRDFITNNRESKIVATSYIVIVMKPKGNIKVFMAVNQKLNKLKIKGHPFEPSIVGIRAPGQIVVEKRDNINNSINTRTKGVVTKEEEEEEEEEE

SEQ ID NO: 173203 - protein, 266 aa, Glycine max
  Coding DNA Sequence Number=SeqID_56425
  Gene Ontology: Mol. function=RNA-directed DNA polymerase activity; Cellular component=intracellular; Biological process=RNA-dependent DNA replication
  Pfam annotation: Domain name=rve; Domain location=147-266; Score=4.0; E_value=0.0027; Accession=PF00665.16; Description=Integrase core domain
MNDNDEANKLDQHAYGYKRLKNEALDSPIEEYCIMEIGSTNPWQQEMMDYLHNPSNKVEFKMKQRVLKYTMIGDELYRQIFNGVSLKCFNQAELIQLMGEIHEGIDTIGQRSQPIVTVMLKGLKNTKSLNLYKKTQAKEMHVVAKPWPFRGWAMGVIDEVYLALSKRHIFILVSTNYFTKWVEAKPLVTATQEVVFRFIKHNIILLLRIPESITTDQGIMITGDKVNLFVQQFDIKLVHSTHYYKQANEKVEATNKILIDIIKKNL

SEQ ID NO: 173204 - protein, 272 aa, Glycine max
  Coding DNA Sequence Number=SeqID_56426
  Gene Ontology: Mol. function=RNA-directed DNA polymerase activity; Biological process=RNA-dependent DNA replication
MEQGNSLSQTQKRRLHRTRALKKMKQTLAIMADMKSRSQDGQVEQEKELKQIEESLLEAWLNKDDLLEVDAMSFLANAETTFDKPTIEIVEHLRPFYMNAQLNEDKMNIVLVDDSPFSADVKMVDVILYSPHLVPIQIPKDYEEGRDLEEHRLPIKQGFKPHQQPPRRCNLQLMPLIKGEIDMMLGIGFIRMDGYVNWLSNIVDLGIYKWLVMSLGLKNIGATYQRAKNLVFHDDIGKKMEVYIDDVVVKSIDKDQQLGVWSKIYKKRDFMG

SEQ ID NO: 173205 - protein, 77 aa, Glycine max
  Coding DNA Sequence Number=SeqID_56427
MHGACRQTAIATGEFGLREGLATASGDMSMQGRNRHSNWRYTQRIGNCQSNWRVPIAEGAGLAPREQAMAVQKNADA

SEQ ID NO: 173206 - protein, 127 aa, Glycine max
  Coding DNA Sequence Number=SeqID_56428
  Subcellular localization annotation: CTP_CleavageSite=20; ConfidenceScore=5.15e-01
MRRPLFSSPPFCLLSSCFVSSSSVPSICHCCVAAKLPWCRCCISAVEVNCLVSLGDDDFRVEDLKMAKSNRSITTGRSSSDRFSGRGSFSRRKVLSEKLPEQVLPVALPEEHSSGRTFCCTGRRFFR

SEQ ID NO: 173207 - protein, 210 aa, Glycine max
  Coding DNA Sequence Number=SeqID_56429
NESRFQTINKRRLEKENLVYVPENKNWTGRAMKDFTRVGVRCADVVATVQERIFVEGLLSITIVPMGGKMVLIKVAEDEDFQALGISSQRITTRKTRLDVARVIYKLQVRRLLTGTICESLSNVRREYKMVEGRGREYLVESNKGELEVAVIDEIAMDKGGVGSVFAGEETVGLVGGGGDLRGNNLVVIEEVSIVLRGKKFPVTEKGVGT

SEQ ID NO: 173208 - protein, 143 aa, Glycine max
  Coding DNA Sequence Number=SeqID_56430
MTHTRNLKEKYLNVWTQQAALGSPEDGVTTRELRASPFWRRRWRDSDKAMREKVETVFFRERSFILVLEKEVHAFEEGIEYIILGEHKGKGNWGTPPLIQTTRAWDLFLTLMHCRVLDNPQPKIKAVKEKMKGKVNTSSISRS

SEQ ID NO: 173209 - protein, 101 aa, Glycine max
  Coding DNA Sequence Number=SeqID_56431
MLSPMKDKGEDFESYGNIKVRMLSPMKDKGEDFESYGNIKARTLSPMKDKGEDFKSYGNIKARTLSPMKHKGGDFESYGNIKARTLCPMKHKSEDFEFYER

SEQ ID NO: 173210 - protein, 56 aa, Glycine max
  Coding DNA Sequence Number=SeqID_56432
GTGSTRAGVGSGGAASLGLTNGELWTSGLMVADGGAGVDDDGMSYALALFLDAICN

SEQ ID NO: 173211 - protein, 157 aa, Glycine max
  Coding DNA Sequence Number=SeqID_56433
MTLFPPMHALSRMSRCTPFRGGVDGGRARQRDDSEDSDGDHDDDDWEGMESTELDEAFSVATALVDAAAVDRLSQKLFLIKLPHSFYFSPVRGETFTVGCSLCETIGARIINNLLLNAAMSEYVPAGVDGKRCLENVVNEVVLLAARRVSISNSNDR

SEQ ID NO: 173212 - protein, 59 aa, Glycine max
  Coding DNA Sequence Number=SeqID_56434
MGYLKKVVINMILLFMLLLSMNLATARVPLWISEPLAHGRFLNADNPFGGNYHKRPPKP

SEQ ID NO: 173213 - protein, 46 aa, Glycine max
  Coding DNA Sequence Number=SeqID_56435
MNVPQWMLTRHEGSRGNAQNQKRLSNHEGMLNGMYLNLNGCSPDQL

SEQ ID NO: 173214 - protein, 41 aa, Glycine max
  Coding DNA Sequence Number=SeqID_56436
MAYLKVVINIFVLLFVLLLSMILATARVPLWISEPHHKAQP

SEQ ID NO: 173215 - protein, 203 aa, Glycine max
  Coding DNA Sequence Number=SeqID_56437
  Gene Ontology: Mol. function=RNA-directed DNA polymerase activity; Biological process=RNA-dependent DNA replication
MPTYAKFMKELLTKKRRFTDEETIEQETSCSATIQKPLPQKSSNPGSFTLPTLLDLGASINPMSLPMMKRIGGLEYPYGVVEDVLVKVDKFTFPIDFVVIDMEEDSKVPLIPGRPFMKTAKVIIDVDDGKLKVQAQDDEVNFKVFDAMKHPNDKKECFRVNVIDEVCFEAKKQFFPSSPLEKALMNVNAVDVLDEEEEKETEK

SEQ ID NO: 173216 - protein, 62 aa, Glycine max
  Coding DNA Sequence Number=SeqID_56438
MAAKKATHTIPESKKRKVQASFQPQVKPEDIHQEEEEMGMYLGEPSTLDEDGMDTSSDEKAL

SEQ ID NO: 173217 - protein, 464 aa, Glycine max
  Coding DNA Sequence Number=SeqID_56439
  Gene Ontology: Mol. function=RNA-directed DNA polymerase activity; Cellular component=intracellular; Biological process=RNA-dependent DNA replication
  Pfam annotation: Domain name=rve; Domain location=218-363; Score =44.9; E_value=2.8e-10; Accession=PF00665.16; Description=Integrase core domain
MVTKGIVLGHKISSRGTEVDKAKVNFLEKLPPPTNVKGIKSFLGHTGFYKCFTKDFSKIVKPLSILLNKDIHFKFDHNCLSIFSLLKQKLLSAPIIMTLNCKYDFELNCDASDYVVGFILEFDLEIKDKKGYEKLVVDHLSRFVNDEVTVKETKVLENFPGEKVFAIQERPWFANMENFKVAEVVLEDFNWCQRKKFFKDAKTSGISKRHELPLQNILEVEVFDCWGIDFVGPLPSSYSNEYILVVVDYVSTWVEVIATQKAYAKIVICVLKRNIFCMYGTPRVLIDDGNSHFCNSWLKMVLEHYDVKHKIVSPYHPQKNGRILEKTIGSFRKDWVMKLDDTLWAYITTFKTPIGLSPFQLVYGKTCHLLVELEHKVFWALKFMNFDPKAASDKRRMQLHELVEMRLQAYESSRRYEEKLEDLGAGRTWIVNGQILKPYLGGDIERLTTMAYLSDPWRSCDASS

SEQ ID NO: 173218 - protein, 194 aa, Glycine max
  Coding DNA Sequence Number=SeqID_56440
  Gene Ontology: Mol. function=nucleic acid binding; Biological process= DNA integration
MATPGDHNNINNNARILLGDYAHQSGLRHFTTKTWLQSHPNQSLTRRKDVEEKFLARFFLPSRYISVKSAIAAFSQRSDEPLSEAWEIYKSLLRKCPNHGFNDIAQLNIFCNGLRPYTKMFLDASIGGSMMLKSLEEAITIIDALATSDHQAHYDRTQHHRKIVLELDSQNALLAQNKLCSQQMEDPRKQMPKL

SEQ ID NO: 173219 - protein, 138 aa, Glycine max
  Coding DNA Sequence Number=SeqID_56441
  Gene Ontology: Mol. function=nucleic acid binding; Biological process= DNA integration
MLEWSVRVAYCCIMKRVEDAGEELQERFVATINWRVVDEILYHVMELMSLLEVWKKLKSQYILKSLTNKLVDLQQDVNVFNQIISDLAKLEVKIEDEDKACILLCSLPSSYEHFVTTLTHGKDLIGLEVIQSTVMSHS

SEQ ID NO: 173220 - protein, 380 aa, Glycine max
  Coding DNA Sequence Number=SeqID_56442
  Homolog annotation: Hit_ID=Q9FIS0; Match level="QueryCoverage=88%, HitCoverage=43%, E-value=4e-14, Identity=29%"; Hit description =Arabidopsis thaliana genomic DNA, chromosome 5, P1 clone:MTG10
MFLETQKNIRIKTRGSGTRSRTESFSDLSSEISASPGTKTPTLVARLMGLDLLPDAHSSSSPSLSTPNLHKPRQHIKIIKHRNSTGSNTLPETPRMSSGRRSEVEHRLSLQINKENNTVPFEDFESPRFSFSKRKYYENSCRSPSHYARQIVKQVKESVSRKVGLDITNTVKNREHGREESVGQFKFKKTPKTSVNESSPGKHSNSSYSPRLSRFIDTKHKPSTTPPSPTTPKNQNTHSILKPPSPTTSKNQNPHSILKPPSPPPVVNIETQLSRVLTKPKPQALPENDWQNQKSATKGKNTSSGKLSSRVNKPPQTSIRNKQEESFITRPPSATKANDIKTKSKRTHPLSSNLLNNLNTVPNLLPVKTRPSPQKQVPFN

SEQ ID NO: 173221 - protein, 42 aa, Glycine max
  Coding DNA Sequence Number=SeqID_56443
METVSGKCALNAFLVHILEKASGSEQAMDRFAHFCSGILRQQ

SEQ ID NO: 173222 - protein, 89 aa, Glycine max
  Coding DNA Sequence Number=SeqID_56444
  Subcellular localization annotation: CTP_CleavageSite=60; ConfidenceScore=5.20e-01
MTLVRPAPLNFSDSIVVGSLLKTFAHGLFVSGGVGRTQNVPHSATARIRSKPIHPASGCVEGLEKCGDVNMNLWELIEIYIGVKFGIKF

SEQ ID NO: 173223 - protein, 39 aa, Glycine max
  Coding DNA Sequence Number=SeqID_56445
MVFSGGHVGLEDLKRAVKDNCMFVEKNSSPNVIHVVKLV

SEQ ID NO: 173224 - protein, 101 aa, Glycine max
  Coding DNA Sequence Number=SeqID_56446
  Subcellular localization annotation: CTP_CleavageSite=64; ConfidenceScore=5.98e-01
MTFVIPSSSSQKSLSTVFFLFVLRDLRSSSSSPCSSSSSSSSTAPPWVLTVVLLRPRVGIVEVSSSSSSSLPWVLTGKVPDQLDPLLHQGYFFNTRSSFEL

SEQ ID NO: 173225 - protein, 78 aa, Glycine max
  Coding DNA Sequence Number=SeqID_56447
MPTRGRSNTTVNTHGGAVDDDEEDEEHGEEEEERRNNEGHEEENGENGEEAQKKQEWRGRSRRSRNGEEHRIGREKGE

SEQ ID NO: 173226 - protein, 305 aa, Glycine max
  Coding DNA Sequence Number=SeqID_56448
MAAFHGCHSPYEASMVAFHGRHSPYGASTAAYHHPHYSSSYGTLHYPTQQPPHPLEFSTATADRLDVVLAELDVATRRLDARLDALLLRLPRRPRPLPRIPLPPPSLPMPSPLTPPTPPQLPPPPPPATTPPPPPPLPATTPPPLPLLPPTPLTPPPPLPLPRPRTPAPPPRPPPLQSTQSPTLTAPPPIPTQSPRPALMPQHPVPLPDPLTIATVHLLADNQPQASSPSHHILLSDLDLFPSVMFIAITTDTELDYHFLPSDITIDSVGWLRFRNTYLHALIPSPILIWDPGSNFEAVVVAPTP

SEQ ID NO: 173227 - protein, 472 aa, Glycine max
  Coding DNA Sequence Number=SeqID_56449
  Gene Ontology: Mol. function=sugar binding; Biological process =protein amino acid phosphorylation
  Homolog annotation: Hit_ID=Q5JK65; Match level="QueryCoverage=62%, HitCoverage=67%, E-value=9e-20, Identity=26%"; Hit description =Protein kinase-like
  Pfam annotation: Domain name=B_lectin; Domain location=89-193; Score =59.0; E_value=1.6e-14; Accession=PF01453.15; Description=D-mannose binding lectin
  Pfam annotation: Domain name=PAN_1; Domain location=336-417; Score =10.2; E_value=0.015; Accession=PF00024.16; Description=PAN domain
  Pfam module annotation: Pfam domain module=B_lectin::PAN_1; Domain location=89-193::336-417
MLLLLLPLMRLFPFLLLLLLVLLFNYGFSESGVGAGYQLMVAVPVEYEVDFKGRAFLVETNQTAPNFRVALSIEAINGKYSCSLEVFLGDVKVWDSGHYSRFYITEKCLLELTMDGDLRLKGPKERVGWKTGTSGQGVKRLEIQRTGNLVLIDALNNIKWQSFNFPTNVMLRGQQLDVATRLTSSQSNSSLFYYSFEIEDKKVALYLNYGKLRYSYWGFQPTMNRSITYIKLSSRGLVLFDVKYKKIAQIPSEGIHPLRFLALNNETGKLGLYYYSPEKGKFEASFQALNSTCDLPIACRPYGICTFSNSCSCIQLLTNEDKGGADCGWAISGGFCNGKEAEMLELDNVSSVLKNVTKVVNITKKACENLCFQDCKCAAALYFGNASTDEAECYLYKLVLGLKQVEKGTGFSYMVKVPKGTVKNHERHNVKRWVFVVAGGVDGLIILLLVGGFGYWLVKRRSHALHSRASTT

SEQ ID NO: 173228 - protein, 811 aa, Glycine max
  Coding DNA Sequence Number=SeqID_56450
  Gene Ontology: Mol. function=calcium ion binding; Cellular component =extracellular region; Biological process=pathogenesis
  Homolog annotation: Hit_ID=Q8XQP2; Match level="QueryCoverage=99%, HitCoverage=88%, E-value=0.0, Identity=41%"; Hit description =Probable hemagglutinin/hemolysin-related protein
DITDDATPTFKGKTEPGATVIVRDNGNELARAVADKDGNWSFTPDQPLADGDHSFTVQPVDKAGNKGPETDAIDFTVDTSKVVIAITQVYDDAGSITGNLTSGQVTDDTTPTLKGTATGNALVKIYDNGQLIGSTVAAKDGSWSFTPGVALSEGPHSLTATATTPAHGESEATAAFDITIDITAPNNAGIEDVRDDVGTEQGTVDNGGATDDTTPTLTGGGKPGDVVTIIDNGETIGSAVIGENGKWTFTPETPLNDGEHKFETVITDPAGNSSKPSDPYVVNVDTQAPNKPAITEVYDDQGDRRGPIAAGDTTDDATPTVRGTAEADSLVNIYDNGVLIGSTRTDGKGNWSFEPPLPLANGAHALTAEAVDAAGNVSESSDKFEFGLISGGVPNAPAITSVMDNVGDIQGLVQKGSVTDDARPTINGTAQPNSLVTLYADGIKLGTVTADANGNWSYTPASDLRDGVHNISATSTNAAGNVSPETGVYPIEVDTTAPGNIINPVLTDDVGQVQGPIRSGETTDDATPTFSGKTEPGATVIVRDNGKELGRAVADDSGNWTFTPGTPLTDGKHSFTAQPVDLAGNQGPIGGAIDFTVDTSAVVVALTRVEDNAGSVKGDLSSGQATDDTTPTLYGTATPNALVKIYDNGKLIGQVSANAQGQWNFTPGTALSEGSHALTVTATTEAHGESEPTSQFDLLIDITAPNKGVIDSVSDDVGTVQGPIGKGGYTDDTTPTLSGRGTPNDKVTIIDNGTPIGEVTVGNDGRWSFTPTTPLNDGTHNFTVVMTDPVGNSSAPSDVWPVIVDTQAPNP

SEQ ID NO: 173229 - protein, 77 aa, Glycine max
  Coding DNA Sequence Number=SeqID_56451
EVFGLWKAKSSVGSSLYVPDGSGYKNLVVYVCLNAVLVEFSLKRGICGRGLMRTRLGYHEESGSSSPGDNTGTHKHC

SEQ ID NO: 173230 - protein, 154 aa, Glycine max
  Coding DNA Sequence Number=SeqID_56452
MAFHPPTSDMCKHLKPLYIKAHINGKMLSKVIVDGGAILNVMSINTLWKMDKDIEDLTTTNMKMTSFEAQNFMLLLSLHSSSPTFKLLSMTSYGGELLLVSSSPRSGISNHLSSFFVPLQLNFKKQRTLLMKKIQGLQAPHGATSLWGYWLPIS

SEQ ID NO: 173231 - protein, 201 aa, Glycine max
  Coding DNA Sequence Number=SeqID_56453
MSVFERLGRLSKSMPSHVSRKVFVPHEKIKKACLCRSGMLNNLNKGHPTGPKTTELRPLINTCHHQGLPKIGQTLTIDEEPVPMQVYVSEVEKALEETFRTALVPFESEKSKVLKEPQQEEVLNEAENEEDVDTQNDSVLVTKEEIYEGIYGIIIDLDIITQQDDLSIDDDLGKSLLDSMLNEIYELFNDIDTMSLIPIEF

SEQ ID NO: 173232 - protein, 145 aa, Glycine max
  Coding DNA Sequence Number=SeqID_56454
  Homolog annotation: Hit_ID=Q9LKA9; Match level="QueryCoverage=47%, HitCoverage=19%, E-value=1e-09, Identity=47%"; Hit description =Similarity to Avr9 elicitor response protein
MDGSSDAIRGEPRLPQGLSPPRRREPGLNAHKPHHLMPVSVADPTTGGTVAGGVFPNDAHRSGVRVDAAAATNLAEESNDSEEEEGGEEEVEGGSARGLARVGDGVGLGGRRHGSRNGAHHEVGCGGGGDGEGGGDYGLGLGTRD

SEQ ID NO: 173233 - protein, 206 aa, Glycine max
  Coding DNA Sequence Number=SeqID_56455
  Gene Ontology: Mol. function=transferase activity, transferring glycosyl groups; Cellular component=membrane; Biological process =protein amino acid glycosylation
  Homolog annotation: Hit_ID=Q9LKA9; Match level="QueryCoverage=70%, HitCoverage=42%, E-value=6e-66, Identity=83%"; Hit description =Similarity to Avr9 elicitor response protein
  Pfam annotation: Domain name=Galactosyl_T; Domain location=14-198; Score=-4.9; E_value=1.7e-06; Accession=PF01762.12; Description =Galactosyltransferase
MGFVGIQTGFTSAGRRESLRKTWFPSDRQGLQRLEEATGLAFRFIIGRTSDRAKMSALQKEVAEYDDFILLDIQEEYSKLPYKTLAFFKAAYALFDAEFYVKADDDIYLRPDRLSLLLAKERSHPQTYIGCMKKGPVFTDPKLKWVSHYHSFYVLYLDVPLLLWFCFGGGGGLRTRLENEAISYLQDEMRILSLKNLIHGGSVHCG

SEQ ID NO: 173234 - protein, 107 aa, Glycine max
  Coding DNA Sequence Number=SeqID_56456
MFPNSRNLFQGDSIPQEQAQIPVLWKAPQKGLYKIHVEIKNNIGRSMSLIVCDSQGEVITTTIKFMESELEPRVVEAYAFRWASSMVVDLCLQGVTFETNCLHLSQA

SEQ ID NO: 173235 - protein, 68 aa, Glycine max
  Coding DNA Sequence Number=SeqID_56457
MKVMRCNAWRSMGHVAVVGSLGGSTMEGLVQCGSGVGCCSVGGGCVRRPLLPLRLSLEGIAMALLNTS

SEQ ID NO: 173236 - protein, 149 aa, Glycine max
  Coding DNA Sequence Number=SeqID_56458
MYNSIITYIGLHCSAHWQMVVILPKENVVIWFCSLHNKPDNYLKGIINRSVLFFNTFALALVSALKGLDDTQQSKSKPPARWIVVKCNRQKGSTECGYYVMHWMSTIILGNFQNNWEMYFTDPRPLEPERLKALRNQWAKYYLKVKNET

SEQ ID NO: 173237 - protein, 186 aa, Glycine max
  Coding DNA Sequence Number=SeqID_56459
  Gene Ontology: Mol. function=DNA binding; Biological process=DNA integration
ADEAILLSYSLHSKAYRVFTKRTLTVEESVHVKKMQDFRKKDFVQEDGIKAKEVELNKEISMKLPKELPREWITQKDLSLDNIIGDISKGVSTRSRLCILCNNMTFVSQVEPRNIDGALCDENWLMEMHEEMNQFKRNDMDVKNAFLNGCIEEEVYVEQPLGFVDHEHPDYVYKLKKELYGLKQAP

SEQ ID NO: 173238 - protein, 106 aa, Glycine max
  Coding DNA Sequence Number=SeqID_56460
  Subcellular localization annotation: CTP_CleavageSite=31; ConfidenceScore=5.06e-01
MMQMLSAPMASRKRKAPSTPNQVRFDRSRFTSQEAWERYTDIIVPRKLLLEKNVVVYYTEFDEFKEELERCHWDKEWTDFGDGNIDVAIVKEFYVNLYDPEDKSPK

SEQ ID NO: 173239 - protein, 70 aa, Glycine max
  Coding DNA Sequence Number=SeqID_56461
METTTKIKLFELENKGFDDAKEESNKVAYKVTSTNIQRLSIALRLIQGQANKIKKKIRPRTISLVDWFLP

SEQ ID NO: 173240 - protein, 90 aa, Glycine max
  Coding DNA Sequence Number=SeqID_56462
MRDPWNNLILPIYRKKREEVAAQLAQESSARLGQLGCFHQKQSCFENTLEGLWEFYGSITGVPKASEAIFNKTGEVVSAQLAQASWVASS

SEQ ID NO: 173241 - protein, 77 aa, Glycine max
  Coding DNA Sequence Number=SeqID_56463
  Subcellular localization annotation: CTP_CleavageSite=47; ConfidenceScore=5.42e-01
MQIASMNSATLRHATRGCVASATGDSSDVATCNGALAMQGRVAGQTSASLRVAGAAFAGLVKVQCSRENARAFGDLG

SEQ ID NO: 173242 - protein, 85 aa, Glycine max
  Coding DNA Sequence Number=SeqID_56464
MVVKSFEDGRSEIKSRDKSSQIEDGIGPSPHPCRLNRSYMEFFQQIRYKLIVRWKPDLVVEKYEVVVDCEAQMCLWALLNLDKKC

SEQ ID NO: 173243 - protein, 81 aa, Glycine max
  Coding DNA Sequence Number=SeqID_56465
  Gene Ontology: Mol. function=chromatin binding; Cellular component =chromatin; Biological process=chromatin assembly or disassembly
  Homolog annotation: Hit_ID=Q1SAV4; Match level="QueryCoverage=82%, HitCoverage=21%, E-value=2e-11, Identity=43%"; Hit description =Integrase, catalytic region
MEYQVDVGGIGPLEQGIDGLYLGRPKRIAGNGKVKDRSVVGPFGECYKFEPLCWPIIDECSEVLFKNAIENICLADRLRVV

SEQ ID NO: 173244 - protein, 487 aa, Glycine max
  Coding DNA Sequence Number=SeqID_56466
  Gene Ontology: Mol. function=RNA-directed DNA polymerase activity; Cellular component=chromatin; Biological process=chromatin assembly or disassembly
YDLPPSTMPDHNTRQTTTDRHEEAVTRLTQSQNTLAQNHVALSQAQTAMNSKVDSILEHLAAITTTTPHSRPHMKLEPLPLPEEAALAKLQEDKILDCHCHSRTPFNYPPPPNQPPGPLAALNPRMPDVASTPDHPLKFDPPSLKQLPHDPPQISLNALSRMSAPKTFRIYDHISHHCVMILVDGGSTHNLIQAQVAKFLNLPTASMSTLQVATMLDVGLIWLSQSPFSELIIFVKKKDDNLHCCIDYRAMNTIKIKHRFLIPIIDELLDELGKASWFSKLNLCHGFHQIRMADEEIPKPAFCTHQGGHYEYRVMLFGLCNAPSTFQAAMNELFQLFLCKFVVVFYGDILIYSPSFSSHLKHPEAVFTSLSQGQFYLLQSKGRTRPNQNSDYGRLAFPMAQSDLCGFLDLIGFYRKFIKGFATVVVLLTTLPWKDNFQWHQDAQLAFDKINCPPPKLPPHRILQQGFLSSSSMCVHVCLGTSCHHHD

SEQ ID NO: 173245 - protein, 562 aa, Glycine max
  Coding DNA Sequence Number=SeqID_56467
  Gene Ontology: Biological process=regulation of transcription
  Homolog annotation: Hit_ID=Q1SWC6; Match level="QueryCoverage=71%, HitCoverage=68%, E-value=1e-95, Identity=46%"; Hit description =Tesmin/TSO1-like, CXC
  Pfam annotation: Domain name=CXC; Domain location=128-168; Score =77.4; E_value=4.5e-20; Accession=PF03638.5; Description=TesminTSO1 -like CXC domain
  Pfam annotation: Domain name=CXC; Domain location=211-252; Score =87.2; E_value=5.2e-23; Accession=PF03638.5; Description=TesminTSO1 -like CXC domain
  Pfam module annotation: Pfam domain module=CXC::CXC; Domain location =128-168::211-252
MEQSETASDLAPRKLARQLDFAAVYGDPSHQKLPPPLPPPQSPLRPPSHSPLRLQLDLQPPGQRPWLYSEAQEQQPGLYSPRPKLVSPVRRIPHPVVKFPVKVLQVVKPESPRSQPRCNVELKDTTPKKQKQCNCKNSRCLKLYCECFAAGIYCDGCNCVNCHNNVDNEAARQEAVGITLERNPNAFRPKIASSPQEQRDSKECEIKVIGKHNKGCHCKKSGCLKKYCECFQANILCSENCKCMDCKNFEGSDERIAIFHKDYNLVHMKQAANATISGAVGSSGYGTHITPKKRKNQEMFPGKSAMDQTVNMTAQYLQEIDPMASSPSSLSDSFISDPSNTRISGSSRSTYRSVLADVLKPNNVKNLCSLFVVLSRVAAKTNAEMRGKVDQQTKTGNFEASVASSAKSLQETRDVHQPACDDHVNKDEAEAVDVAHYNRPLSPETLALMCDEQDDMLFGNCSADGVACNSTFQNMIQKSFNSDGCTDVYREQERLILTKFLDILRGLVTHGSIKGICLTQLTYVNNLHHHIHKIKNARLEHKNEKPYIHPLQGHLVVMHKLF

SEQ ID NO: 173246 - protein, 199 aa, Glycine max
  Coding DNA Sequence Number=SeqID_56468
  Gene Ontology: Mol. function=nucleic acid binding; Cellular component= chromatin; Biological process=DNA integration
  Homolog annotation: Hit_ID=Q2HUL7; Match level="QueryCoverage=98%, HitCoverage=15%, E-value=5e-30, Identity=35%"; Hit description =Integrase, catalytic region; Zinc finger, CCHC-type
MAPTISTTTNELKELMEFNNNFHFSIKLTATNYPAWYKQVHALLIVRDLEGYVIGKIVCPPATVGSDDAAAPNPAYSLWIRQDKLIYLALLGSCDFEARSIMAAADTSRDAWVALAQRLSSITKGTSSISTYLLSIHNIADELALISHPIDYLEMVIHTLNGLGPTFREFTASIRTRDSPIAFIELYDKLVDFKMYFQR

SEQ ID NO: 173247 - protein, 43 aa, Glycine max
  Coding DNA Sequence Number=SeqID_56469
MRLTGVETKVERKLNCEHDGCVGGHGKSAHDLDHVDDTEQHWQ

SEQ ID NO: 173248 - protein, 45 aa, Glycine max
  Coding DNA Sequence Number=SeqID_56470
MATGRGRVLPSQSSTPQHIPVLIPDTRRVSSIGYPCPCPVPGSNL

SEQ ID NO: 173249 - protein, 59 aa, Glycine max
  Coding DNA Sequence Number=SeqID_56471
MATWRDGDGYCLPSPRLPNIYPYLSLILRVKFCYPNFVPIGYENRYGTGSDIPVPDLKS

SEQ ID NO: 173250 - protein, 228 aa, Glycine max
  Coding DNA Sequence Number=SeqID_56472
  Gene Ontology: Mol. function=protein-tyrosine kinase activity; Biological process=protein amino acid phosphorylation
  Homolog annotation: Hit_ID=Q58JJ4; Match level="QueryCoverage=73%, HitCoverage=35%, E-value=1e-18, Identity=46%"; Hit description =Receptor-like protein kinase
  Pfam annotation: Domain name=LRR_1; Domain location=112-134; Score =11.5; E_value=2; Accession=PF00560.23; Description=Leucine Rich Repeat
  Pfam annotation: Domain name=LRR_1; Domain location=135-156; Score =7.2; E_value=13; Accession=PF00560.23; Description=Leucine Rich Repeat
  Pfam annotation: Domain name=LRR_1; Domain location=88-110; Score =12.6; E_value=1.3; Accession=PF00560.23; Description=Leucine Rich Repeat
  Pfam module annotation: Pfam domain module=LRR_1::LRR_1::LRR_1; Domain location=112-134::135-156::88-110
  Subcellular localization annotation: CTP_CleavageSite=62; ConfidenceScore=5.68e-01
MWASRTTGSMAHYPPFADCQSSNTPISTKTTSTPSLSIFSTASRAFKQQLNDQDSVEFKWLRVAGFVVEQPAGRASQWGIDVVAIMVSLTSLWLQGNAFTGTFPENIRDLSSLKDLNLNGNNLIGLVPQGLGGIKLDMLDLNNNRFMGPILDFKAVMVSYYFNDFCVSKSWVLLRMMKRGVVVVNGALVVPLWLFDEGSQELGWNRERGFEKSRVLLRESHTEKEKYN

SEQ ID NO: 173251 - protein, 137 aa, Glycine max
  Coding DNA Sequence Number=SeqID_56473
  Gene Ontology: Mol. function=phosphoglycolate phosphatase activity; Biological process=methionine biosynthetic process
  Homolog annotation: Hit_ID=Q2R483; Match level="QueryCoverage=73%, HitCoverage=36%, E-value=2e-15, Identity=52%"; Hit description =Haloacid dehalogenase-like hydrolase family protein, putative, expressed
MPSWFRFCGVQKERMEPEDMYVLSHSGCVLSAPSPKPWLHKPPKCSDCDPLFKKIEDYPKATAVLVRNHGCYHYLFDATLKLHQMGLDWSTPNHGPIQSARRGLSIAGESNVSVKARKSNGDSDPFPVSSHNPPFFV

SEQ ID NO: 173252 - protein, 147 aa, Glycine max
  Coding DNA Sequence Number=SeqID_56474
MGETHEIPHRNLADIEPRLRYATERQEVGDIPLQNTLEGPQFLPQPQPLHFTMGKIPPAMAEKGKLDHLKERLRAIEGGGNYAFANLKELILVPDVVTPPKFKVPEFDKYKGTTCPKNHLKMHCRKMGVYVKDEKLLIHFFQESLTG

SEQ ID NO: 173253 - protein, 72 aa, Glycine max
  Coding DNA Sequence Number=SeqID_56475
MKISVAKAEPFGGVDSVVEGEEEGVDIHFPEKGIEFRGHGGLGGSEMELSYSEFGNGGLEVVQARCGTCRFP

SEQ ID NO: 173254 - protein, 74 aa, Glycine max
  Coding DNA Sequence Number=SeqID_56476
MKTKDQQPPPTTTTSTEEDEGPTITNNNQPLAWRKTNDEQKWNKHQHQRVKDIFAFSPRLLGAPAKMLGAPSNT

SEQ ID NO: 173255 - protein, 370 aa, Glycine max
  Coding DNA Sequence Number=SeqID_56477
  Gene Ontology: Mol. function=ubiquitin-protein ligase activity; Cellular component=ubiquitin ligase complex; Biological process =protein ubiquitination
  Homolog annotation: Hit_ID=Q84QD7; Match level="QueryCoverage=91%, HitCoverage=46%, E-value=1e-129, Identity=72%"; Hit description =Avr9/Cf-9 rapidly elicited protein 276
  Pfam annotation: Domain name=Arm; Domain location=102-144; Score =13.4; E_value=0.26; Accession=PF00514.13; Description=Armadillobeta -catenin-like repeat
  Pfam annotation: Domain name=Arm; Domain location=146-186; Score =21.1; E_value=0.0039; Accession=PF00514.13; Description =Armadillobeta-catenin-like repeat
  Pfam annotation: Domain name=Arm; Domain location=187-225; Score =22.2; E_value=0.0019; Accession=PF00514.13; Description =Armadillobeta-catenin-like repeat
  Pfam annotation: Domain name=Arm; Domain location=226-267; Score =12.0; E_value=0.39; Accession=PF00514.13; Description=Armadillobeta -catenin-like repeat
  Pfam annotation: Domain name=Arm; Domain location=61-101; Score=39.9; E_value=8.5e-09; Accession=PF00514.13; Description=Armadillobeta -catenin-like repeat
  Pfam module annotation: Pfam domain module=Arm::Arm::Arm::Arm::Arm; Domain location=102-144::146-186::187-225::226-267::61-101
PLEPPEVTDAMGEAFPSACPSKAALEANRATATLLIQQLAGGSQAGKTVAAREIRLLAKTGKENRAFIAEAGAIPYLRNLLSSPNAVAQENSVTALLNLSIFDKNKSRIMDEEGCLGSIVDVLRFGHTTEAKENAAATLFSLSAVHDYKKIIAGEIGAVEALAGLLQEGTPRGKKDAVTALFNLSTHTENCVRMIEAGAVTALVGALGNEGVAEEAAGALALIVRQPIGAKAVVNEESAVAGLIGMMRCGTPRGKENVVAALLELCRSGGAAATERVVKAPALAGLLQTLLFTGTKRARRKAASLARVFQRCEHASVHYGGLGIGYAFAGNSTTTRDTSFAVLSQQNGCFQIELRLAGYCVRMPQIKRDS

SEQ ID NO: 173256 - protein, 109 aa, Glycine max
  Coding DNA Sequence Number=SeqID_56478
MQQGQTDILIARFPDPNYGVKTNHVYLEENHEGQIRASFSTETARQAWKIPLRLKGSSRCGVSTENNGGLWWLLVAVGDGERAWEVGNGFGRKKEKEMTFFQGYTKSKG

SEQ ID NO: 173257 - protein, 277 aa, Glycine max
  Coding DNA Sequence Number=SeqID_56479
  Gene Ontology: Mol. function=ubiquitin-protein ligase activity; Cellular component=ubiquitin ligase complex; Biological process =defense response to fungus, incompatible interaction
  Homolog annotation: Hit_ID=Q9C7R6; Match level="QueryCoverage=91%, HitCoverage=36%, E-value=1e-83, Identity=61%"; Hit description=Arm repeat-containing protein, putative; 6839-9028
MASGAIFSSLRRRRSPTLEAFLAPVDLSAVALVQTLISVANEIVSCFSKRCFFFQRKNSRSLIRKVEVFQLLLEYLRDSDSRSSCLPPTAVLCLKELYLLLYRSKILLDYCAQSSKLWLLLQNHSISAHFHDLNQEISTIMDVFPVKDVLLSKDVREQVELLQKQSRRAKLFIDMKDDALRVRFFSFLDEFENGRLPDSAELRSFYVEKLQIVDAASCRSEIEGLEEQIVNHEGDIEPTISVLNGLVAMTRYCRFLLFGFEEDELGFERGSHKKPKR

SEQ ID NO: 173258 - protein, 258 aa, Glycine max
  Coding DNA Sequence Number=SeqID_56480
  Gene Ontology: Mol. function=GPI anchor binding; Cellular component =membrane; Biological process=cell adhesion
  Homolog annotation: Hit_ID=Q1RVI7; Match level="QueryCoverage=58%, HitCoverage=51%, E-value=2e-69, Identity=89%"; Hit description =Fasciclin domain, putative
  Pfam annotation: Domain name=Fasciclin; Domain location=52-187; Score= 82.9; E_value=9.8e-22; Accession=PF02469.12; Description=Fasciclin domain
  Subcellular localization annotation: CTP_CleavageSite=70; ConfidenceScore=5.68e-01
SPAAAPKPQAKPAPATPAPAPAKPLVPSLPQSPLSDSSSNQDIIRILRKAKSFNTLIRLLKTTQIINQVNAQLVTTKSGGGLTILAPDDGAFSQLKAGYFNSLGDRQQKALIQFHVLPVYVSSSNFDSLSNPVMTLASDSPNGYQINVTAYGNSVNISTGVVNATLTGIVYTDKTLAIYHVDKVLIPLDFSKPRPPAPAPTLAKAPKADKDNSSADDDDQGELNKATSAANSINLISIRGTMLVSLGVALVAAVTFSI

SEQ ID NO: 173259 - protein, 83 aa, Glycine max
  Coding DNA Sequence Number=SeqID_56481
MQKEEKKQRPHYLKAQLKCTHSLKVPTTLSPRKLMKQRHKEHDVTFLPKREREMKKKSRRQTPQTPESEKGRGPVLIIKARIS

SEQ ID NO: 173260 - protein, 1201 aa, Glycine max
  Coding DNA Sequence Number=SeqID_56482
  Gene Ontology: Mol. function=DNA-directed DNA polymerase activity; Cellular component=DNA polymerase III complex; Biological process =DNA replication
  Homolog annotation: Hit_ID=Q9FK71; Match level="QueryCoverage=92%, HitCoverage=100%, E-value=0.0, Identity=44%"; Hit description =Similarity to DNA polymerase III
  Pfam annotation: Domain name=AAA; Domain location=565-775; Score= -21.4; E_value=0.0087; Accession=PF00004.19; Description=ATPase family associated with various cellular activities (AAA)
  Pfam annotation: Domain name=DNA_pol3_delta; Domain location=566-846; Score=-71.2; E_value=0.0065; Accession=PF06144.3; Description=DNA polymerase III, delta subunit
  Pfam module annotation: Pfam domain module=AAA::DNA_pol3_delta; Domain location=565-775::566-846
  Subcellular localization annotation: CTP_CleavageSite=59; ConfidenceScore=5.18e-01
MLHHVLYASASLTSLGISLKIVPCGVSSYWGSSTIVWSAKFLPLGPLVGSMGLIECWVVFMEDSAVRRVGVLIMTRAVRSRVLKDANGDISDHLRNHIHLTNCIHLKNHMHKNSPILADRSIMRDLVVLQRSRSLRDPSASPPSWHSPSVVDLLFKRVENDAVSQGGRRSIGVERRKEGRRLSGTSPPLVSIGSSRVAPGEIVRGNDGITAPSERSSRSGMGDGRRVGREESGRKNDRPDFLDVNPEEPLNQAGKSLAEDVISRHSESKARKSKQRGKNVQDAQVKTLSEQLNDVPLDSDDLASSNIHFRGRFPRQEKIIKEVEARMRSHGSGMNRGKRRKFRSARRTRVATTSRDIVAENELSVASNSLAQASVHHKYHLEEADEFADENVTRAPKNGCGIPWNWSRIHHRGKTFLDMAGRSLSCGLSDSRLKKGTFAANGRNISEMPVASERSSSCTRSDAEALPLLVEASGSHASTENACWDHYYSGELGLFGDNLFKHDVDSDLASEARSGDQRKLRGNRHSRHQSLTQKYMPRTFRDMVGQNLVAQALSNAVMKKKVGLLYVFYGPHGTGKTSSARIFARALNCNSSEHPKPCGFCNYCVAHDMGKSRNIREVGPVSNFDFESIMELLDNMIVSQLPSHYRVFIFDDCDTLSTDCWNAISKVIDRAPRRVDADIIYTLEWIATKEGLEIDKDALKLIASRSDGSLRDAEMTLEQLSLLGQRISVPLVQELVGLISDEKLVDLLDLALSADTVNTVKNLRVIMETGVEPLALMSQLATVITDILAGTYDFRKDRRRRKFFRRPLLSKEDMEKLRQALKTLSEAEKQLRMSNDKLTWLTAALLQLAPDQQYVLPTSSDNSFNHSPFALKDADAREAARLTGNPVDIPNKGRRLSMDARIENVHAGSSADGMTRGLGSEKKRHSVSGFTPQHANSQATEKIRMSERQILGINRTKIEEIWLEVLERIQITGLKEFLFKEGKLISVSFGAAPTVQLMFSSQLTKSTAEKFRGHILQAFESVLGSSITIEIRCELNKDTASAVQQPLTLPSTNDSSSQIRDFNGVGTLAHPSVTDSVEKRRGEIVEEAASQVEQKNSKQQVDAHGTSYKSLEGTSIGQSSASQKKPIVKSHLDQRKLMEQGQSRSLVRSKVSLAHVIQQAEGQRSGWSKRKAVSIAEKLEQENLYVATPSFSLLTYTLCIK

SEQ ID NO: 173261 - protein, 41 aa, Glycine max
  Coding DNA Sequence Number=SeqID_56483
  Homolog annotation: Hit_ID=Q10Q05; Match level="QueryCoverage=78%, HitCoverage=8%, E-value=9e-07, Identity=78%"; Hit description=PCI domain containing protein, expressed
MDLAFDLSLYALLGDNIYSFGELLAHPIESNYIKKFGAPIL

SEQ ID NO: 173262 - protein, 296 aa, Glycine max
  Coding DNA Sequence Number=SeqID_56484
  Subcellular localization annotation: CTP_CleavageSite=23; ConfidenceScore=5.30e-01
MTLSLVNRTRTSSNIRPFTLFLRHHTDSQLPHGPSCVFSTTELRSLRQRRPPQRRGEQVRLPHGCSLPLSHLLHYPLNCTFYHSRCQIPFLLPHPSPLLALQKKLLIPHLATFSALPFFHFHGKFPFLNCPRTFSSNADSVVENDDGGGDSDKGYDGRDVSGESCADPAEVERVCKVIDELFALDRNMEAVLDECGVRLSHDLVVDMLQRTRQFETMVAMLEEMGEMGLLTMETFSVAIKTFAEANQRKKAAGIFDLMKKYEFKVGVDVINFLLDSLSAAKLGKEAQAVFEKQGVE

SEQ ID NO: 173263 - protein, 356 aa, Glycine max
  Coding DNA Sequence Number=SeqID_56485
  Homolog annotation: Hit_ID=Q2QN14; Match level="QueryCoverage=8%, HitCoverage=7%, E-value=1e-09, Identity=87%"; Hit description=AP2 domain containing protein, expressed
  Pfam annotation: Domain name=AP2; Domain location=19-83; Score=123.3; E_value=6.8e-34; Accession=PF00847.10; Description=AP2 domain
MGAVSDGNRSRKKSSSRGHHRFVGVRQRPSGRWVAEIKDSLQKVRLWLGTFDTAEDAARAYDNAARALRGANARTNFELPESSSGGATKRGGSKFVPDCTEPFSFEDVNEPGSEAEGLLGALKAKLLDGKKGKFQFQFLGNCSAPVVQSGMVSRSTQNCSGKKELLLPSSANNTVLSRMNGTGTCSPVHGLMSTLASSNTCAKTVVIPNHDHELVAVASTSSGRVYSHQLCQTPPVTTWPNEVAYDLPWPTQYMSQVPDNSLLASSGAVATLSTWPLSGVTESTVDMTYMDQGQSNSNKSGQMMNMVSMQLPLVGGANEGLWTLEQQQFVQCDQNNSWFSFNGSWDPLLYVPSELT

SEQ ID NO: 173264 - protein, 55 aa, Glycine max
  Coding DNA Sequence Number=SeqID_56486
MEETSSGIVLAYALPTLFNGISKIWCDYYLLYIGLLYYNMITLDTELVPCEENGQ

SEQ ID NO: 173265 - protein, 124 aa, Glycine max
  Coding DNA Sequence Number=SeqID_56487
  Homolog annotation: Hit_ID=Q6Z7E0; Match level="QueryCoverage=81%, HitCoverage=18%, E-value=4e-08, Identity=32%"; Hit description =Putative pentatricopeptide (PPR) repeat-containing protein
  Pfam annotation: Domain name=PPR; Domain location=11-45; Score=35.8; E_value=1.5e-07; Accession=PF01535.11; Description=PPR repeat
MKAKCPSPNVRSYTIMIQDFCKQKMMGEVVEYIDEMVDRECQPDAALYTCLITGCIRRGVVLMIIPIPYTLGMLEKGMKAPQLDYNKCASDISKIGNAVILEELARKMNFVGKSEVSNVLASWG

SEQ ID NO: 173266 - protein, 266 aa, Glycine max
  Coding DNA Sequence Number=SeqID_56488
  Gene Ontology: Mol. function=molecular_function; Cellular component =membrane; Biological process=auxin mediated signaling pathway
  Homolog annotation: Hit_ID=Q9LI65; Match level="QueryCoverage=86%, HitCoverage=62%, E-value=1e-65, Identity=51%"; Hit description =Nodulin-like protein
  Pfam annotation: Domain name=DUF6; Domain location=91-220; Score =46.5; E_value=9.3e-11; Accession=PF00892.11; Description=Integral membrane protein DUF6
MVPVVTFMMALPFGLETVKIKSKSGRAKILGSLVCIGGALMLTLYKGKPLFNFSHYESVSPVAKSSEVNLASTRTTGKWTIGVIALALGTIFWSSWFILQSKISKRYPCQYSSTAIMSFFGAIQSAVICFFTDHNLSIWVLQGKIQIIAILYAGMIGSGLCFVGMSWCVKKRGPVFTAAFSPLVQIMAAMIDIPVLHEQLHLGSVMGSILVIIGLYILLWGKSMEMQNRVVKLVQEAEETKEQEPQPQIQQLTVYVHAETCDSQCH

SEQ ID NO: 173267 - protein, 225 aa, Glycine max
  Coding DNA Sequence Number=SeqID_56489
  Gene Ontology: Mol. function=protein binding; Cellular component =cytosol; Biological process=microtubule cytoskeleton organization and biogenesis
  Homolog annotation: Hit_ID=Q9AYE4; Match level="QueryCoverage=99%, HitCoverage=74%, E-value=1e-107, Identity=79%"; Hit description =Expressed protein
  Pfam annotation: Domain name=WD40; Domain location=110-152; Score =36.3; E_value=1.1e-07; Accession=PF00400.22; Description=WD domain, G-beta repeat
  Pfam annotation: Domain name=WD40; Domain location=156-194; Score =41.3; E_value=3.3e-09; Accession=PF00400.22; Description=WD domain, G-beta repeat
  Pfam module annotation: Pfam domain module=WD40::WD40; Domain location=110-152::156-194
MAVGFQCDGNWMYSGSEDGTVKIWDLRAPGCQREYESRAAVNTVVLHPNQAYTLQKHMMLLFDLPHVPEVDTAVRSLTVMWDGSLVVAANNHGTCYVWRLLRGTQTMTNFEPLHKLQAHKGYILKCLLSPEFCEPHRYLATASSDHTVKIWNVDGFTLEKTLIGHQRWVWDCVFSVDGAYLITASSDTTARLWSMSTGEDIKVYQGHHKATICCALHDGAEPATS

SEQ ID NO: 173268 - protein, 151 aa, Glycine max
  Coding DNA Sequence Number=SeqID_56490
MPSESSTKSSQSPPAEGDKHKHLDREIREMVSAITHRVTDFHKPGSTHHLENEDEHDMRIITLAGTNDGATLRSELDEKSGKTSHGEPEALSTFVNSNFQAINNSIMLGGSYQANDPGVHLDISDFTDQPPESHHHKVEKPGKKGKKKDKE

SEQ ID NO: 173269 - protein, 77 aa, Glycine max
  Coding DNA Sequence Number=SeqID_56491
  Gene Ontology: Mol. function=transcription factor activity; Cellular component=intracellular; Biological process=regulation of transcription, DNA-dependent
  Homolog annotation: Hit_ID=P0ACP5; Match level="QueryCoverage=97%, HitCoverage=22%, E-value=8e-21, Identity=65%"; Hit description=HTH -type transcriptional regulator gntR
MFECQRQGLRVPEQMAIAGFHGHDITQVVNPRLATVLTPRERMGRESAAMLLARIGGDRSVTAPLDVGFEIAEGGSI

SEQ ID NO: 173270 - protein, 782 aa, Glycine max
  Coding DNA Sequence Number=SeqID_56492
  Homolog annotation: Hit_ID=UPI0000E69956; Match level="QueryCoverage =25%, HitCoverage=80%, E-value=9e-63, Identity=59%"; Hit description =conserved hypothetical protein
ERASANALTLATRQLMRDSGGAKVGQPKADVLLYRHIGKQRIALEHHAKWYVSAAATAPDPGPAAEMGAAVDIAARAEQGDKLTFIGAEIDVFKNGGNSWSASFRIEGIGQPGDQQDNRKIRDHQRAGEMPAAVAHVVEINLQRFIAGADQQVSKDKLTNQKREGEQHGNEHPFAQIWQHHKQGCLPGAGAQQMSRVNQLFQVDGLHVVGNGAVDKRQRNGEVTADENPWRAARIAPQLRQPLQGKALRQNGIAPLTGDAVQQRRQQRCGEHNQQQPDNQAMVEFFDARHVRTPRGDAHRHHVEVAGGQRVNGGVGAQRVGQQNHKGAEQRRKQNRQADVPPVAPAAGTEQCRRLFPVFTQPVKRRVEQQNTERNLEPGVNQHHAVARKQLKAVQPAVVAQQQRQAAVQSEQDDKGEGQRHAGEVAGHIGERQQKALKTPGAELVQRITGKQRDQQADIAVVIDAPALVDITPEAVDGNPQQRRELEGDPEQHERQQQQRGQARLRQQTATQRFVVRDAEQGADGAAQVGLLRFQVGLQREAAAKNKQRHLRLFRQNTAVRAIVVHAVIGGDNNLITGGQPAGHPLRQIAIRHSCPAVLVPGIVDVHWVNQQEIGIVLQAQAFGILEQMRVGVTVVPVEMAVLDRQVGRVSVAIARGVERRAVIQFAHPVISGSGGSESGVARVVKDAALIAQAIDAVVNDAAAHRWNADSPWRAALPDYSAHRVPPGLFSSPLPQVRMNAHPVKIGDRYRRNVLRIAGKRMRDTSRRYGMCDWQNVCVTAS

SEQ ID NO: 173271 - protein, 303 aa, Glycine max
  Coding DNA Sequence Number=SeqID_56493
  Homolog annotation: Hit_ID=Q6D2A1; Match level="QueryCoverage=33%, HitCoverage=74%, E-value=5e-41, Identity=85%"; Hit description =Protein psiE homolog
  Subcellular localization annotation: CTP_CleavageSite=57; ConfidenceScore=5.20e-01
MVKVFCTGRYPCFSARYSGDAGKNSSVNSSGLPDRRSRERRPHRSSIWPGSIKSRLSVEEENSVLSGTTVRPISQGSLSPHSTISRSQKRVSAGKNAASCGISSAVMNASRSSCTVTCWQCCSKRRVIESSSSSQSSSGGESNGEEAGSQCSARNWGSASCDIRTSPRDTSACATLASREELLAFQAVTVGQPQRHHQNQNGRRVAQRIERIFMVDNDQTNNRRDPDIDEVAQRKVIAGLKVLHNQRDKLEIEKVDHNAFDQQIRGRLLTGTEQHIRQVNSLFTKKHHQNNGQNHQANVQYPL

SEQ ID NO: 173272 - protein, 50 aa, Glycine max
  Coding DNA Sequence Number=SeqID_56494
  Gene Ontology: Mol. function=transcription regulator activity; Cellular component=intracellular; Biological process=regulation of transcription, DNA-dependent
  Homolog annotation: Hit_ID=Q9I4J3; Match level="QueryCoverage=94%, HitCoverage=20%, E-value=1e-13, Identity=75%"; Hit description =Probable transcriptional regulator
MCRVIDEARRRNKPAAPQFAVDDALRFQQAKRFTQRDARGGILFAQRALG

SEQ ID NO: 173273 - protein, 328 aa, Glycine max
  Coding DNA Sequence Number=SeqID_56495
  Gene Ontology: Mol. function=serine-type peptidase activity; Cellular component=intracellular; Biological process=negative regulation of transcription, DNA-dependent
  Homolog annotation: Hit_ID=P0A7C2; Match level="QueryCoverage=59%, HitCoverage=96%, E-value=1e-89, Identity=85%"; Hit description=LexA repressor
  Pfam annotation: Domain name=DAGK_prokar; Domain location=8-107; Score=160.0; E_value=6.1e-45; Accession=PF01219.9; Description =Prokaryotic diacylglycerol kinase
  Pfam annotation: Domain name=GntR; Domain location=117-176; Score =9.3; E_value=0.0077; Accession=PF00392.11; Description=Bacterial regulatory proteins, gntR f
  Pfam annotation: Domain name=LexA_DNA_bind; Domain location=111-175; Score=135.2; E_value=1.8e-37; Accession=PF01726.7; Description=LexA DNA binding domain
  Pfam annotation: Domain name=Peptidase_S24; Domain location=226-294; Score=72.5; E_value=1.4e-18; Accession=PF00717.13; Description =Peptidase family S24
  Pfam module annotation: Pfam domain module=DAGK_prokar::GntR::LexA _DNA_bind::Peptidase_S24; Domain location=8-107::117-176::111 -175::226-294
MANNVTGFLRIIKAAGYSWQGLRAAWQHEAAFRQEAIAALVAVAIACWLDVDAITRVLLIGSVVLVVIVEILNSAIEAVVDRIGQERHPLAGRAKDMGSAARLYKQPGGGMKALTSRQQQVYDLIRDHINQTGMPPTRAEIASQLGFRSPNAAEEHLKALARKGVIEIVSGASRGIRLLMEEEASEGLPLIGRVAAGEPLLAQEHIEAHYQVDANLFKPSADFLLRVSGMSMKDIGIMDGDLLAVHKTQEVRNGQVVVARIDDEVTVKRWKKQGAIVQLLPENNDFQPIVVDTREQSLTVEGLAVGIALAQADYRNPRDGADAAIFLF

SEQ ID NO: 173274 - protein, 278 aa, Glycine max
  Coding DNA Sequence Number=SeqID_56496
  Gene Ontology: Mol. function=4-hydroxybenzoate octaprenyltransferase activity; Cellular component=integral to membrane; Biological process=ubiquinone biosynthetic process
  Homolog annotation: Hit_ID=Q66FH0; Match level="QueryCoverage=96%, HitCoverage=93%, E-value=7e-89, Identity=61%"; Hit description=4 -hydroxybenzoate octaprenyltransferase
  Pfam annotation: Domain name=UbiA; Domain location=9-271; Score =274.1; E_value=2.7e-79; Accession=PF01040.9; Description=UbiA prenyltransferase family
MRIDKPIGTLLLLWPTLWALWLSGMAIPPLSVLLVFVLGVFVMRAAGCVINDYADRNVDGHVKRTAARPLASGAVTEKEAKLLFAGLGLLAFLLVLTMNRMTILLSFGGLALAWVYPFMKRYTHLPQVVLGAAFGWAIPMGWAAVSESLPFVCWLVFLANICWTVAYDTQYAMVDRDDDLKIGVKSTAILFGRYDKLIIGLLQLAALGLMALVGILLHLNGAFYWSLLLAGGLFVHQQKLIAGRERELCFQAFLNNNYVGLVLFIGVLLNTQPFVALF

SEQ ID NO: 173275 - protein, 148 aa, Glycine max
  Coding DNA Sequence Number=SeqID_56497
  Gene Ontology: Mol. function=transcription regulator activity; Cellular component=intracellular; Biological process=regulation of transcription, DNA-dependent
  Homolog annotation: Hit_ID=Q9HYZ1; Match level="QueryCoverage=99%, HitCoverage=62%, E-value=2e-33, Identity=48%"; Hit description =Probable transcriptional regulator
  Pfam annotation: Domain name=UTRA; Domain location=4-143; Score =154.9; E_value=2.2e-43; Accession=PF07702.3; Description=UTRA domain
MALQQGRIASTEVMEAREVPAQLAIARHLQLLEGDQVYRIRRLRRIDGRAVLYVEHYLNPAFFPGLLREDLTRSLTDLYDQRYGIHYGGARFTIVPGPLPARAAPALNVASGTPGLLITRINRDQHKRVIDCDCEYWRYDALCVDVEV

SEQ ID NO: 173276 - protein, 357 aa, Glycine max
  Coding DNA Sequence Number=SeqID_56498
  Homolog annotation: Hit_ID=Q8ZKH5; Match level="QueryCoverage=85%, HitCoverage=75%, E-value=5e-88, Identity=50%"; Hit description =Putative outer membrane or exported protein
  Subcellular localization annotation: CTP_CleavageSite=20; ConfidenceScore=5.31e-01
MSGFQPLICRVTSCNKALASVQNRANKLFRRRDSTRQLKGDGRLMVKTLFRRKKIAYVVGFNAVFVTSSAFAAGTWYDARNDAMGGTGVASSTWSSAVLANPALMTKAQPEDNVSIIFPSAGVQITDKDKLVDRVDEITDTVDRYRDVINNITLPEIINGAPQVRAAAGDMANQLRDLRGDKANGTAGVALAVSIPNETLPFAFITKAYGTAHIRANVVQSDIDYLDQVANGRIPLPGDQNNLRSSANGLAALITDYGVAMAHEFTIAGHPVSVGVTPKLQKTWLYNYTASVYNYDKNDINDSRYRSTDTGFNVDAGIATDFAENWTFGVTGQNLVSRDIDTKEVNGYRDTYQIRPL

SEQ ID NO: 173277 - protein, 103 aa, Glycine max
  Coding DNA Sequence Number=SeqID_56499
  Subcellular localization annotation: CTP_CleavageSite=62; ConfidenceScore=5.55e-01
MSPSYPSFLAHFLLLSIFPFTTSHLLIVATNSLPCTFMSPSQHPPPSNLGFRVMNPNVEKVVVMMQAREGISGDDEKVRYNEEEESGRGKRGEMGIPKFLEVY

SEQ ID NO: 173278 - protein, 185 aa, Glycine max
  Coding DNA Sequence Number=SeqID_56500
  Homolog annotation: Hit_ID=Q84TU7; Match level="QueryCoverage=43%, HitCoverage=55%, E-value=8e-16, Identity=48%"; Hit description=FPh1
  Subcellular localization annotation: CTP_CleavageSite=82; ConfidenceScore=5.40e-01
KLGVGGFNMGTATGLYSVSCFTAGKYGNGNSYSANLSSAIGLSGYLPCSNLNSGAIAGGVMHRRQTRTSSRGDENFPRKWAECDMGRDIYHWEHGIKCPTYFRASLQRLSKASTVFDPQFINTYLLGAKKNDMAPDSLASTLATLGPRQQNPHIRSCTKELVPTQAQCVLILKNYPNQDPSSELA

SEQ ID NO: 173279 - protein, 227 aa, Glycine max
  Coding DNA Sequence Number=SeqID_56501
MKKELKEAIKIELSRMASQHSPPVEALDTYILAACVSNKGSCAEVTANPLVEEPFVVDVATMGLYVVGEQCTRLVAWGKLFDSATTIHNFPYAGDLVRVSVVTVYDANALIPFLTLEIQYDSHNHVPKPVGPVERCNTVAREYLLGELMKILYDVYQRLVELPWDEMKFRIPDLWMMLTILMSNVPNRFMDDWGTSLGHGSMYDFLEPQSIHNVKDICQECQHYIEV

SEQ ID NO: 173280 - protein, 114 aa, Glycine max
  Coding DNA Sequence Number=SeqID_56502
  Gene Ontology: Mol. function=inositol or phosphatidylinositol phosphatase activity; Biological process=abscisic acid mediated signaling
  Homolog annotation: Hit_ID=Q1SU89; Match level="QueryCoverage=70%, HitCoverage=13%, E-value=2e-16, Identity=54%"; Hit description =Inositol polyphosphate related phosphatase
MEAPPINDTNTLNLRMFMGTWNVGGKSSNEGLNLRDWLMLPSPTDVYAIGSLYTLEVRAMAQRFQEIIPLNARNMLRPEDSGQHRSGRTLVIKPWTLTQAPPVELILLHAVQVT

SEQ ID NO: 173281 - protein, 243 aa, Glycine max
  Coding DNA Sequence Number=SeqID_56503
  Gene Ontology: Mol. function=metal ion transporter activity; Cellular component=membrane; Biological process=metal ion transport
  Homolog annotation: Hit_ID=Q67UQ7; Match level="QueryCoverage=63%, HitCoverage=32%, E-value=4e-28, Identity=50%"; Hit description =Magnesium transporter CorA-like
  Pfam annotation: Domain name=CorA; Domain location=23-242; Score =28.3; E_value=1.2e-07; Accession=PF01544.9; Description=CorA-like Mg2+ transporter protein
MLTLSLGLPHLLCISNDGREPHGFLSFNSLCPHCIPTLIHTQNALEKTLFRNPHLLGRERAIVINLEHIKAIITAQEFLLLNSHDPSVTPSLHELQARIIRHHNQDDVDPNPNPNDAIKILSFEFVSLEACLEAACSVLENEAKTLEQEAHPALDKLTSKISTLNLERICQTKSRLDTIIGRVQKVKEELEHLLDDDEDMAEMYLSEKLAEQQVLEGDVDDDDCGSNDFQDYFDDVKESRVKQ

SEQ ID NO: 173282 - protein, 83 aa, Glycine max
  Coding DNA Sequence Number=SeqID_56504
MSGFTRDSPQISASPHQLDLAPYASEPYNAQWNAPGLLRDKHTLRSSRILGEMEVDEPWLGLWLPLNYQVVFVIGSAVDRLCG

SEQ ID NO: 173283 - protein, 42 aa, Glycine max
  Coding DNA Sequence Number=SeqID_56505
MALLKALLGMLLLVEFLETTWEPWKGLQTVAGPTFCLSVTLP

SEQ ID NO: 173284 - protein, 57 aa, Glycine max
  Coding DNA Sequence Number=SeqID_56506
MKEEREVSKKQVSYDGPIKGKGLDPKFEVSFGEGEGGGVHCYGGWFDIDGKRGTHFC

SEQ ID NO: 173285 - protein, 137 aa, Glycine max
  Coding DNA Sequence Number=SeqID_56507
  Gene Ontology: Mol. function=RNA-directed DNA polymerase activity
LRDSCGKVVLGFSEEVRACLINMDEVKAIDIRIKLLVARGFVDVLVEFDSSFVINIIQNRRMSKHACAQLVQSIHHLAGNSIVRSWAHVLREANQVADFFANYGLSPNDLLVFDSLPTLVYLELMTDVCNASFLRGF

SEQ ID NO: 173286 - protein, 211 aa, Glycine max
  Coding DNA Sequence Number=SeqID_56508
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=O80919; Match level="QueryCoverage=97%, HitCoverage=67%, E-value=8e-61, Identity=48%"; Hit description =Expressed protein
  Pfam annotation: Domain name=DUF231; Domain location=55-207; Score =141.4; E_value=2.4e-39; Accession=PF03005.6; Description=Arabidopsis proteins of unknown function
MVFVGDSLNRGQWVSMVCLVESSVPPTLKSIRTVANGSLNIFKAEENNATIEFYWAPLLVESNSDDPLNHRVAERTVRVQAIEKHARYWTDATFWAHEWGGVKGDNCYKETDQITEEGYWGNGSIPSMMRVVENVIEDLNGRGLNVQLLNITQLSEYRKEGHPSIYRKQWEPLTEEQLSNPKTNADCIHWCLTGAPDAWNELLYAYISIDD

SEQ ID NO: 173287 - protein, 100 aa, Glycine max
  Coding DNA Sequence Number=SeqID_56509
MKIKLWSLKKLSIYMPDSLSGICIDYCILVSIYPYVHHASSCRATFAKAKKKPLVEACKKVKLDETLEKEEALELEEGVLASMKALSAKDHKKKLVEDEY

SEQ ID NO: 173288 - protein, 161 aa, Glycine max
  Coding DNA Sequence Number=SeqID_56510
  Gene Ontology: Mol. function=nucleic acid binding; Cellular component= membrane; Biological process=DNA integration
MDEQGKVVRNKARLIPQGYNQQDGINFIEAFAPAARLVVIRIMLAFATHKNIKLFPMNVKSVFLKGFIEEEVYVKQPPGFEDHTLPNNKYTKEVLNKFKMEGAKLVKTPMQASNPLSRDELGKPLDQMIYKGMIDSLLYLTASRHDIMYSVCSCARFQFDP

SEQ ID NO: 173289 - protein, 268 aa, Glycine max
  Coding DNA Sequence Number=SeqID_56511
  Gene Ontology: Mol. function=threonine endopeptidase activity; Cellular component=proteasome core complex (sensu Eukaryota); Biological process=ubiquitin-dependent protein catabolic process
  Homolog annotation: Hit_ID=O82530; Match level="QueryCoverage=89%, HitCoverage=95%, E-value=1e-113, Identity=87%"; Hit description =Proteasome subunit alpha type 4
  Pfam annotation: Domain name=Proteasome; Domain location=28-215; Score=248.1; E_value=1.9e-71; Accession=PF00227.16; Description =Proteasome A-type and B-type
MSRRYDSRTTIFSPEGRLYQVEYAMEAIGNAGTAIGILSKDGVVLVGEKKVTSKLLQTSTSTEKMYKIDDHVACAVAGIMSDANILINTARVQAQRYTYAYQEPMPVEQLVQSLCDTKQGYTQFGGLRPFGVSFLFAGWDKNFGFQLYMSDPSGNYGGWKAGAIGANNQAAQSILKQDYKDDITREEAVQLALKVLSKTMDSTSLTSEKLELAEVFLSPSGKVKYEVCSPEALTKMLVKSEDRYWLKHFSSLNILHVGNANGFVLGTS

SEQ ID NO: 173290 - protein, 122 aa, Glycine max
  Coding DNA Sequence Number=SeqID_56512
MVFSLEEDYKGALFEGPYILVDQYLLVKRWRLFFLSNVKEVTRIPTWIRIPKLPLDLYTNKFLWRKYVCLEFGEKEGIHKIVAVEDISHSDNGDIRGLQKEDEAMVNADVLENFGTNKLIVN

SEQ ID NO: 173291 - protein, 89 aa, Glycine max
  Coding DNA Sequence Number=SeqID_56513
MPISPYESISWSMSSRHRGRTHKTPSGLGEVQQGPGVSSSGYEALDRARKTPSGPGEVQQGLGVSNSDYGPHSVLQSACPPQQGHAIVT

SEQ ID NO: 173292 - protein, 69 aa, Glycine max
  Coding DNA Sequence Number=SeqID_56514
MKQKGKRKKDLEGRHVIVRKHKSFVKRKHIFWKQGTDAKSLFSGITEIRMDEFIELMKEHNWETLSLFV

SEQ ID NO: 173293 - protein, 80 aa, Glycine max
  Coding DNA Sequence Number=SeqID_56515
  Subcellular localization annotation: CTP_CleavageSite=47; ConfidenceScore=5.05e-01
MCVQAIGLFAQATCAPEFGLPRPFNQRLLILHVVGGTVKQRGQPFPCVQESSTTRDPRSLNPFSETRRREEEVSRKRGRL

SEQ ID NO: 173294 - protein, 99 aa, Glycine max
  Coding DNA Sequence Number=SeqID_56516
  Gene Ontology: Mol. function=protein kinase activity; Biological process=protein amino acid phosphorylation
  Homolog annotation: Hit_ID=Q1SN45; Match level="QueryCoverage=90%, HitCoverage=5%, E-value=6e-13, Identity=43%"; Hit description=AAA ATPase
  Pfam annotation: Domain name=DUF889; Domain location=1-97; Score= -142.7; E_value=0.083; Accession=PF05970.5; Description=Eukaryotic protein of unknown function (DUF889)
MRLTTIKTNQIVNEIKNFVDWILQIGNNGMDSYDKGEGGIEIPTDILALDIDKPFLSLVDFLYSNILENLNIPNFFEERAILAPALETVDEGMKNNIQV

SEQ ID NO: 173295 - protein, 113 aa, Glycine max
  Coding DNA Sequence Number=SeqID_56517
MEHETFLATWLAEIDFSPNGLDGGSSQYCIIIMILERMLLSERAVYAMMPVFPPEFSPLKTILFGNPSQDTIEPLMEALKEYYKDGNEINESRQFIGGVLDLEKRINRLDTLT

SEQ ID NO: 173296 - protein, 107 aa, Glycine max
  Coding DNA Sequence Number=SeqID_56518
  Subcellular localization annotation: CTP_CleavageSite=50; ConfidenceScore=5.12e-01
MLVRTIRTCLFAVARVKSCPGMQSSCVIASLSGCIRTVGALQYQGARKCSPMMARTCSPLKARTYSPLRACSPTKVKVHDPLMERTCSPLKARACGPLKARTCSPLK

SEQ ID NO: 173297 - protein, 208 aa, Glycine max
  Coding DNA Sequence Number=SeqID_56519
  Gene Ontology: Mol. function=RNA-directed DNA polymerase activity; Biological process=RNA-dependent DNA replication
ASAGGKIKLKTSEEATELIENMSANDYAILRDRVHQPTKKSLLELSSHDALLAQNKLLSRKLEILTETLGCSICGEAHETDQCIPIEEKTQEVHYMGNQQRQGYTQGGNNVNKDSGDHTLAINSTRTRVTMSNHKRTELALKNLEVQVGQLAKQIADKSSYSFVLNTEKNPKEECKAVMTRSKRFVEAEVEDNVVSKKKAAEKKDEVR

SEQ ID NO: 173298 - protein, 172 aa, Glycine max
  Coding DNA Sequence Number=SeqID_56520
  Homolog annotation: Hit_ID=Q47522; Match level="QueryCoverage=30%, HitCoverage=64%, E-value=5e-24, Identity=100%"; Hit description=LacZ protein
MATVDPDNGWRFAQCFGDKGEIDDVTEGVLLSFHVQALLQVEILLLYKSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 173299 - protein, 78 aa, Glycine max
  Coding DNA Sequence Number=SeqID_56521
MAHSVFAPCPYSRDLYGRELTRLLVIIPNVVISLLMVSRVPSGVANCRNLPFGGRATRGSRDASSMKGIRAESPPMFI

SEQ ID NO: 173300 - protein, 57 aa, Glycine max
  Coding DNA Sequence Number=SeqID_56522
MGLSGLKEYSNPVTPKAYTPKSPLGPLPSDSGPTPKTILHADTAHELYNTHDLTLVF

SEQ ID NO: 173301 - protein, 222 aa, Glycine max
  Coding DNA Sequence Number=SeqID_56523
MRRAPLDEDLTPIIARGFNSANAEALQKVCKAWEMVQNKDKELRGSSNGPIGGYHRWLKAYMQVEVPEEDEEVQALKTEIEKAQIVKEKFKSAALKIRKENAELRDVNIATTKALEQETKRARREEHGRNKFRGALWGSNNELKLRREERDQSRVDSLILKDELRICLRSKRSLSQRLCETETNMLAIISKYQEELNLATAHEHKVADEYARVYVEKEARGR

SEQ ID NO: 173302 - protein, 119 aa, Glycine max
  Coding DNA Sequence Number=SeqID_56524
  Homolog annotation: Hit_ID=Q1SFS3; Match level="QueryCoverage=77%, HitCoverage=17%, E-value=6e-08, Identity=38%"; Hit description =Lambda repressor-like, DNA-binding
MARVAKVVKISAQELDQVKQNRNGVVRVPRRCLEEKAKALANQSEWASFIDILALLIFGVVLFPNVEGLVDLAAIESFLAFHHSKESPVIAILVDMYDTFDRRCEKCGARIVCYTPALY

SEQ ID NO: 173303 - protein, 146 aa, Glycine max
  Coding DNA Sequence Number=SeqID_56525
MEITIIHTNNEPSIHVKHFFDINELERIGLKLNEILLFYGPNGPKKNVEAKTTTQKMRDMSETMEEDDDASVALRKAKEVVQNQAFPSHKKAKAVKQSVIPLEVPRRVKTRTTKANPKIVGKEWVPPSPPSSSSNKTTHDDLVSFL

SEQ ID NO: 173304 - protein, 132 aa, Glycine max
  Coding DNA Sequence Number=SeqID_56526
MEKLDEVSRSKEHSEQHPSRSILEAHAEPISKSETSKGGVSEEGSHSEHFDIYIAYFRKQTPTGAEKREELEPERQHTNQGWILASKKKNGREVGRVNLELNVRMVVLEVEKCEILRVRKAKFGVSGNWSLK

SEQ ID NO: 173305 - protein, 49 aa, Glycine max
  Coding DNA Sequence Number=SeqID_56527
MACISSSSSMVNSSYLRANKLSLLCFTYDDPSHVRATMDLCIFFLREGV

SEQ ID NO: 173306 - protein, 251 aa, Glycine max
  Coding DNA Sequence Number=SeqID_56528
  Gene Ontology: Mol. function=nucleic acid binding; Cellular component= oxygen evolving complex; Biological process=DNA integration
  Homolog annotation: Hit_ID=Q1SG63; Match level="QueryCoverage=99%, HitCoverage=23%, E-value=1e-59, Identity=42%"; Hit description =Integrase, catalytic region; Zinc finger, CCHC-type
MGRTILNDNSTPKHFWAKAVNTSCYLQNKIYIRPIFKKTPYERWKGQKPNISYFHPFRCNFFLNTKDNLRTFDSKSDNGTFHGYSKTSKAFRVYNLRMLAVEEAIHVKFNEPDKDLSEIDESFANFRFHDELPKRKKVVGAKWVFHNKLDEHGKVVRNKARLDDKGYSQQEGIAYRETYAPMARLEEIQILLSFTTYNNMKLYQMDIKSAFLNKLIQEKDYVEKPSGFESDILCHHFFKLNKELCVLKQSP

SEQ ID NO: 173307 - protein, 123 aa, Glycine max
  Coding DNA Sequence Number=SeqID_56529
MDQMEEEAEDEAQQELMHQWSPLESLMIQKMDAMLHLHQEHSVDVHNTLENITTRLENIETRLTLSNLNWMRMKRRLTKKSKSLISRLKPSKCTQFHIQVWHHQRQKGRGEIARDKGSNMNNM

SEQ ID NO: 173308 - protein, 208 aa, Glycine max
  Coding DNA Sequence Number=SeqID_56530
MLDAWFTDENKKNNFKIIYTTKNVRIPKFLDLEWFSQQGFNFPNLLEAQGLPKLVQMKGTFYPELVKIFYTCARADMEEMVIDDTVWKVVAGLDMGGVCKFEESVDGYNKMQTYRAMLLDPARNLRNHLSVGGLTARDRMLVYLITDILTPRSNNHAQVTNNDLQIVYGLKSASRFIHYFNVDVSNEIVDFTKASNEITKRPIKNLGM

SEQ ID NO: 173309 - protein, 210 aa, Glycine max
  Coding DNA Sequence Number=SeqID_56531
  Gene Ontology: Mol. function=protein binding
  Homolog annotation: Hit_ID=P0AAZ7; Match level="QueryCoverage=24%, HitCoverage=86%, E-value=7e-17, Identity=76%"; Hit description =Protein ycaR
MDESLQRTGFALPLPAIPEYRHAPGTPVRRVCKSTPAALCCNTVFRCRPDRPQSQDRYVRGLAYHSAIRDGAPPSAYMLTCQCVDQAARSASGAFSSTTSRAPCQAAKRLMALCTSARNCWLTRTPGSSQKARRIRRCAWRSILASTRPFTRGGDPIPPDQTVTAARCAWRPAAAPAAAAAYGAATSRPVAQPQRAESLPAQRPAPDRVR

SEQ ID NO: 173310 - protein, 154 aa, Glycine max
  Coding DNA Sequence Number=SeqID_56532
  Gene Ontology: Mol. function=3-deoxy-manno-octulosonate cytidylyltransferase activity; Cellular component=cytoplasm; Biological process=ketodeoxyoctanoate biosynthetic process
  Homolog annotation: Hit_ID=P04951; Match level="QueryCoverage=99%, HitCoverage=62%, E-value=5e-60, Identity=73%"; Hit description=3 -deoxy-manno-octulosonate cytidylyltransferase
  Pfam annotation: Domain name=CTP_transf_3; Domain location=1-151; Score=95.3; E_value=1.8e-25; Accession=PF02348.9; Description =Cytidylyltransferase
MVVHVMERARESGAERVIVATDHPDVAAAVTAAGGEVCMTRADHQSGTERLAEVIEKYQFADDTIIVNVQGDEPMIPAEIVRQVADNLAQADAGMATLAVPIHEAEEAFNPNAVKVVTDASGYALYFSRATIPWDRERYAQSREQIGDTLLRHI

SEQ ID NO: 173311 - protein, 169 aa, Glycine max
  Coding DNA Sequence Number=SeqID_56533
  Pfam annotation: Domain name=zf-CCHC; Domain location=43-60; Score =12.0; E_value=0.01; Accession=PF00098.13; Description=Zinc knuckle
MPMEALFGKLLAYEHELIQHRRNCTPQRKITRIVPVKIENNNFTCFECGKQGRIKFECPIYLRKHVGEKKGKKDKKRKANIAWEDNVSITSDSSSDEEITNVCLMEKSMDDSSTIEETEVNPEFEEVLEAFNEMHEEAPRLVVLNKKLKSYMKLHITKLASTQSEIDKL

SEQ ID NO: 173312 - protein, 47 aa, Glycine max
  Coding DNA Sequence Number=SeqID_56534
  Gene Ontology: Mol. function=protein serine/threonine kinase activity; Biological process=protein amino acid phosphorylation
  Homolog annotation: Hit_ID=Q7XJ65; Match level="QueryCoverage=93%, HitCoverage=12%, E-value=8e-15, Identity=82%"; Hit description =Protein kinase
MGSGNEVHSIVEFNLDAKWLIDPKQLFVGPKIGEGAHAKVYEGNFGF

SEQ ID NO: 173313 - protein, 574 aa, Glycine max
  Coding DNA Sequence Number=SeqID_56535
  Homolog annotation: Hit_ID=P75849; Match level="QueryCoverage=35%, HitCoverage=93%, E-value=5e-87, Identity=73%"; Hit description =Hypothetical protein ycbL
  Pfam annotation: Domain name=Lactamase_B; Domain location=384-564; Score=137.3; E_value=4.1e-38; Accession=PF00753.17; Description =Metallo-beta-lactamase superfamily
  Pfam annotation: Domain name=Peptidase_M15_2; Domain location=233 -370; Score=244.3; E_value=2.5e-70; Accession=PF05951.3; Description =Bacterial protein of unknown function
  Pfam annotation: Domain name=Peptidase_M15_3; Domain location=265 -376; Score=-13.7; E_value=0.033; Accession=PF08291.2; Description =Peptidase M15
  Pfam module annotation: Pfam domain module=Lactamase_B::Peptidase_M15_ 2::Peptidase_M15_3; Domain location=384-564::233-370::265-376
MRSALNNVVLNPPWNVPTTLVRQDIVPKVKQDPSYLYKHGYTLLSGWSADAEVIDPSMIDWHMVSAASFPYRIRQAPGASNSLGRYKFNMPSSDAIYLHDTPNHGLFQRDIRALSSGCVRVNKASELADLLLQDAGWNDSRISDTLKQGDTRYVPIRHRIPVNLYYLTAWVADDGQPQYRTDIYNYDNPARSGSQTGFAHSVTDCGLTAHQAAVTVRPSAGLSLLPGAALASVSTSRPRVLTLSNMHTGETLKTEFFNGKSYDKDELARLNHFFRDYRANQVKHIDPHLFDQLYRLQTLLNTRKPVQLISGYRTLATNNMLRESGPGVAKHSYHTKGQAMDFHIEGISLSNVRKAALSMRAGGRCVCRSWSAMNYLIIPVTAFSQNCSVIWDDETQQAALVDPGGDAETIIAVLAERGLTPSQILLTHGHLDHVGAAAELAQHYQVPIVGPQPADAFWLDNLPTQSRMFGLPECAPLTPDRWLEEGETVQLGNVTLEVLHCPGHTPGHIVFFDRAGRLLISGDVIFNGGVGRTDFPQGSHSDLIAAIRDKLLPLGDDVTFVPGHGPISTLGHER

SEQ ID NO: 173314 - protein, 77 aa, Glycine max
  Coding DNA Sequence Number=SeqID_56536
  Subcellular localization annotation: CTP_CleavageSite=14; ConfidenceScore=5.29e-01
MVVSFFLTHLLPEVASPLNSSSSPFPLPLKFKKQRTPLMKKIQGLQAPMELRHIVTKASRISANYINSCLTLAWFLC

SEQ ID NO: 173315 - protein, 188 aa, Glycine max
  Coding DNA Sequence Number=SeqID_56537
ETTLVSACYQAFRLTDIKKVYTDNHSGISARQRDSKVSMTDLVSAEDDAFRLTNSKKVYTDNHSGISAGQRDSKFSMRDLVSAEDDAFRLTDSKKVYTDNHSGISARQRDSKVSMTDLVSAEDYAFRLTHSKKVYTDNHSGISARQRDSKSETTLVSVCYQLFVLQIAKKNVYTENHSGISARQRDSK

SEQ ID NO: 173316 - protein, 257 aa, Glycine max
  Coding DNA Sequence Number=SeqID_56538
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=4e-26, Identity=26%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
HALVLRELHAFDFRELHVVAFRGLHVLDFRGLHVLDFRGLYALAFGGLHVLAFRGLYVLAFGGLHILDFIGLHVLHFRGLHALALRRLHVLAFRGLHTLAFRGLQGLAFRGLHILAFRGLHILVFRGLYVLAFGGLHVLEFKRLHVLDFRGFHILAFRGLHILAVRGLHALTFRGLQALAFRGLHILAFRGLHVLAFRGLHVLDFRRLHVVDFRGLQALAFRGLHILTFRGLHILTFRGLHALDFRGLHVLVFIGLH

SEQ ID NO: 173317 - protein, 451 aa, Glycine max
  Coding DNA Sequence Number=SeqID_56539
  Gene Ontology: Mol. function=GTPase activity; Cellular component =intracellular; Biological process=small GTPase mediated signal transduction
  Homolog annotation: Hit_ID=Q1GXL7; Match level="QueryCoverage=94%, HitCoverage=95%, E-value=1e-168, Identity=69%"; Hit description=TRNA modification GTPase TrmE
  Pfam annotation: Domain name=Dynamin_N; Domain location=223-337; Score=-30.2; E_value=0.0047; Accession=PF00350.13; Description =Dynamin family
  Pfam annotation: Domain name=GTP_EFTU; Domain location=218-397; Score= -56.0; E_value=0.0035; Accession=PF00009.17; Description=Elongation factor Tu GTP binding domain
  Pfam annotation: Domain name=MMR_HSR1; Domain location=221-338; Score= 146.5; E_value=7e-41; Accession=PF01926.13; Description=GTPase of unknown function
  Pfam annotation: Domain name=Miro; Domain location=222-338; Score =16.0; E_value=0.00015; Accession=PF08477.3; Description=Miro-like protein
  Pfam annotation: Domain name=Ras; Domain location=222-378; Score= -95.4; E_value=0.04; Accession=PF00071.12; Description=Ras family
  Pfam module annotation: Pfam domain module=Dynamin_N::GTP_EFTU::MMR _HSR1::Miro::Ras; Domain location=223-337::218-397::221-338::222 -338::222-378
MANNQALSTDTIAAIATAPGAGGIGVVRVSGPLAAEIARQVLGHCPAPRHAAYLSFLQSDATLIDRGIAIYFPNPHSYTGEDVLELQAHGGTALMQILLERCIECGARHAQAGEFTQRAYLNDKLDLAQAEAVADLINAATVEAARSAVRSLSGEFSQTIQNLLQQLIDLRMYVEACLDFPEEEIDFITQGRVMEKLQANQAALEVIFNQAKQGLLLREGINVVLIGQPNVGKSSLLNALSGEEVAIVTPIAGTTRDTIKSAIQIEGVPLHIIDTAGLRETEDAVEQVGIARTWKAIETAHVALLLIDSQHGIGPLETAILTKLPVEVKKVWVHNKIDVSRETSRVEKNENGQHVFLSAKTGDGIPGLRKTLLDIVGYQPGGEGVFMARARHLQALQMVKHHLDQAMKQMHAAELVAEELRCAQEALGSITGEFTPDDLLGEIFSRFCIGK

SEQ ID NO: 173318 - protein, 235 aa, Glycine max
  Coding DNA Sequence Number=SeqID_56540
  Gene Ontology: Mol. function=DNA binding
  Homolog annotation: Hit_ID=Q2XMU7; Match level="QueryCoverage=87%, HitCoverage=86%, E-value=6e-26, Identity=34%"; Hit description =Putative antirepressor of prophage CP-933N
  Pfam annotation: Domain name=ANT; Domain location=107-221; Score= -45.5; E_value=0.029; Accession=PF03374.5; Description=Phage antirepressor protein
MMISTESLAALNATLLMSSREIARITGITHGEVKRLIKSLETAQRLSQPVTVNHYEHEGETRQEFQLNKRDSLLAVARLSPGFTAELLDRWQEREKFTHLPDFTNPAEAARAWAEQFEQRRAAEQQLALTAPKAEFFDRFVDVHESLGFRQLCKMLKVKEPEFRQFLLERNIMYRDKGALTPQQHHLQAGYFALRSGMGENQHAFSQARFTAKGVKWVASLWAGHVAARPNGVAA

SEQ ID NO: 173319 - protein, 75 aa, Glycine max
  Coding DNA Sequence Number=SeqID_56541
MEVSMRTTLMKLPQMAHYLDIPCTTLARAMCNRGTLEKLPLPAAVDNSMPLSSRCWSREEVRQFRHRLQRRRHQR

SEQ ID NO: 173320 - protein, 82 aa, Glycine max
  Coding DNA Sequence Number=SeqID_56542
MKNPWQLTPYPLSLTDFFRQLLRTEEEGSDTEKGNVGILETMEAHKEVNGVQVVTAWVKIFTAHNNPTAVAFEELLCYLWEL

SEQ ID NO: 173321 - protein, 87 aa, Glycine max
  Coding DNA Sequence Number=SeqID_56543
  Homolog annotation: Hit_ID=Q9FMX9; Match level="QueryCoverage=39%, HitCoverage=7%, E-value=1e-10, Identity=80%"; Hit description=Serine carboxypeptidase II-like protein
MVVISLSMKLKEEHCSIGFSRPLTNQNKNPFSYGSVEQGKVEEGRLQCQGASLVTEQVIAFLVRLSNWHPRIVFLLEVFMLNIFTYS

SEQ ID NO: 173322 - protein, 115 aa, Glycine max
  Coding DNA Sequence Number=SeqID_56544
  Gene Ontology: Mol. function=RNA-directed DNA polymerase activity; Cellular component=mitochondrion; Biological process=RNA-dependent DNA replication
MVLLRCVTTNEAEQILLDVHEGSFGTHANGHVIARKILIAEYYWITMENDCCVHVRKCHKCQAFADNVNAPPMSLNVLSAPWPFSMWGIDVIGAIKPKASNEHCFILIAIDYFTK

SEQ ID NO: 173323 - protein, 52 aa, Glycine max
  Coding DNA Sequence Number=SeqID_56545
MDPVKYIFEKPAFTGRIARWLIRQVCEVLIFTFSLSKSAGLASHPLSATLPG

SEQ ID NO: 173324 - protein, 251 aa, Glycine max
  Coding DNA Sequence Number=SeqID_56546
  Gene Ontology: Mol. function=transcription factor activity; Cellular component=intracellular; Biological process=regulation of transcription, DNA-dependent
  Homolog annotation: Hit_ID=Q5PEP9; Match level="QueryCoverage=99%, HitCoverage=74%, E-value=1e-103, Identity=72%"; Hit description =Possible regulatory protein
  Pfam annotation: Domain name=LacI; Domain location=2-27; Score=44.1; E_value=4.8e-10; Accession=PF00356.11; Description=Bacterial regulatory proteins, lacI f
  Pfam annotation: Domain name=Peripla_BP_1; Domain location=59-251; Score=-70.4; E_value=0.062; Accession=PF00532.11; Description =Periplasmic binding proteins and sugar b
  Pfam module annotation: Pfam domain module=LacI::Peripla_BP_1; Domain location=2-27::59-251
  Subcellular localization annotation: CTP_CleavageSite=29; ConfidenceScore=5.21e-01
MATMLDVSLRAGVSKATVSRVLNGTGQVKESTRQQVFAAMEELGYRPNFLARSLANQTSNSIGLVVSTFDGFYFGRLLQQASRQTETHGKQLIVTDGHDAPEQEEQAVQMLADRQCDAIVLYTRYMSEKAIIKLMNTVQTPLVVINREVSQAPDRCVFFEQQDAAFKAVDYLINQGHREIACITVPIHTPTGKARLMGYRKALEKHGIRLDERRIKYGDAGMTRGYELCKELIADGVPFSALFACNDDMAL

SEQ ID NO: 173325 - protein, 33 aa, Glycine max
  Coding DNA Sequence Number=SeqID_56547
HLDVTLTSSVGPECVELISKVCGVDLYCSESNL

SEQ ID NO: 173326 - protein, 140 aa, Glycine max
  Coding DNA Sequence Number=SeqID_56548
  Gene Ontology: Mol. function=nucleic acid binding
MATRMTLQLADRSITRPYGVIEDVLVKVKHLIFPADFIVIDIEEDVDIPLFLGRPFMSTATCVVDMGKKMLQMGIEDQKINFDLFHEDKDLPSQNVCLKVHVMEERRLKKKVLEKALSTACCAKPQMLTRLYNFKMGLAR

SEQ ID NO: 173327 - protein, 90 aa, Glycine max
  Coding DNA Sequence Number=SeqID_56549
MDLIENMGASDIAILRDRAHIPTKKSLLELTSQDALLAQKKLLSKQLEALTETLRCTICGGAHESGCCIPIEEHPTHEVNYMGNQPRNNF

SEQ ID NO: 173328 - protein, 327 aa, Glycine max
  Coding DNA Sequence Number=SeqID_56550
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=97%, HitCoverage=96%, E-value=1e-115, Identity=66%"; Hit description =Photosystem I P700 chlorophyll a apoprotein A1
  Pfam annotation: Domain name=PsaA_PsaB; Domain location=1-235; Score=- 163.3; E_value=0.00069; Accession=PF00223.9; Description=Photosystem I psaApsaB protein
RPQDMFSDTAIQLQPVFAQWIQNTHALAPGTTAPVGGKVALLPIPLGTADFLVHHIHAFTIHVTVLILLKGVLFARSSRLIPDKANLGFRFPCDGPGRGGTCQVSAWDHVFLGLFWMYNSISVVIFHFSWKMQSDVWGSISDQGIVNHITGGNFAQSSITINGWLRDFLWAQASQVIQSYELIESIVWAHNEVKVAPATQPRALSIVQGRAVGVTHYLLGLAQDPTTRRIWFGIATAHDFESHDDITEERLYQNIFASHFGQLAIIFLWTSGNLFHVAWQGNFEAWVQDPLHVRPIAHAIWDPHFGQPAVEAFTRGGALGPVNIAYS

SEQ ID NO: 173329 - protein, 70 aa, Glycine max
  Coding DNA Sequence Number=SeqID_56551
  Gene Ontology: Mol. function=transferase activity
MTSIAYYKLEMQEGFQGQYRRGDHCKSTIIFEVVTSQDLWIWHAFFGVASSNNDINVLNQSLVFDDVLQG

SEQ ID NO: 173330 - protein, 97 aa, Glycine max
  Coding DNA Sequence Number=SeqID_56552
  Gene Ontology: Mol. function=nucleic acid binding
MTVADSIKIALPKTDNAKEFMSILTTMKFDDSRTMHDHVIEMTNVAARLKTLGMAVNENFFVQFILNSLPSEYDSFQMSYNTLKHKWNMHELHSMLV

SEQ ID NO: 173331 - protein, 103 aa, Glycine max
  Coding DNA Sequence Number=SeqID_56553
MVKAHQKGVRKTNENKNKSMRNKWGPLRVHRMNCFYQKALPSVGTPWKAQRSSEGCMPPNNGPRKKLGYDTVSQPTLRREGDAGLTGTSSKKGKCAESPPTLI

SEQ ID NO: 173332 - protein, 73 aa, Glycine max
  Coding DNA Sequence Number=SeqID_56554
MTKARQKGVRKLNEMKIKVRETSGDHQGEKRQKLATQLDQASSVASSRRHRLLEELPGRPKWTWLLFAPPHIY

SEQ ID NO: 173333 - protein, 106 aa, Glycine max
  Coding DNA Sequence Number=SeqID_56555
  Gene Ontology: Mol. function=electron transporter, transferring electrons within cytochrome b6/f complex of photosystem II activity; Cellular component=integral to membrane; Biological process=electron transport
  Homolog annotation: Hit_ID=P56773; Match level="QueryCoverage=98%, HitCoverage=59%, E-value=3e-46, Identity=95%"; Hit description =Cytochrome b6
  Pfam annotation: Domain name=Cytochrom_B_N; Domain location=1-101; Score=45.4; E_value=2e-10; Accession=PF00033.9; Description =Cytochrome b(N-terminal)b6petB
MVGKYDGLNDDPTLLAVLTASFGVTGYSLPWDQIGYWAVKIVTGVPDAIPVIGSSLVELLRGSSSVGQSTLTRFYSLHTFVLPLLTAVFMLMHFSMIRKQGISGPL

SEQ ID NO: 173334 - protein, 136 aa, Glycine max
  Coding DNA Sequence Number=SeqID_56556
MTTFTWIWMRCYLSNILPGDHNANLPLQMYRLGSRPQDPSGPEEVQQGPGVSSSGYGPLSVLQGARSPSEESHPQRHPVDPEKSNRALGFPALVTGLCSPTGCLFPPARSRHHRDRVCKAPSGPEEVQQGLGVIKL

SEQ ID NO: 173335 - protein, 111 aa, Glycine max
  Coding DNA Sequence Number=SeqID_56557
MGEMLAIQLAQASKVTSSRSNRLLEESSGGPKWAWLLFAPPFVTETYEFRNDTCFLSVMLRNLADYIIIPFLTYGMLRNLTNCATMLPFEFRHVTELHKLPDDGCQVPQNG

SEQ ID NO: 173336 - protein, 135 aa, Glycine max
  Coding DNA Sequence Number=SeqID_56558
MILEDKLKACQRSKRNLTKQLSRTEENMWAIIDQYKEKQNLAITREQRLEDEHAKVSVLQVEREARERVIDSLHREAMMWMDRFTFTLNGSQELPRLLAKAKVMTNVYSAPEEVDGLFDYCQHMIKLMSHIIRNR

SEQ ID NO: 173337 - protein, 171 aa, Glycine max
  Coding DNA Sequence Number=SeqID_56559
  Gene Ontology: Mol. function=oxidoreductase activity; Cellular component=cytoplasm; Biological process=antibiotic biosynthetic process
  Homolog annotation: Hit_ID=UPI0000E693F0; Match level="QueryCoverage =68%, HitCoverage=86%, E-value=4e-23, Identity=49%"; Hit description =antibiotic biosynthesis monooxygenase family protein
MRKAQLKGLKKAPHRGETLVISRRDGCQIIQPQRLGEQALHLADKGLEVGLGDMLIQRLLVAPGLTHVEGIRRVAQLKQRVVEIARLLAGWQQQRLQRVAQGLGLPGFRLQNRDKRNGVVAHLETLQHDFADRAPGFQLSVGFLQIGGVDSAVVFAKGSAQRVIVNQRGDA

SEQ ID NO: 173338 - protein, 60 aa, Glycine max
  Coding DNA Sequence Number=SeqID_56560
  Gene Ontology: Mol. function=oxidoreductase activity, acting on the CH-OH group of donors, NAD or NADP as acceptor; Cellular component =cytoplasm
  Homolog annotation: Hit_ID=Q0Z3M2; Match level="QueryCoverage=83%, HitCoverage=14%, E-value=2e-13, Identity=82%"; Hit description =Alcohol dehydrogenase, zinc-binding:Alcohol dehydrogenase GroES- like
MCRSPLPTAASAIPISIRREREWAGTLYPCVPGHEIVGRVTAVGDAVSGLRRLAIWWASA

SEQ ID NO: 173339 - protein, 106 aa, Glycine max
  Coding DNA Sequence Number=SeqID_56561
MLKLRRAKRDQSRVEGMILEDKLKTCQRSKRSLFGELSKTEGNMWAIIDQYKEKLSLVATHEQRLEDEFAFTLNGSQELPRLLAKAKAMVDVYSAPEEVHGLFDYC

SEQ ID NO: 173340 - protein, 86 aa, Glycine max
  Coding DNA Sequence Number=SeqID_56562
MNCVFVHASSTLEFGAMRSDCLVQFSIFNPFLEPMNCVPVHASSTHEFGAMRSDCLVQFSILNPFSEPMNCVFVHASSTLEFGAMR

SEQ ID NO: 173341 - protein, 172 aa, Glycine max
  Coding DNA Sequence Number=SeqID_56563
MDKAEAIPALIPNEELASMLLAICNGRTPMSPGDIHEGTDPPHHHWEAGFKVDMPCFISALNLFTTLMMMFMDVDEEHIQGIEPIFDNDDAVVDDELVLDHVSTLSMPHRIVLSYHSTKHNLHWTVVDSMTNLFDEGGNDVKVWRNHGLKRDQGVRGCESSTNEIQCPKRYI

SEQ ID NO: 173342 - protein, 48 aa, Glycine max
  Coding DNA Sequence Number=SeqID_56564
MENWQTALRNNFAGLQTRREWRIGEQRYAITSRGSRLEGGGHMNNARQ

SEQ ID NO: 173343 - protein, 269 aa, Glycine max
  Coding DNA Sequence Number=SeqID_56565
  Homolog annotation: Hit_ID=Q1S328; Match level="QueryCoverage=51%, HitCoverage=17%, E-value=3e-07, Identity=27%"; Hit description =Disease resistance protein
  Pfam annotation: Domain name=RPW8; Domain location=3-144; Score= -30.0; E_value=0.016; Accession=PF05659.2; Description=Arabidopsis broad-spectrum mildew resistance protein RPW8
MALLIEATVGAVFNESLRTVLEFKNKTVCFKSSLVHLQSTLVAISPVIKEIEQQNNELKLPKEELQSFIRKMEEGTQLVFECSKIRWLHFVTRACYKDKLDQFSDELVKLFAIDMQAQMARDRKETLLKVRRILRVVEKTCFDPGEAIDNTVLRYSEVTEIVSVSWLKILGRIKTGMLSPNTLYRAYLVFKESSDGTWRKLGVQYPKESDDGGWRCLGRETSLRGHAIGTQPSWPMDFGMLRIMWTGLGTNLKAVNSLPSFMVSVMSAI

SEQ ID NO: 173344 - protein, 744 aa, Glycine max
  Coding DNA Sequence Number=SeqID_56566
  Gene Ontology: Mol. function=RNA-directed DNA polymerase activity; Cellular component=chromatin; Biological process=chromatin assembly or disassembly
  Pfam annotation: Domain name=RVP_2; Domain location=298-415; Score= -37.4; E_value=0.00082; Accession=PF08284.2; Description=Retroviral aspartyl protease
  Pfam module annotation: Pfam domain module=RVP_2::RVT_1; Domain location=298-415::547-729
MAEHGTCRTTTDHLEEAIAALTEKHSNLANKFEAMCERLSHMSSTAPPPPQIPRPPVKLDVPRFDDHDPLGWIFKISQFFDYQGTPEEDRIMERIHHFVASSPPSNRIPLRSLDLQRPPRSFVEADSTRYSNGTVIVGSPQLFHLRPESEICREVQAFHPVSLPKATALARLQEDKINDHRKHVRSSFGHPPPSNTTPSNPHTTQTARPKPPFVQRTQEDMAYRREKGLCYNCDEKWSSSHHCKGRVLFFIANSDESPPSEMVTAKPSNPSITELDPIIDDPSQLFDPTSLQPHISLHAMAGVPATDTFRLYGLINNTRVTILVDSGNTHNFVQPRVTKFLNLPMQDRMPLRVMVGNGSILDCQQLCPDTKILIQDHTFVVTLRVLLLSGTNVVLGVEWLRTLGPIVTDYTAFTMQFTFFGRPINLLANVQVDTYPVSAHQVKRLITTNSTSGLFHLSLLPIPQPETASDPPHPIPAIDELLIKYQSLFNQPSSLPPPRQHDHQINLIPSTNPINVKPYRYPYFQKTEIEKQVMTLLDSGLIQPSCSPFSSPVLLVKKKDGTWRMCIDYRALNSITVRDRFPLPTIEELLDELGHASWFSKLDLRQGFHQNLMAERDIPKTTFRTHQGHYEYRVMPFGLCYAPSTFQVAMNTLLSPFLRKFTAVFFDDILLDYLGHVISDKGVQPDPSKIQAIIDWPNPRSPKDLRTFLGLTGFYRKFVKGYVAIAAPLTKLLCKDAFKWILDS

SEQ ID NO: 173345 - protein, 107 aa, Glycine max
  Coding DNA Sequence Number=SeqID_56567
MEEWEKFNHIEERLRAIEGGGDHAFADMAELCLVPNVKGTTCPKNHLKVYNRKIRAYAKDEKLLMHFFQESLTEAAVTWMQLQNMCDEILPRKGLVTRAMSKRLQED

SEQ ID NO: 173346 - protein, 1008 aa, Glycine max
  Coding DNA Sequence Number=SeqID_56568
  Gene Ontology: Mol. function=RNA-directed DNA polymerase activity; Cellular component=chromatin; Biological process=chromatin assembly or disassembly
  Pfam annotation: Domain name=RVP_2; Domain location=325-450; Score= -27.1; E_value=0.00013; Accession=PF08284.2; Description=Retroviral aspartyl protease
  Pfam annotation: Domain name=RnaseH; Domain location=834-953; Score= -19.6; E_value=0.0039; Accession=PF00075.14; Description=RNase H
  Pfam module annotation: Pfam domain module=RVP_2::RVT_1::Retrotrans _gag::RnaseH; Domain location=325-450::574-743::95-185::834-953
MAEHGTRRATTDRLEEALTTLAAKHSELASRVDAMCERFSSIPPYQQPSSSPRIHQRPPVKLDVPRFDDHDPLGWIFKISQFFDYQATPEEDRITVASFYLDGAALSWFQWMYRNGFITTWQALLHAIETRFTPSIYDDPRGTLFKLVQRGSVTEYMTEFERLANRIVGLSLSDLLSCFISGLNPEIRRELQAFQPVSLPHATALARLQEDKINDRRKNSRPSSLIPQTSTPQSSTLTQHPRPKTPFIQRTPEDMMHRREKGLCYNCDEKWSSSHRCKGRVLLFIADSDAPSASDNNLHETLPQPLTETPPPYDPSLLQPHISLHVMAGVPATDTFRLYGVINHARVTILIDSGSTHNFIQPRVAKFLGLNMEETMALKVMVGNGSVMECRQLCPATTLLIQNHLFTVTLRVLPLSGADVVLGVEWLRTLGPIITDYTSFTMAFTYLDQPITLHADVSSNTDPTSAHQLRRSIHTHSISGLFHLSLLPVIQPEPDSDPPHPNPAINTLLLKYQNLFQQPSTLPPPRQHDHHINLIPSAHPVNVRPYRYPHSQKNEIEKQVTALLESGLIQPSRSPFSSPVLLVKKKDGTWHMCIDYRALNAITIRDRFPIPTIEELLDELGHASWFSKLDLREGFHQILMADSDIPKTAFRTHNGHYEYRVMPFGLCNAPSTFQAAMNALLNPFLRKCVAVFFYDILIYSETLPDHLLHLECIFGALSQAQYYLKRSKCSIGQRQLDYLGHVVSGKGVQPDPSKVQAIIDWPTPRSSKDLLSFLGLTGFYRKFIKGYAGLAAPLTRLLCKDAFQWTMESQSTFNSLKTAMTTAPILTLPNFNLPFVLETDASGSAIGAVLQQQGHPIAYFSKPLCPRLQHASAYVRELHAITAAVRRWRQYLLGHRFTVYTDQRSLRELMSQVVQTPEQQFYLAKLLGFDYDIQYKAGSSNIVADSLSQIDCLSQAQCLILSIPHHEFMTQLKETFKASPEFQQQRAAVLAHLEQYRDFAISGDLILF

SEQ ID NO: 173347 - protein, 46 aa, Glycine max
  Coding DNA Sequence Number=SeqID_56569
MPVMMFLAFLQQGTTRDVLEGKPHALSISRTTYRFTYMMYHALETS

SEQ ID NO: 173348 - protein, 266 aa, Glycine max
  Coding DNA Sequence Number=SeqID_56570
MTVVVDEGSLKFEEKPVKVDSDPFHIQANYIEPMQIMMMGASIGSPKLNTSLSKEEVNQALEEFKKEEESVFPLVRESLVEFLSKKHKSEKKRKSHVPHANVSSNKWFLPRNKGSNSSFKAFGVNDLMIRRGGTTAGSKKEYYEYQNPPWVNRNMSKTQWRRHQRMKRDAILGMQQNNGVRPLVLNRITEGLPPGFEKKRLRKEQEDKEVIIDCFEYSFEDSLEAICGVISILPADYAEDYQNEHMLRDCAREDYLDDPFLSPKVV

SEQ ID NO: 173349 - protein, 106 aa, Glycine max
  Coding DNA Sequence Number=SeqID_56571
MSPLKLEIQLSRHWHWQDSADVEPAALAKQVRLGQLGMVLQSRGAVVQDGFTNMAGEFVLKVSRHCCWRERCLRGTHACKLKVAAYKKQAFPETFSERVSQVGVAE

SEQ ID NO: 173350 - protein, 110 aa, Glycine max
  Coding DNA Sequence Number=SeqID_56572
MRLVRIRDNENDGMPNIDSAMHACILPACMYIVSMHGEIRLHWTRGCSASVTGEIAGTVFATLTGDFGAEGAGKVQRAQDSSRAVGFRLSWFRNQCWRNKEHISPMVLTK

SEQ ID NO: 173351 - protein, 142 aa, Glycine max
  Coding DNA Sequence Number=SeqID_56573
IKTGMLSPNTLYGAYLVFKESSDGAYGFKNMPVEVSIGVIREVTDSRIMNLVVGSSESSIRGRVTMVDGVLHDFLADTCRDDATVQVPVPKVLSPLPPPSDVVPLGPDALDESASMKAFVLCSVSNHLNIETRHLTRQRTRL

SEQ ID NO: 173352 - protein, 79 aa, Glycine max
  Coding DNA Sequence Number=SeqID_56574
  Homolog annotation: Hit_ID=Q1RST0; Match level="QueryCoverage=90%, HitCoverage=6%, E-value=4e-16, Identity=76%"; Hit description =Peptidase S1 and S6, chymotrypsin/Hap; Immunoglobulin/major histocompatibility complex; ...
  Homolog annotation: Hit description=AAA ATPase, central region
MAPGEKFCLLLKIIGLQKLGLGLINQSQMAMILEAFVRMIVGSFVLVDDSRGDDADKVAINDIFEVVPVLYRSKRCLYS

SEQ ID NO: 173353 - protein, 94 aa, Glycine max
  Coding DNA Sequence Number=SeqID_56575
MQQTSLHAEQNPNNNWSVILKDMEMLNCGWTLNTKQRPSWRQTHRAHQGQEEQHRREVEVATEPWGRGPERWRHPCTCRRGSRGALKRRGAQEP

SEQ ID NO: 173354 - protein, 407 aa, Glycine max
  Coding DNA Sequence Number=SeqID_56576
  Gene Ontology: Mol. function=peptidase activity; Cellular component =integral to membrane; Biological process=aromatic compound metabolic process
  Homolog annotation: Hit_ID=Q84SE0; Match level="QueryCoverage=96%, HitCoverage=96%, E-value=1e-110, Identity=53%"; Hit description =Putative TPA: Cgi67 serine protease
  Pfam annotation: Domain name=Abhydrolase_2; Domain location=59-268; Score=-68.4; E_value=0.01; Accession=PF02230.7; Description =PhospholipaseCarboxylesterase
  Pfam annotation: Domain name=BAAT_C; Domain location=136-285; Score= -76.1; E_value=0.013; Accession=PF08840.1; Description=BAAT  Acyl-CoA thioester hydrolase C t
  Pfam module annotation: Pfam domain module=Abhydrolase_2::BAAT_C; Domain location=59-268::136-285
MGCMVSQLAAKFAFFPPSPPTYQLKKSGEDGKLTVVSAAAPIPHADDTSLDVLLVDTKHGNKIVAFYLRNPYARLTLLYSHGNAADLGQLYDLFVQLKVNLRVNLMGYDYSGYGASTGKPSESSTYADIEAIYECLETEYGVSQEDVILYGQSVGSGPTLHLAAKLPRLRGVVLHSGILSGLRVLCHVKFTFCFDIYKNINKIKKVKCPVLVIHGTEDDVVNWLHGNGLWKMARESYDPLWIKGGGHCNLELYPDYIRHLCKFIQEMESMTTEKRLKKIRQSANQSKSNTGCTCSRCCRVKCCRVKCPECSNCCCCMNVSWSINCPECCWRPSCKCCCFPKFRSCFGSICCTKWSWPSCCATKCSLSLPSCCCCYPKRARPNCCMSCFCWQCCVGKHSDGTNGKQNG

SEQ ID NO: 173355 - protein, 62 aa, Glycine max
  Coding DNA Sequence Number=SeqID_56577
MKRKLEYVAAYTIKNEQLTWPSVMNKHLNHPKDLEGEHMRWKLSHVPFNNRGHAISCYLRLR

SEQ ID NO: 173356 - protein, 69 aa, Glycine max
  Coding DNA Sequence Number=SeqID_56578
MSTSKSYGSHSYPKKDQGQGILRVTPSKPKDDKGKTIEKQAPKGYTRLVSNLSLAITPHPKALQTSMAQ

SEQ ID NO: 173357 - protein, 731 aa, Glycine max
  Coding DNA Sequence Number=SeqID_56579
  Gene Ontology: Mol. function=sequence-specific DNA binding; Cellular component=nucleus; Biological process=regulation of transcription, DNA-dependent
  Homolog annotation: Hit_ID=Q8LJS7; Match level="QueryCoverage=98%, HitCoverage=92%, E-value=0.0, Identity=63%"; Hit description =Homeodomain protein GhHOX2
  Pfam annotation: Domain name=Homeobox; Domain location=28-84; Score =82.6; E_value=1.2e-21; Accession=PF00046.19; Description=Homeobox domain
  Pfam annotation: Domain name=START; Domain location=227-452; Score =175.6; E_value=1.2e-49; Accession=PF01852.10; Description=START domain
  Pfam module annotation: Pfam domain module=Homeobox::START; Domain location=28-84::227-452
MESGSGSEQLVEDKSGYEQESHEEPTKKKRYHRHTARQIQEMESLFKECPHPDDKQRLKLSHELGLKPRQVKFWFQNRRTQMKAQQDRADNMILRAENETLMSENYRLQAALRNVICPNCGGPCIMGADMGFDEHQLRIENARLREELERVCCLTTRYTGRPIQTMAADPTLMAPSLDLDMNMYPRHFSDPIAPCTEMIPVPMLPPEASPFSEGGVLMEEEKSLALELAASSMAELVKMCQTNEPLWIQSSEGEREVLNFEEHARMFVWPQNLKNRSELRTEASRDTSVVIINSVTLVDAFLDAQKWMELFPTIVSRAKTVQIISSGASGLASGTLQLMCAEFQVLSPLVSTRETHFLRYCQQNAEEGTWAIVDFPVDSFHQNFHPSYPRYCRRSSGCVIQDMPNGYSRVTWVEHAKVEEKPVHQIFCNYVYSGMAFGAQRWLGVLQRQCERVASLMARNISDLGVIPSPDARKNLMKLAQRMIKTFSLNMSTSGGQSWTAISDSPEDTVRITTRKITEPGQPNGVILSAVSTTWLPYSHTKVFDLLRDERHRSQMDTLSNGNSLNEVAHIANGSHPGNCISLLRINVASNSSQNVELMLQESCTDQSGSLVVYTTIDVDAIQLAMSGEDPSCIALLPQGFKIVPMLSSPITDTTNSSEPPISLNNNSGGCLLTMGVQVLASTIPSAKLNLSSVTAINNHLCNTLHQIEAALSSTNSHENGFFLCTEPTKQ

SEQ ID NO: 173358 - protein, 326 aa, Glycine max
  Coding DNA Sequence Number=SeqID_56580
MDETSKPLAVDGGTDQWAASAVMDLGGPMFHAALLMALRETVAADHVSHVFYGHDGSVQYSSAASLLNQSLIEWTTTVYVDDQFYRRDPNYALLRDLACRPEHHPDLIIQAAAPERILDAEYRELLFERPGFASKISLIGARSEGASYINLYFSRSHPPAVPARGRARADLVGWPVRTRGPGGGPAAPGAHRQGSGPRTGPVADHGGDLQEPHLQEEQRGQPEGIPDQGAGRLRSALQRLIPAGGRQARAFTVFHKTHTKTGGTGAGSFPMIRGTARRPRRPGVVPAAPCRAGSFSCRCLSARSAAQAYPPRRAGPWAAGPKAIDA

SEQ ID NO: 173359 - protein, 88 aa, Glycine max
  Coding DNA Sequence Number=SeqID_56581
MEADHRLRERRLAEAANRFWRSRSRLKELAPSARERKRAIFPENGAGKGKLEKMLVEAEARAKEERERNGIEEKPFLYYNITQDGKRG

SEQ ID NO: 173360 - protein, 170 aa, Glycine max
  Coding DNA Sequence Number=SeqID_56582
MMSIKEIVEVSAAYQTRARARVMGEVEKVQEQMKADIEAMKEQMATMMEAIISMKKIREVDTVVVAATSAVAKVNPMPPSGLNQMNHPTLNMVGKDLGSTDGPMMCKFKTSTPSHHMACLPTIHHPMWHTLSMKISITPLRYSLRTNNLNLIRHISLKPWGRHMKFPTTI

SEQ ID NO: 173361 - protein, 236 aa, Glycine max
  Coding DNA Sequence Number=SeqID_56583
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=8e-32, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
FRGLHVLALRGLHVLAIRGLHALTFRGLHPLTFRGLHVLTLRGLHALAFRGLHALTFRGLHGYTSSPSEDYTSPPSENCTSSLFRELHALAIRGLHVLTFIGLHTLTFRGLHILIFKGLHVLAFVGLHALTFRGLHVLAIIGLHALTFRGLHVLTFRGLHVLAFRGLHALAIRGLHVLTFVGLHTLAFRGLHVLAFKGLHVLAFVGLHVLAFVGQHALTLQRATRPHLQRTARRRL

SEQ ID NO: 173362 - protein, 300 aa, Glycine max
  Coding DNA Sequence Number=SeqID_56584
  Gene Ontology: Mol. function=drug transporter activity; Cellular component=membrane; Biological process=polysaccharide biosynthetic process
  Homolog annotation: Hit_ID=Q12XY4; Match level="QueryCoverage=97%, HitCoverage=61%, E-value=7e-19, Identity=25%"; Hit description =Polysaccharide biosynthesis protein
  Pfam annotation: Domain name=Polysacc_synt; Domain location=2-247; Score=12.7; E_value=4.4e-05; Accession=PF01943.8; Description =Polysaccharide biosynthesis protein
MVARVFGPENMGRLSIVQSASAIFIFFATLGLDHFVVREFTRKPDDHELKCSLLITQTLGWLFYVAAVVIYFVIKGNLQHEIYLIANVTLSTFFLRVIYLKLYLQAINQAKVIAVAATTSRVFALIYLLIGTFMHFSYDIMIVYLPIQAFIQTVMMWFGYRKVVKSSEQPFTYSFKRMFPLLREAFPVLIATAVYYGYSQADVLIVSYFMNDHDVGIYAAAMRLIPQAAFVGHIAAITFYSSISVSFDKDFSLFLLQTKRVIKLQIMLAMCLVIIGSLLSTLIIYCLYGEKFMQSARGIL

SEQ ID NO: 173363 - protein, 39 aa, Glycine max
  Coding DNA Sequence Number=SeqID_56585
MVQLSAHRCAKPNIFTKALSVAAALSPKCLLEVTTSSWA

SEQ ID NO: 173364 - protein, 506 aa, Glycine max
  Coding DNA Sequence Number=SeqID_56586
  Gene Ontology: Mol. function=DNA binding; Cellular component =membrane; Biological process=DNA integration
  Homolog annotation: Hit_ID=Q1SKN1; Match level="QueryCoverage=91%, HitCoverage=36%, E-value=1e-131, Identity=47%"; Hit description =Integrase, catalytic region
  Subcellular localization annotation: CTP_CleavageSite=67; ConfidenceScore=5.84e-01
MMTHTANPNNPTHLTIPPANSPTSSTQDNSSSSPPWTPSLRRSTRTRHPPTYLQDFHRVLTSHADTSSTKVKYPLHFVLSYSHLSHSHKHFIMSITAIAKPNSYAEASSYDCWIKAMQVELKALQQNHTWILTPLPPHKKAIGCRWEGLDFLDTFSPVAKLTTVQMLLALAALCNWHLRQLDVNNAFLHGDLNEEVYMKLPPGLVVDNPNLICHLQRSLYGLKQASRKWFTRLSSFLFSQGFRQSSVDHSLFLYSNNDNTVTAILVYVDDIILAGDNLKSITHFTKFLDQTFSIKDLGILKFFLGLEVARSSHGIHLCQGKYALDILSDSGMLGSRPTSTPMDYSTRSPGSGIFFAAHSTLTLKAFSDSDWTGCRDTRCSITGFSVYLGDYLISWRSKKQSTVSRSSSEAEYRALASTTCELQWLSYLLHDFWVPFLQPATLYCDNQSAIQIASNPVFHERTKHIEIDCHIVRDKVNAGLLKLLPVSSSMQLADIFTKPLTPAIFQ

SEQ ID NO: 173365 - protein, 105 aa, Glycine max
  Coding DNA Sequence Number=SeqID_56587
MGKSQFTCKAFMFFVLWCNERNDDDIGVITKKKEEKTGVAVKDNENDGMPNIVQHLTTRWALPVTGSKMTSARMIRHVSVTDSWSYLTCRSDGDCCSRFRIRVHA

SEQ ID NO: 173366 - protein, 81 aa, Glycine max
  Coding DNA Sequence Number=SeqID_56588
MAGVCAGVEIGGAGAVEEEGAAVSSGLKLFRDLESDWTPLALHRAVIKAVNPSLDESCCAVREIWWEMRYPTFISIFIMMP

SEQ ID NO: 173367 - protein, 908 aa, Glycine max
  Coding DNA Sequence Number=SeqID_56589
  Gene Ontology: Mol. function=DNA binding; Cellular component=nucleus; Biological process=regulation of transcription
  Homolog annotation: Hit_ID=Q9FJS0; Match level="QueryCoverage=80%, HitCoverage=93%, E-value=0.0, Identity=57%"; Hit description =Arabidopsis thaliana genomic DNA, chromosome 5, P1 clone:MQD22
  Pfam annotation: Domain name=JmjC; Domain location=315-438; Score =187.5; E_value=3.2e-53; Accession=PF02373.13; Description=JmjC domain
  Pfam annotation: Domain name=JmjN; Domain location=114-157; Score =10.2; E_value=0.0029; Accession=PF02375.7; Description=jmjN domain
  Pfam annotation: Domain name=zf-C5HC2; Domain location=535-588; Score= 15.9; E_value=0.00088; Accession=PF02928.6; Description=C5HC2 zinc finger
  Pfam module annotation: Pfam domain module=JmjC::JmjN::zf-C5HC2; Domain location=315-438::114-157::535-588
MSLFIKCSRLWFPQNERPIHLVIDSSMVERRVTLSKEARNGLEFLKRKRLQRAKFVTATQTSVANMMSRSGNALRASASCGPRFHGNANVFSKRKVDKFDTNDLDWTDKILECPVYSPTKEEFEDPLIYLQKIAPEASKYVNRGIDTLTRQPGFLVLVSLLKSSLSICKIISPLSASVPAGVVLMKEKAGFKFTTRVQPLRLAEWDTEDKVTFFMSGRNYTFRDFEKMANKVFARRYCSAGCLPATYLEKEFWHEIGCGKMETVEYACDVDGSAFSSSPTDQLGNSKWNLKKLSRLPKSILRLLETSIPGVTEPMLYIGMLFSIFAWHVEDHYLYSINYHHCGASKTWYGIPGHAALDFERVVREHVYTNDILSSDGEDGAFDVLLGKTTLFPPNILLEHEVPVYKAVQKPGEFIITFPRAYHAGFSHGFNCGEAVNFAIGDWFPLGAVASRRYALLNRVPLLPHEELLCKEAMLLRTCLELEDSDFPSPDLFSHNSIKISFVNLMRFQHRARWFLTKSRAGISVSFHSHGTILCSLCKRDCYIAYVGCNCHKHHVCLRHDADSLDFNCGSKHTLYLREDIMDMEAAAKMFEQEDGILDEIRKQTKSDQNMYAYPLSNMFQGAEANGYTPYCELKLDSVAEFYATPEHSTNNQEYSSQYQSVFVHCSENQKPVVSEVSFSSATSTLCSLSESLESFSAPKNAEEHININATSIIDFEEFAERISNSACESSLSPAVYHERSVKPRGDLQRFDKKPVVNESDDSDSEIFRVKRPSSLKAERRNMNDAMSSKHTAQQGLKRLKKILPEGKSGQPMDFSRSNESSYKYGHPVNHKGHAEISSRDRFATGNGIPISIRCKKLGNEEISMQRDHNRRDRLQQTFREPPSMELEPKHLKVRGPSFLGLESSRSN

SEQ ID NO: 173368 - protein, 181 aa, Glycine max
  Coding DNA Sequence Number=SeqID_56590
  Gene Ontology: Mol. function=phosphoenolpyruvate carboxylase activity; Biological process=carbon utilization by fixation of carbon dioxide
  Homolog annotation: Hit_ID=Q6Q2Z9; Match level="QueryCoverage=95%, HitCoverage=16%, E-value=5e-66, Identity=71%"; Hit description =Phosphoenolpyruvate carboxylase
MTRSPSFNSSQLVAQRKLFAESQIGRTSFKRLLEPKVPQVPGIAPYRVVLGYIKDKLQRTRRRLELLIEDGPSEHDPMDYYETTDQLLEPLLLCYESLQLCGSGVLADGRLADLIRRVATFGMVLMKLDLRQESGRHAETIDAITRYLDMGTYSEWDEEKKLDFLTRELKGKRPLVPPSIE

SEQ ID NO: 173369 - protein, 146 aa, Glycine max
  Coding DNA Sequence Number=SeqID_56591
ERSALEGRTRASSAGRSGSENVGLSNANVGENPMPRKPKGSSARFVHGGVIRGRENASSQSSSTRRYSAEVIHAILPGKARTTFNKWVPVPETDTGVPPHKGGRSDQARATVYQKHRSPQSREPTTEAPVNGGRNYNGPKVAKFLV

SEQ ID NO: 173370 - protein, 66 aa, Glycine max
  Coding DNA Sequence Number=SeqID_56592
MGSKIYPKVHENPRVFISSSSPSLLESSIQYPWGVELHHPLHLGKDLTSNPEVLHTLGSPPPPRHL

SEQ ID NO: 173371 - protein, 69 aa, Glycine max
  Coding DNA Sequence Number=SeqID_56593
IAPIRHPVDPKKSNRVLGFPALITDLCQFYRVPVTPNKVIKPPINKAFIEKYYASRRTQGEAPQQPGDD

SEQ ID NO: 173372 - protein, 198 aa, Glycine max
  Coding DNA Sequence Number=SeqID_56594
  Homolog annotation: Hit_ID=Q8LM25; Match level="QueryCoverage=58%, HitCoverage=12%, E-value=6e-08, Identity=33%"; Hit description =Putative retroelement
MGKAATAIIKIETMTIAAIEENMMDVDAIKKGKGMIDTDAIKKEMRIMNTNTIRVKEKSKDVSQQKGKKPVKQAPRKFSPNFLEAIKAEIERLLEAKFIQTTRLKNKVEFRWEKEHQEAFDDIKRYLANLPVLVPPVKGIDFRLIWKLTLALSSLTGSGVYPDLSSFTGSGVYPDLSSFTGSGVIQKLYSLYQAIRAP

SEQ ID NO: 173373 - protein, 149 aa, Glycine max
  Coding DNA Sequence Number=SeqID_56595
MVSTGVSNETLAVLRQQIDHRDALAIPRNQPGNRHNVVIWPLMLLLGSPHYHQIRYTLAQLSKECFINTSLEERLRASIGTSKVNTPLSEKEINQALEEFEKEEEPVFPQASESLVDFLSKKKKAKKEIMLCPHCRAMLDRSTTKAFEA

SEQ ID NO: 173374 - protein, 79 aa, Glycine max
  Coding DNA Sequence Number=SeqID_56596
MGNARFLEEVKFGKEGNIRNVVFEEEPIIDSDSILIPIIVQGTTPVIENNVQIIFNDIILEQDNNRVLPQKPIEKPQQP

SEQ ID NO: 173375 - protein, 187 aa, Glycine max
  Coding DNA Sequence Number=SeqID_56597
  Subcellular localization annotation: CTP_CleavageSite=69; ConfidenceScore=5.32e-01
MTLASGVKGSKKTNKAKTDDRVRLLPKPLKFQLASKSTTSKPLKTKVSKGLNDFDEDVLISSSFKATSVATTKQKADKIVDLSSSQDPSQSGDNRNLPAGEKQVGVEVATDTFARMPIVETNIVEESPMEVREDLERETYPLDADLFSFIDIWSSDSMPSKASESSHNRNFTHFDAAVAKFRRLAFD

SEQ ID NO: 173376 - protein, 156 aa, Glycine max
  Coding DNA Sequence Number=SeqID_56598
MKAQVEKDEGPEAETLSRLLIVAEGPSNPCGVYPDLSSLTGSGVYPDLSSFTGSGVYPDLSSFTGSGVYPDLSSFTGSGVIQTFVACIKRSAPIWKLTLALTECSLTFVPLKAIKDQVLANFLVDHSNIEILECYSGIKPWILYLDGSNHINEDRN

SEQ ID NO: 173377 - protein, 143 aa, Glycine max
  Coding DNA Sequence Number=SeqID_56599
MSSRKRARTDDIPSSSIPAPHLRELAQNRPIVPLEYFLEKVAWPEAQLPLVRTNEAAPSRPALAQVEPMPAEPRTPVVNPPLSLELEVVPPSPPLIIISDASSDEAATPPEETVDPPASPVGGIDDLSDSSSGEVVALTDSPV

SEQ ID NO: 173378 - protein, 124 aa, Glycine max
  Coding DNA Sequence Number=SeqID_56600
  Homolog annotation: Hit_ID=Q1SWX1; Match level="QueryCoverage=73%, HitCoverage=17%, E-value=7e-11, Identity=36%"; Hit description=IMP dehydrogenase/GMP reductase
MGSSQKPSLKKRFYQVKVKGLDTTSIKELGRLMEPLQMQAFYKTYGKILELTIAEVSIEAIASLTQYYDQPLRCFTFGDFQLVPTIEEFEEILGCPLGGRKPYLSSGCLPSLSRIATVVKDSAR

SEQ ID NO: 173379 - protein, 129 aa, Glycine max
  Coding DNA Sequence Number=SeqID_56601
MDKAEAIVALIPNVKLNLLTCDVENYKRNTVLIKPYISEPYELLIALLQCTPYTKTNKPEQDPTFVNTEDQSYMMLSVPSLNSKLYACTKNRGADTTKFKEGHHKALLPQRLCIRKKGRKEDDLEADPR

SEQ ID NO: 173380 - protein, 97 aa, Glycine max
  Coding DNA Sequence Number=SeqID_56602
MDDSKLLIYEGSTTIHNVPLCSDQVKVDVEEVRDAYACVPIPTKKVQLVGQTLNTFLAWPTHLLQPFSEQGLEGPRKPVDRLDLDVDPLYLMTLTIA

SEQ ID NO: 173381 - protein, 156 aa, Glycine max
  Coding DNA Sequence Number=SeqID_56603
MFIDGLRPQTKQLLDASAGGKIKLKTPEAATELIENMLASDHAILHDRVHQPTKKSLLELSSHDTLLAQNKLLSRQLEILTETLGCTICDVAHETGQCIPIEENTQEVHYMGNQQRQGYTQGGFSGFLQGPYNHKDSGDHTLAINSTRTRVEDKIL

SEQ ID NO: 173382 - protein, 159 aa, Glycine max
  Coding DNA Sequence Number=SeqID_56604
  Gene Ontology: Mol. function=nucleic acid binding
  Homolog annotation: Hit_ID=Q1SXJ0; Match level="QueryCoverage=69%, HitCoverage=48%, E-value=2e-18, Identity=39%"; Hit description =F7F22.15, related
MTLQLADCSITRPYRVIEDVFTKVKHFIFPTDFVVMDISEDTDIPVILRRPFILTTSCIVDMGRRKLELGFEDQKIDFDLFVEDKPTPEQNVCLQVMEGGQEVLTPRAKRIFVHALSLESQVLSAQPLHLRLIWSAKLAKAELSQLQFNLNSTKLQPDC

SEQ ID NO: 173383 - protein, 69 aa, Glycine max
  Coding DNA Sequence Number=SeqID_56605
MARAGDNGGVYHQLDGSQCLFLDAMTTQMQRLLNRNKEELYRRIAKSSLFTLCHTLISSGDYNLMIYNH

SEQ ID NO: 173384 - protein, 82 aa, Glycine max
  Coding DNA Sequence Number=SeqID_56606
NPRAFSCISGPIYLEFSIQCPCGVVPSVVRLMKQGPYNQQGQWRTHPGNQFNKDQSGPSNSTESALKNLEVQWDNWAKQIAD

SEQ ID NO: 173385 - protein, 456 aa, Glycine max
  Coding DNA Sequence Number=SeqID_56607
  Gene Ontology: Mol. function=helicase activity; Cellular component =mitochondrion; Biological process=protein amino acid phosphorylation
  Homolog annotation: Hit_ID=Q1RY94; Match level="QueryCoverage=99%, HitCoverage=99%, E-value=1e-168, Identity=65%"; Hit description =Pentatricopeptide repeat
  Pfam annotation: Domain name=PPR; Domain location=151-185; Score =18.0; E_value=0.035; Accession=PF01535.11; Description=PPR repeat
  Pfam annotation: Domain name=PPR; Domain location=186-220; Score=2.4; E_value=3.9; Accession=PF01535.11; Description=PPR repeat
  Pfam annotation: Domain name=PPR; Domain location=259-293; Score =47.0; E_value=6.6e-11; Accession=PF01535.11; Description=PPR repeat
  Pfam annotation: Domain name=PPR; Domain location=294-328; Score =44.3; E_value=4.3e-10; Accession=PF01535.11; Description=PPR repeat
  Pfam annotation: Domain name=PPR; Domain location=329-363; Score =49.1; E_value=1.4e-11; Accession=PF01535.11; Description=PPR repeat
  Pfam annotation: Domain name=PPR; Domain location=364-398; Score =36.9; E_value=7e-08; Accession=PF01535.11; Description=PPR repeat
  Pfam annotation: Domain name=PPR; Domain location=399-433; Score =20.1; E_value=0.0082; Accession=PF01535.11; Description=PPR repeat
  Pfam module annotation: Pfam domain module=PPR::PPR::PPR::PPR::PPR::PP R::PPR; Domain location=151-185::186-220::259-293::294-328::329 -363::364-398::399-433
  Subcellular localization annotation: CTP_CleavageSite=43; ConfidenceScore=5.53e-01
MGKIPPSFRSAIANPNLRNPSSLFRPQPHHFPNKHQQPRKPSKQQQKPSSLPLFKSPNLEDAKKLFNSIANSSSDPRFPNSLLHSYAKLATTPSDSIKFFNHITKTLPSFSPDRSTFHILLSHASNNSNLLSPIHQTLNLMLAAGITPDTATADVAVRSLCSAGRLDHAVELIKEFASKHCPPDTYTFNFLVKHLCKSSTITTVYAFIDEMREKFDVKPDLVTYTILIDNVCNGKNLNLREAMRLVSVLHEEGFKLDCFVYNTIMKGYCVLSRGSEAIEVYNKMKEEGVEPDLVTYNTLIFGLSKSGRVTEARKLLRVMAEKGYFPDEVTYTSLMNGLCRKGDALGALALLGEMEAKGCSPNACTYNTLLHGLCKARLVEKAVKFYQVIRAGGLKLDTASYGTFVRALCRDGRIAEAYEVFDYAVESKSLTDVAAYSTLESTLKWLRKAKEQGLAI

SEQ ID NO: 173386 - protein, 90 aa, Glycine max
  Coding DNA Sequence Number=SeqID_56608
MIIDRSSEVAGDGDSLKTVAEIMTADEIYEIRSLSSLHHPLCIFSARLKVEIEVTSINEDAEGNQRLHVGEGSNDVVWEKKVATNSGRGK

SEQ ID NO: 173387 - protein, 69 aa, Glycine max
  Coding DNA Sequence Number=SeqID_56609
MEGRWMCGQGVAPNGCLLLLPRALGFCIVSHTGIWYIMQSVVITSQDHYELWLIWSLNSQEEKECFSYS

SEQ ID NO: 173388 - protein, 78 aa, Glycine max
  Coding DNA Sequence Number=SeqID_56610
  Homolog annotation: Hit_ID=Q1SU13; Match level="QueryCoverage=59%, HitCoverage=10%, E-value=1e-10, Identity=72%"; Hit description=IMP dehydrogenase/GMP reductase
MEVAATSEPERSLTIMNHPLCSFPGLSRSLSNELNQLLQPPGFDCNDLNEYFLLKPVVNLITYNILRQFSITVLECVS

SEQ ID NO: 173389 - protein, 163 aa, Glycine max
  Coding DNA Sequence Number=SeqID_56611
  Gene Ontology: Cellular component=mitochondrion
MEELKDGYIYENGKLVVHFLQAIHAAEKRQADLDVHVSNEQKKLLKKLKDVAARELMLAEEAAMLDRELKRERAKASLAIKALRQKMEDKLKTELEQKEIETDLKLKQTQELAKAYLNTTIANENAAIANENAAQIQKMAEANVNVRFLLKSKMGRCTHSKPF

SEQ ID NO: 173390 - protein, 44 aa, Glycine max
  Coding DNA Sequence Number=SeqID_56612
MESMGLARDIAQKELSFGYNNNISCSDPNMLHNAYTLTQDMGLE

SEQ ID NO: 173391 - protein, 254 aa, Glycine max
  Coding DNA Sequence Number=SeqID_56613
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=P19023; Match level="QueryCoverage=88%, HitCoverage=55%, E-value=3e-80, Identity=87%"; Hit description=ATP synthase subunit beta, mitochondrial precursor
  Pfam annotation: Domain name=ATP-synt_ab; Domain location=26-230; Score=148.9; E_value=1.4e-41; Accession=PF00006.15; Description=ATP synthase alphabeta family, nucleotide-binding domain
  Pfam annotation: Domain name=ATP-synt_ab_N; Domain location=2-47; Score=14.7; E_value=0.0075; Accession=PF02874.13; Description=ATP synthase alphabeta family, beta-barrel domain
  Pfam module annotation: Pfam domain module=ATP-synt_ab::ATP-synt_ab _N; Domain location=26-230::2-47
MTALEVLDHSSRLVLEVAQHLGEGVVRTIVMDASEGVVRGWHVLNTGSLIIRCMREGNDLYRGGFSVFAGVGERTREGNDLYREMIEIGVIKLDDKQTENKCAFVYRQMNEPPGARARVGLTGLTMAKHFRDAKGQDVLLFIDNIFRFTQANSDVSALLGRIPSAVGYQPTLSTDLGALQERITTTKKGSITYVQAIYVPADDLTDPAPAITFAHLDATTVLSRQVLGLSGKEKITMRRELLSPLMVRMFGNEF

SEQ ID NO: 173392 - protein, 82 aa, Glycine max
  Coding DNA Sequence Number=SeqID_56614
MIMNGVRIAHELQRRCSNQLQALLVVLQSHQNCLHHHQRWLHERAAMVVQASEDGGTRGERHWWLEGQTRLCEEATSMAKGQ

SEQ ID NO: 173393 - protein, 73 aa, Glycine max
  Coding DNA Sequence Number=SeqID_56615
  Gene Ontology: Mol. function=microtubule motor activity; Cellular component=microtubule associated complex; Biological process =microtubule-based movement
  Homolog annotation: Hit_ID=Q6YZ52; Match level="QueryCoverage=64%, HitCoverage=12%, E-value=8e-13, Identity=62%"; Hit description =Kinesin motor protein 1-like
MVFGHSLAALVIHMLDKLRLQAHSEQGDQRSPGIIPLAVKDAFSVIQEVVNDLLNPAGQNLRIREDAQLSLYH

SEQ ID NO: 173394 - protein, 53 aa, Glycine max
  Coding DNA Sequence Number=SeqID_56616
MVLKTCSTYYDASGIVKDLDNDNMLKFEYIIQVHDFVEFDLAEQLIWKYKIRP

SEQ ID NO: 173395 - protein, 70 aa, Glycine max
  Coding DNA Sequence Number=SeqID_56617
MEGSNKILTGKKEAAGRGGCLLQGCLAQHPHMCTCATVSCAALAPCTMCLPVPMLTKSGCATVAVATHYA

SEQ ID NO: 173396 - protein, 57 aa, Glycine max
  Coding DNA Sequence Number=SeqID_56618
MVIFHYGDAAEDKGKERASAKRNTLWLSARNNLEEDELYRFAERTVTTRLVATVSTL

SEQ ID NO: 173397 - protein, 135 aa, Glycine max
  Coding DNA Sequence Number=SeqID_56619
MENGVKVDFVQGAEEKANLVGREVGHGGQGMKKCHHREAEIGRRCQMILCDSVKSLDRMHETLGFAHFEGDARFWCTHPPFMLFVHEAQPPFASPLFFFSAFVSPCHFHWPLELLLLHWVSALRKCIERAIPPSR

SEQ ID NO: 173398 - protein, 626 aa, Glycine max
  Coding DNA Sequence Number=SeqID_56620
  Gene Ontology: Mol. function=RNA-directed DNA polymerase activity; Biological process=RNA-dependent DNA replication
  Homolog annotation: Hit_ID=Q1T5K4; Match level="QueryCoverage=46%, HitCoverage=41%, E-value=2e-42, Identity=30%"; Hit description=RNA -directed DNA polymerase
  Pfam annotation: Domain name=B_lectin; Domain location=415-520; Score= 105.7; E_value=1.4e-28; Accession=PF01453.15; Description=D-mannose binding lectin
  Pfam module annotation: Pfam domain module=B_lectin::RVT_1; Domain location=415-520::52-255
MEGRPNVGIEALLRCEANGTLHGLEVGLVEVSKQKLLELVVNFDTQKLRFLAFFYGGYYEIPKKVPFSEDPQHLGKFRPISLVGCMYKILAKVLPNRMKGVFSKVIDQRQSMFLGEKYLFHSALVVNEVIDEAKRLKKGYLFFKIDYEKAYDSGCLMSTRVSIFVNGSPMLEFMVSKGLRQGDPLDPFLFNVVVEGLCGLMRKALDKKLDSSFNVGNKGSKHVVMDEEEGVLERYANMLNSKLMHISFVYLGIPIATNPRKVETWKLINDKFAKMLLAWVENTRFCLLRGLRDEVSETLSIWWREIYKSCGGANDLKWFDESVERCMGNRDDILFWRDVWLGQQSMWVDHGCFWEQELLQNLQRDWEGHSSSFSLSVEKFKEDVIVSSPKGKFTAGFYPVGDNAYCFAIWYTQPPHTLVWMANRDQPVNGKRSTLSLLTTGNLVLTDAAQFMVWSTNTATSSKQVQLHFYDTGNLVLLDNSDNVVVLWQSFDYPTDTLLPDQTLTKNSNLISSRSGTNYSSGFYKLFFDSDNVLRLMYQGPRVSSVYWPDPWLLNNNLGIGGTGNGRTSYNDSRVAVLDEFGHFVSSDNFTFKTSDYRTVLQRRLTLDPDGSVRVYSKNDGEDKWS

SEQ ID NO: 173399 - protein, 346 aa, Glycine max
  Coding DNA Sequence Number=SeqID_56621
  Subcellular localization annotation: CTP_CleavageSite=13; ConfidenceScore=5.18e-01
MSKSDSSSSCLARSFKNSAWSMSSLMTALEESPSTICSHSRYSYTTNYSHHATEFSTPRDQVRIACLEHTMPLSSPLSACNVDNNNNSSTCLSDIDEWLEHSNKFCKSSIHLTESVHSGQSGSPEEEDSRLSAICSTYLAAQEHELHNITLPCVREDSSVFQGQSCISCTCKPPKFGGYERTRLMGPYDEFLDDIRRRKQEAERDARKKAKHVELILKLRRKENALNDWELQQTRKAMDKMDKIQAFISLEKIEGKAQASTDFTRLNRLLYIGRVHHPSNAVKNELERKQFKASARTQKKICLVREKAEKQKLKLRRSAMKRFQQIQTSKTRSPSEISWGSRLPLC

SEQ ID NO: 173400 - protein, 296 aa, Glycine max
  Coding DNA Sequence Number=SeqID_56622
  Gene Ontology: Cellular component=chloroplast inner membrane
  Homolog annotation: Hit_ID=Q9ZVH7; Match level="QueryCoverage=52%, HitCoverage=54%, E-value=8e-28, Identity=38%"; Hit description =Putative non-green plastid inner envelope membrane protein
  Subcellular localization annotation: CTP_CleavageSite=47; ConfidenceScore=5.02e-01
MTLRFESVVWALNPKLSHHRFSIPNLRRNPHSLFAPPPPPRIRTSFLAFEEGGGGEIEPEKNENNNDNRTGAEESWKQALDTFREQASKIRDASQEAYELYSEKAIAVLKDATEELRVAAKEIGDEGKQYLTVVAENSPEVKEVVESFTSPSRDLSEISQLRDFYVGVPYGSIAALRFGIVLGSVLLALGVSSLRAYKRGQPSSLMLKGQTAIASILFLREIRLLAAEDTKTSCGVRPSSEVAYHELVLPFIDLSSTLSICKWFFREKPMLGRLQEGEFALLLANEGFVRLSSFEV

SEQ ID NO: 173401 - protein, 1739 aa, Glycine max
  Coding DNA Sequence Number=SeqID_56623
  Gene Ontology: Mol. function=protein-N(PI)-phosphohistidine-sugar phosphotransferase activity; Cellular component=cytoplasm; Biological process=phosphoenolpyruvate-dependent sugar phosphotransferase system
  Homolog annotation: Hit_ID=Q1RY91; Match level="QueryCoverage=94%, HitCoverage=70%, E-value=0.0, Identity=80%"; Hit description=CCR4 -Not complex component, Not1
  Pfam annotation: Domain name=Not1; Domain location=1260-1652; Score =802.3; E_value=2.6e-238; Accession=PF04054.5; Description=CCR4-Not complex component, Not1
MIANLFEEYRFFPKYPERQLKIAAVLFGSVIKHQLVTHLSLGIALRYVLDALRKPADSKMFLFGSLALEQFVDRLIEWPQYCNHILQISHLRSTHSEIVAFIEQALARISSGHSDVDGASHASVISNHHSAQASLGHVEVVNDYSVGPIAVLSGSSVIQPGQQHLSMQLQQRRENPLDDRLKASVGSSTDVKPLLSSLGQSSVLTPTDASSTNKLHSTVSTSSMLSSSSPGFVRPSRGTTSARFGSALNIETLVAAAEKREIPIEAPGSEVQDKILFIINNVSAANIEAKAKEFTEILKEQYYPWFAQYMVMKRASIEPNFHDLYLKFLDKVNSKALNKEIVQATYENCKVLLGSELIKSSSEERSLLKNLGSWLGKLTIGRNQVLRAREIDPKSLIMEAYEKGLMIAVIPFTSKVLEPCQSSLAYQPPNPWTMGILGLLAEIYSMPNLKMNLKFDIEVLFKNLCVDMKDVTPTSLLKDRKREIEGNPDFSNKDVGASQSQIITDIKSGLVPPVNQVELPLEVTNPSNTGAHPHILSQYGGPLHISSGALMEDEKVTPLGLSDQLPSAQGLLQANPAPAPFSISQLPTQIPNIGTHVIINQKLSGFGLQMHFQRAVPIAMDRAIKEIVSSIVQRSVSIATQTTKELVLKDYAMESDETRILNAAHLMVASLAGSLAHVTCKEPLRASISGQLRTSLQNLNIANEILEQAVQLVTNDNLDLGCAVIEQAATDKAINTIDTEIGQQLSLRRKHREGMGSTFFDANLYPQGSMGGVPEPLRPKPGQLSLSQQRVYEDFVRLPWQNQSSQSSHSMSAGVAVQSGNTGLTGTNGSVSGQINPGYPVTTGASSINIRAADSVSQHSMEKDSVASFPSAASTPELHAVDSSEVKESGTSPQPLVTSGAVERLGSSFLEPSLTTRDALDKFQIVAQKLEAMVSNDSRDGEIQGVISEVPEIILRCVSRDEAALAVAQKVFRGLYDNASNNIHVSAHLAILTAIRDVCKLAVKELTSWVIYSEEERKYNKEITVGLIRSELLNLTEYNVHMAKLIDGGRNKAATEFSISLLQTLVVEEPKVISELHNLVDALAKLATKPGCPESLPQLLDMIKNPGALSSSNAGKEDKARQSRDNKGSGLLPANREEFNSVDSIEPDPAGFREQVSMLFTEWMVNLTSFIDFFPQELAVAHCLSTEMINSGSLQSQPLQTMSFLAIEIYAKLVFSILKGSNKLFLLSKILAVTVRFIIKDAEEKKASFNPRPLFRLFINWLLDLGSLEPVTDGANLQILTAFANAFHALQPLKVPAFSFAWLELISHRSFMPKMLTGNGQKGWPYIQRLLVDLFQFMEPFLRHAELGEPVRVLYKGTLRVLLVLLHDFPEFLCDYHFTFCDVIPPSCIQMRNIILSAFPRSMRLPDPSTPNLKIDLLQEITQSPRILSEVDAALKAKQMKVDVDEYLKTRQQSSPFLSELKDKLLLSPNEAASAGTRYNVPLINSLVLYVGMQAIHQLQGRTPHTQTSANAFPLAVFSVGAALDIFQTLIVDLDTEGRYLFLNAIANQLRYPNTNTHYFSFILLYLFAESNQEVIQEQITRVLLERLIVNRPHPWGLLITFIELIKNPRYNFWNRSFIRCAPEIEKLFESVSRSCGGPKPVDDSMVSGWIFLTEKGPKFIPALLQNLNLLPWPETKLKVQNISENPEEKNLTHEEHYSTQFVNWRSNSYYSQKGRRSCNSFPRPPTLESSIISFFAKS

SEQ ID NO: 173402 - protein, 294 aa, Glycine max
  Coding DNA Sequence Number=SeqID_56624
  Gene Ontology: Mol. function=nucleic acid binding; Biological process= DNA integration
  Homolog annotation: Hit_ID=Q1SEE1; Match level="QueryCoverage=65%, HitCoverage=14%, E-value=4e-61, Identity=61%"; Hit description =Integrase, catalytic region; Zinc finger, CCHC-type; Peptidase aspartic, catalytic
MQIEDYLYQKKLYQPLSGVKPEDMKQEEWNLLDRQALGVIRLTLAKNVAFNIVNEKTTVGLMKALSDMYEKPSAANKVYLMRRLFNLKMGEGISVTDHINEFHTILAQLESVQIKFEDEVKALILLSSLPDSWAATVTAVSSSTRENALKLSDIRDLILSEDVRKRDSGESSSHVSNSTLNTEGRGRTTQKGQNGRGRSKSRRKGFGLECGVKLPYVVARGPQTSMQVPHVARMASGTACPAGEAGWPEWLVGRASTAGGNVLGYKCEVKSHIGLPYVMARDPQVYPSNLPNIG

SEQ ID NO: 173403 - protein, 410 aa, Glycine max
  Coding DNA Sequence Number=SeqID_56625
  Gene Ontology: Mol. function=protein serine/threonine kinase activity; Cellular component=cell surface; Biological process =protein amino acid phosphorylation
  Homolog annotation: Hit_ID=Q2QWY4; Match level="QueryCoverage=88%, HitCoverage=45%, E-value=9e-79, Identity=42%"; Hit description=D -mannose binding lectin family protein, expressed
  Pfam annotation: Domain name=Pkinase; Domain location=120-403; Score =193.3; E_value=5.6e-55; Accession=PF00069.15; Description=Protein kinase domain
  Pfam annotation: Domain name=Pkinase_Tyr; Domain location=120-403; Score=100.4; E_value=5.4e-27; Accession=PF07714.7; Description =Protein tyrosine kinase
  Pfam module annotation: Pfam domain module=Pkinase::Pkinase_Tyr; Domain location=120-403::120-403
MDFKGSFFLRLPLSHEEYENPVQNNDNGGLVCGGEGGGAKLLERQYAEEKENGSVKLMLWFASALGGIEVVCIFLVWCFLFRNKNRKLHSGADKQGYVIATAAGFRKFSYSELKQATKGFSEEIGRGGGGTVYKGVLSDNRVVAIKRLHEVANQGESEFLAEVRIIGRLNHMNLIGMLGYCAEGKHRLLVYEHMENGSLAQNLSSSSNVLDWSKRYSIALGTAKGLAYLHEECLEWILHCDIKPQNILLDSDYQPKVADFGLSKLLNRNSNLNNSSFSRIRGTRGYMAPEWVFNLPITSKVDVYSYGIVVLEMITGRSPTAGIQITELEAASHHHERLVTWVRDKRRTRSKMGSSWVDQIVDPALGSKNYDRNEMEILATVALECVEDEKDARPSMSQVAERLQNHEPYT

SEQ ID NO: 173404 - protein, 808 aa, Glycine max
  Coding DNA Sequence Number=SeqID_56626
  Gene Ontology: Mol. function=protein serine/threonine kinase activity; Cellular component=cell surface; Biological process =protein amino acid phosphorylation
  Homolog annotation: Hit_ID=Q2QWY4; Match level="QueryCoverage=98%, HitCoverage=99%, E-value=1e-160, Identity=38%"; Hit description=D -mannose binding lectin family protein, expressed
  Pfam annotation: Domain name=B_lectin; Domain location=67-172; Score =101.3; E_value=2.8e-27; Accession=PF01453.15; Description=D-mannose binding lectin
  Pfam annotation: Domain name=PAN_2; Domain location=335-406; Score= -1.5; E_value=0.0019; Accession=PF08276.2; Description=PAN-like domain
  Pfam annotation: Domain name=Pkinase; Domain location=517-801; Score =176.5; E_value=6.4e-50; Accession=PF00069.15; Description=Protein kinase domain
  Pfam annotation: Domain name=Pkinase_Tyr; Domain location=518-801; Score=92.9; E_value=1e-24; Accession=PF07714.7; Description=Protein tyrosine kinase
  Pfam annotation: Domain name=S_locus_glycop; Domain location=201-323; Score=-29.7; E_value=0.0055; Accession=PF00954.11; Description=S -locus glycoprotein family
  Pfam module annotation: Pfam domain module=B_lectin::PAN _2::Pkinase::Pkinase_Tyr::S_locus_glycop; Domain location=67-172::335- 406::517-801::518-801::201-323
MASSTFLLPLFVSLIFHNFQHSSSFSLSVEKFKEDVIVSSPKGKFTAGFYPVGDNAYCFAIWYTQPPHTLVWMANRDQPVNGKRSTLSLLTTGNLVLTDAAQFMVWSTNTATSSKQVQLHFYDTGNLVLLDNSDNVALLWQSFDFPTDTLLPNQPLRKSTNLISSRSGTNYSSGYYKLFFDFENVLRLMYQGPQVSSVYWPYDWLRSNNIDYGIGNGRYTFNDSRVVVLDDFGYLVSSDNFTSKTSDYGMIIQRRLTLDHDGNVRVYSIKDGQDKWSVSGIFRRQPCFIHGICGPSSICSYEPASGRKCSCLPGYRWLDSEDWSQGCVPKFQLWCRNNNTEQDSRFLQLPEVDFYGYDYGFFLNHTYQQCVNLCLRLCECKGFQHSSSGQGGVNGQCYLKTQLLNGHRTPGYSRSFILRLPSSMHDYDENTINIGLVCGGNRGVQVLERPYVEEKENGSVKLMMWFASALGGIEVVCIFMVWCFLFRKNNADKQIYVLAAETGFRKFSYSELKQATKNFSEEIGRGGGGTVYKGVLSDNRVAAIKRLHEVANQGESEFLAETSIIGRLNHMNLIGMLGYCAEGKHRLLVYDYMENGSLAQNLDSSSNVLDWSKRYNIALGTARGLAYLHEECLEWILHCDIKPQNVLLDSDYQPKVADFGLSKLLNRNSNLNNSNFSRIRGTRGYMAPEWVFNLPITSKVDVYSYGIVVLEMITGRSPTTGVRVTELEAESHHDERLVTWVREKKMKASEVGSTWVDRIVDPALGSNYDMNQMEILATVALECVDEDKDVRPSMSQVAERLQNHENDS

SEQ ID NO: 173405 - protein, 302 aa, Glycine max
  Coding DNA Sequence Number=SeqID_56627
  Gene Ontology: Mol. function=DNA binding; Cellular component=nucleus
  Homolog annotation: Hit_ID=Q84YJ6; Match level="QueryCoverage=68%, HitCoverage=37%, E-value=6e-17, Identity=29%"; Hit description=DNA -binding protein family-like
  Pfam annotation: Domain name=Myb_DNA-binding; Domain location=6-59; Score=18.2; E_value=0.03; Accession=PF00249.21; Description=Myb-like DNA-binding domain
MEEETMVTWSTWEELLLGGAISRHGTRDWTVIAAELKTRTVSPCIFTPEVCKAKYEELNFQYPGGCTSWFEELKKKRVAELKRDLKQSEEVIGSLEMKIETLKAGRDEKRDDCHVDNGSAEPELNVPSHKLDRVNDSPKEMSKDGLSAGSFTHETKTNWTHECQIPATSCEDVATKPEASGSTEQEKVLNVDKLANIVYQEHGGCLKKPRGKRKRKDCSRSINEVSVRESDFSADVCKESSLSYCGEIVKSSGVNEENANLKTAGIKDLMELLDSFLVVQGASVFTYKHDNQTNGFVVFVIL

SEQ ID NO: 173406 - protein, 180 aa, Glycine max
  Coding DNA Sequence Number=SeqID_56628
MATMVEAMMSMKKIMEANTVAVAATSVVAKYGRPHDVQIQNEHAFPPYGLPPNYTPPNVAYTPNANVNNSTPIPIESQQPQTDHAHRKGGEDYAFAKLEELFLVPNIITPPKFKVLDFDKYKGTTCPKSHLKMYCRKMGAYTKDEELLIHFFQESLTGHQYNSDMTSDRMQLQNMCKKGA

SEQ ID NO: 173407 - protein, 57 aa, Glycine max
  Coding DNA Sequence Number=SeqID_56629
MENSRTALGSQFEGLQTRRCRTDEQHYPMNSWGSEYKWRMENWRIALGNHFAGRQTR

SEQ ID NO: 173408 - protein, 111 aa, Glycine max
  Coding DNA Sequence Number=SeqID_56630
  Subcellular localization annotation: CTP_CleavageSite=71; ConfidenceScore=5.28e-01
AKVYVSLSELNVLSECHPLSKASMRLADRRNMEGNLSRRHVLSASSACSASRFSPSRLRVSLVLSRNSLTRAKRESGAKRDVQAEKRALNSRKSLKSEIHRGKEQSKEAKF

SEQ ID NO: 173409 - protein, 114 aa, Glycine max
  Coding DNA Sequence Number=SeqID_56631
  Homolog annotation: Hit_ID=Q5PIX3; Match level="QueryCoverage=57%, HitCoverage=82%, E-value=2e-12, Identity=54%"; Hit description =Putative membrane protein
MPTNRAQTSACWKRRWRWWLTASCRKPDPASGPGQAGRTESARGNIIRYRLFYDAAADWRIAAGRDRRAAGGHRGDVSRRAVCACYKIVAVAGAGGGRRVAVSRIYHAAGRGET

SEQ ID NO: 173410 - protein, 203 aa, Glycine max
  Coding DNA Sequence Number=SeqID_56632
  Gene Ontology: Mol. function=protein binding
  Homolog annotation: Hit_ID=Q6DXT5; Match level="QueryCoverage=70%, HitCoverage=32%, E-value=1e-39, Identity=57%"; Hit description =Putative leucine-rich repeat family protein
  Subcellular localization annotation: CTP_CleavageSite=47; ConfidenceScore=5.17e-01
MDLSSNQLNGTIPKFISQMKSLKHLNLANNNLHGVVPFNLSFIKRLEVFKVGGNSNLCYNHSMVSSKLKLGISPCDKFGMPVTPPSKDSSADDSSDDDYDEGDEEGSRHKKEHHHGPNKFVLGVAIALSSIVFLIVFLILCSKLVVTLLQGRFKERKHNENVTAEKKGNCYLHFGGDVWKNEEGETLINSMCSAMSLSWDARC

SEQ ID NO: 173411 - protein, 229 aa, Glycine max
  Coding DNA Sequence Number=SeqID_56633
  Gene Ontology: Cellular component=integral to membrane
  Homolog annotation: Hit_ID=Q7CPA8; Match level="QueryCoverage=51%, HitCoverage=87%, E-value=4e-30, Identity=57%"; Hit description =Putative inner membrane protein
  Pfam annotation: Domain name=LrgA; Domain location=18-125; Score =116.7; E_value=6.7e-32; Accession=PF03788.5; Description=LrgA family
MASALRPRTTDILQRVTVPLQLVLYIALFVASGQLVSWLHLPLPANVVGMVLLLLLIVSGIVPLRWVKAGANWLLAEMLLFFIPAVVAVVNYSDLLRSEGWRICVVIAVSTLMVLAATSLPVVSGADAAGLLPQQTPVPAQTHTAADAVGVNAAGAGGAVAADARQLAGLHRRKPLAAVAAGAGDAGFCGAGLRKPAHYPSPLAVAERGRDHCHAGGRVQFGVAGAAAD

SEQ ID NO: 173412 - protein, 57 aa, Glycine max
  Coding DNA Sequence Number=SeqID_56634
MTLEDFLQRVAWLGDQPSPDLGVGGETFGAGDAADTIEADIDYVANLTTTQGECHYE

SEQ ID NO: 173413 - protein, 485 aa, Glycine max
  Coding DNA Sequence Number=SeqID_56635
  Homolog annotation: Hit_ID=UPI00006DB69B; Match level="QueryCoverage =93%, HitCoverage=45%, E-value=1e-28, Identity=27%"; Hit description =COG3210: Large exoproteins involved in heme utilization or adhesion
MRFTRNPIALGIVAAQAVFYFPGVGEAATLGAYNPRDNDQQSGALIVNGGSATLTGNQAFEPGIDGAVNTTLGQVTIAAGAQYLNQARLDPGPQNLAITVPDPTTGGNTTFQVFDSASLVAQAPVTASTVVPDLQNVNDNQYIDARIADVSGSGSSLDVSIGQANANSSASTNAWTMAAKNTTLFQVSNGGTLNWNNNNRITFNGSAANVSGGQVTDSLAVQNLATYNGSFSVQTLDGKTTAFNVTNASQLQSYNNWLVSQLQAGNLAPASYLSAFNQAVTITNGDIVYNVSATAPDEVTQPIGSRVVINAEGAGSQVTVAAGKTLEVVGASDGAVRVASGANATIDGKLASRGTALALDGATATNSSSGVINGGFLNRIDGTGVGAASNNATAVTVQNGGDFTNNGVLNLGTTGSNLTNGVAGIRLDANAQASNSGNINVGVNGSSARGTTSGVLLTSDSSRFTNNSGGTIYLGRGAQNSLNDN

SEQ ID NO: 173414 - protein, 78 aa, Glycine max
  Coding DNA Sequence Number=SeqID_56636
METWGVTYEMDDLTLQRNKPPNSRKVMGKFSLNVIWDTEEFVMSGGCNRKWVECAKEGEIKQTIKGRHLIYVDISYCT

SEQ ID NO: 173415 - protein, 288 aa, Glycine max
  Coding DNA Sequence Number=SeqID_56637
  Gene Ontology: Mol. function=zinc ion binding
  Homolog annotation: Hit_ID=Q1SZI5; Match level="QueryCoverage=82%, HitCoverage=76%, E-value=8e-48, Identity=48%"; Hit description=Zinc finger, RING-type; RINGv
  Pfam annotation: Domain name=zf-C3HC4; Domain location=183-239; Score= 11.9; E_value=0.0093; Accession=PF00097.15; Description=Zinc finger, C3HC4 type (RING finger)
MDQNTSEGRGEVLGPVYEGEDGNLSNLVEGVVVVIDAVDGNSLGGRVSISEEAGTSGEVGKDFGSDMELEEGIEEVKDQDNHDQENISDDKLLEVDQGTSYNSNHLVNQVVIETVVAIESVQTKYVTEDNRKLETKVDESGLSMVSMKAPEGVSETDKDSRVIDIKCSSCKKVYEDSEGERVCRICHLTSVQSSDETTVGTASSATSADLIQLGCACKDELGIAHVHCAEAWFKLKGNRELVSVAHCYLPWIGTSLVGEQLASLLHSDIAVQCISVAISLFGIPIVKE

SEQ ID NO: 173416 - protein, 170 aa, Glycine max
  Coding DNA Sequence Number=SeqID_56638
  Gene Ontology: Mol. function=glycerone kinase activity; Cellular component=cytoplasm; Biological process=glycerol metabolic process
  Homolog annotation: Hit_ID=Q1ZGM7; Match level="QueryCoverage=98%, HitCoverage=29%, E-value=8e-41, Identity=55%"; Hit description =Dihydroxyacetone kinase
MGDACRQRRLQYLAREQRQLQLGKAAEIVDHQQRLFAVGQRLRQLIGHDAGNFAAVLLIERDHPRLTVNAHPQLAMTSCHAIVALFTRNVTGGKRQADGGRGVDGALRQGFDLVERVPLLRGKAGDFVHQHGAGNAARLWIFRAARYRPAPSPAPPCNQDFSPFPLRGQS

SEQ ID NO: 173417 - protein, 542 aa, Glycine max
  Coding DNA Sequence Number=SeqID_56639
  Gene Ontology: Mol. function=protein serine/threonine kinase activity; Cellular component=integral to membrane; Biological process=protein amino acid phosphorylation
  Homolog annotation: Hit_ID=Q6DXT2; Match level="QueryCoverage=99%, HitCoverage=99%, E-value=0.0, Identity=60%"; Hit description =Putative leucine-rich repeat transmembrane protein
  Pfam annotation: Domain name=LRRNT_2; Domain location=34-76; Score =30.6; E_value=5.5e-06; Accession=PF08263.3; Description=Leucine rich repeat N-terminal domain
  Pfam annotation: Domain name=LRR_1; Domain location=104-126; Score =15.0; E_value=0.28; Accession=PF00560.23; Description=Leucine Rich Repeat
  Pfam annotation: Domain name=LRR_1; Domain location=128-150; Score =16.7; E_value=0.085; Accession=PF00560.23; Description=Leucine Rich Repeat
  Pfam annotation: Domain name=LRR_1; Domain location=152-171; Score =9.3; E_value=5.2; Accession=PF00560.23; Description=Leucine Rich Repeat
  Pfam annotation: Domain name=Pkinase; Domain location=220-491; Score =106.5; E_value=7.6e-29; Accession=PF00069.15; Description=Protein kinase domain
  Pfam annotation: Domain name=Pkinase_Tyr; Domain location=220-491; Score=52.8; E_value=1e-15; Accession=PF07714.7; Description=Protein tyrosine kinase
  Pfam module annotation: Pfam domain module=LRRNT_2::LRR_1::LRR_1::LRR_ 1::Pkinase::Pkinase_Tyr; Domain location=34-76::104-126::128-150::152- 171::220-491::220-491
MEHIKVVAWLISLFLWNWVLVVDGTDNLLSPKGVNYEVAALMSMKSKTNDEFHVHVMDGWDINSVDPCTWDMVGCSAEGYVMSLEMASVGLSGTISSGIENLSHLKTLLLQNNQLSGPIPTEIGKLLELQTLDLSGNQLDGEIPNSLGCLTHLSYLDLSFNNLSGPTPKILAKGYRYRVISNEWQSSPKGACCCIGTDHTFSTHLMRFSFWELQTATGNFNSKNILGQGGFGVVYKGCLANKMLVAVKRLKDPNYTGEVQFQTEVEMIGLAVHRNLLRLYGFCMTPDERLLVYPYMPNGSVADHLRDFLFSLVLKQRLVVKSHRWTRTGECVLHEQCNPKIIHRDVKAANILLDESFEAVVGDFGLAKLLDQRDSHVTTAVRGTVGHIAPEYLSTGQSSEKTDVFGFGILLLELITGHKALDAGNGQVQKGMILDWVRTLFEEKRLEVLVDRDLRGCFDPVGLEKAVELSLQCTQSHPTLRPKMSEALKILEGLVGQSVRPEESQGGTNLYDEITCSFSQNYGDAHEEPSFIIEAIELSGPR

SEQ ID NO: 173418 - protein, 242 aa, Glycine max
  Coding DNA Sequence Number=SeqID_56640
  Gene Ontology: Mol. function=glycerone kinase activity; Biological process=glycerol metabolic process
  Homolog annotation: Hit_ID=UPI0000DB7C4C; Match level="QueryCoverage =68%, HitCoverage=58%, E-value=2e-35, Identity=49%"; Hit description =PREDICTED: similar to dihydroxyacetone kinase 2, partial
  Pfam annotation: Domain name=Dak2; Domain location=83-224; Score =109.9; E_value=7.3e-30; Accession=PF02734.7; Description=DAK2 domain
MKGFSLTLLALEEAFFEALHAPVRVLGWTPMYDFAPISLQHAERIGSVLDFDPSDNAEVAQVVERVTHTLIDLESELNALDAKVGDGDTGSTFAAGAKKIQRGLREQQLPLDELPTLLALVGEQLATVMGGSSGVLMSILFTSAGQQLEEGSMLPQALMHGLERMKHYGGAQPGHRTLVDALQPALEALAAGESLAAAAAAAQQGADATAQMQSAKAGPFGLSQSSESVWRVAIPARTPSMR

SEQ ID NO: 173419 - protein, 50 aa, Glycine max
  Coding DNA Sequence Number=SeqID_56641
  Gene Ontology: Mol. function=glycerone kinase activity; Biological process=glycerol metabolic process
  Homolog annotation: Hit_ID=Q2Y5F8; Match level="QueryCoverage=94%, HitCoverage=8%, E-value=7e-20, Identity=97%"; Hit description =Glycerone kinase
MGVQHRINARRGEDIAAHRSGQHPFADKARVRRFVAGATAGNQCDFAFIP

SEQ ID NO: 173420 - protein, 110 aa, Glycine max
  Coding DNA Sequence Number=SeqID_56642
MVNGGNNGGDNDDVNNSDIDRDINNGHGGSGGGDDDGGGIIDGDNDDVVGGDSDRGDINSGGNGGCSDIGGSCGDGDKGGSGGGGDNDDESDTNDGGDGNVYEDGGDNQL

SEQ ID NO: 173421 - protein, 600 aa, Glycine max
  Coding DNA Sequence Number=SeqID_56643
  Gene Ontology: Mol. function=two-component response regulator activity; Cellular component=nucleus; Biological process=two -component signal transduction system (phosphorelay)
  Homolog annotation: Hit_ID=Q1SGC3; Match level="QueryCoverage=96%, HitCoverage=100%, E-value=0.0, Identity=60%"; Hit description =Response regulator, RegA/PrrA/ActR type
  Pfam annotation: Domain name=Myb_DNA-binding; Domain location=363 -413; Score=49.9; E_value=8.6e-12; Accession=PF00249.21; Description =Myb-like DNA-binding domain
MLISGIDRSVTFCGRLRNDAKPAMVFTANDLQEWKDFPKGLKVLLHERDNISAAEIRAKLEAMDYNVSTFCDENDALSVISSGLESFHIAIVEVSSSSAQGGFKFLENAKDLPTIMTSNNHCLNTMMKCIAIIHRHSLLIVNAYFLALCSILFLKLGAVEFLSKPLSEDKLRNIWQHVVHKAFNAGANILSESLKPVKESVASMLQLQTDNEQHESRVSIDIEKVSSFVDNDHELSPGNDKYPAPSTPQLMQGTRLLDDGDCQEQANCSTEKESGEHDGESKSVETTCGNLNAEITPQQRKSEITLVREEVDIVDASMGESVASPHTQKRKVLSNTDRNTKASNKVGVHSDSCEIRGKRKKIKVDWTPELHKKFVKAVEQLGIDQAIPSRILELMKVESLTRHNVASHLQKYRMHKRQILPKEEERKWSNQRERSYSVQRPIMAFPPYHSNHTHPLPPVYPMWGQSGGPMAGMQIWGSPGYPLWQPTAENWRWKPFPGMHADAWGCPVLPIPPQAPGFPYSQNMPALLNADAADHTFTMPQSSFEHYLAEEVVDKVVKEAINKPWLPLPLGLKPPSTESVLAELSRQGISNIPPKGSKSC

SEQ ID NO: 173422 - protein, 682 aa, Glycine max
  Coding DNA Sequence Number=SeqID_56644
  Gene Ontology: Mol. function=protein-tyrosine kinase activity; Cellular component=large ribosomal subunit; Biological process =protein amino acid phosphorylation
  Homolog annotation: Hit_ID=Q6QNV0; Match level="QueryCoverage=95%, HitCoverage=95%, E-value=1e-178, Identity=51%"; Hit description =Receptor-like kinase
  Pfam annotation: Domain name=LRR_1; Domain location=104-123; Score =2.1; E_value=1.2e+02; Accession=PF00560.23; Description=Leucine Rich Repeat
  Pfam annotation: Domain name=LRR_1; Domain location=130-150; Score =9.5; E_value=4.8; Accession=PF00560.23; Description=Leucine Rich Repeat
  Pfam annotation: Domain name=LRR_1; Domain location=152-173; Score =24.3; E_value=0.00044; Accession=PF00560.23; Description=Leucine Rich Repeat
  Pfam annotation: Domain name=LRR_1; Domain location=175-196; Score =12.6; E_value=1.2; Accession=PF00560.23; Description=Leucine Rich Repeat
  Pfam annotation: Domain name=LRR_1; Domain location=198-220; Score =15.8; E_value=0.16; Accession=PF00560.23; Description=Leucine Rich Repeat
  Pfam annotation: Domain name=LRR_1; Domain location=222-245; Score =9.6; E_value=4.6; Accession=PF00560.23; Description=Leucine Rich Repeat
  Pfam annotation: Domain name=LRR_1; Domain location=80-102; Score =16.0; E_value=0.14; Accession=PF00560.23; Description=Leucine Rich Repeat
  Pfam annotation: Domain name=Pkinase; Domain location=400-672; Score =5.5; E_value=6.9e-09; Accession=PF00069.15; Description=Protein kinase domain
  Pfam annotation: Domain name=Pkinase_Tyr; Domain location=400-672; Score=17.9; E_value=1.4e-13; Accession=PF07714.7; Description =Protein tyrosine kinase
  Pfam module annotation: Pfam domain module=LRR_1::LRR_1::LRR_1::LRR _1::LRR_1::LRR_1::LRR_1::Pkinase::Pkinase_Tyr; Domain location=104 -123::130-150::152-173::175-196::198-220::222-245::80-102::400 -672::400-672
MKPFCTFFILLSLLVILVESSCKNEDQEMVSKAFQSVSGFNSSWFETGSNCSNAEIKGINLSSKNLSGNISWKYLRNISKLKVLDLSGNFLQGQVPNWFWRSSTLLVVNLSSNRFGGSINPTSQNGSFSSLQNLNLSHNRFTNRLHLSGFSNLESLDLSHNNLGTLPSGFQNLTNLHHLDLSNCNIKGNVKPISSLTTLSFLDLSNNTLNGSFPSDFPPLNNIKFLNVSHNNLKASTTLDRFKKFGKSAFIHAGHNFNYYNESKTPKLDSNSTPQHQQPHHIHAKKKRSKEKQKSKHKTRTMIVASSCASALVVVSLCMCLVWCCRRRRQLAKRSKWAISKPAPLSIKMMEKSGPFAFETESGTSWVADLKEPSSAPVVVFEKPLMNLTFVDLLAGTSHFGKDSLLAEGRCGPVYRAVLPGDIHVAIKVLENARDVHDDDAVALFVDLSQLKHPNLLPLSGYCIAGKEKLVLYEFMSNGDLGRWLQELPTGETNVEDWSGDTWDIIQNGAASRASPPEKMGWLVRHRIAVGVARGLAFLHHAGSRPVVHGHLVTSNVLLGDDFEPRIADFGFRKFGRESATANCSTETDVYCFGVVLMELLTGRAGTAETVVWVRKAVREGHAVRALDERLKLGGGSGDSESEMVESLRVAYLCTAESPGKRPTMQQVLGLLKDIHPSHALD

SEQ ID NO: 173423 - protein, 586 aa, Glycine max
  Coding DNA Sequence Number=SeqID_56645
  Gene Ontology: Mol. function=nucleotide binding
  Homolog annotation: Hit_ID=Q6DXT1; Match level="QueryCoverage=96%, HitCoverage=95%, E-value=0.0, Identity=65%"; Hit description =Putative growth regulator
  Pfam annotation: Domain name=DUF246; Domain location=162-549; Score =601.5; E_value=7.5e-178; Accession=PF03138.5; Description=Plant protein family
MGKQGSHKSLRPEFQGWHSKTLLLHGLKSDSSKCSYCRGLNVGKKHIRAIVVMFGLLGCLFLLDSLVISYFEFTNLQPSAASNSSSVFQGRDSYIYSKQSPVYMYERLLNLASSALAEKEFKQESSNLWVEPFRQASLWKPCAERKVQTNPRKPVQNNGYILVSANGGLNQQRVATCNAVAVASLLNATLVIPKFLYSNVWKDPSQFGDIYQEEYFMNILKDDIKLEKELPPHMKSLDVEAIGSQITDADLGKEATPANYIKVVLPLLLKNGVVHFLGYGNRLGFDPMPSDIQRLRCKCNFHALKFVPKIQQIGSLLIQRIRKYGARHSMLDTQLLGKFIHNNEYHEAKRGSEKYLALHLRFEIDMVAYSLCEFGGGEEERKELQAYRERHFPLFLERLKKNSTYISPKHLRKLGRCPLTPEEAALVLAGLGFKRETYIYLAGSHIYGGNSRMEPFTSLYPNVITKETLLTYNELEPFRNFSSQLAALDFITCASADVFAMTDSGSQLSSLVSGFRTYYGGHHAPTLRPNKTRLAAILRENDTIRWNRFEVRVKKMILEAQKAGIRSYGRSIYRNPRCPECMSKHH

SEQ ID NO: 173424 - protein, 65 aa, Glycine max
  Coding DNA Sequence Number=SeqID_56646
MGSTEYERKKAKREKRDRGWAVVVGEVGQFAVIVVVKWEERRHVFFDGGVNGTFEGDRKGWVPVL

SEQ ID NO: 173425 - protein, 222 aa, Glycine max
  Coding DNA Sequence Number=SeqID_56647
  Pfam annotation: Domain name=DUF1723; Domain location=1-34; Score =8.4; E_value=0.051; Accession=PF08330.1; Description=Protein of unknown function (DUF1723)
ETSSFHLPVEEVTITLDDVASLLHFPITGAFHTFDALDVDQVVDLLVDLLKNFPTIASIVADEDNHERKSCACRWKSGKALPISTYRKRLDKLTSDVVCWIPYVRQFGYVQTIPPNPVAPSLSIEEIEDIWLQFSEYLAPAVDAVAMPEPPTPAPANVDMPRHAVDACQRITDSLEHMINMRMIMTRNEAYTQTKPYLRLARGVTEQHHVYVQSRRRRDTQD

SEQ ID NO: 173426 - protein, 129 aa, Glycine max
  Coding DNA Sequence Number=SeqID_56648
MLPTGKVTAFNLCHFFSKTDPHAFYDAMDFLSVHYDSKLDLDALTLRGGRVTVMARQSYSLILFNSVFYVVLCFTVLSLFTLGASLLFFISLRSVRFGEGEGTGVQHCGGRRWHTRYAFALGVRSGVPQ

SEQ ID NO: 173427 - protein, 244 aa, Glycine max
  Coding DNA Sequence Number=SeqID_56649
  Gene Ontology: Cellular component=integral to membrane
  Homolog annotation: Hit_ID=Q1SGC5; Match level="QueryCoverage=99%, HitCoverage=99%, E-value=2e-87, Identity=60%"; Hit description =CD9/CD37/CD63 antigen
  Pfam annotation: Domain name=Tetraspannin; Domain location=6-139; Score=-31.9; E_value=0.0013; Accession=PF00335.10; Description =Tetraspanin family
MACRGCWECLLKLLNFILTLAGLAMVGYGIYLFVEYNKAWDNTLNFSEDKTEVQFGRPMLVVVSLSNSFLDELPKAWYECCSSPAIFWGLGCAAFTFFDKSWKEEIPKDKTGDFDMIYEFLRENWNVVRWVALGIVIFEALLFVLALIVRAANRPPEYDSDEEYINPRQQVRQPLLNRPAGPASGAPATGTLDKRPSRNDAWSARMREKYGLDTSEFTYNPSESHRYQQVNPQPTEERSRCAIM

SEQ ID NO: 173428 - protein, 510 aa, Glycine max
  Coding DNA Sequence Number=SeqID_56650
  Gene Ontology: Mol. function=protein serine/threonine kinase activity; Cellular component=cytoplasm; Biological process=protein amino acid phosphorylation
  Homolog annotation: Hit_ID=Q6DXR4; Match level="QueryCoverage=94%, HitCoverage=98%, E-value=0.0, Identity=72%"; Hit description =Putative serine-threonine kinase
  Pfam annotation: Domain name=NAF; Domain location=348-405; Score =101.0; E_value=3.5e-27; Accession=PF03822.5; Description=NAF domain
  Pfam annotation: Domain name=Pkinase; Domain location=29-283; Score =346.1; E_value=5.7e-101; Accession=PF00069.15; Description=Protein kinase domain
  Pfam annotation: Domain name=Pkinase_Tyr; Domain location=29-281; Score=60.0; E_value=3.8e-16; Accession=PF07714.7; Description =Protein tyrosine kinase
  Pfam annotation: Domain name=RIO1; Domain location=42-191; Score= -97.1; E_value=0.082; Accession=PF01163.12; Description=RIO1 family
  Pfam module annotation: Pfam domain module=NAF::Pkinase::Pkinase _Tyr::RIO1; Domain location=348-405::29-283::29-281::42-191
MADVVSKTPTSSLISPHKKETSNLLLGRFEIGKLLGHGTFAKVYYARNVKTGEGVAIKVIDKEKILKGGLVAHIKREISILRRVRHPNIVQLFEVMATKSKIYFVMEYVRGGELFNKVAKGRLKEEVARKYFQQLISAVGFCHARGVYHRDLKPENLLLDENGNLKVSDFGLSAVSDQIRQDGLFHTFCGTPAYVAPEVLARKGYDGAKVDLWSCGVVLFVLMAGYLPFHDQNVMAMYKKIYRGEFRCPRWFSPDLSRLLTRLLDTKPETRIAIPEIMENKWFKKGFKQIKFYVEDDRLCNVVDDDGLMDNDDDTISIASVATFSDYSVSESDSEVETRRRNDATLPRPPSLNAFDIISFSPGFDLSGLFEEKGDETRFVTAAPVNRIISKLEEIAQLVSFSVRKKDCRVSLEGTREGVRGPLTIAAEIFELTPSLVVVEVKKKGGDRAEYERFCKNELKPGLQNLMVEESATSSDLSTPTQPSLLRGLSEPVPDISSDIETPLYIPTDD

SEQ ID NO: 173429 - protein, 225 aa, Glycine max
  Coding DNA Sequence Number=SeqID_56651
VAGRQVWIMRTSMTTLTQIWMILLLSNIPPSEHNFDLLLPKCQLVYSIMTQISVLVAQLILDAIHLFVGIAPLRHPVDPNKSNKALGSPALITGLCQFYGVPVAPTKLIQPPINRSVIEKYCMPRQGQQLGQDQQQQLVANHRGQMKLNDSFYQYTLHHHRQDPNPYLWPTLKEFKATIAWPRDRPNFQEEACPTGAQGAAQGGKGGAEVDGDMADLLDFFIGGD

SEQ ID NO: 173430 - protein, 239 aa, Glycine max
  Coding DNA Sequence Number=SeqID_56652
  Gene Ontology: Mol. function=protein serine/threonine kinase activity; Cellular component=cytoplasm; Biological process=protein amino acid phosphorylation
  Homolog annotation: Hit_ID=Q9LWM4; Match level="QueryCoverage=94%, HitCoverage=56%, E-value=1e-50, Identity=43%"; Hit description =Putative CBL-interacting protein kinase 2
  Pfam annotation: Domain name=NAF; Domain location=107-168; Score =87.0; E_value=5.6e-23; Accession=PF03822.5; Description=NAF domain
MVKAYVAPEVIKKKGYDGAKADIWSCDLKRLLYRILDPNPKTRIDISKIVQSRWFRKGYAQIEEFQLPPLPPRNGKDISEVQAAFASSSDSDSDGSPMSNKEESPMKLYRFNAFDLISISSGFDLSGLFEDDQNERQLARFTTRKPPSTIVSMLEEIAQIDSRFKILKKNGVVRLEGCKTGINGQLTIDAEIFEVTSSFHVVEVKKIAGNTLEYWKFLDQYLKPLNEMVWVWQRYEQQQ

SEQ ID NO: 173431 - protein, 646 aa, Glycine max
  Coding DNA Sequence Number=SeqID_56653
  Gene Ontology: Mol. function=protein-tyrosine kinase activity; Cellular component=integral to membrane; Biological process=protein amino acid phosphorylation
  Homolog annotation: Hit_ID=Q1SMM8; Match level="QueryCoverage=99%, HitCoverage=95%, E-value=0.0, Identity=57%"; Hit description=Protein kinase
  Pfam annotation: Domain name=LRRNT_2; Domain location=1-42; Score =45.4; E_value=2e-10; Accession=PF08263.3; Description=Leucine rich repeat N-terminal domain
  Pfam annotation: Domain name=LRR_1; Domain location=45-67; Score=3.0; E_value=78; Accession=PF00560.23; Description=Leucine Rich Repeat
  Pfam annotation: Domain name=LRR_1; Domain location=69-91; Score=9.4; E_value=5; Accession=PF00560.23; Description=Leucine Rich Repeat
  Pfam annotation: Domain name=LRR_1; Domain location=93-115; Score =11.0; E_value=2.5; Accession=PF00560.23; Description=Leucine Rich Repeat
  Pfam annotation: Domain name=Pkinase; Domain location=359-615; Score=- 64.1; E_value=9.6e-05; Accession=PF00069.15; Description=Protein kinase domain
  Pfam annotation: Domain name=Pkinase_Tyr; Domain location=359-615; Score=-87.5; E_value=4.2e-07; Accession=PF07714.7; Description =Protein tyrosine kinase
  Pfam module annotation: Pfam domain module=LRRNT_2::LRR_1::LRR_1::LRR_ 1::Pkinase::Pkinase_Tyr; Domain location=1-42::45-67::69-91::93 -115::359-615::359-615
MENSGLALLAFRARITYDPFNALVNWNPNDCDPCKWLGVHCVDGKVQMMKLKGLSLEGTLAPELGKLSHLNSLVLCKNNFFGAIPKELGDLPKLELLDLRENNLLGNIPTEMGKMSLLKHFVWQSNFKRWNKPNSLVILTKATLMKCLNALALPLYVDKFWPHLNLNRFKLRKSIFHGHENDYCDLLPSSNVPEIAQNVPELVNSARRMLLQSSGNNLAAASFSGEPTIEISFVPTTFSSGAFPAIPDVNKKQNQTPTPSHSPFDSPHIVSDENQTSQQDETNGASRNLWKYIIVVVVVVLVIVIIILLYVSRKRAAKVIGPWKTGLSGQLQKAFITGVPKLNRAELETACEDFSNIVIHCYEGCTIYKGTLSNEVEIAVVSTLITSSQDWSKDMEMKYRKKIDTLSRINHKNFMNLIGYCEEEEPFTRMLVFEYCPNGNVFEHLHVEEVERLDWSRRVRIIMGIAYCLQYMHHDLNPPVIHSNLASNMIFLTDDFAAKTAEVTFRNIVSPTKTTCDSKKSQVSSWNNLETNVFDFGKLLLEIISGKLPYSEEQGNLVNWVDKYLNDKSSISNLIDPALQSFKENELDVICEVIQDCIQPDLKLRPTMRDVTFKLREVLGVSPEQAVPRLSPLWWAELEILSVETT

SEQ ID NO: 173432 - protein, 67 aa, Glycine max
  Coding DNA Sequence Number=SeqID_56654
MLEELVQSLFPSSTNIFCPITPFGPRHICKSMQRIWQRMIGKKQNPQKEAARELEQGVSLVKRLSYY

SEQ ID NO: 173433 - protein, 77 aa, Glycine max
  Coding DNA Sequence Number=SeqID_56655
MVLASSTLVVAILSGHREEYKGRELEQKQTKCLEQRCKGGCMIQGPRHAYANRNSQKHDRTEPGGIGSSYVSADKES

SEQ ID NO: 173434 - protein, 139 aa, Glycine max [sequence omitted]

SEQ ID NO: 173435 - protein, 82 aa, Glycine max
  Coding DNA Sequence Number=SeqID_56657
VAGGSSSAERVLVGAKKANKVDTIPAERVSAAVKKANKVDSPPSVESLSFKKACGGRTRTVGHESAVKRNATPRNDRKRIAK

SEQ ID NO: 173436 - protein, 442 aa, Glycine max
  Coding DNA Sequence Number=SeqID_56658
  Gene Ontology: Mol. function=catalytic activity; Biological process =protein amino acid phosphorylation
  Homolog annotation: Hit_ID=Q9FM53; Match level="QueryCoverage=72%, HitCoverage=66%, E-value=3e-54, Identity=35%"; Hit description =Arabidopsis thaliana genomic DNA, chromosome 5, P1 clone:MJH22
  Pfam annotation: Domain name=DUF860; Domain location=4-342; Score =529.8; E_value=2.8e-156; Accession=PF05898.4; Description=Plant specific of unknown function (DUF860)
AVKRRKEIPFDNVIQRDKKLKFVVKVRNILVTQPDRVMSLKTLGKFKRDLGLDKKRRLIAVLKKFPAVFQIMEEGVYSLKFKMTPEAERLYFEEMRVRNEMEELVVVKLRKLLMMSLEKRILLEKIAHLKTDFGLPPEFRDTVCHRYPQYFKVVATQRGPALELTHWDPELAVSAAELAAEENRIREVEEQNLIIDRPPKFNRVKLPKGLNLSKGEMRKIMQFRDLPYISPYSDFSGLRPGSREKEKHACGVVHEILSLTLEKRTLVDHLTHFREEFRFSQQLRGMLIRHPDMFYVSLKGDRDSVFLREGYQDSQLVEKDRLLLIKEKLRTLVNVPRFPKGPARRIVEDSMRGSDSREDESGEEEEEWLEDVDNLMNDDGFDDIDDGDDWSDEEDDDLPPDFDEDAELLEMGQGKTIKQDSRQNDEMVLLPVLPDGRPREQW

SEQ ID NO: 173437 - protein, 81 aa, Glycine max
  Coding DNA Sequence Number=SeqID_56659
MEADGTMVNEVVMVAKAIMVVMTIYDVCGAMVTKMVMHGMLISMAMEEEVVAKVVVANVMAKTMIPVATIRQATTVGYELE

SEQ ID NO: 173438 - protein, 182 aa, Glycine max
  Coding DNA Sequence Number=SeqID_56660
  Subcellular localization annotation: CTP_CleavageSite=29; ConfidenceScore=5.08e-01
MRHRGAPEEPPQPQPSFPHRKKKRKRRATATATVGSTSVSFETSHTDAPDQLNTHIHDAAVACEQSKATAAGDGFRFGELRQRSVNGRDSFVDLAVTAVGDGYVTETVESLELKRVLGNDSIPKRLPVSSFLEKVLHGNSVWSTTTVGDEKGRERVYDTIFRLPWRCELFTMSSMGILQSSV

SEQ ID NO: 173439 - protein, 188 aa, Glycine max
  Coding DNA Sequence Number=SeqID_56661
  Gene Ontology: Mol. function=phosphoserine transaminase activity; Cellular component=chloroplast; Biological process=L-serine biosynthetic process
  Homolog annotation: Hit_ID=Q1H0N2; Match level="QueryCoverage=97%, HitCoverage=51%, E-value=3e-68, Identity=69%"; Hit description =Phosphoserine aminotransferase
  Pfam annotation: Domain name=Aminotran_5; Domain location=2-176; Score=-181.7; E_value=0.0041; Accession=PF00266.9; Description =Aminotransferase class-V
MSSHILSRPIDVSKYGVIYGGAQKNIGPAGLCLVIVREDLLDQASALTPAVFHWKTQADNQSMINTPPTYSIYIAGLVFEWLLAQGGVDAIEKVNIAKANLLYHYLDQTEFYDNLIQKEYRSRMNIPFRLRDESLNDAFLKAADTQGLLQLKGHRSVGGMRASIYNAMPIEGVQALVEFMQAFEQKNS

SEQ ID NO: 173440 - protein, 54 aa, Glycine max
  Coding DNA Sequence Number=SeqID_56662
MVINEQFATMLGSSRQWGPRHPIPAQWCQQLSVEVIIGNYGMPLSDGQLRPSRI

SEQ ID NO: 173441 - protein, 46 aa, Glycine max
  Coding DNA Sequence Number=SeqID_56663
MKKEPGLEDEVGPSHMQPYRPLMPTMLFNIVNLTPNLRQGTGPDSP

SEQ ID NO: 173442 - protein, 1267 aa, Glycine max
  Coding DNA Sequence Number=SeqID_56664
  Gene Ontology: Mol. function=protein binding; Cellular component =membrane; Biological process=defense response
  Homolog annotation: Hit_ID=Q6R269; Match level="QueryCoverage=99%, HitCoverage=100%, E-value=0.0, Identity=59%"; Hit description =Disease resistance protein
  Pfam annotation: Domain name=LRR_1; Domain location=1080-1102; Score =9.6; E_value=4.6; Accession=PF00560.23; Description=Leucine Rich Repeat
  Pfam annotation: Domain name=LRR_1; Domain location=1105-1128; Score =8.1; E_value=8.8; Accession=PF00560.23; Description=Leucine Rich Repeat
  Pfam annotation: Domain name=LRR_1; Domain location=1154-1174; Score =0.8; E_value=2e+02; Accession=PF00560.23; Description=Leucine Rich Repeat
  Pfam annotation: Domain name=LRR_1; Domain location=1177-1200; Score =5.3; E_value=30; Accession=PF00560.23; Description=Leucine Rich Repeat
  Pfam annotation: Domain name=LRR_1; Domain location=1202-1225; Score =13.3; E_value=0.88; Accession=PF00560.23; Description=Leucine Rich Repeat
  Pfam annotation: Domain name=LRR_1; Domain location=574-595; Score =11.1; E_value=2.4; Accession=PF00560.23; Description=Leucine Rich Repeat
  Pfam annotation: Domain name=LRR_1; Domain location=597-619; Score =13.7; E_value=0.7; Accession=PF00560.23; Description=Leucine Rich Repeat
  Pfam annotation: Domain name=LRR_1; Domain location=620-642; Score =14.2; E_value=0.48; Accession=PF00560.23; Description=Leucine Rich Repeat
  Pfam annotation: Domain name=LRR_1; Domain location=644-665; Score =2.6; E_value=93; Accession=PF00560.23; Description=Leucine Rich Repeat
  Pfam annotation: Domain name=LRR_1; Domain location=778-799; Score =0.5; E_value=2.2e+02; Accession=PF00560.23; Description=Leucine Rich Repeat
  Pfam annotation: Domain name=LRR_1; Domain location=856-877; Score =7.9; E_value=9.6; Accession=PF00560.23; Description=Leucine Rich Repeat
  Pfam annotation: Domain name=LRR_1; Domain location=879-902; Score =1.6; E_value=1.5e+02; Accession=PF00560.23; Description=Leucine Rich Repeat
  Pfam annotation: Domain name=LRR_1; Domain location=934-957; Score =10.1; E_value=3.7; Accession=PF00560.23; Description=Leucine Rich Repeat
  Pfam annotation: Domain name=LRR_1; Domain location=977-1000; Score =2.2; E_value=1.1e+02; Accession=PF00560.23; Description=Leucine Rich Repeat
  Pfam annotation: Domain name=NB-ARC; Domain location=151-457; Score =301.1; E_value=2.1e-87; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::NB-ARC; Domain location=1080-1102::1105-1128::1154 -1174::1177-1200::1202-1225::...
  Pfam module annotation: Domain location=574-595::597-619::620 -642::644-665::778-799::856-877::879-902::934-957::977-1000::151-457
MPVLETLGGALFGAVLQVLFDKLDSHQVLDYFRGRKLNEKLLKKLKGKLRSVNTVVDDAEQKQFTDANVKAWLDEVRDVLLDTEDLLEEIDYEFSKTELEAESQTSASKVCNFESMIKDVLDELDSLLDQKDDLGLNNVSGVGVGSGSGSKVSQKLSSTSLVVESVIYGRDDDKATILNWLTSDTDNHNELSILSIVGMGGMGKTTLAQHVYNNPRIVEAKFDIKVWVCVSDDFDVLMVTKNILNKITNSKDDSGDDLEMVHGRLKEKLSGKKYLLVLDDVWNEHRDQWKALQTPLKYGAKGSKILVTTRSNKVASIMHSNEVRGLKQLREDHSWQVFSQHAFQDDYPELNAELKDIGIKIVEKCHGLPLALETVGCLLHKKPSFSQWERVLKSKLWELPIEDSKIIPALLLSYYHLPSHLKRCFAQCALFPKDHKFHKESLIQFWVTQNFVQCSQQSNPQEEIGEQYFNDLLSRSFFQRSSREKYFVMHDLLNDLAKYVCGDICFRLEVDKPKSISKVRHFSFVSQYDQYLDGYESLYHAKRLRTFMPTFPGQHMRRWGGRKLVDKLFSKFKFLRILSLSFCDLQEMPDSVGNLKHLRSLDLSDTGIKKLPDSTCFLCNLQVLKLNHCYLLEELPSNLHKLTNLRCLEFMYTKVRKMPMHIGKLKNLQVLSSFYVGKGSDNCSIQQLGELNLHGRLPIWELQNIVNPLDALAADLKNKTHLLDLELEWDADRNLDDSIKERQVLENLQPSRHLKKLSIRNYGGAQFPSWLSDNSSCNVVSLSLKDCKYCLCLPPLGLLPRLKELSIEGFDGIVSINADFFGSRSSSFASLETLEFCQMKEWEEWECKGVTGAFPRLQRLFIVRCPKLKGLPALGLLPFLKELSIKGLDGIVSINADFFGSSSCSFTSLESLKFSDMKEWEEWECKGVTGAFPRLQRLSMECCPKLKGHLPEQLCHLNYLKISGCQQLVPSALSAPDIHQLYLADCEELQIDHPTTLKELTIEGHNVEAALLEQIGRNYSCSNNNIPMHSCYDFLLSLDINGGCDSLTTFPLDIFPILRKIFIRKCPNLKRISQGQAHNHLQSLGMRECPQLESLPEGMHVLLPSLDRLHIEDCPKVEMFPEGGLPSNLKGMGLFGGSYKLIYLLKSALGGNHSLERLSIGGVDVECLPEEGVLPHSLVNLWIRECPDLKRLDYKGLCHLSSLKTLHLVNCPRLQCLPEEGLPKSISTLWTYNCPLLKQRCREPEGEDWPKIAHIKRVSLHGNDVDI

SEQ ID NO: 173443 - protein, 217 aa, Glycine max
  Coding DNA Sequence Number=SeqID_56665
MTPMTRSRTKLVAVIFNKAQVEKDEEVVSSKTDEDPKTGQIQGPMTRSRTKQLVDTLQQMVADILNKVQVEKDEGPEAEKDFWHLIKFCENFSLGSSLNQSRTYQGNPVAFTLNYLPSLEVASSKNSVTCIKRSAPSKDHIKNSVTYIKQSAPRKDHIIWSVFCYVICILVRILVYILLRSVTNSVWGQFGLLGEFRGLGFRRLLNLFSYLPIGRIA

SEQ ID NO: 173444 - protein, 194 aa, Glycine max
  Coding DNA Sequence Number=SeqID_56666
EYVKRLYDQVKVQIAKKNESYTKQANKKRKEVVLEPSDDPGHLRANVFQEGGNDENPEICQIQAKGPSGEGQRPKWRRIKPPSNPCDVYPDLSSFTGSGVYPDLSSFTGSGAAESSTHSECFTASDAGRGGGKDLMSPSQWTIVERRSVWRQSLVASNAFGSATALDLLLEALTERWPWSLLRRLGNTRGGVEE

SEQ ID NO: 173445 - protein, 154 aa, Glycine max
  Coding DNA Sequence Number=SeqID_56667
  Gene Ontology: Mol. function=metal ion binding; Cellular component =nucleus; Biological process=regulation of transcription, DNA -dependent
  Homolog annotation: Hit_ID=Q53K34; Match level="QueryCoverage=82%, HitCoverage=14%, E-value=1e-21, Identity=43%"; Hit description=Myb -like DNA-binding domain, putative
MEIHNYIMKRFHTNPNVHIELKDLLEINVGDLGSRQEELEFLGYWGLINFHPLLSMGSIVASIDDDRVPENNSFLEKLYRFESHQFSPIAQKIGLMTPIMTSGLFLDTTVAEELVKHDEGPKVEYHCNSCSVDRSCKRYHCQKQVLAYNLDVFA

SEQ ID NO: 173446 - protein, 1126 aa, Glycine max
  Coding DNA Sequence Number=SeqID_56668
  Gene Ontology: Mol. function=nucleic acid binding; Cellular component= proton-transporting two-sector ATPase complex; Biological process=DNA integration
  Pfam annotation: Domain name=rve; Domain location=444-594; Score =30.1; E_value=7.8e-06; Accession=PF00665.16; Description=Integrase core domain
  Pfam annotation: Domain name=zf-CCHC; Domain location=273-290; Score =16.1; E_value=0.0022; Accession=PF00098.13; Description=Zinc knuckle
  Pfam module annotation: Pfam domain module=RVT_2::rve::zf-CCHC; Domain location=697-908::444-594::273-290
MLKNNDQIPAKLPIFDGTNYERWTTQMKVVFKYQGVLDIISTSVTPLETNPTEAHRATHREQMKKDDKAIFLIHQCVDSNILEKIIDYETAKEAWDVLATTYASDKQTKKVRLMALRRQLGLLQMKSNETMAQFVNWLVILANQMKSCGEVMTDSMKVEKVLTGLTPNFDHVVSAIEQSKDLEMLKLEQLLGSLEAHELKMKNREGIKKEEKDSKKVLLAKNQKIGGGDSWKNKKGKGKWKYKKQESSGSKSENQKKEGGNNRKGKKKSKEHIQCYNCQKYGHYADDSDDEEAVMLMTTVKSETGIEEWWYLDTGCSNHMTGHKDWFCEIDETVKRSIKFGDGRSVMAKGIGKVAIRRVDGSKVTISDVLYVPNMESNLLSLGQLLEKEFSMHMDGEHMEVAYSNGKCVLKVTVSKNRTFKVGVSTIEQNLNKLQKKNMVVGLPSIEVPRQVCGRCCEGKQLRKAYNATVPTRAKEKLVVIHSDVYGPFEIKYHGVEKQSDCSIKMLRTNGGGKYTSLEFDNFCKEEGIIHEVMAPYTPQHNGTAGRRNRTMLNMVRCMLREKHIPHDSLTTAHILNKCPTKRLDSLTPEEAWSGLKPSVKHFKVFDSLYYRLVPKQNRRKLDSRAQTMILVDVIGVVPLRRSLRQISPPVRFQDDYDVFPDAAINVNGELMNLVLLVEAEPISLEEALASPHWRKATEEELRSIQKNKTWALVNLPSNKKAIEVKWVFKTKVKPFGEIAKYKARLVAKGFLQKPGPDFNEVYAPIARIETMRLIVAIASMRKWTVSQLDVKSAFLNGPLEEEVYTRQPPGYEKIGMEDRVMKQNKAIYGLKQAPRAWNKRTDGFLQKHKFLKCTTEHGVYLKDYGVTSVVMLCLYVDDLLVTGDSKQEIDRFNMLDCNSATTPCEPGIKLFTGEDTNLVDSTLYRQLIGSLRYLCNSRPDITYGVGLVSKFMEKPCKDHLLAAKRILKYVKGTLECGILFPAAKENSEIEIVGYTDADWSGDASDKKRTSGCEAEYILATFGASQALWLGMLVEELNIKCSNVMKLRIDNKSAIDLAKHPTAHGRNKHIEVKYHFLRDQVNKNKLALEYYRTEEQCADMLTKALKPKRLEEMKKKIGMHKLTDLN

SEQ ID NO: 173447 - protein, 443 aa, Glycine max
  Coding DNA Sequence Number=SeqID_56669
  Homolog annotation: Hit_ID=Q84QC8; Match level="QueryCoverage=31%, HitCoverage=19%, E-value=1e-32, Identity=54%"; Hit description =Chloride channel
MVLFARYNIVFGTPLLNYIIQRHGGNISPASTFRAFSDAKEDEEDDEEEDQDQDKVSTDEYDDISGEASDEADVFARHGGFKWQRVDKLCNEVREFGADLIDVDELASVYDFRIDKFQRQAILAFLRGFSVVVSAPTSSRKTLIAEAATECEYLLTTAFHAVLDVCFTIDVNGLLSVSVKETTTGYRNEITITNDQKKLSAEEIIRIIHEAENYQVDDRKFMKKANTMNALDDYVYKMRNALNNKNISSKLCLQEREKIKSVISKVTNLLEGDNQPYEIEVFEDHLNELVNLFDRVIGKIFDNEILKNDWSSRKKVQIIHYVMLKWGFALLIGLGTGLVGFFNSFAVENIAGFKLFMTTSLMSKHRYLDAFLAYAGANMCLAAATAALCAFIAPAAAGSGIPEVKAYLNGVDAQHILAPSTLFVKVNNTTILGASLPFLHKHR

SEQ ID NO: 173448 - protein, 159 aa, Glycine max
  Coding DNA Sequence Number=SeqID_56670
  Gene Ontology: Mol. function=RNA-directed DNA polymerase activity; Cellular component=nucleus; Biological process=RNA-dependent DNA replication
MKRQKHASYSSHDSCKSSNEELSNYYGGRHRSHTKHHSQRREKDRRPQEVNNSLSYFHGKDNVEAYLDWEMKVEQLFACHHISEERKVPLVTLSFQGYALYWWTSLVRERRIHGDPPVEYCNDLKSALRKRHIASYYKRELMDNLQRLRQGSKGKNKRS

SEQ ID NO: 173449 - protein, 124 aa, Glycine max
  Coding DNA Sequence Number=SeqID_56671
  Homolog annotation: Hit_ID=Q9SJI9; Match level="QueryCoverage=86%, HitCoverage=43%, E-value=2e-32, Identity=61%"; Hit description =Expressed protein
  Pfam annotation: Domain name=DUF1637; Domain location=1-122; Score =33.2; E_value=4.8e-14; Accession=PF07847.3; Description=Protein of unknown function (DUF1637)
MGIGVEEIQDFSTLAARPAKLVKDCQMSAPCNTTVLYPSKGGNIHCFKALTPCALFDVLSPPYSSEDGRHCSYFRKSTRKDLPGVELDQLSGVKPSEITWLEEIQAPENLVVRRGVYKGPTIRR

SEQ ID NO: 173450 - protein, 359 aa, Glycine max
  Coding DNA Sequence Number=SeqID_56672
  Gene Ontology: Mol. function=cysteine-type endopeptidase activity; Cellular component=vacuole; Biological process=proteolysis
  Homolog annotation: Hit_ID=Q84Y03; Match level="QueryCoverage=80%, HitCoverage=88%, E-value=2e-68, Identity=44%"; Hit description =Cysteine protease
  Pfam annotation: Domain name=Inhibitor_I29; Domain location=50-109; Score=75.5; E_value=1.7e-19; Accession=PF08246.2; Description =Cathepsin propeptide inhibitor domain (
  Pfam annotation: Domain name=Peptidase_C1; Domain location=137-297; Score=29.1; E_value=9.9e-14; Accession=PF00112.13; Description =Papain family cysteine protease
  Pfam module annotation: Pfam domain module=Inhibitor_I29::Peptidase _C1; Domain location=50-109::137-297
MGCQLKTHLFLLFIVWGSWSFLCYDLPSEYSILALEIDKFPSEEGVVELFQRWKEENKKIYRNPEEEKLRFENFKRNLKYIVEKNSKRISPYGQSLGLNQFADMSNEEFKSKFMSKVKKPFSKRNGVSSKDHSCEDEPYSLDWRKKGVVTASREGSRLLWNLWTVIVLMMDVMEARWIMLLNGLCTMEKTKVIGIDGYYDVGQSDSSLLCATVKQPISAGIDGTSWDFQLYIGGIYDGDCSSDPDDIDHAILVVGYGSEGDDDYWIVKNSWRTSWGMEGCIYLRKNTNLKYEPTTPSPSSPPSPPPPIYGCCESENAVCCIGTELEMDFVSRYEISYAWRFSGRGCKVKKDGKATVTMD

SEQ ID NO: 173451 - protein, 238 aa, Glycine max
  Coding DNA Sequence Number=SeqID_56673
  Homolog annotation: Hit_ID=Q9FMF9; Match level="QueryCoverage=49%, HitCoverage=9%, E-value=1e-20, Identity=50%"; Hit description =Nuclear protein-like
  Subcellular localization annotation: CTP_CleavageSite=48; ConfidenceScore=5.38e-01
MDLGFKKEFEASSWLRWTPRSRRRGKSRSEWSSNWLRSPPSRLTPISTAEATRAPTSLPSLPTKMTRISTPWTTRSHTSWLLTPPPKSLLKYMPSAPDSDNDIGFRKPQRIIDRDDDYRRRRLNQIISPARRPRTLREKEETLKAIAMKKKEEEEAAKGAPPQQQQKRRNRWDQSQDDGGIDPGSKHATEQSEGLEHEIKQVRESLISAYEKNIATRLKVEVCRLEANNYNITKDACA

SEQ ID NO: 173452 - protein, 707 aa, Glycine max
  Coding DNA Sequence Number=SeqID_56674
  Pfam annotation: Domain name=DUF688; Domain location=1-671; Score =192.9; E_value=7.7e-55; Accession=PF05097.3; Description=Protein of unknown function (DUF688)
MAERRLNINAPLMSVRRSAATPPSLTEAKKKILEKRHTLPYYKSDTFSDQVTEPVAVPFNWEHIPGRRKGNGGSEPQPPKATSITPSPRLPPGKSINATKQPLEKESKAANKSKSFNVSVVKVDSDKERKVEKIVESRRSNVKYDDDDDNDDNDAYSDALENLSPTESFSMNCSVSGVSGLENLGANKSGSFSTDQQTRDFMMSRFLPAAKAMTLLPPQYSSKKQSALVEQQPRDVSKLVRDDKKQLPIKHNTAIIPYTGQNQEEESEDEVDDNEYDNSSNIAAKGCGLLPQLHIRNSLCLLNPVAVMKMKNQAPLPPASEVVKPNKSSHIRSFSPVPAVKKAWEAIHKNKSSSRAASPDKQEGKKKWTSESNRFTYSGELLPGRLSPFRRSRAAAAGISPCRSKPQSPFRGAKLPGDTKEAENYKFGKVKFHSGVLGNVHDVPSQGAKRTSYSGNLTIEKTLYIDTASTAKLSSSNISSLDNNRRVDTVVADLDRRRGKIGSSQEIKQVRAVEEKVTFDTDVLSAFDSIPPSLYRILNLTAKEERDEGLTTDQNISQEPVSLQSVQGTFAEDPKTNTQQIVLANDSGKGSAVSAVSPLPPPLPKSPSESWLWRALPLVSVKNSFLHSSQGTQSQAKRHDSNTTSGNLKWETIVKTSNLHQDHVRYSQRNDPLGCLTWCYLIFREKNPLNILVWLSSALSEAFCPSM

SEQ ID NO: 173453 - protein, 77 aa, Glycine max
  Coding DNA Sequence Number=SeqID_56675
MVEDARTTLGNQFVGLRTRWMHEQCLAINSWGSGLDGGGCMNDNQFMGLRTRFEGGGCTNNARQSIRGAPDSMVEDT

SEQ ID NO: 173454 - protein, 78 aa, Glycine max
  Coding DNA Sequence Number=SeqID_56676
MSSIVCRDHARKTLSGPEEVQQASVSSTECLSPPARSSGPLLIELSSRSTAPPGRRRAKHHSSLGMAGSEQQARRHHL

SEQ ID NO: 173455 - protein, 50 aa, Glycine max
  Coding DNA Sequence Number=SeqID_56677
MEIIIQQAQGSLQSIIFKLKMGARDSSFMNKDHPEVWRGHPVLDKWPQIY

SEQ ID NO: 173456 - protein, 321 aa, Glycine max
  Coding DNA Sequence Number=SeqID_56678
  Gene Ontology: Mol. function=kinase activity
  Homolog annotation: Hit_ID=Q5GA22; Match level="QueryCoverage=68%, HitCoverage=62%, E-value=7e-60, Identity=53%"; Hit description =Hypothetical protein adh1B
MLFHAHFGSVYPDRLLNRVRSCDSILPSDLPDQTRFGFGLAVGVGGEILPETLEKMLSICDHVFVDIQALIRRFDNINGRVSHVALRDSGFFHLLPRVAFLKASADEAVFIDVEEVRKLCCVVVTHGKDGCEVFCPNGAFKVAPFVADQVDPTGAGDCFLGGFAAGIVRGLAVPDAALLGNFFGSIAVAQLGPPKLDFNLIQSVDNLKTDQNISPIEKNGLENGYDQQQQTLIPLGEDEMHKRKLQGIPFLERRDESPGFRKPPEQDQFYASLVTAKAIIMCQIQESGRNLLSSPKVLEQNNAKTILSLTSVHEEPIPSVD

SEQ ID NO: 173457 - protein, 124 aa, Glycine max
  Coding DNA Sequence Number=SeqID_56679
  Homolog annotation: Hit_ID=Q5GA22; Match level="QueryCoverage=47%, HitCoverage=17%, E-value=3e-11, Identity=54%"; Hit description =Hypothetical protein adh1B
MVGSGGGVGEVGAHPGDGVEGEGEGVEDDGDEGGSAAEGLGDGLAVAVEDVMAVVADDEAAAGNDGFGVCDHDHVKRLRVFCHFTLSVGCIRIMLSAPNNTLMLNQILINRDDKMGYLAHCEPM

SEQ ID NO: 173458 - protein, 373 aa, Glycine max
  Coding DNA Sequence Number=SeqID_56680
  Homolog annotation: Hit_ID=Q10QC4; Match level="QueryCoverage=94%, HitCoverage=95%, E-value=3e-79, Identity=45%"; Hit description =Expressed protein
MADSICRTLRDGALEGELVPTLTIKDSLASPFAFHVFSHILLQLSSHVIAQKSQSQGIVIVALSRSPSSYTSLLKMNGVDFASSNNKWIHILDCYTDPLGWKDKTRKTVNATNPSQQISLATSSYKSVKDVDKLFSVITELGRGLVGENKARFCVAIDSLSELLRHASLQSVAGLLSNLRSHDQISSIFGLLHSDLHEEKAVAVLEYMSSMVASVDPYHHSADGQKECLENSVSEQNFTKGKFNARFKRRNGRVRVTCEEFNVESGGINFVSVSSVDGTAIAGLVPKVQFNLQLSEKERIDRSNVVLPFEHQGNGKPIQIYDGRRSLEESNSEANPISSGKKEDSAMGEIIYFRDSDDEMPDSDEDPDDDLDI

SEQ ID NO: 173459 - protein, 197 aa, Glycine max
  Coding DNA Sequence Number=SeqID_56681
  Gene Ontology: Mol. function=phosphoinositide phospholipase C activity; Cellular component=cytoplasm; Biological process =intracellular signaling cascade
  Homolog annotation: Hit_ID=O49952; Match level="QueryCoverage=85%, HitCoverage=29%, E-value=3e-43, Identity=52%"; Hit description =Phosphoinositide-specific phospholipase C
  Pfam annotation: Domain name=PI-PLC-X; Domain location=119-197; Score= -40.9; E_value=0.027; Accession=PF00388.9; Description=Phosphatidylino sitol-specific phospholipase C, X domain
  Pfam annotation: Domain name=efhand_like; Domain location=39-121; Score=71.2; E_value=3.3e-18; Accession=PF09279.1; Description =Phosphoinositide-specific phospholipas
  Pfam module annotation: Pfam domain module=PI-PLC-X::efhand_like; Domain location=119-197::39-121
MATTSRHLSHIKMPKQHFKVCFCFRRMFRLKVADEPPDEIDILFKEYSQHGIMSMDDLCDFLVQFQGEEEGVAIKKHAQTIFDSLRHLNIFHRRGLHVEAFFRYLLSDLNVPLAEVHHDMNFPLAHYFLYTGHNSYLTGNQVSSASSTSAIIKALKKGVRVIELDLWPNSRGDDVLVHHGGYGFIVFNSILGEEIDT

SEQ ID NO: 173460 - protein, 117 aa, Glycine max
  Coding DNA Sequence Number=SeqID_56682
  Gene Ontology: Mol. function=nucleic acid binding
MNIDDELQTLLLLSSFPESWDTLVVTLSNFAPHGKLSIDHVTDSLLNEESKRKERGLSSHSEANVVENRGRSEHRGHKKSECRFLKRDQKAGNVHANQIDPKKKNEGGIIIAMASND

SEQ ID NO: 173461 - protein, 234 aa, Glycine max
  Coding DNA Sequence Number=SeqID_56683
  Gene Ontology: Mol. function=nucleic acid binding; Cellular component= nucleus; Biological process=DNA integration
MEQSHTKHPTQTMEESTMETVQTKDESQEAIEIDDKEKWMQAMKEEILKNEEKNPNPRYKARIVVKGCNQKKDIDFEEIVSLVVKMTSIRAIFGLAAKQGLEVEQLDVKTTFLHGDLEEEIYMEQPEGFVEPGKEYVACRLKKSLPSLKQAPRECKNKMNIDALKKALRKSFAMKDLGPDYIEKVLERCNMHNAKPIHVPLCGHFKLSMMQCPKNEEEKKEMSKVPYSSVVACG

SEQ ID NO: 173462 - protein, 1093 aa, Glycine max
  Coding DNA Sequence Number=SeqID_56684
  Gene Ontology: Mol. function=protein binding; Biological process =protein metabolic process
  Homolog annotation: Hit_ID=O80875; Match level="QueryCoverage=99%, HitCoverage=99%, E-value=1e-142, Identity=35%"; Hit description =Expressed protein
  Pfam annotation: Domain name=AAA_2; Domain location=722-889; Score= -9.2; E_value=4.5e-05; Accession=PF07724.4; Description=ATPase family associated with various
MPTPVSIARQCLTDEAARALDDAVAVARRRSHAQTTSLHAISALLALPSSALRDACGRARSGAARFSATYSPRLQFRALELSVGVSLDRLPSSKSTAGGSDEEPPVSNSLMAAIKRSQANQRRHPESFHMFQQSQQGTTTTSFLKVELKHFVLSILDDPIVSRVFAEAGFRSCDIKLALLQPPLPPVQHRFNRSPPVFLCNLDPARPDENIRRILEVLARKNKRNPLLMGVYAKNALRGFVEMVRNGRGGSVLGSELRVVCLEREIGEFVKKGGSGEEKFGVRLKELEQCESSGSGVVVSFGEIEVFLGDDVDVDAVRFVFSGLTRLLEIRGEKVSLLGVAETSHAYSKLLGLFPNVENDWDLHLLTVTSATPSMEGLYSKSRENGNLCTVQVLARIPEKCTNQDLVVLVLLTACVSQYGRAAMSSILMNDLLKVGPSSSNSTSSPWLQKVVNVETHRGSDAAKTNEENTSLNDKILGFQKKWNDICQRLHHTSSLPQFDISQTRSQSPTLEVSRFGPDFKESSSKDPSHNEFQYSSQISYMPKELHGIFPSKQLSVPLPSDTVSINTGTDHVLKVSETLQIHMKTPWAAPSLMANKSVLDHRSSSSPTRVTTDLGLGTLYTSTAQDPDTPKLQDQRKHLQRLSDSVSTDCDGTNENTSHRTARSSCSGSNLEGKFDLADFKSLNRLLNEKVGWQDQAIRAISQTLSLCKSGAGKRRGSHGRADIWLAFLGPDRLGKRKIASALAETIFGNPESLISVDLGFQDGFYPLNSVFEYQKSRCYDVLRRKTILDYIAGELSKKPHSVVFLENVDKADVLVQNSLLQALRTGKFSYSHGRAISINNTIFVVTSTVCKGNDSFVLEESKMFSEERMLEAKRCQMQLLIGRASEDAKRIGGTNVKVVPRKGFSKSSSLNKRKQADISDSKEGATSKMQKQDSEASRSFLDLNMPVEEGEEGVNDNDHESESMSENTDAWLSDFFDQIDEKVVFKPFNFNELAEQVLKRIGMLFQRTFGSELQLEIDHEVIAYILAAAWLSDKKNAVEDWIEHVLGKGFVEAQQKYHPAAQYVVKLVNCESIFVEEQAPDVCLPARINMD

SEQ ID NO: 173463 - protein, 114 aa, Glycine max
  Coding DNA Sequence Number=SeqID_56685
MVQLISDTIYCLQGSHPQRHPVDLKKSNRALGFSALGLGVASSKYGSLSVQGSACCPQQGHQTPYQSSFHQEVLRPQAGAGRNTIAALGWPVSDRQVIRRPAQDVKEGLLGGNL

SEQ ID NO: 173464 - protein, 73 aa, Glycine max
  Coding DNA Sequence Number=SeqID_56686
MFIDGLRPHSKQLLDISDNGKIKLKTLNEAMELIENMEASDHVILHDRTHIPSKKSLLELTSQDEQASCKTPN

SEQ ID NO: 173465 - protein, 49 aa, Glycine max
  Coding DNA Sequence Number=SeqID_56687
MGKRGMQTQLILETHNSRDKQSLDLNKSLKKVQMFFSLSKKKIQDEASS

SEQ ID NO: 173466 - protein, 200 aa, Glycine max
  Coding DNA Sequence Number=SeqID_56688
  Gene Ontology: Mol. function=transporter activity; Cellular component= integral to membrane; Biological process=transport
  Homolog annotation: Hit_ID=Q2RNM4; Match level="QueryCoverage=92%, HitCoverage=45%, E-value=6e-34, Identity=44%"; Hit description=Major facilitator superfamily MFS_1 precursor
MVTQVGYAVGLFFLIPLGDYIERQRLILRQAQVLFLAMIGMMLSPTATVLVFYSFLTGMAATVAQQIVPLAASLSRTSARGKTVGTVMSGVLAGILAGRAIGGLIGQYVGWRGVFLSGAIMTLLAIFFILRILPTQSLSTPKFNYLAVLRSLGLLWKNEPQVRGATLTQVMLFASFSVLWTVLPFWLAHRYDYGAGITAP

SEQ ID NO: 173467 - protein, 473 aa, Glycine max
  Coding DNA Sequence Number=SeqID_56689
  Gene Ontology: Mol. function=two-component response regulator activity; Biological process=two-component signal transduction system (phosphorelay)
  Homolog annotation: Hit_ID=Q1MK13; Match level="QueryCoverage=99%, HitCoverage=51%, E-value=3e-37, Identity=27%"; Hit description =Putative transcriptional regulator
  Pfam annotation: Domain name=TPR_4; Domain location=157-182; Score =10.9; E_value=1.9; Accession=PF07721.5; Description=Tetratricopeptide repeat
  Pfam annotation: Domain name=TPR_4; Domain location=197-222; Score =5.9; E_value=7.4; Accession=PF07721.5; Description=Tetratricopeptide repeat
  Pfam annotation: Domain name=TPR_4; Domain location=244-269; Score =9.9; E_value=2.5; Accession=PF07721.5; Description=Tetratricopeptide repeat
  Pfam annotation: Domain name=TPR_4; Domain location=422-447; Score =2.4; E_value=19; Accession=PF07721.5; Description=Tetratricopeptide repeat
  Pfam module annotation: Pfam domain module=TPR_4::TPR_4::TPR_4::TPR _4; Domain location=157-182::197-222::244-269::422-447
MRQFACDKLRQQGEYTVLEARFADYYKVMVKEAQDDWFMLPTGQWRERYSHILNDLRSVLQQTLIEGAAPSKGLEILQAMTPFWIEYSLYDECQRHIYPLLYENTSQVVLTLRQRMNLSAVAGKASTWAKGPTPETHSAWKTALTIAEKLDDKEIRLQAHYGLWLYYLRTGELDKALEHAQSMCELARSITDEEAMATGLRILGVSLHFLGRHDVGRDYLQQSLDWYEHGELSHSFRFGLDQESAGQAFLSRLLWLQGEYKAAKQMAWRGVKKAARLQHVCSLCCALAEGACMTAALDRNPRWVIKAANWLIHLAKRHDLYFWKTYGELFLVWAKQFSHTDVSQTTLFSSLRAMGLDWQYSPLLSEIDTGVSLRATRQDHENWCTPELMRLSATQLPPQKQRLLLEKALDKARQQQAHGWALRIAYSLATLQAEAGEKWAAKQLIQDALHDVEDSDNATDVRSAIALCARIGA

SEQ ID NO: 173468 - protein, 86 aa, Glycine max
  Coding DNA Sequence Number=SeqID_56690
MGQPQGPQVKGIPLCHINKSFVSTSWMCEGRVAMIHDEVPQEQPNWVRSCPPKFELGNWQVVEQPRISMANIMVFPGQAKAAKDEA

SEQ ID NO: 173469 - protein, 102 aa, Glycine max
  Coding DNA Sequence Number=SeqID_56691
DRAHKAPVDPKKSNRALGFLALVIGLCQSYRVPAPQQGIAPARHPVDPEKSNRFLGFPALITSLCQFYRVPVAPNKVIRLLINQVFIKKYCAPRHVQGEAPW

SEQ ID NO: 173470 - protein, 298 aa, Glycine max
  Coding DNA Sequence Number=SeqID_56692
  Homolog annotation: Hit_ID=Q1SKD7; Match level="QueryCoverage=44%, HitCoverage=34%, E-value=4e-08, Identity=27%"; Hit description =Ankyrin
MAPRKLPSKRYRKDTAEEGSSAAPQADTDFDRHRFRSTEHHQCFEAIKGWSFVRERRVQLRDDEFPDFQEEIARRHWALLVTPMAKFDPKIVMEFYANAWPTEEGVRDMRSWVRGQWIPFYADTLSQFLGYPLILAEGQQCKEMGVDHAHQHDHPYLDMDDFAAQQHSAQDGAYETPYRPGEVQQGPGVSRVDYGPLLVYEVPVTPNKVIRPPIFSAFIEKYCTPRQTQGEAPQQPGDDQPHAADAPSSPPESTSAHLWRLERCIRHMDDQAVRGCSSTAWGLGPVGTSEGGDEAQDD

SEQ ID NO: 173471 - protein, 170 aa, Glycine max
  Coding DNA Sequence Number=SeqID_56693
KEGRIRILSSCEGCPMRGVPSDESITPFIARGFSDHNARVLQGVRKAWDAAAAIVSSSSEEVKGIITGQRHDLEGRAKGNMWAIIDKCKEKLNLVATHEQRLEDEYAKISAEREARERVIDSLHQEATMWTDRFALTLNKSQELPPLLAKAKAVADTYSAPEEIHGLLSY

SEQ ID NO: 173472 - protein, 375 aa, Glycine max
  Coding DNA Sequence Number=SeqID_56694
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=7e-46, Identity=29%"; Hit description= UPI00006A17C9 related cluster
GPHVLAFRGLHALFFRGLHVVAFRGLHVVAFRGLHVLAFRGLHALAFRGLHVLTFRGQHALAFRGPNALTFRGPNALAFRGLHVLAFRRLHVIAFRWLPSHAFRGLRVLALRGLHALAFKGLHVLAFRGLHVFAFRGQHVLPFRGLHALTFKGLHILTFRGLHVLTFEGLYALAFRGLHDLAFRELHIPALRGLHVLVFRGLLALALRGLHVFAIRGLHVLTFRGQHHLALRELHILTFRGALAFRGLHALAFRGLHALAFRGLRVLAFRGLHGLAFRGLHVLAFRSLHVLTFRGLHALTFRGHTPSPSENYTSSPSEDYMSSPSEGYTPSPSEGYTPSLSEGYMPSPSVDCTSSPSEGYTSLPSKDSTSSLSEG

SEQ ID NO: 173473 - protein, 84 aa, Glycine max
  Coding DNA Sequence Number=SeqID_56695
MRKDLNTVSAVLRKKTMRKRIRRVELISIGEIKRKLKKKKIASYESRFDEEMSKIGRFEGLRMEERRKGEEAVQGFLKNVVFID

SEQ ID NO: 173474 - protein, 86 aa, Glycine max
  Coding DNA Sequence Number=SeqID_56696
MPHGLFPYKGHALMPLRHFTEHLVGARLGINSKRTGTMWHSTKRRSKYTNEKLESLGMEYLLVGDEQKRETESKNAKNDDPRAANS

SEQ ID NO: 173475 - protein, 226 aa, Glycine max
  Coding DNA Sequence Number=SeqID_56697
  Gene Ontology: Mol. function=oxidoreductase activity; Cellular component=periplasmic space; Biological process=nitrogen compound metabolic process
  Homolog annotation: Hit_ID=Q5H4W0; Match level="QueryCoverage=81%, HitCoverage=28%, E-value=6e-87, Identity=78%"; Hit description =Copper resistance protein A
MRRPGPGPAGWGKAVSGSFFDPHFAHHARFHVVQQMAVVGPAAERIGAHAIAAARARRHVDGVLAQLEFALCVFQIAPHAVQVDRVLHHGVVDQHDAHALAVVQPQRLGAGERDAVERPGEFLHVAGQVQLDLAARLAAIRILEQAAHRAVGQHLAAVVAQADAGVVQLRFGGRTLHVHQRVVALAGRKIRCLAGGIAPVGAMDHAGAAAAFHALHRGHVVATVAT

SEQ ID NO: 173476 - protein, 166 aa, Glycine max
  Coding DNA Sequence Number=SeqID_56698
MAPRKLASKRSRKDKAAKGTSSAPEYDRVDRASAVDITGYPHGQWIPFDADAIGQLLGYPLVLEEGQECEYGQRRNQSDGFDEEAIAQLLCIPGQDFARTSAGRRVRIMRTNMTTLTQIWMTLLLSNILPTDHNSDLPMPKCQLVWRLLGTLSTQISPTGPWDFPR

SEQ ID NO: 173477 - protein, 52 aa, Glycine max
  Coding DNA Sequence Number=SeqID_56699
MHIVVVKQGQDHLELPSGVGTKHGQQKPIKVLRNGCKWGWGHDRLIVALSLR

SEQ ID NO: 173478 - protein, 68 aa, Glycine max
  Coding DNA Sequence Number=SeqID_56700
MDEALEDVHANIDQPCHAGLERLLNLRIVIEGIEVCIFTKECLRIARVVTAQRNVYVRSRRRQHMEDG

SEQ ID NO: 173479 - protein, 86 aa, Glycine max
  Coding DNA Sequence Number=SeqID_56701
MSPPPLETSQSLKISSKVLQDGFLFNLAPVTLAQPEGEDSALSELAFAQRLYTAHLSSRIVHALGHQMGCLADNVLSQKMSGFASS

SEQ ID NO: 173480 - protein, 256 aa, Glycine max
  Coding DNA Sequence Number=SeqID_56702
  Homolog annotation: Hit_ID=Q1T493; Match level="QueryCoverage=96%, HitCoverage=46%, E-value=2e-26, Identity=30%"; Hit description =Nucleic acid-binding, OB-fold, subgroup
  Pfam annotation: Domain name=Rep_fac-A_C; Domain location=115-248; Score=-60.8; E_value=0.019; Accession=PF08646.1; Description =Replication factor-A C terminal domain
FLKFLDDYEGDGPITVLLTHGRIKEAQGSCLPSVNNSFKASKLIINKPVMEIQEFNERLAELGIEARSGFKSHSEGCTQLSGSIQLSSKESFFGKAEAKTIADINTISKEIVCVTVGTITRIVLDNDSWCYTTCIQCHKKSDAEMAPFTCACGKYNKEAMLRYRLEVMINQGDENTKFLLWDRECSELIGQSADAVNKLKIEDGDVDLNASPQALDKLLGYELAFKIKVQPKFRNYAILKCSADSSLIKCCDGYAS

SEQ ID NO: 173481 - protein, 479 aa, Glycine max
  Coding DNA Sequence Number=SeqID_56703
  Gene Ontology: Mol. function=NAD(P)+ transhydrogenase (B-specific) activity; Cellular component=cytoplasm; Biological process=cell redox homeostasis
  Homolog annotation: Hit_ID=P27306; Match level="QueryCoverage=53%, HitCoverage=55%, E-value=1e-137, Identity=94%"; Hit description =Soluble pyridine nucleotide transhydrogenase (EC 1.6.1.1) (STH) (NAD(P)(+) transhydrogenase [B-specific])
  Pfam annotation: Domain name=Pyr_redox; Domain location=1-69; Score =13.1; E_value=0.0013; Accession=PF00070.17; Description=Pyridine nucleotide-disulphide oxidor
  Pfam annotation: Domain name=Pyr_redox_dim; Domain location=145-257; Score=136.1; E_value=9.3e-38; Accession=PF02852.12; Description =Pyridine nucleotide-disulphide oxidored
  Pfam module annotation: Pfam domain module=Pyr_redox::Pyr_redox_dim; Domain location=1-69::145-257
VDLINTRDRLLAFLDQEMSDSLSYHFWNSGVVIRHNEEFEKIEGVSDGVIMHLKSGKKVKADCLLYANGRTGNTDSLALENVGLEADGRGLLKVNSMYQTAQPHIYAVGDVIGYPSLASAAYDQGRIAAQAIIKGEATAHLIEDIPTGIYTIPEISSVGKTEQQLTAMKVPYEVGRAQFKHLARAQIVGMHVGSLKILFHRETKEILGIHCFGERAAEIIHIGQAIMEQKNGGNTIEYFVNTTFNYPTMAEAYRVAAGCAEAIPDDTPARWCAAAPVCNTADSTRHHAGRAEMGIFISAGFEAEAHRLIAQTVTIFQHQQFFTGQIRHRHAIAIVPRVILIDRQLHWLIKQRHFNKSFALFYQRQNRAVELTAVELRQQLLRLRLVQIHLEFREGLMQHRNNMRQQIGTGGRNQTNVQRPGHGFALLAGHLLQYLHFTQHGSRLIHQQQSSLSKQHLTAGPFQQDHTQFIFQLANLPAQ

SEQ ID NO: 173482 - protein, 110 aa, Glycine max
  Coding DNA Sequence Number=SeqID_56704
  Gene Ontology: Mol. function=protein serine/threonine kinase activity; Cellular component=membrane; Biological process=protein amino acid phosphorylation
  Homolog annotation: Hit_ID=Q40096; Match level="QueryCoverage=99%, HitCoverage=14%, E-value=8e-18, Identity=42%"; Hit description =Receptor protein kinase
ILSGKRNRGFYLENQSANLVTHAWNLWKGGRAIEMVDSNIEDSCVLSEQHAEDRPLMPSVVLMLGSESELAEPKEPGFYIKNDEGEKISISGQSDLFSTNEITITLLEAR

SEQ ID NO: 173483 - protein, 57 aa, Glycine max
  Coding DNA Sequence Number=SeqID_56705
MSVALSGRSLSQQIGLARRVDKDVAFAPTYPQAFERFILTNKNQKRSLRRWTLNDLK

SEQ ID NO: 173484 - protein, 66 aa, Glycine max
  Coding DNA Sequence Number=SeqID_56706
MPVAGGDFNYLRVTFGACFPMPWSLEIGISSAKWRLTVPSLPKGFNEIDFVVVAVILLITLVIATV

SEQ ID NO: 173485 - protein, 106 aa, Glycine max
  Coding DNA Sequence Number=SeqID_56707
MDCAEISVKQLNSTGKNPNVGKQSSLDKIRVPKCSFYIEAGFFYGDLYCLSHRQASSISEFTFLQKFIVSAKPPKPIQIKQVTWSPPACGFNKCNTDDAARGSPGM

SEQ ID NO: 173486 - protein, 69 aa, Glycine max
  Coding DNA Sequence Number=SeqID_56708
MLGGSRSEIGGGGNVGADNVVIIGEGRGSVEAKEVVHGCLVRGICVHSRFWDARSKSMGARSKSLMSFI

SEQ ID NO: 173487 - protein, 60 aa, Glycine max
  Coding DNA Sequence Number=SeqID_56709
MMIWKQRAKLVMATARWALKHLVYGIVILRLGTYTNRPKDDVPKGKLYKIPEQTLLTNNK

SEQ ID NO: 173488 - protein, 119 aa, Glycine max
  Coding DNA Sequence Number=SeqID_56710
  Gene Ontology: Mol. function=sequence-specific DNA binding; Cellular component=nucleus; Biological process=regulation of transcription, DNA-dependent
  Homolog annotation: Hit_ID=Q9FJK3; Match level="QueryCoverage=54%, HitCoverage=20%, E-value=2e-10, Identity=49%"; Hit description =Similarity to MADS-box DNA-binding protein
  Pfam annotation: Domain name=SRF-TF; Domain location=9-59; Score =30.7; E_value=5.1e-06; Accession=PF00319.9; Description=SRF-type transcription factor (DNA-binding and dimerisation domain)
MARNKVHYTYINNPMKGKATFKKRKNGYLKEVDEITTLCDIQACVIIYTLDEPEPEITKKNENFQVQEVTLAIENGGETMTEGEQALVANVAAISNMNWSNDNNNEDDGDVIHVNIGRC

SEQ ID NO: 173489 - protein, 101 aa, Glycine max
  Coding DNA Sequence Number=SeqID_56711
MGCRRQMLTFPLGRCPKIQRLKNPTLLGYPTYTMEPYMQALALGKAAVGFRVAYSPSWSSYSSLASKIGEELATQLAQASQVASQRSNSLLEEESGRPKWA

SEQ ID NO: 173490 - protein, 87 aa, Glycine max
  Coding DNA Sequence Number=SeqID_56712
MCLPPNFAPPNVAHTPDENVNNSTPILIESQQPQSNHAHVSQPIRETYEVPYHNLADFEPCLGYATEGQTVGGIPLPNTLDDPQFRP

SEQ ID NO: 173491 - protein, 59 aa, Glycine max
  Coding DNA Sequence Number=SeqID_56713
MALCDGADVLGKTGAKLEEFPVQAEKLSCSDPSIVCASGGDMSKLPSLQAHFNPLAREH

SEQ ID NO: 173492 - protein, 119 aa, Glycine max
  Coding DNA Sequence Number=SeqID_56714
MRAKARVKSEIAEVQKQMKADMEAMKEQMTTMMDAMMSMRKMMEVNTAIVVAASTATEVDLTHPSGHNQVIRPASDMGQSKHSFPSYGLLSNYTPPNVAHAPDENVDNSTPILIESQQP

SEQ ID NO: 173493 - protein, 370 aa, Glycine max
  Coding DNA Sequence Number=SeqID_56715
  Gene Ontology: Mol. function=protein kinase activity; Biological process=protein amino acid phosphorylation
  Homolog annotation: Hit_ID=Q2QZ78; Match level="QueryCoverage=76%, HitCoverage=50%, E-value=1e-63, Identity=45%"; Hit description=AT hook motif-containing protein, putative
  Pfam annotation: Domain name=DUF889; Domain location=123-305; Score =201.6; E_value=1.9e-57; Accession=PF05970.5; Description=Eukaryotic protein of unknown function (DUF889)
MFFLYGFGGTGKTFIWRTLASSLRAKNQIVIIVASSGIASLLLPGCRTAYSRFKIPIPIFEDSTCNIHQGIKLAELLNQTSLIIWDEAPMAQKFYFEVFDQSLRDIITDKSKSNQIFGGKVIVFGGDFCQILPVIPRGTRSNIVNAAINSSYLWDSCEILTLTKNMRLHSNLESVDEQETATFAKWILDIGDGIIDDENDGYATIQIPAHLLITQYDDSISAIVKSTFPDLDQHHNNPEFFKSKAILALTNETVEQINDYVLSFIPGDHMEYLSSDSIDKSETSKNIGLTVYIPRMSMSPSQSPWPFKLLRRQFPIMLSYAMTINKSQGQSLSMVGLYLPTPVFTHGQLYVALSRVNSAKGLKILIHDDE

SEQ ID NO: 173494 - protein, 58 aa, Glycine max
  Coding DNA Sequence Number=SeqID_56716
  Homolog annotation: Hit_ID=Q1T4L1; Match level="QueryCoverage=42%, HitCoverage=5%, E-value=4e-07, Identity=92%"; Hit description=Major facilitator superfamily
MSGGGMNVQSTPRSSGYANVVIAFVFVLVYVPETFDEVEVIWRERAWGKNPNTQNLLE

SEQ ID NO: 173495 - protein, 196 aa, Glycine max
  Coding DNA Sequence Number=SeqID_56717
  Subcellular localization annotation: CTP_CleavageSite=73; ConfidenceScore=5.03e-01
MGPFSNFFRYGSILHVNACMHKANRQWNWRVCSAVKDLPSPLAILPCMGNCQSNWRVPTGRCRLSRARCRFSRAEGGQAMQEGRRAVVTRHPYWRFALGEGIASLAGDLWTEWTRKLHWRVALIKNSGVIKEEAPSLHSCVPCIAFFFFIRSSTTLCSSFFVPTRCFFFLDSASFLFLLRGFSLLGLLMLGGTFKF

SEQ ID NO: 173496 - protein, 119 aa, Glycine max
  Coding DNA Sequence Number=SeqID_56718
  Gene Ontology: Mol. function=protein binding
  Homolog annotation: Hit_ID=Q1RX20; Match level="QueryCoverage=55%, HitCoverage=10%, E-value=1e-17, Identity=64%"; Hit description =Cyclin-like F-box
MNSPHFFLSNGAQIERPEMVASGADGGQESTIEISAIVERKVVRGGFEQKTNCGIVEVTAIKLESGQVKEENRLIGLTRRWKEGRKVDEKEDGETLAQKHERLAQRARGRGRIEGGARE

SEQ ID NO: 173497 - protein, 102 aa, Glycine max
  Coding DNA Sequence Number=SeqID_56719
MAAQLIRDRVEMECLEGAWETLEGNTRCRFRGTIGFTATSLVHPDEPARTLQRTVEWTAPWISFVYFLGWVYLGLTQNSLEIMSSEKEMTPNRVVNWPFRTL

SEQ ID NO: 173498 - protein, 91 aa, Glycine max
  Coding DNA Sequence Number=SeqID_56720
MANKNISSNETYPPSRHSENNSKAPKFLKGRVKSWLIWLEAYKNKMPKSSPNMHVKQEVSTRVKPRLLCKQSMGQNTPNKIDDDGSNSHQG

SEQ ID NO: 173499 - protein, 111 aa, Glycine max
  Coding DNA Sequence Number=SeqID_56721
MTHSRTMEELINKIQLSPKIMPTSSRRLSGSSPESYSLHPAAVILLPRTRFVIITVRKPCRVHQDHPVVHVTAPSIGDQLGAQRSSLPGDKPPQYKVHSATVILFPMSYEV

SEQ ID NO: 173500 - protein, 73 aa, Glycine max
  Coding DNA Sequence Number=SeqID_56722
MTFFQNYLDYKAQNVQVTNALENGSFAHTPDVFSKIPTGQLHVASLRSFIKRLLEKLPRGFFEKLSQEASLRS

SEQ ID NO: 173501 - protein, 222 aa, Glycine max
  Coding DNA Sequence Number=SeqID_56723
  Homolog annotation: Hit_ID=Q9LU57; Match level="QueryCoverage=91%, HitCoverage=71%, E-value=5e-69, Identity=63%"; Hit description =Arabidopsis thaliana genomic DNA, chromosome 5, P1 clone:MWD22
MVYYTRCSHLQLRVQFFFTVYISSPSKKELVAFLKKISSREPRLNVVDVDVPLNILCQNDEKLEQVTLGREFHISLGRTVPIRVHQIDSVVSMLRQKLQIQHQYWIDFNKWEVFVNDDHTRSFLSAEVVQGGLVEITKQIEVVNAIYRLHNLPEFYKDPRPHISLAWALGDIAHSLKKIVDEEMKCAVGKSLKKCIFSCKFKSIECKIGKKAYTICKISDGQ

SEQ ID NO: 173502 - protein, 339 aa, Glycine max
  Coding DNA Sequence Number=SeqID_56724
  Gene Ontology: Mol. function=cation transporter activity; Cellular component=integral to membrane; Biological process=cation transport
  Homolog annotation: Hit_ID=Q8ZJL7; Match level="QueryCoverage=55%, HitCoverage=63%, E-value=3e-67, Identity=70%"; Hit description =Cation-efflux pump fieF
  Pfam annotation: Domain name=LTXXQ; Domain location=116-138; Score =18.9; E_value=0.019; Accession=PF07813.3; Description=LTXXQ motif
  Pfam annotation: Domain name=LTXXQ; Domain location=43-65; Score =17.5; E_value=0.048; Accession=PF07813.3; Description=LTXXQ motif
  Pfam module annotation: Pfam domain module=LTXXQ::LTXXQ; Domain location=116-138::43-65
MRKVTALVMASLLAIGSTAAFAADTIPDTAQPPGNDAMTRIPGQHHMFDGVSLSEQQRQQMRDLMRQARHDLPGVNVAEMEAMHKLVTAEKFDEAAVYAQAEKMAQQQVKRQVEMARVRNQMYNLLTPEQKSVLDQKHQQRMQQMEQQISALCTPGKVRCVGRYRAGVVTAVDQNRRLVPHRFGQPAGGAGRFAGRYRRLADQPSGGALFAAAGRCRAHLWPRQSGIAGGAGAKHVYFRLRPVSVPHRLPAFVCAANAARSRRRDRRDGDRVDQHPDSGHLSTLGGQKNAQPGGARRYAALSVRCHDEWCYSYRSWAKLVRLPAGGRAVRAGHRRLHPV

SEQ ID NO: 173503 - protein, 39 aa, Glycine max
  Coding DNA Sequence Number=SeqID_56725
MRGYLMVTHTFRQPRANESVDAQRVLYSCHPETFKPNDA

SEQ ID NO: 173504 - protein, 225 aa, Glycine max
  Coding DNA Sequence Number=SeqID_56726
  Gene Ontology: Mol. function=serine O-acetyltransferase activity; Cellular component=cytoplasm; Biological process=cysteine biosynthetic process from serine
  Homolog annotation: Hit_ID=Q8D1S7; Match level="QueryCoverage=100%, HitCoverage=82%, E-value=1e-116, Identity=93%"; Hit description =Serine acetyltransferase
  Pfam annotation: Domain name=Hexapep; Domain location=135-152; Score =2.2; E_value=77; Accession=PF00132.14; Description=Bacterial transferase hexapeptide (three rep
  Pfam annotation: Domain name=Hexapep; Domain location=167-184; Score =12.2; E_value=1.9; Accession=PF00132.14; Description=Bacterial transferase hexapeptide (three rep
  Pfam annotation: Domain name=Hexapep; Domain location=199-216; Score =14.4; E_value=0.41; Accession=PF00132.14; Description=Bacterial transferase hexapeptide (three rep
  Pfam annotation: Domain name=SATase_N; Domain location=9-113; Score =205.3; E_value=1.4e-58; Accession=PF06426.4; Description=Serine acetyltransferase, N-terminal
  Pfam module annotation: Pfam domain module=Hexapep::Hexapep::Hexapep:: SATase_N; Domain location=135-152::167-184::199-216::9-113
MSSEELEQVWNSIKSEARALADCEPMLASFFHATLLKHENLGSALSYMLANKLATPIMPAIAVREVVEEAYKSDNQMIVSAARDILAVRLRDPAVDKYSTPLLYLKGFHALQAYRIGHWLWQQGRQALAIYLQNQISVAFGVDIHPAATIGCGIMLDHATGIVIGETAVVENNVSILQSVTLGGTGKTSGDRHPKIREGVMIGAGAKILGNIEVGKGAKIGAGSV

SEQ ID NO: 173505 - protein, 96 aa, Glycine max
  Coding DNA Sequence Number=SeqID_56727
  Gene Ontology: Mol. function=acetyl-CoA carboxylase activity; Cellular component=acetyl-CoA carboxylase complex; Biological process=fatty acid biosynthetic process
  Homolog annotation: Hit_ID=P49158; Match level="QueryCoverage=99%, HitCoverage=28%, E-value=7e-43, Identity=77%"; Hit description =Acetyl-coenzyme A carboxylase carboxyl transferase subunit beta
SDRIELSIDSGTWNPMDEDMVSLDPIEFHSEEEPYKDRIDSYQRKTGLTEAVQTGTGQLNGIPVAIGIMDFQFYGGQYGIRSRSAYARRKFELDPN

SEQ ID NO: 173506 - protein, 240 aa, Glycine max
  Coding DNA Sequence Number=SeqID_56728
  Subcellular localization annotation: CTP_CleavageSite=14; ConfidenceScore=5.18e-01
MNVGALISGQITSMAQSNSSRLGFLALITTLCRSRGIAFDSLVFERLSPVINLAYIRKNYWNLNDLIVSIRGARRARARPAELPSTSTAPPPARTSAAPSTPSSADFQHLEAMFNEWVAWPGTQPPLHREDEGLTAQVPQQREDESSETSTSYPLIRRKRVVETQEVAATSEKSLDATSEPSEPMADMASIQQAADPSTHEDQTTSVLSPNTSPPTTPVLRLIDEEDGQIQDNQDKSQEF

SEQ ID NO: 173507 - protein, 75 aa, Glycine max
  Coding DNA Sequence Number=SeqID_56729
MSAWWLYKRISLHVLYCYSSAPMNKGSRSSQAVSVEVILSCIGNSRPHGDQPESQGSSKLSSMYPSTSIPSHEKI

SEQ ID NO: 173508 - protein, 136 aa, Glycine max
  Coding DNA Sequence Number=SeqID_56730
  Gene Ontology: Mol. function=ribonuclease H activity
  Homolog annotation: Hit_ID=Q1S3X4; Match level="QueryCoverage=61%, HitCoverage=47%, E-value=3e-11, Identity=42%"; Hit description =Ribonuclease H
MEVYTRSFLPKCKQRNPKRGCVVFSYLTFLQIKSCGHTTNIHAKHLGIYHGLQRSWSLNHRHFIVESDSLTSMALIKQRSPPFHAHAALINSIRSFMSYPWEKLKFQHTYREGNMCAGNNRSVCGLIWINLTILMI

SEQ ID NO: 173509 - protein, 67 aa, Glycine max
  Coding DNA Sequence Number=SeqID_56731
MGVVLRAWSCLSIAPTSWQENRFLEVLGGCLGAGIVFRHGGRKGKLDQLIEERTFPLEFEVKGAYEK

SEQ ID NO: 173510 - protein, 149 aa, Glycine max
  Coding DNA Sequence Number=SeqID_56732
MGWIFKISQFFYYQNTPDEERITITSFYMDGPTLSWYQWVFRNEFINSWPAMLQALKTRVAPSFYDDPKGALFKLAQRGIVNEYLTKFKCLTNHIVGLAPPFILSHFIFDLSPEIRVKSRLYSPFHFLKRFLWPSFKKTRLRITVAITV

SEQ ID NO: 173511 - protein, 115 aa, Glycine max
  Coding DNA Sequence Number=SeqID_56733
MVDWPVPTTVKSLCGFLGLTGFYRKFIQCTITLSLSLAKISAHDYNVPPCHDQHVEAKLHGESKVIQRCFDDNNDDDKGDDKKLKDQSKNNSSESRTIQEFKIRIKKNSRLKKKV

SEQ ID NO: 173512 - protein, 159 aa, Glycine max
  Coding DNA Sequence Number=SeqID_56734
  Gene Ontology: Mol. function=phosphoinositide binding; Biological process=cell communication
  Homolog annotation: Hit_ID=Q1S2J1; Match level="QueryCoverage=74%, HitCoverage=16%, E-value=7e-50, Identity=84%"; Hit description=Phox -like
MAPASARASHRSSAASGSEVALRHHMFAMKYAAEKVVAHVRKLSNESVGSNGSSIRGSDMSNFGIPNSSGNSSHDLPGSAMVSRETNIMGHTKLKSTGDTQLVLPLDQHNKLNRFLSTMQRRLGTAKTDMEDLIVRLNQEIAAKDFLATKVHDWACISL

SEQ ID NO: 173513 - protein, 156 aa, Glycine max
  Coding DNA Sequence Number=SeqID_56735
  Gene Ontology: Mol. function=RNA-directed DNA polymerase activity; Cellular component=membrane; Biological process=RNA-dependent DNA replication
MRRNSRRRRSRGRRGTCSFESEGVKAALALWRLKEREEEHPRNKKELQSLIGKIIFLRRFYINSVGKVRDFSPLLKLKDSYEFVWHVEQQEVFDQIKDVANPPILMLSIQGRPLKLYISTAEESSGCLLAQDTKDDTERAVYYLSMLLNDVKTIYT

SEQ ID NO: 173514 - protein, 101 aa, Glycine max
  Coding DNA Sequence Number=SeqID_56736
SLRRPRLSSRRAIEAASDNAAEGTEPDLVFIYWIWFFVGDVANTDNHSITCDTPPRLPRHLLRPPPCLAHFQSNVESSLRVKLKSLYNGNKNKYCDPKTCS

SEQ ID NO: 173515 - protein, 131 aa, Glycine max
  Coding DNA Sequence Number=SeqID_56737
  Homolog annotation: Hit_ID=P48422; Match level="QueryCoverage=39%, HitCoverage=10%, E-value=7e-09, Identity=55%"; Hit description =Cytochrome P450 86A1
  Subcellular localization annotation: CTP_CleavageSite=28; ConfidenceScore=5.25e-01
MMSQKNQLIAIDNVSLPARRKFSAICRSAATLSGFLAPSRFFMKERMVALEGEYNAREWIEMKPNWESQVRFTESVVGACRKGGQGTKVRPGEKLEEDVLAKNVGEGSWGEVVVEGVVGVGDGENGEGGAV

SEQ ID NO: 173516 - protein, 106 aa, Glycine max
  Coding DNA Sequence Number=SeqID_56738
  Gene Ontology: Mol. function=L-ascorbate peroxidase activity; Cellular component=chloroplast; Biological process=response to oxidative stress
  Homolog annotation: Hit_ID=O81333; Match level="QueryCoverage=54%, HitCoverage=13%, E-value=2e-13, Identity=68%"; Hit description =Thylakoid-bound L-ascorbate peroxidase
MYLLAEWEDEKSKKILFDKYAFMQAIRDDLFQLASATIVEEAGGRKIPMKYGRVDVFEPKQCPKEGRLLDARNVRLFNSQMVTFNCCLRHLGCADLIILSYFHRYK

SEQ ID NO: 173517 - protein, 86 aa, Glycine max
  Coding DNA Sequence Number=SeqID_56739
  Subcellular localization annotation: CTP_CleavageSite=60; ConfidenceScore=5.57e-01
GLLLPGKPLARILAATSLLTVNTVSQRSSKNKGKRGALGVPALVTSGREGESLSHLLRILARRKRKNSGFSDGKAFGNYSSARNSP

SEQ ID NO: 173518 - protein, 599 aa, Glycine max
  Coding DNA Sequence Number=SeqID_56740
  Gene Ontology: Mol. function=protein serine/threonine kinase activity; Cellular component=cytoplasm; Biological process=protein amino acid phosphorylation
  Homolog annotation: Hit_ID=Q9LDN6; Match level="QueryCoverage=99%, HitCoverage=85%, E-value=1e-163, Identity=55%"; Hit description=MAP kinase
  Pfam annotation: Domain name=Pkinase; Domain location=2-164; Score =60.3; E_value=6.3e-15; Accession=PF00069.15; Description=Protein kinase domain
  Pfam annotation: Domain name=Pkinase_Tyr; Domain location=1-163; Score=-69.9; E_value=3.5e-08; Accession=PF07714.7; Description =Protein tyrosine kinase
  Pfam module annotation: Pfam domain module=Pkinase::Pkinase_Tyr; Domain location=2-164::1-163
MVIQSGPPLDEMSIACILRDLLHAVDYLHSEGKIHRDIKAANILLSENGDVKVADFGVSAQLTRTISRRKTFVGTPFWMAPEVIQNTDGYNEKADIWSLGITAIEMAKGEPPLADLHPMRVLFIIPRENPPQLDDHFSRPLKEFVSLCLKKRPSAKELLKDRFIRNARKSSKLSERIRERPKYQIKEDEETPRNGPSGMGEASGTVKVARDLRGEENNRPSDQGKTLKSAGWDFSIGGSQGTGTFRNVSRPPQFRDKITEVSHNQLTQRKAPQSGYQGGSVNRSALNESLESSFGRDLRVPHHDEHLDNHLEDDELSGNGSGTVVIRSPKGSRSSAFRDQSSQSSSSYASFEDASSSGTVVLRGQHDESDSPQTPRSRLGLNDRNSNASMEDSAANLAEAKAAILRKSNAREKLARGKINNDRQESKRDQKASSSDSSRPHGEYDAHKGMLRSHHASDGEESAKIMSSSVPLSVLLIPSLKEGEWGGRKAIADDPELVRAVINSLINMEGTKPKSCDVFVKKLLQRLASSKEDSLKDLQGLADQLFSKTKSAQETRNAEADNRKKQQNKEHNSNSNLSPLARFLLSRWQGQTSRDLNPS

SEQ ID NO: 173519 - protein, 75 aa, Glycine max
  Coding DNA Sequence Number=SeqID_56741
MYYIIVRILMPCSSTLAQASGEDLILMWAFLTGHPIDWAHLVHYCMHKALRSSAPLPYPQLVTLFLRHFEIPFGF

SEQ ID NO: 173520 - protein, 154 aa, Glycine max
  Coding DNA Sequence Number=SeqID_56742
LLLQEQQLKRKSTSKSYGSHSYPKKDQGQGILGVAPSKLKDDKGKTIEIQPPKASMQEKTSSINEEAKGEESNEEIYPHEEAQPLMAEEECKEVNVSSKRLAKKESHFAIKRNIKETSLLRQPPHFLLCKKTLVSTATPLGLEVIPLVKELLDE

SEQ ID NO: 173521 - protein, 320 aa, Glycine max
  Coding DNA Sequence Number=SeqID_56743
  Gene Ontology: Mol. function=transcription regulator activity; Cellular component=nucleus; Biological process=regulation of transcription
  Homolog annotation: Hit_ID=Q9FK20; Match level="QueryCoverage=95%, HitCoverage=92%, E-value=1e-59, Identity=47%"; Hit description =Similarity to helix-loop-helix DNA-binding protein
  Pfam annotation: Domain name=HLH; Domain location=107-158; Score =52.2; E_value=1.7e-12; Accession=PF00010.16; Description=Helix-loop -helix DNA-binding domain
MEPQKSLLMDESLCDIFKDTEFGDTHFGGGDLFSILESIDDLKDFPPTNNNEAVIGRTSKENEQNSRMVSQKVLISSSAPQDSETEHEISPKSKRQKLRSTSPEELQKVSHITVERNRRKQMNENLLVLRSLMPSFYVKRGDQASIIGGVVDYINEMQQLLQCLEAKKQRKVYIEVLSPRLVSSPRPSPLSPRKPPLSPRISLPISPRTPQQPSSPYKPRLQPGYLSPTIANSPTSSASSSINDNINELVANSKSIIADVEVKFSGPHVLLKTVSPPIPGQAMRIISALEDLALEILHVNISTADETMLNSFTIKKTDKK

SEQ ID NO: 173522 - protein, 575 aa, Glycine max
  Coding DNA Sequence Number=SeqID_56744
  Subcellular localization annotation: CTP_CleavageSite=74; ConfidenceScore=5.90e-01
MATSPVSPPPPPPSSSPPPPPPSQASTSPSTVKQTHKATRSGPLQSIRTVWLTLSVKNTALARINGASFDVRKKAQAIQKQNTALHVLSCGGYEYLEEKLISEKTKKKLEEVARGKDVVIDPSSPIRHHVKWKMARTKKTGQMTSESAKEIAQKIISHFQLTIATIIVYYVNAFNKYMSFVQDSLEEQASQGSFVPHGRQDVLTAAIGPRATDPTNQGPAGGVDHKKVTQQLLASFSQMQSQLQSHMQSQGLVLPPKPEVGPSRPHVSTKRSYVDPSGNDPKTGDSDKCGLYIEANHPRPVALGRLYEGSTVHNIPLLPGQVKVGFEEVKVAQVAIPVPTDEVTLSEHISVGQAAVSATKPPPRPDPEVDDPLYLMMLTIPELFLKPFQVNWDSTVFEVFNPNFPLYIKQEDLSEIAHGGQCLNIYVIQLWILHLTETTMRAGNSDVYGFLEPQSIQRSGQSQFDLESYIESWMQSSKHDVYLGAYLNGALKGLDDTPQPKSKVAARWIVVKCNRQKGSTECSYYVMHWMSTIILGSFRNNWETYFNDARPLQPERLKALYIQWAQYYLRLRHQT

SEQ ID NO: 173523 - protein, 155 aa, Glycine max
  Coding DNA Sequence Number=SeqID_56745
GSCPQGTQWTRRSPTGPWGFQLWLRASLSPIGCMFPPTRSRHHDIRIAPARHPVDPKKSNRVLELPALITGLCQFYGVPVTPSKVTKPPTNRAFIMKYCAPRHPQGETPQQPGDSQQQATDALPPPPKPLNSSTKAGAFPTTCGRLAGDQVQSQR

SEQ ID NO: 173524 - protein, 92 aa, Glycine max
  Coding DNA Sequence Number=SeqID_56746
MDSYPGSRFMADELRFWLERLVEMPNMIKIHSICPSGTIVDHFRRLNTHRGGIRKVLGCFRKKTTKNTKAVVNLSNTGGALRKLHPKHLEGG

SEQ ID NO: 173525 - protein, 47 aa, Glycine max
  Coding DNA Sequence Number=SeqID_56747
MEPEYWDKNPFKATAKPRHYGANLNQPKKFSAPFDPAGYTYWDYIDA

SEQ ID NO: 173526 - protein, 47 aa, Glycine max
  Coding DNA Sequence Number=SeqID_56748
GKVYGELGLWLKACRTDGHDICQGVGLASGSGIKGMSHIISMTHMQQ

SEQ ID NO: 173527 - protein, 62 aa, Glycine max
  Coding DNA Sequence Number=SeqID_56749
MAIYRKNPFGAREARPGKLELTQAIQLLRLKGISLPKSDNQTSTLSDLSALHYNRCQILQFD

SEQ ID NO: 173528 - protein, 54 aa, Glycine max
  Coding DNA Sequence Number=SeqID_56750
MAVIGSVLIGWAMVVVHWPWSLWSPMVIALVVVNPPWSWYVAGINKMQGKMKDN

SEQ ID NO: 173529 - protein, 213 aa, Glycine max
  Coding DNA Sequence Number=SeqID_56751
  Subcellular localization annotation: CTP_CleavageSite=23; ConfidenceScore=5.04e-01
MGSKVGWEVKVHFPSLNTNSVINASHVDLQRSGPTVGVSNSFEPHSCLTPSGDATQISSHEHTCNSKPLPDVYRGMSPTDQDGAQKSACRMSDHAASVVVTALLMVEEESGAIEGSSWNTTSSGCRVEAKVGCNPSDEGAYRDVANHVGYKMNVNAHAVANELDPYIAPHAGTHPPNREEAKFSENSILEVVMAGDVMCGGTCRERRSFLCLT

SEQ ID NO: 173530 - protein, 126 aa, Glycine max
  Coding DNA Sequence Number=SeqID_56752
  Gene Ontology: Mol. function=DNA binding; Biological process=DNA integration
  Homolog annotation: Hit_ID=Q6WAY9; Match level="QueryCoverage=59%, HitCoverage=33%, E-value=2e-13, Identity=47%"; Hit description=Pol
MEHYLLGPVLISILDEVIPSGKIMPRCCSTGNLMHKLTDATLEIIEAMASNAYNGIREMDQKRILEKTLNELDEFKLSAYENTKLYNEKTKKWHDQSIKRHKFHEGEKVLVYNSHLHLFPRKLHSR

SEQ ID NO: 173531 - protein, 68 aa, Glycine max
  Coding DNA Sequence Number=SeqID_56753
  Subcellular localization annotation: CTP_CleavageSite=42; ConfidenceScore=5.15e-01
MKNLCSSSIPSTNFGHLKTYNPASPPLDRYFIHSNIMESSLRLSSPAKLFPLKSRLSKQHKFPIASGI

SEQ ID NO: 173532 - protein, 151 aa, Glycine max
  Coding DNA Sequence Number=SeqID_56754
MKEEIKEKEAKEESQLDEERMLPNPPWKTQSSCSKINLQIWTYVFKPPTAIYHQKLCKLQAKEKCTKRTILLSSNIKDVYSIRKRTEKKDVTTPNTLPYVAREADLYPCLQHELRIAPLQSLGSFFNNTEELVEEKWGNYKPEQLYYSGFS

SEQ ID NO: 173533 - protein, 140 aa, Glycine max
  Coding DNA Sequence Number=SeqID_56755
MSRFKVKLLQEEMTERIKDGLLIKSKEGENYKELNWSTLMIVEQGYIYLSYNTENKRGYISCGSVQVEGTSTCLFKENKGGYIPCGSLLVKDFTRLLEISKTGGCLGTERRSKMVVLEFASRMIQTKCSWLGLHQVAIRA

SEQ ID NO: 173534 - protein, 76 aa, Glycine max
  Coding DNA Sequence Number=SeqID_56756
YEKLRENTKPLSTSQATFRRPVDGLVTTTFKRLDEASSSNSVEDVAPEMCDLDCSCDDHDEDTNDETDDEDEGEGK

SEQ ID NO: 173535 - protein, 45 aa, Glycine max
  Coding DNA Sequence Number=SeqID_56757
MSNQGAPRWVEPMWFSDGSSLDVEVITTVRQKWATYFLSFRKSSC

SEQ ID NO: 173536 - protein, 191 aa, Glycine max
  Coding DNA Sequence Number=SeqID_56758
  Gene Ontology: Mol. function=oxidoreductase activity, acting on the CH-OH group of donors, NAD or NADP as acceptor; Cellular component =cytoplasm; Biological process=branched chain family amino acid biosynthetic process
  Homolog annotation: Hit_ID=Q0X2X1; Match level="QueryCoverage=94%, HitCoverage=50%, E-value=3e-86, Identity=87%"; Hit description=3 -isopropylmalate dehydrogenase
AALLRGLEGHVGDALHFGLGVAHGVEGFLGAGEVAVSGHAAAARLVEVDVAGQLADDEDVQACDQFGLEAGGMGQLRIADGRAEVGKQTHVLAQAQDGLLGAQRAVQRVVLPVAHGAEQHGVGLHGQLQRGFGQRVAGSFVGSAAHGGGLHVEVQAQGAQHLHGFRNDFGADAITGQDCDFHGVPFERLFG

SEQ ID NO: 173537 - protein, 128 aa, Glycine max
  Coding DNA Sequence Number=SeqID_56759
  Gene Ontology: Mol. function=RNA-directed DNA polymerase activity; Biological process=RNA-dependent DNA replication
MEADYKPIRQPQRRLNLVMKEEVRKEVVPKKGGMTVIRNEKNDLIPTRTVIGWRMCIDYRKLNDATRKDHYPLPVMDQMLERWIFWLQSVEAKLHGESKMMTKVVTKSSKINQRTTQVNQRSIKEQLK

SEQ ID NO: 173538 - protein, 61 aa, Glycine max
  Coding DNA Sequence Number=SeqID_56760
MTHQDFQVQAIGQFAQATCAPEFGLPRPFNQRLLVLHVGGVAVKQQTFMWPHFIMPESLSS

SEQ ID NO: 173539 - protein, 90 aa, Glycine max
  Coding DNA Sequence Number=SeqID_56761
  Gene Ontology: Mol. function=zinc ion binding
  Homolog annotation: Hit_ID=Q1SE15; Match level="QueryCoverage=67%, HitCoverage=22%, E-value=5e-26, Identity=88%"; Hit description=Zinc finger, DHHC-type
MVVGLTITLLTLFGWHVYLILHNMTTIEYYEGKRAKWLAMKSGQSYRHPFNIGAYKNITLVSPYFVVFAGTNLQICTDSVSYLRICSSVS

SEQ ID NO: 173540 - protein, 248 aa, Glycine max
  Coding DNA Sequence Number=SeqID_56762
VLKCRLLTTGSDEGIRKTAWIGERREKGESAHDAWKVGEESDSKPSAIDHAHQMQTWLLLALARPSTASTADAADLDLDVPSIAKEVAELVLWDLDSDFPYSSLNPIGNPSLSAPEPNESVWYAEASPSPEAEVERKEVACAWRALSSEADTFCSIVCCLSWEEGWNLSLPSPRIECDLFLSTPPPRLELKPAHDNANETADKPITGYGEKILTNGRLKDSYSFFTIADQMLGIDCSEKPLLAKKQEF

SEQ ID NO: 173541 - protein, 99 aa, Glycine max
  Coding DNA Sequence Number=SeqID_56763
KKEGVETRIVITERAGWTKSVSYLCFPLISDERYLAPFVAPYVKSRDMPKMKRKQAYAIRENSVMGVQIAIRPTWAFQILPPEGCCFWRKQPCSPGRAG

SEQ ID NO: 173542 - protein, 46 aa, Glycine max
  Coding DNA Sequence Number=SeqID_56764
MAIVFEEELKAFMVVGIIVTVWLQAIMVKLSWVMMVLRTSAYNPPG

SEQ ID NO: 173543 - protein, 56 aa, Glycine max
  Coding DNA Sequence Number=SeqID_56765
MKGVVKTLKPFPCWSSPRQAGCLKLKVSARPGELELNQASGFLRAEEISWPRGAKW

SEQ ID NO: 173544 - protein, 60 aa, Glycine max
  Coding DNA Sequence Number=SeqID_56766
MRRCKGLRLVPPSRLVRHATLMLMPCQILLRTKCVEVALSSGCTLSPTAELSSTITFGTS

SEQ ID NO: 173545 - protein, 283 aa, Glycine max
  Coding DNA Sequence Number=SeqID_56767
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q5VS25; Match level="QueryCoverage=77%, HitCoverage=14%, E-value=6e-57, Identity=50%"; Hit description =Putative beta 1,3 glucan synthase
MESRCWTSAQDPLPVAALRTSTARIVPLRINLLPYGLSRLSELFMGCGFKYDRKQQEAQQKLELIILGVPFSMGCKSMFLVIILFLVGRNCIILSINYVQHNRLEVALLLIVYITYRWFIVISWLFAPYIFNPSGFKWQKTVEDFEDWTSWLLHKGGVGVKEDNSWESWWDKEQMHIQTLRGRIFGDNFECKLHLTGDDTSLAVKRIVFIRELDYDHIFTYNPKKSVDFQLVLRFSQGVASIGLVAVVCLVVAFTPVSIADLFASILAFIPTGWGILSVSSDS

SEQ ID NO: 173546 - protein, 59 aa, Glycine max
  Coding DNA Sequence Number=SeqID_56768
MKVFTFLKNNDLIAKGHKSRRVKELQVETLTAYEIASTVTTDKRRVREMIVKTRQKESE

SEQ ID NO: 173547 - protein, 617 aa, Glycine max
  Coding DNA Sequence Number=SeqID_56769
  Gene Ontology: Mol. function=protein dimerization activity; Cellular component=nucleus; Biological process=regulation of transcription
  Homolog annotation: Hit_ID=O22465; Match level="QueryCoverage=52%, HitCoverage=96%, E-value=1e-128, Identity=74%"; Hit description=GH1 protein
  Pfam annotation: Domain name=AUX_IAA; Domain location=68-342; Score =503.4; E_value=2.6e-148; Accession=PF02309.7; Description=AUXIAA family
MSPPLLVTEEDEGQSNASMVASASSPSSECFTLNEARLKERNYLGLSDCSSVDSSIVPSLSDEKKENLNLKATELRLGLPGSQSPERDPDLFSLSSTKLDEKPLFSLLPTKDGICSLSQKTVVSGNKRGFADTIDPEFPGNAGINMMLSPKPSGVKPTTVKEIPSKVLQEHPSAANGTGHNHTGASISSSAPAAKAQVVGWPPIRSFRKNSLATTSKNNDEVDGKPGAAAIFVKVSMDGAPYLRKVDLTNYTTYRELSSALEKMFSCFTLGQCGSHGAPGREMLSESKLKDLLHGSEYVLTYEDKDGDWMLVGDVPWDMFIDTCKRLKIMKGSDAIGLGSLSFLRSSQGHGKIQEQVLVGIGTVDFVLFTKSPVSFRPMLVSNLGYLLVGLCWEDWDCQVAGKWQMFIYFRIIISIACWQNLLFDNGGCGLAIENVCSDRTISGARGGGASGIGGGDNAVAMMMVWCGGGGDMSGISGGGSYNDSNVSGDKDDNDNGGVMVCGCGGSCGDGHNGDIFGNDGGDSSEDINGGGSGSNVGGDVNGDDCDNDSSVSGSAKWWESGGCNDIDNGCGDIDKGVGGNSNTNGGGDVDDNGGSGSDTSGHGGDNDGDGDNVVAE

SEQ ID NO: 173548 - protein, 43 aa, Glycine max
  Coding DNA Sequence Number=SeqID_56770
MAEPSKKRKGSSSRSQRHSEAHDTPIPSSISSSSLFSSEEQRI

SEQ ID NO: 173549 - protein, 346 aa, Glycine max
  Coding DNA Sequence Number=SeqID_56771
MYGKSSKMLEHEIHLVVHGDCFLKTFDGCLFGIVVWHGGWLRQASNDFQDYFDDAKESRVKQVPKNQASRIKSQRIKIQEQLSFKIQEQSIKIQDSRFKIQEKLISRFKRRNREATVKTSQGKGYIYLGCYTENKRGYISCGSVQVEGTSTWLFKENKGGYIPCGSLTCKGFYKVERNLKNRWLLGDWMPLDPTSGIRADILRKVSQLQDSWPPQILCFPREIPSIGHLSLMEHEMELQRLNQNEETDKRKRSIALKASSSMEEEEEEEEEEEEEEFDDEEDFSLFANCPSNELWPEKNDKKSYKERRSKKSYIAWDDNDSSDGSEKEINLLSKDYESDENISQEV

SEQ ID NO: 173550 - protein, 153 aa, Glycine max
  Coding DNA Sequence Number=SeqID_56772
  Gene Ontology: Mol. function=RNA-directed DNA polymerase activity; Cellular component=chromatin; Biological process=chromatin assembly or disassembly
MAAPEESIKSTTSILEEPGRYSGRDDGGLPYVTSNREKHVPDYVCDFSLVIGLWMVGRTQAKLSATHAEQFSPECTDKNGVVIGYQALGKPMELTNYINLPKERKEQAKVATGPLAYESHISLIDRLCIEQHGGRYLDACAARRSAAGCDKVF

SEQ ID NO: 173551 - protein, 585 aa, Glycine max
  Coding DNA Sequence Number=SeqID_56773
  Gene Ontology: Mol. function=RNA-directed DNA polymerase activity; Cellular component=chromatin; Biological process=chromatin assembly or disassembly
  Pfam annotation: Domain name=RVP_2; Domain location=207-336; Score= -46.0; E_value=0.0038; Accession=PF08284.2; Description=Retroviral aspartyl protease
  Pfam module annotation: Pfam domain module=RVP_2::Retrotrans_gag; Domain location=207-336::18-108
MAKTPSAEFLKSANSLIIVASFYMDGPTLSWYQWMTRNGFITSWPALLQALESRFAPTFYDDPHGALFKLQHKGSMNEYLSEFERLANRSVGLAPLALLSFFISGLYSELRKEVQALQPISLLQAVTLAKLQEEKFQDKCRHSRPPPSPSLQSQTGPPHYLHLRVHLSNDCSRKNWPFVVTRVCVTTVTRNFNTSDTLHHEDNLGVPQISLNALSGMPAPKTFRIYGTVAHHQVVILVDGDNTHNFIQARLAAFLHLDTSSIATIRVMIGNGSTLDCDTKCSSIPITIQGHPFSVDLYTLPIGGADIVLGVQWLKLLVPVTTDYSSLTMTFNYMGQHISLHADPSLCPSQASAQQLKCLTQTYSISALFQLTHEPQQLPPHRTITHRIHLLPNSSPVNVKPYRYPYSQKNELERQVVVMLDADRIRPSHSPFSSPMLLVKKKDGSWHCFVDYRAFNAITIEDRFPIPTINELLKKIVRKSWFSKLNLRQGFHQIRMHDDDIQKTGFRTHHGHYEFKKFVAVFFDDILVYNPSFLSHLEHMEIVFSTLLREAFFLRRTKCILAKQQLSYLGHIVSPHGVAPDLQKI

SEQ ID NO: 173552 - protein, 154 aa, Glycine max
  Coding DNA Sequence Number=SeqID_56774
  Gene Ontology: Mol. function=chromatin binding; Cellular component =chromatin; Biological process=chromatin assembly or disassembly
  Homolog annotation: Hit_ID=Q1SAV4; Match level="QueryCoverage=98%, HitCoverage=42%, E-value=2e-31, Identity=46%"; Hit description =Integrase, catalytic region
MEVVDFILSSGAAMHTVLQRRLQKYQASMKSRPDAHRRDIIFAVGDWVYVKLRPYRQTSIQPTYSKLSKRYYGSFMVQARVGAVAYCLQLPPNFQNTPYFPYPSTLPPSSIDNHPLVQPLQLLDWKMDLNTEPPTQQVLVQWNGLAPEDTSWEP

SEQ ID NO: 173553 - protein, 277 aa, Glycine max
  Coding DNA Sequence Number=SeqID_56775
  Homolog annotation: Hit_ID=Q2HRX8; Match level="QueryCoverage=85%, HitCoverage=43%, E-value=2e-13, Identity=25%"; Hit description=IMP dehydrogenase/GMP reductase
  Pfam annotation: Domain name=DUF1723; Domain location=89-140; Score =35.2; E_value=2.3e-07; Accession=PF08330.1; Description=Protein of unknown function (DUF1723)
MKPPSGEATLVAKDVEHVDHATDKVHEQPEEEATDVEGFLGGPHEASILMDYVHHMAMEHPELKLSSYGRKIEKFGKPTPEIESLVVATRLSPLIACSLGTERWHKETSSFHLSVGEVTITMHDVASLLHLPITGAFHSIEALHVDKVVFLLVELLEVSSKEVRDETVQYHGAYVQLLWLRDIYRSKCCTLFANKSATYMHMVFLDAFHDLIQTGSYAWGAIALCWIYENFPSVASFIVAKDYQERKPRACRWKSGKALPMSTYHKRLDRFISDVVC

SEQ ID NO: 173554 - protein, 129 aa, Glycine max
  Coding DNA Sequence Number=SeqID_56776
MTTSSAWESQQVGNKCPPKGEIEDILFLKEVVANDHKKENSKRRKDDHNLTRKSKDKKFLNRQNIERVFDPAVKPSNFTARSNVSPYAPPMITMDNDDDISYTALDAVVCKHGNAGFYVSMSLRHFFHL

SEQ ID NO: 173555 - protein, 307 aa, Glycine max
  Coding DNA Sequence Number=SeqID_56777
  Gene Ontology: Mol. function=nucleic acid binding; Cellular component= membrane; Biological process=DNA integration
  Homolog annotation: Hit_ID=Q1S1G2; Match level="QueryCoverage=90%, HitCoverage=19%, E-value=2e-50, Identity=37%"; Hit description =Integrase, catalytic region; Zinc finger, CCHC-type; Peptidase aspartic, catalytic
MALTSKNKMGFLNGTIPVLATTDPIYLSWECYNTLIISWLLNSLSPSIVQSVIFLDRAVDIYIDLQERFSQSDFYGIRQGSRSVSDYYTALKSLWEELDNFRPFHVSTCSTKLYHQQDFIIRILKGLDDHFSVVHSQILLMDPLPSSNRVFSMVAQQERQHSSSSTIDEPNAFINVGQSTYGKGHGIRGPSGPAGVNARTNGSNKKCIYCGCTEHTVDVCYSKHGYPLGHPHYPGRPRFHNRDNSPSSVVVNSATQEVDSHIHSSISQDNDSNELGFSLTRAQYQGLQGLLQQQKPNTNASPSTASP

SEQ ID NO: 173556 - protein, 143 aa, Glycine max
  Coding DNA Sequence Number=SeqID_56778
  Homolog annotation: Hit_ID=Q2HVE2; Match level="QueryCoverage=49%, HitCoverage=8%, E-value=7e-08, Identity=40%"; Hit description =Ribonuclease H
MKNHHFVGLGNFHHELWREYRKALHHEELFWVREAFIYPKSISTLNETFIVLIPKSDKPTHVREYRLGDYLTLSSYYLEIPTTLIILEGFPACSGWESNPYSVDDPSHVSLHHQINYGAQRVCEELEKLQRHFVWNDNQDGRG

SEQ ID NO: 173557 - protein, 104 aa, Glycine max
  Coding DNA Sequence Number=SeqID_56779
MVTLKKTTKEKLRASSSTESLRWIMEIPLRLKCSSPYGGLVASNDGLWRPPVVVGGGGGGGANFPLGLGIELIALVSLREFSSWFKFEGDSTINESGIVVLPKQ

SEQ ID NO: 173558 - protein, 364 aa, Glycine max
  Coding DNA Sequence Number=SeqID_56780
NGKDFPRNETLGLETLCVGGEGGVVSRKGRNWGRVVWEGFEIEEELLLTTNGDDDMVIVLRFPLTAFKKWVLRKLNVALAIDGQGILTLYTTSYKNLKGRFFKALSVIDPEDIEFKKQLTLFATMFKYSCIIELEYRSVNLRVFIKKSSKKSMAPSRKAAAVTATAETTLVQGILEDSFTVAVEKPWSLEKSAILYVVKDRGRDLMKAKEALNVQKSRLAAEVKRLRKKAMDAKAKHIIFYQAKVNLEKEKQLLTEKENEILGSLAVVKKENEGMEVKVNPWKWNPRLLLMREKTSGVATNVYSRKTLEKPKRGVDKGVALAPIYPQAKGHLGAVAAHPGELKPNPEAVSLPRRAGARPSKLVT

SEQ ID NO: 173559 - protein, 144 aa, Glycine max
  Coding DNA Sequence Number=SeqID_56781
METEQHPPQQSSSMAASMHDEGLPPHAQSYEFTPQFMPQPHHHQQDYKYNLKFFSANGEDFMSNLMGTDLRTLESLVEEQLVIPSLASFHQSMTNSSSTNDFVQEEPVVVPSEQVEPQQHGRVHRQSTRNRQPPRCGSGGPKRY

SEQ ID NO: 173560 - protein, 260 aa, Glycine max
  Coding DNA Sequence Number=SeqID_56782
  Gene Ontology: Mol. function=nucleic acid binding; Biological process= metabolic process
MKNSVPLVRTKTKLFTINPKRKMMRKNPDLFHQSQLHSLDREEVQHLVGTLFEGMRFLAKQDVRNALQQYHLIENDLSTSVPTLIAHIKSIEGYTTTYRKAWLEKQNVVEDVYDNWERSYHDLLRLLQVMQKFLPGMVVEKETLLMPPQGGQPVESFIMFHRLFWSFRPCIDGFQYCKPIIHVNGTWLYSKYRVTLFVAVAKDGNNKILLIAFAIVESESTNPTFNYQYNMLREETNVDRAINWLSEISQEKWTLAWDGG

SEQ ID NO: 173561 - protein, 78 aa, Glycine max
  Coding DNA Sequence Number=SeqID_56783
  Subcellular localization annotation: CTP_CleavageSite=42; ConfidenceScore=5.24e-01
MNNNPWELLDIDDFDLPSFVRPTIQSSSSSTRLILGPARVVQAAMMNRQSREPLRTQEFIMRAHQMLMHTSQDTIRVH

SEQ ID NO: 173562 - protein, 146 aa, Glycine max
  Coding DNA Sequence Number=SeqID_56784
  Gene Ontology: Mol. function=hydrolase activity; Biological process =intracellular signaling cascade
  Homolog annotation: Hit_ID=Q1S1N3; Match level="QueryCoverage=95%, HitCoverage=44%, E-value=1e-16, Identity=34%"; Hit description =Calcineurin-like phosphoesterase family protein, related
  Pfam annotation: Domain name=DUF1723; Domain location=27-76; Score =72.1; E_value=1.8e-18; Accession=PF08330.1; Description=Protein of unknown function (DUF1723)
MPSPDPIIEPLLVQAEFSDVAKLGQVKIDNALVIALVERWRPASHTFHLPVGECTITLKDVDLQLGLSIDDRPITGPTYSNWEQTCTKYIGVVPTNNALKGLTLKLKWLKEHMLTVPVKPTQQQLAGHCRAYILRLIGGVVMPNKL

SEQ ID NO: 173563 - protein, 129 aa, Glycine max
  Coding DNA Sequence Number=SeqID_56785
MKNSKYLTCFNPTPENIVTYVVYTLKLARLNLEDQKELRHAVFGITACCGSDEENEYPQRKSQSSLSTDTRFETTSTRSKTTVMAPTICYEERSTVVRGGFEHDDGWRGQRYCCHGAEEERGGDDEDGS

SEQ ID NO: 173564 - protein, 291 aa, Glycine max
  Coding DNA Sequence Number=SeqID_56786
  Gene Ontology: Mol. function=RNA-directed DNA polymerase activity; Cellular component=intracellular; Biological process=RNA-dependent DNA replication
MDIQAAYSCLLGRPWIHEAGAVTSTLHQKLKFVRNGSLITVSGEEALLVSHLSAFSFIGADETEGTSFQGLTVEGKKPEKNEVSFATWKSAQKVVQEGTGVGWGKVVQLLESKNREGLGFASSAGSATNSVGSSSITSTFCSAGFINNSPEANAVLEDVPEEIVLAFVTPGKLVRNWDAVDIPAVPFEHNNHALSPNFESPVYEAEEEEDDEIPEELARLLEYEKKAIRPHEEVVEVINLGTKEDKKEVKIGASLEATVKRRVIELLKEYVDVFAWSYQDMPGLDPRIVEH

SEQ ID NO: 173565 - protein, 203 aa, Glycine max
  Coding DNA Sequence Number=SeqID_56787
  Subcellular localization annotation: CTP_CleavageSite=20; ConfidenceScore=5.47e-01
MDRLTTMMSALLSAQNSQAAAATVEQPLVSTTPLSTVTSPPLFLPPGCTWGMPPPVCGSPQPAVSEVPPPFAQQSAPVPQPSTSFPQAAMTYSAPLIHTIQQEVEPIFQAENVVAFDKMEELQERFDGMQREVEALRGRDLFGKDACELCLVPNVTIPHKFKVPDFEKYKGNSCPRSHLVMYARKMSMYTDNHKLLIHFFQTA

SEQ ID NO: 173566 - protein, 112 aa, Glycine max
  Coding DNA Sequence Number=SeqID_56788
  Subcellular localization annotation: CTP_CleavageSite=28; ConfidenceScore=5.09e-01
MSPPPLGPHDHSQTHIKLSGWLPLVALVSMNLHTTNSLKLSRTWTFLSLELSDYAEASRKGYIPCGTSRGYIYLGLTENKRGYISCGLVLVEGTSTRFKENKGGYIPCGSLL

SEQ ID NO: 173567 - protein, 129 aa, Glycine max
  Coding DNA Sequence Number=SeqID_56789
MKNKERYFKRFLKIFKGLEITMPFGEALQQMPLYSKFMKDILTKKGKYIDNENIVVGGDATFSSSSILPSGVSILSSSGRSSSSTLPSSYAFFCPRVSTALHSSFGFLSVLAPKVLVGRSALSCANWPI

SEQ ID NO: 173568 - protein, 205 aa, Glycine max
  Coding DNA Sequence Number=SeqID_56790
MEVNTATIVATSTATKVDPTHQFGLNQVNCPASDMVGQEGEALGNMGGPHFVQVLNKHSFLPYGLPPNYTSPNVAHAPNENVDNSAPKPLGANNPNLIMHILPPTVVEREKFDHIEKRLRAIEGDEDYAFANMVELCLVPDVNIPPKFKVPDFNKYKGTTYPKNHLKMYNRKMGAYSKNEKLLMHFFQESIIGSAITWYTNLEPS

SEQ ID NO: 173569 - protein, 35 aa, Glycine max
  Coding DNA Sequence Number=SeqID_56791
MLVSAMHCSIRRHCIDFEMANVQRKNSDENSNIGL

SEQ ID NO: 173570 - protein, 101 aa, Glycine max
  Coding DNA Sequence Number=SeqID_56792
  Subcellular localization annotation: CTP_CleavageSite=53; ConfidenceScore=5.27e-01
MYPPLFSLNNLVDVPSTRTDPQEMYPLLFSVTTTQVDVPSTCTTKDVPSNVLRQSSQAGEGRNKRIQAVSPLFFRKREKRDTKRIQAVNPWRILFGKGRRE

SEQ ID NO: 173571 - protein, 60 aa, Glycine max
  Coding DNA Sequence Number=SeqID_56793
MENWRTALRNNFAGLQTPLGNNIHGAPKKSGEWRIGEHRYAITSRGSRLVGGGCMNSARQ

SEQ ID NO: 173572 - protein, 293 aa, Glycine max
  Coding DNA Sequence Number=SeqID_56794
  Gene Ontology: Mol. function=transcription factor activity; Cellular component=membrane; Biological process=regulation of transcription, DNA-dependent
  Homolog annotation: Hit_ID=P52666; Match level="QueryCoverage=98%, HitCoverage=99%, E-value=2e-83, Identity=56%"; Hit description=HTH -type transcriptional regulator budR
  Pfam annotation: Domain name=HTH_1; Domain location=3-62; Score=87.4; E_value=4.3e-23; Accession=PF00126.17; Description=Bacterial regulatory helix-turn-helix protein, lysR family
  Pfam annotation: Domain name=LysR_substrate; Domain location=86-292; Score=123.4; E_value=6.4e-34; Accession=PF03466.10; Description=LysR substrate binding domain
  Pfam module annotation: Pfam domain module=HTH_1::LysR_substrate; Domain location=3-62::86-292
MELRHLRYFVAVAETQHFTRAAELLGMSQPPLSQQIQRLEHEIGTPLLKRLTRGVELTDAGRAFLPDAIAIVQLADMALEKARGVARGMSGQMSLGFASSVAFGAPVFDLIRAFKTRYPAMELITREENMALLMQDLGEGLLDAAFIRLPCESSKAFNLKVIATEEMKVALPASHALSQQQSVALTQLAEESLIIFPREVAPSLYELIVSACLRAGFDATRFQQAPQITSSLGMVGAGCGIALVPASLCCVNNPQLVFRDIENNTLFTDIAFAWRRNHPAKTVLHLLSLINGE

SEQ ID NO: 173573 - protein, 77 aa, Glycine max
  Coding DNA Sequence Number=SeqID_56795
  Gene Ontology: Mol. function=acetolactate decarboxylase activity; Biological process=acetoin biosynthetic process
  Homolog annotation: Hit_ID=Q04518; Match level="QueryCoverage=97%, HitCoverage=28%, E-value=2e-18, Identity=57%"; Hit description=Alpha- acetolactate decarboxylase
MCNFVSDCSCEDQLKASVTQLGQQSPEKVIYQTSLMSALLNGVYDGSTTVAQLLQKGDFGLGPFNQLDGELVAFDRQ

SEQ ID NO: 173574 - protein, 577 aa, Glycine max
  Coding DNA Sequence Number=SeqID_56796
  Gene Ontology: Mol. function=signal transducer activity; Cellular component=outer membrane-bounded periplasmic space; Biological process=regulation of transcription, DNA-dependent
  Homolog annotation: Hit_ID=Q1R0S8; Match level="QueryCoverage=83%, HitCoverage=90%, E-value=6e-75, Identity=36%"; Hit description =Diguanylate cyclase/phosphodiesterase with GAF sensor
  Pfam annotation: Domain name=EAL; Domain location=375-548; Score= -9.1; E_value=5.4e-10; Accession=PF00563.11; Description=EAL domain
  Pfam annotation: Domain name=GAF; Domain location=57-189; Score=76.1; E_value=1.1e-19; Accession=PF01590.16; Description=GAF domain
  Pfam module annotation: Pfam domain module=EAL::GAF; Domain location =375-548::57-189
MTDAGVKPTMRKTIIIFTLINHASGRAGAEEIMLMNFNGDDDRRARALKALRSRDESRDDVLQNFVRLTSQALGIPGSFVSVLDDEHQHICAAHNFALEHSSREDSLCRHAVDSDGAVVISDTLLDARFARHPLIIGAPFIRFYAGVPLRHRDGYVLGTLCVTDVAPHAFSADQVKVLQLLADLVMSFLEAWHCAGFTDPVTALPNRQRLIRDLQRLASIGDRTPQRLILIDCIDMPRAYELARSMGMGPVESLLKHVTTLLPLRLQPGADDIIYTVATGRFAILTMDNSPLTAASVAENLAGISADLDAGISVALTCFTGDWQPGARHELQPGGRSAPHSGLSADERSGCGTATGSGPVAGVPAEDLPEQWPAHWTGGTGALAASAARRTRSRSVYPAGGTDRAAQRLNQLGDRQGDRQVKTPAAQPPPAASDHQYQQPRLLRSRPAALQGLEMLKLRGFGISLDDFGTGYSNIGYLRRMPLDVIKLDRALISEIASDTASRIIARSIITMLKQLDYTVLAEGVENVDTVAALAEYGCDQAQVYAGERLEQSPWQYDDSVSLKQNDTSKVKQKYPA

SEQ ID NO: 173575 - protein, 127 aa, Glycine max
  Coding DNA Sequence Number=SeqID_56797
VVVPPGSIPSVEQFREMVAWPGTQPSLHREDEGPTAQATIPEPFVIGEEAEETQVAAATPDRSLEATSEPFAPVVSLPSPQPAANPSTPLLEMPEDPTTPVLAMDPSPLATPVFHLTDDEDVQTHDT

SEQ ID NO: 173576 - protein, 271 aa, Glycine max
  Coding DNA Sequence Number=SeqID_56798
  Gene Ontology: Mol. function=RNA-directed DNA polymerase activity; Cellular component=mitochondrion; Biological process=RNA-dependent DNA replication
  Pfam annotation: Domain name=rve; Domain location=16-171; Score =112.6; E_value=1.1e-30; Accession=PF00665.16; Description=Integrase core domain
MGGISRRNGMPLQNIMEVEVFDCWGIDFMGPFPSFAGNEYILVVVDYVSKWVEAMATSRNDAKTVVKFIKKNIFARFGVPQILISDGGSHFCNTQLQKVLSQYHVNHRVASPCHPQTNGQVKVSNRELKKILEKTVASTRKDWSSKLEDALWAYRTAYKTPIGLSPFQLVYGKSCYLPVEMEHKAYWALKLLNFDKKASREHRKIHLLELEKIRLIAYESLRLYKEKVMTYHDKKLLKTSNRDNRKFRSYGAIELYDPQSQNPDRTWVVNG

SEQ ID NO: 173577 - protein, 55 aa, Glycine max
  Coding DNA Sequence Number=SeqID_56799
MDGLRTKLGAQNDHNLSLRSFLTRSSLGGKAQNDHNLSLRATGHDRLWMVKRCTE

SEQ ID NO: 173578 - protein, 104 aa, Glycine max
  Coding DNA Sequence Number=SeqID_56800
VENGELHKAITTHGSKLENGGHMNENAIHGAPKNGLRMENCTKQSLRMARNSKVENGELHKAITMHGSKLEDGGHMNENAIHGAPKRLRVENCTNQYAWVRSRR

SEQ ID NO: 173579 - protein, 108 aa, Glycine max
  Coding DNA Sequence Number=SeqID_56801
VPGDMSRGSGDLGDVRRAPGSQQIKGTKTTKQGGLWWLASCESCVIYGFLPLVIDYQGLENEVVEASGNRLPVCVIDYTEEWVTGNRLPGMCNRLHSAFFRFSCPEAV

SEQ ID NO: 173580 - protein, 88 aa, Glycine max
  Coding DNA Sequence Number=SeqID_56802
  Gene Ontology: Cellular component=integral to membrane
  Homolog annotation: Hit_ID=Q00M73; Match level="QueryCoverage=92%, HitCoverage=17%, E-value=3e-14, Identity=47%"; Hit description =Membrane protein-like protein
MLLDFQEASKLLEAEPKSGDDYKSLPSGPTESLFEEAPLLKNIYWKELSLLAYVWVAFFIVQIVKVRLLLDIFGYYMSDEFQQSILVV

SEQ ID NO: 173581 - protein, 183 aa, Glycine max
  Coding DNA Sequence Number=SeqID_56803
  Gene Ontology: Mol. function=nucleic acid binding
  Homolog annotation: Hit_ID=Q1RVK6; Match level="QueryCoverage=97%, HitCoverage=43%, E-value=8e-32, Identity=36%"; Hit description=Zinc finger, CCHC-type
MENTIFSTGISNGVENGKESSDNGGKSDSISFKDIVMKNKEKMETRPRKDLFKENLARCTSDQNPRENYWVTMKKRLTRTWKLVASFTFLDIGHGFYMTKFDNEEDNKKVIKEGPRLIFYHYVTEQAWSPSLFSSEAKINKTFMWVRFPSLNLIVYDESILLAMAATIGTPIKVDSNKLNVRR

SEQ ID NO: 173582 - protein, 162 aa, Glycine max
  Coding DNA Sequence Number=SeqID_56804
MKPVVTDEKFHTPNHGGFDGVIKTKNAKPVSNIQVATKTNLGKSVEDMSKQSLNGSHVDDSLNGEWLMVRKKKWNNVGYQNKRGLALIDNKSKLKFDGRNKGKNTVVVYGAKIVDNEPKFEVGLSNISHEGKYLYSRACHLAWNSFKTQADHHGGSYLCTIG

SEQ ID NO: 173583 - protein, 145 aa, Glycine max
  Coding DNA Sequence Number=SeqID_56805
  Gene Ontology: Mol. function=ribonuclease H activity; Cellular component=nucleus; Biological process=RNA-dependent DNA replication
  Homolog annotation: Hit_ID=Q1SZM6; Match level="QueryCoverage=84%, HitCoverage=40%, E-value=2e-22, Identity=43%"; Hit description =Ribonuclease H
MYIAKNLLSFFISRYILENARFGGIIHDSFGNWHVGFYGSCGMAMSLEAELLAILHGLNLSWDKGFRNIQCELNFTLALQLILEGRNSLHPYALTIQKIQDFKLLDWDLHFNHTFRKGNMCGDELAKRGSLFQCNLQVFDDCPPS

SEQ ID NO: 173584 - protein, 421 aa, Glycine max
  Coding DNA Sequence Number=SeqID_56806
  Gene Ontology: Mol. function=nucleic acid binding; Cellular component= chromosome, pericentric region; Biological process=regulation of transcription, DNA-dependent
  Homolog annotation: Hit_ID=Q9XFH4; Match level="QueryCoverage=89%, HitCoverage=49%, E-value=1e-131, Identity=63%"; Hit description =SWI2/SNF2-like protein
  Pfam annotation: Domain name=DEAD; Domain location=222-392; Score= -19.3; E_value=0.00024; Accession=PF00270.19; Description=DEADDEAH box helicase
  Pfam annotation: Domain name=ResIII; Domain location=218-386; Score= -21.3; E_value=0.0028; Accession=PF04851.6; Description=Type III restriction enzyme, res subunit
  Pfam annotation: Domain name=SNF2_N; Domain location=224-421; Score =168.3; E_value=1.9e-47; Accession=PF00176.13; Description=SNF2 family N-terminal domain
  Pfam module annotation: Pfam domain module=DEAD::ResIII::SNF2_N; Domain location=222-392::218-386::224-421
MGLSFRNDLTQCFRDESKSTNTYAHHTGFEMEAKDKVKNEDSAAESPTSVLEDEDVCALKEEVKLEEMVTADVKDDGSSLISKTMVEEEEKLLEARIKEEEVQYEEAVDLNDIQFNKLDELLTQTRLYSEFLLEKMDDITLAVGEQENREEQESNPSAKKGRGSKRKVASQYNTRKAKKAVAAMLTRSKESEKTEDMNMTEEERVEKEQKELMPLLTGGKLKNYQLKGVKWLISLWQNGLNGILADQMGLGKTIQTIGFLSHLKAKGLDGPYMIIAPLSTLSNWVNEISRFAPSLPAVIYHGDKKQRDDIRRKHMPTRTIGPQFPIVITSYEIALNDAKKYFRSYNWKYLVVDEGHRLKNSQCKLVKALKFINVENKLLLTGTPLQNNLAELWSLLNFILPDIFASLEEFESCHHQMMCQL

SEQ ID NO: 173585 - protein, 76 aa, Glycine max
  Coding DNA Sequence Number=SeqID_56807
MITRSKIVEQLRDYQIRHKRNYSALTYFSPKPHIQTRACSMVWSGDIAKPVRVIDLKNLGRRGKAISLILDENKII

SEQ ID NO: 173586 - protein, 45 aa, Glycine max
  Coding DNA Sequence Number=SeqID_56808
VDVAVAIGFALLFLMLANISEEQGKKTAIVHMRVHSGAVVSCLYT

SEQ ID NO: 173587 - protein, 134 aa, Glycine max
  Coding DNA Sequence Number=SeqID_56809
  Gene Ontology: Mol. function=oxidoreductase activity; Cellular component=cytoplasm; Biological process=antibiotic biosynthetic process
  Homolog annotation: Hit_ID=P94425; Match level="QueryCoverage=54%, HitCoverage=77%, E-value=2e-09, Identity=37%"; Hit description =Hypothetical protein ycnE
  Pfam annotation: Domain name=ABM; Domain location=48-111; Score=55.8; E_value=1.4e-13; Accession=PF03992.6; Description=Antibiotic biosynthesis monooxygenase
  Subcellular localization annotation: CTP_CleavageSite=65; ConfidenceScore=5.24e-01
GTQNSRSAAAVRLSDSTTMQKAANWAHIQFHYRPRKSIMITLNVFFQVNPAKRQAFLSLLNTMVQESNKETGCSFYQLWQCQSDENSYALIENWDDKAALSAHQKTPHWIAFNDVVNSYLTHDYDEHHYTEIAR

SEQ ID NO: 173588 - protein, 65 aa, Glycine max
  Coding DNA Sequence Number=SeqID_56810
MTTLTQMWMTLLLNNILSSDRNTDLPLRKDRAHKAPSGPGGVQQGPGVSSSGYGPPLVLQGVRSP

SEQ ID NO: 173589 - protein, 95 aa, Glycine max
  Coding DNA Sequence Number=SeqID_56811
MHETSNSTLSQLHKASSSNLRIVSRYVYPVVVDHNRLFKDIKYSHDREFGTRVRINRILKANHDWYFEIQTKIDQILKANLLGPDSKGTLINLKI

SEQ ID NO: 173590 - protein, 55 aa, Glycine max
  Coding DNA Sequence Number=SeqID_56812
MIRGLHAHLTIIELPFRSLLVLWVSHIERAFPYLWLSHGLELSLKTKTIWRPTNL

SEQ ID NO: 173591 - protein, 135 aa, Glycine max
  Coding DNA Sequence Number=SeqID_56813
  Homolog annotation: Hit_ID=Q1S3Q9; Match level="QueryCoverage=99%, HitCoverage=36%, E-value=2e-11, Identity=33%"; Hit description =Cyclin-like F-box; F-box protein interaction domain
MFGFGYDPSIVGKNLKGFPVLWTLPKVGGVYLSGTLNWVVIMGKETIHSEIVIVSVDLEKETCRSLFLPDDFCFFDTNIGVFRDSLCVWQDSNTHLGLWQMRKFGDDKSWIQLINYQKNRRFYHCACLTMEISSC

SEQ ID NO: 173592 - protein, 234 aa, Glycine max
  Coding DNA Sequence Number=SeqID_56814
  Gene Ontology: Mol. function=transporter activity; Cellular component= outer membrane-bounded periplasmic space; Biological process=transport
  Homolog annotation: Hit_ID=Q8D033; Match level="QueryCoverage=99%, HitCoverage=92%, E-value=2e-90, Identity=68%"; Hit description =Arginine 3rd transport system periplasmic binding protein
  Pfam annotation: Domain name=SBP_bac_3; Domain location=14-234; Score= 312.8; E_value=6.1e-91; Accession=PF00497.10; Description=Bacterial extracellular solute-binding proteins, family 3
MATLAMNAYAAEKIRFAASATYPPFESLDQNNRIVGFDIDLAKALCQQMQAECTFTNNAFDSLIPSLKFRRYDAVISGMDITAERSKQVDFTQPYYANSAIVIAHQGEYSDFSQLKGKRIGVENGTTHQKYLLEKHPEVIAVAYDSYQNAILDLKNGRLNGVFGDSAVVNQWLKANTDLSTVGEHITDSDYFGTGLGIAVRKGNSALLQQLNSALAALKANGRWQQINQKWFPE

SEQ ID NO: 173593 - protein, 201 aa, Glycine max
  Coding DNA Sequence Number=SeqID_56815
  Gene Ontology: Mol. function=helicase activity; Cellular component =membrane; Biological process=protein amino acid phosphorylation
  Homolog annotation: Hit_ID=Q9LTU4; Match level="QueryCoverage=97%, HitCoverage=14%, E-value=2e-63, Identity=56%"; Hit description =Helicase-like protein
  Pfam annotation: Domain name=DUF889; Domain location=120-201; Score= -83.0; E_value=7.3e-06; Accession=PF05970.5; Description=Eukaryotic protein of unknown function (DUF889)
  Subcellular localization annotation: CTP_CleavageSite=31; ConfidenceScore=5.32e-01
VVYFLYGYGGTGKTFVWTTLSSAIRSNGRIVCTVASSGIASLLLPGGRTAHSKFAIPVPATQNSTCNIHQGSELAELLKVTKLIVWDEAPMCHRFAFEALDKSLKDIMPNNLPFGGKIVVFGGDFRQILPIVPKGNRSDIVHATINASYIWDHFQILKLTKNMRLLSSAPEQPDNQELKQFSEWLLDIGDGKIGQDNDGFS

SEQ ID NO: 173594 - protein, 164 aa, Glycine max
  Coding DNA Sequence Number=SeqID_56816
  Homolog annotation: Hit_ID=UPI00005F8FA7; Match level="QueryCoverage =42%, HitCoverage=49%, E-value=2e-29, Identity=90%"; Hit description =COG0789: Predicted transcriptional regulators
  Pfam annotation: Domain name=MerR; Domain location=93-130; Score =45.2; E_value=2.2e-10; Accession=PF00376.13; Description=MerR family regulatory protein
MGLLDQWAERHILDAQDKGEFDNLPGQGQPLALEDDSAVPAELRAGYRLLKNAGYLPPALEDRKEALTVARLLQGINTCIGRQIHPGGEVMFKIGQLAKLAEVTPDTVRYYEKQGMMDHNVRTEGGYRLYTEQDLQRLRFIRYAKQLGFTLETIAELLSIPRRS

SEQ ID NO: 173595 - protein, 49 aa, Glycine max
  Coding DNA Sequence Number=SeqID_56817
MTPGHASDPLPDGHAPQPRVVPQAPQTDIPHVPEPGASSTSVEELRHAV

SEQ ID NO: 173596 - protein, 290 aa, Glycine max
  Coding DNA Sequence Number=SeqID_56818
  Homolog annotation: Hit_ID=Q7N7C1; Match level="QueryCoverage=36%, HitCoverage=35%, E-value=6e-27, Identity=59%"; Hit description =Similar to putative exported protein
LLSWAAEYKYRLDGKQLLHNYSMEQQASIIADYWFLKKMNRIILAGMLTLLLAGCMHMNDPRPKNYAASVTVVDNHVCVRVQPEGDERLAGVIIEEIGNANAIFGKNFADNEMPAVTAATCIPDDNYKFEDGKSYGVSVTLLSRDKRSKGIEPAARLFGAGWVCRTALCPWPMIYFALRKLFASAGQKRLRTPFAEGIFLHHFHLALQLQPVPARLAVVRFDVALVRHGDVGQQRAGLVAAFEARDGRRQRLQVFGVGGVDADAVQAVGAFQRRQQRPAKLRRIGVRGFD

SEQ ID NO: 173597 - protein, 125 aa, Glycine max
  Coding DNA Sequence Number=SeqID_56819
MLRFLILLPPLQPSPFMVLPPHTSKPSPRRRREEEEEEEEDIIASMEALSIEEHKKKIVEDARLVALTGKRKTSKEATMVKTDGDIIETNLGVETVKPRPMFEANAQAPDVESSGLGIIKKGGLN

SEQ ID NO: 173598 - protein, 86 aa, Glycine max
  Coding DNA Sequence Number=SeqID_56820
MVGAFDGGFEGLGSYEGCFLGFLVVSEGGSDGGEGGSFVIVVCLKARDSLWYLDNGCTRHMTGDKSRLTNPVDGSLLVGLLWRLNL

SEQ ID NO: 173599 - protein, 189 aa, Glycine max
  Coding DNA Sequence Number=SeqID_56821
NHTSSKGSTPHWPEFLKSPNLGAGIRPPKASRKWGGRNTEKIFGVLFPNVDGLVDLAAIDVFLAYHNHKESPVVAMLADLYDTFDRRCPSIRYKVTTRASKKERRIGTNSWLAWGGDRELRGSSNGIIGGYHKWLRVRTQGLDWLPNLKTVRDDEVKASEESDEVQPLKAELERAWVVEEKFKSIAIKV

SEQ ID NO: 173600 - protein, 50 aa, Glycine max
  Coding DNA Sequence Number=SeqID_56822
MKAKNESLFLDDGDPSRPTGRLPRRRKFFSTPNAYIIIAILITGAKVMAV

SEQ ID NO: 173601 - protein, 83 aa, Glycine max
  Coding DNA Sequence Number=SeqID_56823
MDKVDIFVPHPLTNACLLIQLSPECGCKPLVCLLKQPALLSVDFQDRSIRDYSSCTLVGRSELSRIGCWTNGLSYLEKKRGLN

SEQ ID NO: 173602 - protein, 58 aa, Glycine max
  Coding DNA Sequence Number=SeqID_56824
TPFHPGLFVGDAGGFQSPTREPLNVGGLVPPHCSLKSVVSDDACPGACFVQRDATTLS

SEQ ID NO: 173603 - protein, 105 aa, Glycine max
  Coding DNA Sequence Number=SeqID_56825
MRFFIVIHLFICSHEQKVPDHHRIQTQTTHRKSGKNHVGRLGVHDKTNHTLGDQSRSQCFTRMLQPYGINIGLKEHSNRVTPKAYTPKSPSGPLPPDSGPTQKTF

SEQ ID NO: 173604 - protein, 90 aa, Glycine max
  Coding DNA Sequence Number=SeqID_56826
MSKVPGLSETTLAKPQRTQMLLSRNVHKEDEHSTTWMNSLSAGMLAKRVCLEMHIFKAYLMSSLSASDVLSEIIAFSRKTQMKKFFDFLF

SEQ ID NO: 173605 - protein, 44 aa, Glycine max
  Coding DNA Sequence Number=SeqID_56827
AEDGAVGMELTLKITAAKKEEEEEEAKMKYGSRSQKRMLLIFIL

SEQ ID NO: 173606 - protein, 150 aa, Glycine max
  Coding DNA Sequence Number=SeqID_56828
TADPSAIGSRQPWLAPPLAAVKEKPRCVSSGVLGVNPGDDLLSHGLSHTTIGAAAFHFRVRDGIGWFHSANFTRETVAAALAAPASRSCPWGGSGVLGVNPGDDLLSHGLSHTTIGAAAFHFRVRDGIGWFHSANFTREAVGASPSDTAG

SEQ ID NO: 173607 - protein, 150 aa, Glycine max
  Coding DNA Sequence Number=SeqID_56829
MNIGALILAHMTSIAQSNSCRLGLTFECLSPAINLANIRKNCWNIDDLTISFRGARRARARLANIPSTSAALAPTPASTFAAPSIPAHVDSLRFETMLQSIPQGQILLLQSLQVVAPLGTILSVEQFLERVAWPGAQPSLDREGEGPVSR

SEQ ID NO: 173608 - protein, 55 aa, Glycine max
  Coding DNA Sequence Number=SeqID_56830
MKHRSKLESGGHMNALRKIIHVVPEIMEHSSKLENGGHMNDNAIHSRGSGTGGLP

SEQ ID NO: 173609 - protein, 173 aa, Glycine max
  Coding DNA Sequence Number=SeqID_56831
MAAFHGCHSLYRASMDAFHSCHSPKEASMAAEDRLEAALANLAARSTPPRILTGCLSPKIASATRPPLPFFLPAITTVAALAVQANSVTHAYRTHDHANSAATPAAHESPVLLRTTTPTSAPPPLAVFRHPKLKTVAPIAPLPLPRFHLNNRHIRLNHPLPLSLRTAHRCYRH

SEQ ID NO: 173610 - protein, 147 aa, Glycine max
  Coding DNA Sequence Number=SeqID_56832
  Gene Ontology: Mol. function=hydrolase activity
  Homolog annotation: Hit_ID=Q1EMV2; Match level="QueryCoverage=93%, HitCoverage=99%, E-value=7e-35, Identity=53%"; Hit description =Fluoroacetyl coenzyme A thioesterase
MKTTPVIGLAYQHTFTVPISKTVPALYPEAAEFQVMPVVFATGFMVGLLEWACIKAIHPYLDWPDEQTVGTHINVCHQAPTPPGMTVTVSVALLAIEGRKLVFSVEAHDGIDLIARGTHERFIIQRDRFDAKLSAKLAAHQPPLPHG

SEQ ID NO: 173611 - protein, 177 aa, Glycine max
  Coding DNA Sequence Number=SeqID_56833
MAPIKKKRWETHTSNDLELVLPDVVIDLRRNLPFDGRATQGSQVRLPREEGAQSRHQHLFEENVGKTRMCGLRTLIVKGLGVIFTHGEGISTLRVRHKGRQLSQPTLLRASEARFAGAFSKGGKCAESPLSQPTLRREGDARLTGCVFHERNTRGVATNVYLRKTSEKPEKTRSTNF

SEQ ID NO: 173612 - protein, 91 aa, Glycine max
  Coding DNA Sequence Number=SeqID_56834
MSSESKASECDTTIRKIFTTIVIIDYEPIDFRRNSEFQDRENNSRVLGKKVILSMKTIAQITGFMRKGKKYHSDCEKTYEKHHLADKLKLT

SEQ ID NO: 173613 - protein, 64 aa, Glycine max
  Coding DNA Sequence Number=SeqID_56835
MTKDVIHSHNSAAPGSIFSHFLPYCELPMPICRLSEPSTERNNPLAKREEEYGRRMSCACLLSE

SEQ ID NO: 173614 - protein, 123 aa, Glycine max
  Coding DNA Sequence Number=SeqID_56836
  Gene Ontology: Mol. function=DNA binding; Cellular component =mitochondrion; Biological process=DNA integration
  Homolog annotation: Hit_ID=Q1SJY5; Match level="QueryCoverage=92%, HitCoverage=11%, E-value=1e-41, Identity=66%"; Hit description =Integrase, catalytic region
MSGHFSQFENKSILGTRWVFKNKLDEQGKVVRNKARLVAKGYNHKEGIDFTKTFAPVDRLEAMRIMVSFVAHKNIKLFEMDVKSAFINGYIEEKVYVRQLPRFEDHTLPNHVFKIKKAMYGSK

SEQ ID NO: 173615 - protein, 135 aa, Glycine max
  Coding DNA Sequence Number=SeqID_56837
QDGDLDLNASPQALDRLLGHVLAFKVRIQSKFKNVVVLRYSNELDLINVVLKMLADSEACSKIDPSNVDCNNATHAECQSLSVTADHDPFAGFPLTPKKRMPSDEVDDELGSSQISLAQLSSNKLTRHSDKSQFS

SEQ ID NO: 173616 - protein, 114 aa, Glycine max
  Coding DNA Sequence Number=SeqID_56838
MMIEIEEVQEQMKVDIEAKKEQMTTMMEAMMSMRKMMEVSMATVVAASTATEVDPPHPSSLKQVNHLVSDMVGQGGKALGSTGSPHFVQVQNKHSFLPYGLPPNYTPPNVVTQN

SEQ ID NO: 173617 - protein, 472 aa, Glycine max
  Coding DNA Sequence Number=SeqID_56839
  Gene Ontology: Mol. function=sequence-specific DNA binding; Cellular component=nucleus; Biological process=regulation of transcription, DNA-dependent
  Homolog annotation: Hit_ID=Q66Q67; Match level="QueryCoverage=100%, HitCoverage=63%, E-value=1e-109, Identity=45%"; Hit description =Homeodomain protein HOX3
  Pfam annotation: Domain name=START; Domain location=97-335; Score =136.0; E_value=1e-37; Accession=PF01852.10; Description=START domain
MQLENAQLKEEHEKVSSLLARYLEKQMSPPELQQQAFNIPIIGSSSHAPELENSSINYEIGGSSSSHGPSRYGMQIMVSDDHNLLRSEGIEKALMFKVAAAAMNELVRLIRINEPLWTKSSTQDGKPILQHENYEKIFPRTNSFKGANLRVEATKESGIVSINSIQLIDMFLDPKYIYTHKRMVNPSLQDKWVNLFPTIVTKAETMKVIENGLVGSRSGALQLMFEQMHVLSPLVQPREFQFLRYCQQIEEGVWVIADVSFDSFRQKTSFFHSWRHPSGCMIQEMPNGCSMVTWVEHVEVDDKIQTHQLYKDLIATGIAYGAERWIMELQRICERFACFYVERIPSQDSGGVINSLEGRRSVMNFSHRMIKVFCESLTMSGNLDFPHMNMENNSGLRVSIRKNRNHLGQPKGMIVVAATSIWLPLHYMKVFEFFTDDRRRAQWDVLCFGNDANKVAHISNEIHPGNCISIYR

SEQ ID NO: 173618 - protein, 97 aa, Glycine max
  Coding DNA Sequence Number=SeqID_56840
MATQLTVAYRIFAINVLMVENPKRLLSSDATTTSTPKEERNPNYLASRLSIYCHASQLQNNNKTCVSNRWPYNIHKTALQLTVYDISAVRNCDINSI

SEQ ID NO: 173619 - protein, 217 aa, Glycine max
  Coding DNA Sequence Number=SeqID_56841
  Gene Ontology: Mol. function=nutrient reservoir activity; Cellular component=apoplast; Biological process=auxin mediated signaling pathway
  Homolog annotation: Hit_ID=Q1S4W4; Match level="QueryCoverage=85%, HitCoverage=86%, E-value=6e-81, Identity=77%"; Hit description=Cupin, putative
  Pfam annotation: Domain name=Cupin_1; Domain location=60-210; Score =155.1; E_value=1.8e-43; Accession=PF00190.13; Description=Cupin
  Pfam annotation: Domain name=Cupin_2; Domain location=95-172; Score =41.1; E_value=3.7e-09; Accession=PF07883.2; Description=Cupin domain
  Pfam module annotation: Pfam domain module=Cupin_1::Cupin_2; Domain location=60-210::95-172
MANLSLLVAVLALSLSSVALAADNSALQDFCVADPKGQVLVNGLACKDPKLVEANDFFFSGLHTAGNTTNPNGSKVTPVFATQLPGLNTLGISMARIDYAPWGINPPHMHPRATEILTVLDGALEVGFVTSNPENRHFRVVLQKGDAFVFPIGLVHYQRNVGYGNAVAIAALSSQNPGLITVANAVFGATPDIDSDVLVKAFHLDKAIVNYLQSNKF

SEQ ID NO: 173620 - protein, 48 aa, Glycine max
  Coding DNA Sequence Number=SeqID_56842
MDKSLKLGVCFSVRLKKIQMQRSIYIYLAGVAMIAQTVLAFRVSVNVV

SEQ ID NO: 173621 - protein, 459 aa, Glycine max
  Coding DNA Sequence Number=SeqID_56843
  Gene Ontology: Mol. function=binding; Cellular component=thylakoid; Biological process=photosynthesis
  Homolog annotation: Hit_ID=Q1EPH3; Match level="QueryCoverage=42%, HitCoverage=25%, E-value=7e-35, Identity=43%"; Hit description=Male sterility protein-related
  Pfam annotation: Domain name=TPR_1; Domain location=53-86; Score =31.5; E_value=2.9e-06; Accession=PF00515.18; Description =Tetratricopeptide repeat
  Pfam annotation: Domain name=TPR_2; Domain location=53-86; Score =26.1; E_value=0.00012; Accession=PF07719.7; Description =Tetratricopeptide repeat
  Pfam annotation: Domain name=TPR_4; Domain location=53-78; Score =18.6; E_value=0.023; Accession=PF07721.5; Description=Tetratricopepti de repeat
  Pfam module annotation: Pfam domain module=TPR_1::TPR_2::TPR_4; Domain location=53-86::53-86::53-78
MLVKRSGRVDEEIAMLCHKLKQIEDGLTFVGRTTKQARSQGKKIQITAEQEISRILGNLAWAYLQKGDYKTAEEHYRKALSFEVDRNKQCNLAICLIHMNKIKEAKFLLQAVRTATKNRKMDDSFAKSFERASQMLIEIETSSSQNAAFSMTTQCPPQSFENSIRMSSDSVQSRSENRSEISEGDAPHARRRLYQSPDPSRRDLSVPCTKPKRCSWGFNNGHRREAWGDANSDYKPTFGTPPNDKHVTRMLNSRENGFSSPANGNGKAATLEDPAILKHEATKVTSSDSLHTLNTESATEFTEKEKSAADDSSYGSILSESHVTVVNGVNEFASGKRKPEKKSWADIVEEEQNEENDFFSGFTNFDDKNGAEVFNDENEDSNIIYPSPWPQNQPDEWSSKKLESLDKKDGHYASESAILSRNPTARRSLCFNPELIGEKRLTRRSRLQDHGSHLLKEFY

SEQ ID NO: 173622 - protein, 70 aa, Glycine max
  Coding DNA Sequence Number=SeqID_56844
MPPPTLMVKYYEFKGYWAALQRCSPLAQRWEGVTIGRSRSYPPFASLPKYLQVGDKQYAANRDRSSSYLG

SEQ ID NO: 173623 - protein, 148 aa, Glycine max
  Coding DNA Sequence Number=SeqID_56845
  Gene Ontology: Mol. function=histidinol dehydrogenase activity; Cellular component=chloroplast; Biological process=amino acid biosynthetic process
  Homolog annotation: Hit_ID=Q5NAY4; Match level="QueryCoverage=89%, HitCoverage=28%, E-value=2e-63, Identity=90%"; Hit description =Histidinol dehydrogenase, chloroplast precursor
  Pfam annotation: Domain name=Histidinol_dh; Domain location=2-147; Score=-68.3; E_value=3.7e-15; Accession=PF00815.10; Description =Histidinol dehydrogenase
MGRLSFSVVIMCFSVHGGTAVLPSTALMLAVPAQIAGCKTIVLANPPTRDGTTCKEVLYCAKKAGVTHILKAGGAQAISAMAWGTETCPKVEKIFGPGNQYVTAAKMILQNSEAMISIDMPAGPSEVLVIADKHAIPSHVAADLLSQV

SEQ ID NO: 173624 - protein, 215 aa, Glycine max
  Coding DNA Sequence Number=SeqID_56846
MGEVEEVQEQMNADMETMKEQIATMMEAMMSMKKIMEANAVVVAATSVVAKVNPMPPSDLNQMNHPTSDMVAKDLGSTDDPMMCKFQTGMPSRHMACLPTIHHPMWRTLPMRMSITLLPYLLRADNLIVYMSLNPWGRHHEIPHHNLADFKPCLRYATEGQVVGGIPLQNTLEGPQFRPPTTTLLWKNGGLHTFKLCRFGLRQRKDQSGFGKRQI

SEQ ID NO: 173625 - protein, 185 aa, Glycine max
  Coding DNA Sequence Number=SeqID_56847
MIMRSQDIYSSQDEATTSPSSSESEEAKGGESSEEIYPQEEGQPLMVKEECKEVSVSSKRLVKKESHFEIKTNIKETSPLRQPPHLLLCKKTLVSTTTPLGLEVIPQVKELLDEGLVRKSLNPCALLVPKIDIIRNNQHKNTEKVIKGFPRTLRFVKEVSLVFRWVCVAKLQLLKEASQGGELSF

SEQ ID NO: 173626 - protein, 417 aa, Glycine max
  Coding DNA Sequence Number=SeqID_56848
  Gene Ontology: Mol. function=cation transporter activity; Cellular component=integral to membrane; Biological process=zinc ion transport
  Homolog annotation: Hit_ID=P75757; Match level="QueryCoverage=53%, HitCoverage=77%, E-value=2e-76, Identity=68%"; Hit description=Zinc transporter zitB
  Pfam annotation: Domain name=NMN_transporter; Domain location=1-130; Score=139.7; E_value=7.9e-39; Accession=PF04973.3; Description =Nicotinamide mononucleotide transporter
IQLYASLLLQLFFFVANVYGWYAWSRQTSSHEAALKIRWLPLPKAIGWGAACVIAIALMTRYIDPVFAFLTRTAVGLMQSLGLNVAMPQLQPDAFPFWDSCMMVLSIVAMILMTRKYVENWLLWVVINVISVMIFARQGVYAMALEYAILTLIALKRHAPVDAERTGTGFARAVPISGDDARGLPALRARAACRSPRITRSPGRRRADTPSAPWHGQSDNAGADTDECVAAGRRDRTAESPARAASAPAFRPPATHAHDAHYALHQCDLVQALAQQRPAAAHHQQRHQQRQNRIDRRPAGQHDDHRCHDRAHRTQQIAQHVQRGGTHVEILLFAAAMQQPERQQIRQQAGNGDAEHQAAFNRLGLVKTAQRFPDDQDGNHQQRDGVNERCQRGKTQQAKSVTRIRFAPGELHGQQRH

SEQ ID NO: 173627 - protein, 102 aa, Glycine max
  Coding DNA Sequence Number=SeqID_56849
MYKEKLSLAISHGQRLEDEHVKVSTLQVEREARERVIESFHEEAVKWIDRIALTLNGSQEIPRLLARANAMADVYSAPEEVHRLFDYCQHMVELMSHIIRNR

SEQ ID NO: 173628 - protein, 209 aa, Glycine max
  Coding DNA Sequence Number=SeqID_56850
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=3e-17, Identity=31%"; Hit description= UPI00006A17C9 related cluster
YRPLGYLLPSPLRGLHVLTFRGLHALTIRGLHALASRGLHVLTTRGLHALTSRGLHTLTVRGLHVLTIRGLHALTSRGLHVLALRGLHALTLGTSYPHRQRTTRPRLERTTRPHHQRAARPHLQRTTCPRLERATRPHLGGLHVLTIRGLHALTIRGLHVLALRGLHALILGLHVLAIRGLHALTIRGLHVLSLRGLHALTLGTSYPHR

SEQ ID NO: 173629 - protein, 108 aa, Glycine max
  Coding DNA Sequence Number=SeqID_56851
  Gene Ontology: Cellular component=mitochondrion
MDVDKILPSSSTLGWHSLKVKGEVQTKKGLWWIPRHPETRKGVVSDEMLRGVENKRRSGDSRYRSTFRTAAESTGRQETTCLNRENGVVGELFQSVVLLGEAAENAAP

SEQ ID NO: 173630 - protein, 212 aa, Glycine max
  Coding DNA Sequence Number=SeqID_56852
  Gene Ontology: Mol. function=chitin binding; Cellular component =extracellular region; Biological process=chitin metabolic process
  Homolog annotation: Hit_ID=UPI000044A8F0; Match level="QueryCoverage =84%, HitCoverage=99%, E-value=3e-22, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MTGSLDESISCFLIRLDPWVLVPIAIRGLHVLAFRGFHVLTFRGLHTLIFRGLYVLPLRGLHVLAFGGLHALAFKGSCTFTFRGLHVLTSRGLHVLVFRGLHVLAIRGLHVLAFRGLHVLAFRGLHILAFRGLHALTFRGLHVLTFRGLHVLTFKGLHVLTIRGLQALAFRGLEVLAFRGLHAFAFRVLHVLAFEGYASSLSVGSISTSKRI

SEQ ID NO: 173631 - protein, 97 aa, Glycine max
  Coding DNA Sequence Number=SeqID_56853
MTDKASGPYKKKLRTYLGIVACDKVLQTVSERWRQFKSNLTRKWALAADKDEHPGRVRAAGAGVTIKQYFGLAERTSHTSSSITPEGLEQLTQQIRD

SEQ ID NO: 173632 - protein, 119 aa, Glycine max
  Coding DNA Sequence Number=SeqID_56854
  Gene Ontology: Mol. function=protein serine/threonine kinase activity; Cellular component=plastid chromosome; Biological process =positive regulation of transcription, DNA-dependent
  Homolog annotation: Hit_ID=Q6H5Z3; Match level="QueryCoverage=99%, HitCoverage=67%, E-value=6e-42, Identity=41%"; Hit description =Putative pentatricopeptide (PPR) repeat-containing protein
  Pfam annotation: Domain name=PPR; Domain location=16-50; Score=42.9; E_value=1.1e-09; Accession=PF01535.11; Description=PPR repeat
  Pfam annotation: Domain name=PPR; Domain location=51-85; Score=36.1; E_value=1.2e-07; Accession=PF01535.11; Description=PPR repeat
  Pfam module annotation: Pfam domain module=PPR::PPR; Domain location =16-50::51-85
MRFKEMQEKGLIPDVVTYSTLIECFGKTDKVEMACRLFDEMLAEECTPNLITYNILLDCLEKSGRTAEAVDLYAKLEQQGLTPDSITYAVLERLQSGGHRKLRFRQQNPITGWVVSPLR

SEQ ID NO: 173633 - protein, 101 aa, Glycine max
  Coding DNA Sequence Number=SeqID_56855
MSTLPALPKLEIKILYVNMSEPDEDVDGGDGAAKGAAVHVAEELARLVESSRVGGLGEDEEVAVVELEESEGEGGVFEGLEDFRGFERGEGEGEGGEVVGK

SEQ ID NO: 173634 - protein, 48 aa, Glycine max
  Coding DNA Sequence Number=SeqID_56856
MDFAMGAAGGSGDDQHNQSLNKGKKTTTYRRHKEDQRTRLEEHENHTS

SEQ ID NO: 173635 - protein, 43 aa, Glycine max
  Coding DNA Sequence Number=SeqID_56857
MDSSMASPGGSGDEGSHQGRRPSYKRLSSAQTARLESDHVDRI

SEQ ID NO: 173636 - protein, 330 aa, Glycine max
  Coding DNA Sequence Number=SeqID_56858
  Gene Ontology: Mol. function=sequence-specific DNA binding; Cellular component=nucleus; Biological process=regulation of transcription, DNA-dependent
  Homolog annotation: Hit_ID=Q66Q67; Match level="QueryCoverage=91%, HitCoverage=41%, E-value=1e-49, Identity=38%"; Hit description =Homeodomain protein HOX3
  Pfam annotation: Domain name=START; Domain location=132-329; Score =46.2; E_value=1.1e-10; Accession=PF01852.10; Description=START domain
MHNENLVLREALKTIICPSCGGPHNEEERRELCLEQLRLENARLKAQHEKLSKFLVQHMDKPILEQNLDSPIRGSSSHGPLLGSSLRLRAGRSRMNLGASTSHDSFQDEEDTMSSQAGSKIITQMEKTMMAHIAVAAKDELLKLLRTNEPLWVKSSTDQRYVLHLECYETIFPRINHFKNSKARVESSKDSRIVRIKAKELVDMLLNSEIWENLFSRIVTKARTIQVLENGSLENRSGVLLLMREEMHVLSPLVPSREFYFLRYCHQVEANVWVIADVSVDCMKENNHDPNCWRFPSGCMIQGISNGMCQRHKKGKKGKQRTGRISMEQG

SEQ ID NO: 173637 - protein, 214 aa, Glycine max
  Coding DNA Sequence Number=SeqID_56859
LPQHFLKTLVVLEQGESLPSYSRFCRLRPDPQELAARLCIPGRGFVLNTEGLPCKLLRKDLTTLAQTWSVLSYSNLAIISHTSDLNLDRAWLVYGLVMKMDMNIRALISEQISLIAQSNSSRLGFQALITALCKARGVTSYSLTYESLSPAINLAYIKKNCWNLNDPSVTFPGTQKSRARRSEAPSPSVDHAPPTSAPSTFALPSAPVLPVPST

SEQ ID NO: 173638 - protein, 110 aa, Glycine max
  Coding DNA Sequence Number=SeqID_56860
MDPPLEMVAQLVLALAQDKQLHRILSLIFLSQNQQLEGWWLQRIDCFLALASAAEGLGYRASIIPHKRRFMMQSYPTRALDTKLQVHWARDAREGPRVLMSLRVDFGPMG

SEQ ID NO: 173639 - protein, 104 aa, Glycine max
  Coding DNA Sequence Number=SeqID_56861
  Gene Ontology: Mol. function=transition metal ion binding; Cellular component=cytoplasm; Biological process=fucose metabolic process
MACPCPVYEGLQSDSKKPLYPGCKKSLTSLSTVLSLVNVKARYGWSDKSFTSLLEVVHNLLPEENTLPKSYYQAKKILCPMGIEYQKIHVCPNDCILYKHEYEE

SEQ ID NO: 173640 - protein, 63 aa, Glycine max
  Coding DNA Sequence Number=SeqID_56862
IASFPVFRRFPQINVGGDSARIPFMEHASRESRVALPPKGRRASSTEDGSRQICPKFGGGIIK

SEQ ID NO: 173641 - protein, 186 aa, Glycine max
  Coding DNA Sequence Number=SeqID_56863
  Gene Ontology: Mol. function=3',5'-cyclic-nucleotide phosphodiesterase activity; Cellular component=periplasmic space; Biological process =cAMP catabolic process
  Homolog annotation: Hit_ID=Q667S9; Match level="QueryCoverage=57%, HitCoverage=31%, E-value=2e-33, Identity=64%"; Hit description =Putative 3',5'-cyclic-nucleotide phosphodiesterase precursor
MGQQRFQAVALHAAHRRRLVFPEIAVVHDNRVGLMHHRGVQQRLTGGDAGHDALHVRAAFYLQSVGGVVLKRRGVQFRSKCLPVALRHQDEFHPQIVALCQLLRNGGARVFALLQAGLDVADHHRQTVQRAIAAAVLRQVLQLLQQPGRRQMAVQMFILHPVRVRGFDNHALELLLLDKRPQRAPD

SEQ ID NO: 173642 - protein, 67 aa, Glycine max
  Coding DNA Sequence Number=SeqID_56864
MAFAHDIVELSLRNKLCALCMSIRICSRSFLTKIQSLLPHEECLAVKWWLDRNIEMAITEATGLQMR

SEQ ID NO: 173643 - protein, 135 aa, Glycine max
  Coding DNA Sequence Number=SeqID_56865
MAGTFFLLKKQNSLEIMSSEKEMTPNRVVNWPFRTLYFRRSYENSRIAKNTSFRFPSHYGIFTDRVSLLPFDFRHVSGLHILCTKGCQDMGMSPEWGWNSNGMASLVEFTGNCGRFGLGYKPTRTNMRRSALERR

SEQ ID NO: 173644 - protein, 37 aa, Glycine max
  Coding DNA Sequence Number=SeqID_56866
MLRDKWWNDTICIEMVRLMTMENLMLEDAGMQCSERI

SEQ ID NO: 173645 - protein, 318 aa, Glycine max
  Coding DNA Sequence Number=SeqID_56867
  Gene Ontology: Mol. function=acetyl-CoA carboxylase activity; Cellular component=acetyl-CoA carboxylase complex; Biological process=fatty acid biosynthetic process
  Homolog annotation: Hit_ID=UPI0000689EF2; Match level="QueryCoverage =99%, HitCoverage=100%, E-value=1e-99, Identity=57%"; Hit description= acetyl-CoA carboxylase, carboxyl transferase subunit alpha
  Pfam annotation: Domain name=ACCA; Domain location=2-148; Score =253.1; E_value=5.7e-73; Accession=PF03255.4; Description=Acetyl co -enzyme A carboxylase carboxyltransferase alpha subunit
  Pfam annotation: Domain name=Carboxyl_trans; Domain location=1-283; Score=-295.4; E_value=0.1; Accession=PF01039.12; Description =Carboxyl transferase domain
  Pfam module annotation: Pfam domain module=ACCA::Carboxyl_trans; Domain location=2-148::1-283
MEYLSFELPIKELMDQYQTCSLVGEESGVDVKLACSQIEDKIIEKKKEIYGNLTPWQRVQLSRHPDRPYALDHINGIADKGSFLELHGDRNFADDPALVGGLATLDGHKVMIIGTQKGRTTKERQHRRFGMPNPEGYRKALRLMKLAEKFRIPVVTLVDTPGAYPGLEAEERGQGEAIARNIFEMVQLKTPIFTYIIGEGASGGALGIGVGNKVYMLENTWYTVIAPESCSSILWRNWDHKEDAANALNLTPQDALREKFIDGIIEEPLGGAHYDPETAYLNLKSSILQNIKAFSKFTGQELETQRQEKFIAMGQFKG

SEQ ID NO: 173646 - protein, 300 aa, Glycine max
  Coding DNA Sequence Number=SeqID_56868
  Gene Ontology: Mol. function=ubiquitin thiolesterase activity; Cellular component=intracellular; Biological process=ubiquitin -dependent protein catabolic process
  Homolog annotation: Hit_ID=Q93X76; Match level="QueryCoverage=97%, HitCoverage=64%, E-value=1e-129, Identity=73%"; Hit description =Putative carboxyl-terminal proteinase
  Pfam annotation: Domain name=DUF239; Domain location=81-260; Score =276.6; E_value=5e-80; Accession=PF03080.5; Description=Arabidopsis proteins of unknown function
MDDDLSDSFQLWSLSGESCPEGTIPIRRTTEEDMLRANSVRRFGRKKVINRVRRDTSGNGHEGISTTEQRLALTCGHPLWKTHMNSACLKCGSFLVHLGMISTPLKLVSPELYGDSYPRFFTYWTTDAYQATGCYNLLCSGFVQTNSKIAIGAAISPTSSYSGGQFDISLLIWKQDPKHGNWWLEFGSGILVGYWPSFLFTHLGDHASMIQFGGEIVNSGSSGSHTSTQMGSGHFAEEGFAKASYFRNMQVVDWDNNLIPLSNLKVLADHPNCYDIQGGVNNAWGNYFYYGGPGRNVKCP

SEQ ID NO: 173647 - protein, 594 aa, Glycine max
  Coding DNA Sequence Number=SeqID_56869
  Gene Ontology: Mol. function=subtilase activity; Biological process =proteolysis
  Homolog annotation: Hit_ID=Q1XNN9; Match level="QueryCoverage=45%, HitCoverage=37%, E-value=2e-21, Identity=28%"; Hit description=C -type lectin precursor
  Subcellular localization annotation: CTP_CleavageSite=37; ConfidenceScore=5.31e-01
MGSCPVTTPIYKVLTCMKNTTTSINICATKIITPTFSSSTQTPVPSTVSILTAPIHGTAILNPSTGIITYNPAPGYFGPDVIVYTFCGNAPEFIDCETVTINLTVVPFIVKDATLEACQYEDKAYFDLTTANVIDFNLVTKKYYPTLADLNANTNQITNPQNYESTGGVVYVNITSNEGCTGIAKITLIAKPIKKSPTLLDKYICIDSRTNLDAGPGYDSYQWSTGATTQSIEGVGVGEYTVILGKDGCFVTQIVKVIKTQDPVITQIEISNNTATVIVTGGTPPYKYSVDGTSNWQDSNVFTNLSRGQHTFYVKDANNCTPISVEITVPNLINAITPNGDNINDYIDYSELGYKENLSFVIYDRYGNKIFTGDKFNNYKWDGRHFDKKIVTGTYWYHINWNESNKEKTPIKYTGWILRDTDHWIAPYYSTIEGYTNALYLSTDSVIPFEVKIYNNNSIIGTAIISKGNPQTFTLNNNVILATNIADGFKVINKGLYLKGDKRFYCSLRMAQSAHGEIITSKGKAGIGKEFFIASSPNSAISAIYNFTAGILATEDNTTVTVSWNSTGVTFYGGTPTGNSHTFTLNKGQSFIFA

SEQ ID NO: 173648 - protein, 77 aa, Glycine max
  Coding DNA Sequence Number=SeqID_56870
MISKGEGSDFVAKAVDLAARELITSASLGQDEISKQGANYFLHMYRLWSSVSGELVVYFKVMLSLGEKSGRKKKDKE

SEQ ID NO: 173649 - protein, 86 aa, Glycine max
  Coding DNA Sequence Number=SeqID_56871
MGSYGGHSSTGEGGTTVWLHPKHPSVAYDYDGYEAIAQRLERVLNLRMVTAGTELYEIMHDCLTIARGGASADGSVRAGQRRRMNH

SEQ ID NO: 173650 - protein, 183 aa, Glycine max
  Coding DNA Sequence Number=SeqID_56872
  Gene Ontology: Mol. function=protein serine/threonine kinase activity; Cellular component=cytoplasm; Biological process=protein amino acid phosphorylation
  Homolog annotation: Hit_ID=Q9M728; Match level="QueryCoverage=98%, HitCoverage=39%, E-value=2e-80, Identity=79%"; Hit description =Viroid symptom modulation protein
  Pfam annotation: Domain name=Pkinase; Domain location=1-121; Score= -74.7; E_value=0.00041; Accession=PF00069.15; Description=Protein kinase domain
MVGGCLPELMAEPTNVRSMSFVGTHEYLAPEIIRGEGHGSAVDWWTFGIFLYELLHGITPFKGEGNKATLFNVVGQPLRFPKKPHVSNVARDLIKGLLVKEPQKRFAYKRGATEIKQHPFFNGVNWALVRSATPPIIPKPLDFSKYANKSNIPPIDKKIADIVASDKSRHTQPNSSYEDFEYF

SEQ ID NO: 173651 - protein, 114 aa, Glycine max
  Coding DNA Sequence Number=SeqID_56873
MENHIYASSYSPSTNYRSFRDHPAADAMFLSHHLHHRTDASDAAAFRFPSSALSAVEAADIAPPGVTSRIASSAASANFLSSWPPVAAAAAVPSALDLKRSSDGYKVCVRVECF

SEQ ID NO: 173652 - protein, 219 aa, Glycine max
  Coding DNA Sequence Number=SeqID_56874
VIESLHAEAMKWMDRFAFTLNGSQELPRLLARAKAMADVYSAPDEVHGLFDYCQHMEVQEQMKADMEAMKDQMTSMMEAMISMRRMMEDNAAAVATTSAAAEADPTHPSGINQTSRPVPDVVGQGGEVLGSKVIENTNHSVPVLLESQQPQLGHAPFAQPMGETREEPWDHALGEFEPYPAYATEGPTFGGMPQPKSPATTLTFLGGETTSRHGRKREI

SEQ ID NO: 173653 - protein, 187 aa, Glycine max
  Coding DNA Sequence Number=SeqID_56875
  Gene Ontology: Mol. function=protein serine/threonine kinase activity; Cellular component=cytoplasm; Biological process=protein amino acid phosphorylation
  Homolog annotation: Hit_ID=Q1SXL1; Match level="QueryCoverage=90%, HitCoverage=42%, E-value=3e-30, Identity=65%"; Hit description =Serine/threonine protein kinase, active site
  Subcellular localization annotation: CTP_CleavageSite=15; ConfidenceScore=5.13e-01
MPSNSNPSTTSSRVVAETTREFSIITKSTNQGQRSGVSSRNDSLESTSGAHIKPHTGGDVRWDAINMVSRGNGLNLSHFKLLQRVGYGDIGSVYLVELKGSKAFFAMKVMDKASLAKILLALEYLHMLGIVYRDLKPENVLVRDEGHIMLSDFDLSLRCSVNPTLVKSSSAHESNNGPSGSILDDEQ

SEQ ID NO: 173654 - protein, 246 aa, Glycine max
  Coding DNA Sequence Number=SeqID_56876
  Gene Ontology: Mol. function=chitin binding; Cellular component =extracellular region; Biological process=chitin metabolic process
  Homolog annotation: Hit_ID=UPI0000DBF0F4; Match level="QueryCoverage =94%, HitCoverage=93%, E-value=1e-23, Identity=37%"; Hit description =Choline-phosphate cytidylyltransferase B (EC 2.7.7.15) (Phosphorylcholine ...
  Homolog annotation: Hit description=transferase B) (CTP:phosphocholine cytidylyltransferase B) (CT B) (CCT B) (CCT-beta).
DYTSHLQRTARLTFRGLDAFTFRGLEVLAFRGMHALGFRGLDVLAFRGLHAFAFRGLDVLVFRGLDVLAFKGLHVFTFRVLYVLTFRGLDVLAFRGLHALAFKGLRAPTFRGLRALTFRGLHVLTFRGLHVLTFRGLHALAFRGLHVLAIRGQHVLAFRGLHILTFIGLHVLTFRELLVLTFRGLRALTFKGLHVLALRGLHAFTFKGRYVLDFRGLHAFAFRRLCVLTFNGLHIRTLREFKVLCP

SEQ ID NO: 173655 - protein, 86 aa, Glycine max
  Coding DNA Sequence Number=SeqID_56877
MAGWNDCAIADALQALAQALGNQNKGEAVGAAEYQGLNHFQQNNPPGFNGGYNPDSAQNWIREIEKIFQVMTCPEGQKVAFPTYTL

SEQ ID NO: 173656 - protein, 115 aa, Glycine max
  Coding DNA Sequence Number=SeqID_56878
  Gene Ontology: Mol. function=RNA-directed DNA polymerase activity; Cellular component=chromatin; Biological process=RNA-dependent DNA replication
MASEDMEKTMFVTLWGTFCYKVMSFGLKNVGATYQRAMVALFHDMMHKEIEVYMDDMIAKSRTEEEHLVNLRKLFERLWKYQLRLNLAKCTFRVMSGKLLGFIISQKGIEVDPDK

SEQ ID NO: 173657 - protein, 237 aa, Glycine max
  Coding DNA Sequence Number=SeqID_56879
  Gene Ontology: Mol. function=nucleic acid binding; Cellular component= integral to membrane; Biological process=DNA integration
  Homolog annotation: Hit_ID=Q1T010; Match level="QueryCoverage=99%, HitCoverage=17%, E-value=1e-46, Identity=43%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=zf-CCHC; Domain location=196-213; Score =28.0; E_value=2.3e-05; Accession=PF00098.13; Description=Zinc knuckle
ANFQKIAHAKTAKEAWCILEKAYSGDAKLKKVKLQTLRRQYEMIQMEPTEKVVDYFTRILSTTNLMKDCGEKLDDHMVVEKILRSLSPRFDYIVCAIEESKNLEDLKIEELQGSLGVHKQRLNDRDTERSTQALQAHSSKGKGRGEWSIDKGKGSHKTHSKNSKETQSETGESSGQHKNGVKSWKKEGKKFDKRKVKCFNCNKYEHFASECTHKQKEGRNKVGDEANLAEEADSDSE

SEQ ID NO: 173658 - protein, 680 aa, Glycine max
  Coding DNA Sequence Number=SeqID_56880
  Gene Ontology: Mol. function=nucleic acid binding; Cellular component= intracellular; Biological process=DNA integration
  Homolog annotation: Hit_ID=Q1T010; Match level="QueryCoverage=99%, HitCoverage=52%, E-value=0.0, Identity=51%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=178-341; Score =181.9; E_value=1.6e-51; Accession=PF00665.16; Description=Integrase core domain
  Pfam module annotation: Pfam domain module=RVT_2::rve; Domain location=485-680::178-341
MTGNKHWLVNLDTSQGSKVRFADSSSICCEGVGNVVIKRKDGSNAIIENVMYCPTMDSNLLSLGQLLEKGYKMRMEDLMLKVYDKKQSFILKAKMSNNRTFKVNFNVVDVHCMTAEGNDVNWLWHFRYGHLNFHGLSRLVAKHMVSGMPQIKAPTEVCEGCVAGKQPRNSFNVSLPPRAKEPLEVVCSDVCGPIEPCTYGGNLYFVIFINEFTRMLWVYPIKRKSEVFAVFQKFKAYAEKQSGATLKILRTDGGGEYTSKEFEVFCESKGIVHEVTAPYTPQHNGLAERRNETLLNMVRSMLKLKGLPKELWGEAVTTATYILNRSPTKKLEKITPEEAWTGKKPRVSHFRIFGSPCWKHVLDEKRKKLDDKTIEMIMVGYHPTGAYKLYDPIEKKVQSKGMSVLNELGETSGEEAIGNSIGGASPAIAQRPQRISKLSTRLSDFEVYTEDAIISEGELVHYALLVDAEPVGYVEALKEEVWKKAMLEELAAIERNHTWKLVKLPKGKKPISLRWVFEVKRKPDGTIEKHKARLVVRGFMQREGLDYTEVFAPVARIETVRIVVVLAHSRGWNMWHLDAKSAFLNGLLEEEVYVTQPPGFESKESGNLKLNKVLYGLKQAPRAWNKRIDGFFLKIGFEKCKVEYEVYVKEENGDVIILCLYVDDLLIIGGNEVVIQIVKK

SEQ ID NO: 173659 - protein, 105 aa, Glycine max
  Coding DNA Sequence Number=SeqID_56881
MVGAGLKKDLRVSRVVPGGSLNAFLFLLIGVISQRLAMGFLIWDPGEEDQAGPCEQLDALSPFNPLSEMWQKEKESMDRPHRLHPVGTTRSPQGRIRHPGVADRP

SEQ ID NO: 173660 - protein, 304 aa, Glycine max
  Coding DNA Sequence Number=SeqID_56882
  Gene Ontology: Mol. function=DNA-3-methyladenine glycosylase I activity; Biological process=base-excision repair
  Homolog annotation: Hit_ID=Q1SSK0; Match level="QueryCoverage=100%, HitCoverage=77%, E-value=1e-90, Identity=61%"; Hit description =Methyladenine glycosylase
  Pfam annotation: Domain name=Adenine_glyco; Domain location=206-304; Score=3.4; E_value=1.5e-10; Accession=PF03352.4; Description =Methyladenine glycosylase
  Subcellular localization annotation: CTP_CleavageSite=33; ConfidenceScore=5.14e-01
MCSSMTKVTVGIEAATATSLVARINGRPVLQPTCNRFPNLERRNSIKKLSPKSPCPPSPPLPSKTSLAPLVSPKSKSPRPPPIKRGNESTGLNSSSEKIVTPRNTIKTPTLERKKSKSFKERSYDALGLSASTEASLSYSSNLITESPGSIAAVRREQMALQHAQRKMKIAHYGRSKSAKFERVVPLDPSSNLTSKTSEEEKRCSFITANSDPIYIAYHDEEWGVPVHDDKMLFELLVLSGAQVGSDWTSILKKRQDFRAAFSEFDVATLANLTDKQMVSISLEYGIDISQVRGVVDNANRILE

SEQ ID NO: 173661 - protein, 89 aa, Glycine max
  Coding DNA Sequence Number=SeqID_56883
MAASSQFNISADQDASTKIEKSTPRPTPIVTTTTSNKGLEFILIPGHEKQCKKVWENPESKFACLRASLQSSYFNLNGHNYYRRPQTTR

SEQ ID NO: 173662 - protein, 625 aa, Glycine max
  Coding DNA Sequence Number=SeqID_56884
  Gene Ontology: Mol. function=CTP synthase activity; Cellular component=cellular_component; Biological process=pyrimidine nucleotide biosynthetic process
  Homolog annotation: Hit_ID=Q9LTW8; Match level="QueryCoverage=86%, HitCoverage=91%, E-value=0.0, Identity=74%"; Hit description=CTP synthase
  Pfam annotation: Domain name=CTP_synth_N; Domain location=1-284; Score=691.5; E_value=6.2e-205; Accession=PF06418.4; Description=CTP synthase N-terminus
  Pfam annotation: Domain name=GATase; Domain location=308-545; Score =263.9; E_value=3.3e-76; Accession=PF00117.18; Description=Glutamine amidotransferase class-I
  Pfam annotation: Domain name=Peptidase_C26; Domain location=301-527; Score=-100.0; E_value=0.0085; Accession=PF07722.3; Description =Peptidase C26
  Pfam module annotation: Pfam domain module=CTP_synth_N::GATase::Peptid ase_C26; Domain location=1-284::308-545::301-527
MKYVLVTGGVVSGLGKGVTASSIGVLLQACGFRVTSIKIDPYLNTDAGTMSPFEHGEVFVLDDGGEVDLDLGNYERFLDLKLTRDNNITTGKIYQSVIEKERRGDYLGKTVQVVPHITDAIQEWIECVAQIPVDGKEGPADVCVIELGGTIGDIESMPFIEALGQFSYRVGPGNFCLVHVSLVPVLNVVGEQKTKPTQHSVRQLRGLGLTPNLLACRSSKELDDNVKEKLSQFCHVPSSSILTLYDVPNIWHIPLLLRDQKAHEAILKTLNLRGVATEPNFKEWIATTKVYDKFHEMVRIAMVGKYTNLSDAYLSVLKALLHASTACNHKLVVDLVPAEHLEDDTSKEDPDAYKAAWGLLKGANGILVPGGFGDRGVEGKILAAKYARENNIPYLGICLGMQIAVIEFSRSVLGLHDANSTEFDPKTENPCVIFMPEGSKTHMGGTMRLGSRRTYFHVADCKSAKLYGNASFVDERHRHRYEVNPDMISQLESAGLSFVGKDETGKRMEIVECPSHPFFIGAQFHPEFKSRPGKPSPLFLVYLWCILSEREKFNTLNECLIVTGLISAACERTIVPASNGYSKLTNGIHSPLLKAAAAHNGNNGFKSSNSSLNGVYTSTTTNGVC

SEQ ID NO: 173663 - protein, 185 aa, Glycine max
  Coding DNA Sequence Number=SeqID_56885
FQSAALKIRKENAELRDINIATTKALEQETKRARREEHGRNKFRGALWGCNNELKLRREERDQSRVDSLILKDELKACSRSKRSLSQRLCETETNMLAIITKYQEELSLATTHEHRVADEYAQVYAEKEARGRVIDSLHQEATMWTDRFALTLNGNQELSRLLAKAKAVADTYSAPEEIHGLLSY

SEQ ID NO: 173664 - protein, 142 aa, Glycine max
  Coding DNA Sequence Number=SeqID_56886
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=53%, HitCoverage=14%, E-value=8e-37, Identity=97%"; Hit description=NADH -plastoquinone oxidoreductase subunit 2
MGGASSSILVHGFSWLYGSSGGEIELQEIVNGLINTQMYNSPGILIALLFITVGIGFKLSPAPSHQWTPDVYEGVRVRNNESLYDKQIHFASSLLRVVPTKDRTNDVYNTLNSRCRCYIVGSHPSDTTSIIGASVNKRITLR

SEQ ID NO: 173665 - protein, 343 aa, Glycine max
  Coding DNA Sequence Number=SeqID_56887
  Gene Ontology: Mol. function=malate synthase activity; Cellular component=glyoxysome; Biological process=tricarboxylic acid cycle
  Homolog annotation: Hit_ID=Q81TX1; Match level="QueryCoverage=95%, HitCoverage=62%, E-value=1e-128, Identity=66%"; Hit description =Malate synthase A
  Pfam annotation: Domain name=Malate_synthase; Domain location=5-343; Score=428.1; E_value=1.2e-125; Accession=PF01274.12; Description =Malate synthase
METTIQLRIKAQSQFEEIFNPELIEFLIELHQNFNAKRLDLLEERKETQLDFDRRNLPRFLPQTEEIRNGDWVCSPLPEDLLDRRVEITGPVDRKMIINALNSGASTFMADFEDSNAPTWKNCMEGQINLSDAINGSIDFTTREGKAYQLQEKTAVLLVRPRGLHLHEKHIEINGEEASGSLVDFGIYFFRNAQRLLEKGSGPYFYLPKLEHYKEARWWNEVFDFAQNYLQIPRGTIKATVLIETITASFQIDEILYELKEHSAGLNCGRWDYIFSFVKKFRNLPEFIIPDRDQVTMTSPFMTAYSKRVIEICHKRNVHAIGGMAAQIPIKNDDQANHIALKK

SEQ ID NO: 173666 - protein, 276 aa, Glycine max
  Coding DNA Sequence Number=SeqID_56888
MGCCFSTPTKQTQNKNQNNQTTKKNHHHEPPPPLEAESVKEVLSETPITKPQQVPILTPETKTLLPLLQDPPPNFETKSKAPPTEEVSEVVSQLSETCSISESFSAATTATTATAVTATTTTVTVADKREEDEATSKIHKWDRSPSRKRPYAADGNLAGVRYRRLKSPARRQEPSPEKKIKGGPRPIRGREILDSGTAANRKRNVGPAALRRDSGEGSGRRSRSPACARNGKVGAGGGRKEVAPAKEVEKETKSECEEVGEKNDVVSKEECLENPH

SEQ ID NO: 173667 - protein, 43 aa, Glycine max
  Coding DNA Sequence Number=SeqID_56889
MEKSKEEKAYTMVKSYSTSLNKCCCIPKQWRAEAYKPEKLNFT

SEQ ID NO: 173668 - protein, 100 aa, Glycine max
  Coding DNA Sequence Number=SeqID_56890
MAGDDADEDDNQNLNIEPPLGIELAYSTTIHMSDIGNNRPWEDHEFGHLIDHPKELVYELRMLFRGMRFPNKANVKYAVNIYRIKNNRSYKVTKSGTDLG

SEQ ID NO: 173669 - protein, 51 aa, Glycine max
  Coding DNA Sequence Number=SeqID_56891
  Homolog annotation: Hit_ID=Q10QG2; Match level="QueryCoverage=82%, HitCoverage=10%, E-value=2e-08, Identity=67%"; Hit description=COP9 signalosome complex subunit 4, putative, expressed
MRDLGSNIPFKVRITQVDMLVREKLVELYESEKQWSKASQMLSGIDLDSGI

SEQ ID NO: 173670 - protein, 104 aa, Glycine max
  Coding DNA Sequence Number=SeqID_56892
MGWGCLASPVDETQADSGCLASLVGESQVDYTASRDGGSSWGCVAIPIGDTLLSPSYVAYIATGSDDTPLSPALLPLAMAGSAMPPVAMAVSPENRPPPLFLLK

SEQ ID NO: 173671 - protein, 551 aa, Glycine max
  Coding DNA Sequence Number=SeqID_56893
  Gene Ontology: Mol. function=hydrolase activity; Cellular component =membrane; Biological process=intracellular signaling cascade
  Homolog annotation: Hit_ID=Q1T1F7; Match level="QueryCoverage=75%, HitCoverage=88%, E-value=1e-51, Identity=32%"; Hit description=IMP dehydrogenase/GMP reductase
  Pfam annotation: Domain name=DUF1723; Domain location=128-177; Score =40.9; E_value=4.2e-09; Accession=PF08330.1; Description=Protein of unknown function (DUF1723)
MDFARVAVTAAHDEPVVPAPDVQANIFPDDPMAPADVKDIVADIPVNTGVEAVKDKHEGFLGGPSDPSVLTQYADHVACSVWTGEERPKLKLSSHGRKVHSLGRHVPGIEGLVAGTGLSPLIACSVDLGDRGLLSSFVERWHWETSSFHLPVGELTIMLDNVSSLLHLPVVGDLHAFQPLHVDDAVQMLVDLLMVSAESVGAETAQCHGPYVRLQWVRDIYERRCQTSHWTVAARAYLLHLLGCTLFANKSATNVHVVYLEALRDLSMTERYAWGVAALVHMYDQLNDTSISHSRQLGGYIILLQCWIYEHFSSVADSTADQEYDEDSPRACRWIAMKKIVKSIRTPMYRERLDRLRIPDVCWIPYGEHRSVRDFHVISCYSGLLGWGPIVVYYRPERVVRQFGYMQTIHAPPVDSWVSYNDIHDRWMHYSDHIVPAGEVCAVPGQCASDYMDWFFRISHPFMTPGHASDPLPHDHAPQPRVVPQAPQTDIPHVPEPGASSTSMEEPRHAVEVCNDIAERLECHLSLGVVTPGSLTHEVIEECLRLARSVT

SEQ ID NO: 173672 - protein, 115 aa, Glycine max
  Coding DNA Sequence Number=SeqID_56894
MEIAQIKEFGLAKVSTPQGCLVGEVTKETCEGYNRIFITKKGVLRQPLGALGYWNIEVYIDDVVVRLPNFDKHLSDMEQAIKRIRAHELKKESKGMHFSNNDKSFPRILSPSKRG

SEQ ID NO: 173673 - protein, 144 aa, Glycine max
  Coding DNA Sequence Number=SeqID_56895
  Subcellular localization annotation: CTP_CleavageSite=53; ConfidenceScore=5.53e-01
MWIQKLTDQLDPELSLLQAMPTNSARRILTSTMPTRGGSNTTVNLVGIPTAARSMMTKKTKMKNECAAVMTTVLKLFREEEDERRLGRRRTREGGDQKLKRSKNGEEEAEAGMWDWKGERRMNNFFFKLIKPEADFGYTFFAQR

SEQ ID NO: 173674 - protein, 191 aa, Glycine max
  Coding DNA Sequence Number=SeqID_56896
MVVDEEEDSSKDDLAVEQMEAKLLKGKPYPYHALRPSKGKETVKDQQTRHPNGQEIPSPEELKNGIFLYIGPKIGSNLANNEGQKEKMSPPRRKTSLGERHAAEVNVREGVTTLKIIMGIHERPVVTSARPMLSLLLGWTDFEFDGLLSNDVLIPMVVVGLFPMEFARQGPQSMNLERDALIHEGGISESS

SEQ ID NO: 173675 - protein, 87 aa, Glycine max
  Coding DNA Sequence Number=SeqID_56897
MQVEKKNKNATTWRRRQRNEENGHKWPREKKKNALHDPYILYGSCNPEEHPQQQWQLPIAYVRMLWAFAAREHHLNHDYPFSRRLFL

SEQ ID NO: 173676 - protein, 79 aa, Glycine max
  Coding DNA Sequence Number=SeqID_56898
  Gene Ontology: Mol. function=hydrolase activity, acting on acid anhydrides, catalyzing transmembrane movement of substances; Cellular component=proton-transporting ATP synthase complex, coupling factor F(o); Biological ...
  Gene Ontology: Cellular component=process=ATP synthesis coupled proton transport
  Homolog annotation: Hit_ID=P56760; Match level="QueryCoverage=76%, HitCoverage=100%, E-value=3e-10, Identity=53%"; Hit description=ATP synthase C chain
  Pfam annotation: Domain name=ATP-synt_C; Domain location=26-75; Score= 38.8; E_value=1.8e-08; Accession=PF00137.12; Description=ATP synthase subunit C
MKVETKNKSRSNSLRGNIMNPIISAASVIAAGLAVGLASIGPGVGQGTAAGQAVEGIARQPEAEGKIRALALLFANPFV

SEQ ID NO: 173677 - protein, 291 aa, Glycine max
  Coding DNA Sequence Number=SeqID_56899
  Gene Ontology: Mol. function=RNA-directed DNA polymerase activity; Cellular component=chromatin; Biological process=one-carbon compound metabolic process
  Homolog annotation: Hit_ID=Q1T2D5; Match level="QueryCoverage=31%, HitCoverage=7%, E-value=5e-21, Identity=47%"; Hit description=Chromo
MALVSPKSCLMNVFLCHVYLMKALAQIQFRKTRRSSKLVEEFINGGHRKSVFDGAMVELDETRIKHRLNLFLEFYLLAMGIPIWFNCDGFGVEERCMWWEMGRTGEVGGAIWKRVETAWVCIMRLSWWTEAVGGLRGMFATSHWAPNTMSAPLKGKPKRVYWCGRKTEKLGNAQLRKIVRTATNKNGELVVVDGAIGGVWRHRKINILVRDEEVDTGIAVMPRRPLIVAIIIETLALLMGRGLVGWVVVYNGEKGGGYGGGQATCPLEVWPEPRPEASTSTAKPTPHDEVH

SEQ ID NO: 173678 - protein, 173 aa, Glycine max
  Coding DNA Sequence Number=SeqID_56900
MEHNGDKGNFLIWDATCIKLFGKTAGECRDELILVGEDIKVFPTCVDEILLKTWAVRFKFRSQLRQSSVLDVSEELHHIQSLIATLGLKEQSSKGKGIAIEPESSPPIFVHHGGSFVSILHHPSLSQSSDYDPGNSTCLTPTKMISCQQTNSDFDSDEHAQYQLSTNKHIKAE

SEQ ID NO: 173679 - protein, 366 aa, Glycine max
  Coding DNA Sequence Number=SeqID_56901
  Homolog annotation: Hit_ID=Q7CL33; Match level="QueryCoverage=52%, HitCoverage=43%, E-value=8e-39, Identity=44%"; Hit description=RhsD protein
  Pfam annotation: Domain name=RHS; Domain location=177-214; Score =25.9; E_value=3.4e-05; Accession=PF03527.4; Description=RHS protein
  Pfam annotation: Domain name=RHS_repeat; Domain location=30-86; Score= 17.5; E_value=0.048; Accession=PF05593.4; Description=RHS Repeat
  Pfam annotation: Domain name=RHS_repeat; Domain location=90-125; Score=12.8; E_value=1; Accession=PF05593.4; Description=RHS Repeat
  Pfam module annotation: Pfam domain module=RHS::RHS_repeat::RHS _repeat; Domain location=177-214::30-86::90-125
MRCKVVSCIKDHLLQHREPNQGKPGARLVYDLADNLLGERSPQSDIDAHLPLAPIVDNRLTHWQKLFYRYDAWGNLISRRNGLYEQHYRYDADNRLVQAQGEFDAQCHYDALGRRSRKAVRYKGKTEQTTRFLWQGYRLLQEQRDDGSRRSWSYDPASPWSPLAALEQAGDSHSADIYWYHTDLNSAPLEVTDAAGNLCWSGQYDICFPDPKSRLSSFFIWNEGDGKFLSYSLPKGKMPSASSSDIFNLHDYFPASLGIPIFSKRAKAVFERKVSSEMLFYECAVENVTETMFLCKVNNYFSIIDEEASTFRELEDGSKLIDVPAYKCDREFFIARDSIYCERIIVSQQFVDLCNEEQLNIGFERC

SEQ ID NO: 173680 - protein, 71 aa, Glycine max
  Coding DNA Sequence Number=SeqID_56902
MRGYRMVIRTFRQPGANEPIEAQRLTSSFAPFVIQGQRVRWQVEIPYGHPHLSSTEANEFDGIRMMLVVRF

SEQ ID NO: 173681 - protein, 349 aa, Glycine max
  Coding DNA Sequence Number=SeqID_56903
  Homolog annotation: Hit_ID=Q8GMB4; Match level="QueryCoverage=27%, HitCoverage=22%, E-value=3e-17, Identity=50%"; Hit description=Group II intron-associated open reading frame
KYFTFGDRRWLFSAATPEGKTLHLTRAMDTPIKRHIKIRGDATPYSPGMEIYFERRLDLIWTGKLKKMKTVAALWKRQATICLILSCYIPTATVSYTAGKPVPIAGIYKGLSGMRGNLHVPFLGGGGAAETAEQRTDDSESIKRVKGISGLAGMAGAPAPAFPGPQGVGVAVQMLAENPKKTAPGGAVCGHQLPGLFARSFLCRSSQHARVQAACMDNQRRAAIPSPASSRTAISGLTEALPLATLLSAEADTPSSFASTRRPILLSSIYSIKNISITVREFESDAPVSPDRDGKKVFPVAFQGMKTKARVVFEFIGRNSLINDQQAKPDAFSVLSLHAADIAFFKQLL

SEQ ID NO: 173682 - protein, 92 aa, Glycine max
  Coding DNA Sequence Number=SeqID_56904
MRAADLESNGIHGRSGCHREEIVKRKKKKNKETEKDRKRKLREKKGESLPPEVISGNGERWHIEKQRWLPFVIGRIGGKRKKKKVWCNRSTI

SEQ ID NO: 173683 - protein, 336 aa, Glycine max
  Coding DNA Sequence Number=SeqID_56905
  Homolog annotation: Hit_ID=Q1T2K4; Match level="QueryCoverage=90%, HitCoverage=67%, E-value=1e-71, Identity=50%"; Hit description=IQ calmodulin-binding region
  Subcellular localization annotation: CTP_CleavageSite=50; ConfidenceScore=5.26e-01
MARRALRALRGLVRLKTLQGQSVKRQAASTLRSMQTLARLQSQIRESRIRMSEENQALQHQLPQKHEKELEKLRAAVGEEWDDRSQLKEQIEAKLLHRQEAALRRERALAYSFSHQQTWKGSSKSLNPTFMDPNNPKWGWSWLERWMATRPRDGHSTVVDHNDHASVKSAASRAMSVGEITKLCSLQDKRPSPFGQKPRRPAPQSSPSKTPSTNGKARPSSSKGSSVWGGDEGSRSMFSVQSERYRRHSIAGSSVRDDESLASSPAIPSYMAPTSSAKARSKIIRPSPEKGGDSVFARKRLSFSPSSASRRHSDPPKVEMVSNNDAAAAVSNGRGR

SEQ ID NO: 173684 - protein, 128 aa, Glycine max
  Coding DNA Sequence Number=SeqID_56906
MAAQLIHDRVVMECLEGVWETLKGNERCRFRGTIQLTATSLVHPEEPARTLQQPVEWILPTPTPYRLVEPDPEELSPEPAVDDLDLPEDDEDPLPDVDSPEDIMSASKADSTKESGPRGTANSDDSSS

SEQ ID NO: 173685 - protein, 323 aa, Glycine max
  Coding DNA Sequence Number=SeqID_56907
  Gene Ontology: Mol. function=RNA binding; Biological process =gynoecium development
  Homolog annotation: Hit_ID=Q1T451; Match level="QueryCoverage=89%, HitCoverage=61%, E-value=1e-108, Identity=71%"; Hit description=KH, type 1
  Pfam annotation: Domain name=KH_1; Domain location=246-307; Score =52.4; E_value=1.5e-12; Accession=PF00013.19; Description=KH domain
  Pfam annotation: Domain name=KH_1; Domain location=70-137; Score =59.5; E_value=1.1e-14; Accession=PF00013.19; Description=KH domain
  Pfam annotation: Domain name=KH_2; Domain location=70-115; Score=3.0; E_value=0.053; Accession=PF07650.7; Description=KH domain
  Pfam module annotation: Pfam domain module=KH_1::KH_1::KH_2; Domain location=246-307::70-137::70-115
MCHIVVFSLLFIACTFQCRWEVAKVLISGKEDLEAPLSPAMDAVIRVFKRVSGFSEIDAKNKASAVAFCSVRLLVASTQAINLIGKQGSLIKSIQENTGASVRVLSGDEVPFYAAADERIVELQGEAMKVLKALEAVVGHLRKFLVDNSVLPLFEKTYNATISQERQADTTWVDKPSLHSASQPSIVTDIPLSTKRDSLFADRESQLDSLLPPSTMSMYGQDSSLSGLRSSALSRPSAPPIVTTVIQTMQIPLSYAEDIIGIQGTNIEYIRRTSGAILTVQESRVPDEIIVEIKGTSSQVQTAQQLIQLDLHRHMCMLGQLRS

SEQ ID NO: 173686 - protein, 89 aa, Glycine max
  Coding DNA Sequence Number=SeqID_56908
MASTDQQKKDTDTVGSSTGMFKPTGDSVDEVISNHTEPVASNYSRLDTGLRSSYPQLGSSSYSSSSLSSQPYSGGYGSSALGGYSTFRL

SEQ ID NO: 173687 - protein, 139 aa, Glycine max
  Coding DNA Sequence Number=SeqID_56909
  Gene Ontology: Mol. function=cytokine activity; Cellular component =extracellular space
  Homolog annotation: Hit_ID=Q9LU69; Match level="QueryCoverage=85%, HitCoverage=88%, E-value=2e-41, Identity=75%"; Hit description=Light- inducible protein ATLS1-like
  Pfam annotation: Domain name=MIF; Domain location=2-128; Score=34.4; E_value=7.8e-08; Accession=PF01187.8; Description=Macrophage migration inhibitory factor (MIF)
MPTLNLFTNVPVDTVVASDILRDATKAVAKIIGKPESVKSSFTLLLTLFRHCSPYVMILLNGGVPIAFAGTEEPAAYGELISIGGLGPSVNGKLSSTIAEILETKLYIDSSRFYIKFYDVQGIGCYLLITEVILVDVDF

SEQ ID NO: 173688 - protein, 93 aa, Glycine max
  Coding DNA Sequence Number=SeqID_56910
MKKKRKPSLRREETKTGKKTETNSHQRRHEACRRLTHTGEGTEREGIIGISIDFEVADPKFYKARDRVIPRQPLLHSAPQQRSVSQQGASLAR

SEQ ID NO: 173689 - protein, 505 aa, Glycine max
  Coding DNA Sequence Number=SeqID_56911
MDSLLANYASSDEEEDQQPSPPKTTTFSSLPQPKLSLFQSLPQPKSSLFQSLPPPKQPSTESSSLPNPNPNPDPKPQIEKTQPKRVVQFRPPIIPLPHPSQHDDDDDDDDDDEEEERNRRKKKLESSTQTSSVKSFLASIPAPRNTATLGVQASSGSGRKSILETETPPPASNSGGFSNVPVDQSTGDYENFDDYQYATDQYASYYGNFGSGAEPGSSGTEPKAGVAAYGTEQYGNYGDAYASYGDYGQYGNNWGDVSAPPVLEASGIDVSVVRIPGKRGRHEIPTEVIEVKQEELIKNRPREDQVKLTGIAFGPTYQDEYQSRIALEDALCLFFSSKYTAPFVDDFDLGVTSFDAPWLFLEAAECQILNFGSVQGLCVLVIERRADLRNFGMWKDNLISLAWNWKKPNTQISKLWIIYIENATLGRRQTNLVTKANFMCFILYACITKDTFQPASTKGKPTKLHKRKHQIGSLYFDMKQNEMKLAERRVKGMLTKAETQAKYGW

SEQ ID NO: 173690 - protein, 175 aa, Glycine max
  Coding DNA Sequence Number=SeqID_56912
  Gene Ontology: Mol. function=L-lactate dehydrogenase activity; Cellular component=cytoplasm; Biological process=tricarboxylic acid cycle intermediate metabolic process
  Homolog annotation: Hit_ID=Q1SP88; Match level="QueryCoverage=65%, HitCoverage=35%, E-value=1e-21, Identity=48%"; Hit description=NAD -binding site; L-lactate/malate dehydrogenase
  Pfam annotation: Domain name=Ldh_1_N; Domain location=6-131; Score =42.3; E_value=1.6e-09; Accession=PF00056.13; Description =lactatemalate dehydrogenase, NAD bind
MDDINNKFNQIFTDKLVLVDTNADKFCDEMLDLQHVAAFLPRTKINASADSFVTVGTRQIAGESRLNLLQRNLSLFGAIIPPLIRYSPNTILLIISNPIDILTYAHARNGGKRTQVCKFGEKVDEGEGLGGVAMGGEAALDGVDDGGGGGVRGDKGGETDGEDAEGVAEFGRVRV

SEQ ID NO: 173691 - protein, 92 aa, Glycine max
  Coding DNA Sequence Number=SeqID_56913
MSVEIKSESIDKSFEVNGHRLKPFLTNPSLMDVVVEENSKFYKEKTKKFHDSLIANMDFVVGQKVLLYNSRLGLMSEVILSQHKFIQQHAIT

SEQ ID NO: 173692 - protein, 182 aa, Glycine max
  Coding DNA Sequence Number=SeqID_56914
  Homolog annotation: Hit_ID=UPI00005F951A; Match level="QueryCoverage =40%, HitCoverage=71%, E-value=3e-29, Identity=78%"; Hit description =COG3254: Uncharacterized conserved protein
  Pfam annotation: Domain name=DUF718; Domain location=50-146; Score =98.8; E_value=1.6e-26; Accession=PF05336.3; Description=Protein of unknown function (DUF718)
MWPFHGIFGAGPTLDETFGLIDTAEKSSQVVVMALSMGGIRQSITTEQLIALGERFNVKPWPAALQAERSDRRHTPIWPELERTLKAHGAHNYAIWLDAERNLLFASVEVESEARWQAVAQTEVCQRWWASMRDLMPSNPDNSPLRITAENGDAPEQSRQANDCAHVAHVCHLQMQTDLVTE

SEQ ID NO: 173693 - protein, 60 aa, Glycine max
  Coding DNA Sequence Number=SeqID_56915
MPSIDQNLPYVSVKGVKEWHLYVHGNSPGINEDFNGVACRSRNSRSNSGHGDRIPQIYLQ

SEQ ID NO: 173694 - protein, 393 aa, Glycine max
  Coding DNA Sequence Number=SeqID_56916
  Homolog annotation: Hit_ID=Q94KJ2; Match level="QueryCoverage=85%, HitCoverage=87%, E-value=2e-52, Identity=40%"; Hit description=CIL
  Pfam annotation: Domain name=CCT; Domain location=355-390; Score =46.5; E_value=9.2e-11; Accession=PF06203.4; Description=CCT motif
  Subcellular localization annotation: CTP_CleavageSite=50; ConfidenceScore=5.76e-01
MSSSCLSGAGGRTYGFDFEFVKSPSSSTFTSHTSSSPSSTISESSNSPLAISTKKPRTPRKRPNQTYNEAAALLSTAYPNLFSTKNLKTQGKGKFSRPTSENFDYESSEPLLPFRVFDGTASCFLLDQTGPKPIMERPKVVSVQEKENNNNKACESPGEISSIVNFNSVELNDDGEESLDAESILDEEIEEGIDSIMGSSIQEVSNDAVSNLPWIMPFDGKLEFPRPRVRALRHVEDGNWWNFPAVDILSISPKINTKPPPVAAEKKMKKKKKVATPAEKTVVVELKNAELPKPKQGLMLKLNYDDVRNAWSDRGTPFSDDSPLADVPGNDVTARLSQIDLLWDNGGVREASVLRYKEKRRTRLFSKKIRYQVRKVNADRRPRMKVRVSSQLS

SEQ ID NO: 173695 - protein, 174 aa, Glycine max
  Coding DNA Sequence Number=SeqID_56917
MLDKNNKFNLYLGEAIYLGWVLNNNKACIEKEEAHLVWSHMMARFISNKTKTHLLRHSESAKGVIVCHRHQSSEATKAKWVEIDGVKLLEEHVQRVMVKKATPDWLPFLPGSSFWVPPPPSPFLHKFSIPSHPFFLQDDESGNSIATPRGTEVTVQLKVMTPAEHVSLSEDEEG

SEQ ID NO: 173696 - protein, 695 aa, Glycine max
  Coding DNA Sequence Number=SeqID_56918
  Gene Ontology: Mol. function=Rab GTPase activator activity; Cellular component=intracellular; Biological process=regulation of Rab GTPase activity
  Homolog annotation: Hit_ID=Q1T440; Match level="QueryCoverage=78%, HitCoverage=99%, E-value=1e-159, Identity=55%"; Hit description =RabGAP/TBC
MHELLAPVLYVLQFDVECLLEVRKLYEDHFTDRFDGLFCQENDLSYSFDFRKSSDLMEDEIDSYENLTKIKSLDELDPKIQNIVLLSDAYGAEGELGVVLSEKFIEHDAYCMFDALMNGARGSIAMADFFSYSPLPGSHTGLPPVIEASAALYHLLSHVDSFLHGHLVDLGVEPQYFALRWLRVLFGREFSLSNLLIIWDEIFSSDNSKVEKHAQDNADSGFRIFNSSRGAFISAMAVAMMLHIRSSLLAAENPTTCLQRLLNFPENTNVEKLIEKAKSLQALALSTEILSSMPSFVECHTKGKSAIARSRTLSSESISPKTPLTLVPDSYWEEKWRVVHKAEELKQDGVEKQVPTWKKGWTEKVKLSLKRTESDPSSSRTKSGKKESKLPVRRCLLVDLSKELGFEEDTEKLCCHDNLSATVEEEQREDGSEGSNNYSPEDRCLSQNTSSEENSPVISCPASPPNEANDHKDDSQKSSVGSNLSLDIINETSLSSSPIDSPLPISDHPENGPQTPGRNNINNSAGNSTTNSERKLNKFQWLWKFGRNNGEFMSEKGGDTSEAAKPANNCNNQSNTTPSSTANNCNNHSNTIPSSTAKNCNNQSNIIPSSTANGHRRSVSCQGESTDQNVMGTIRNIGQSMLEHIRVIECAFQQDRGQGASLDNMSKNAVVGKGQVNAVSALKELRKISNLLSEM

SEQ ID NO: 173697 - protein, 128 aa, Glycine max
  Coding DNA Sequence Number=SeqID_56919
  Gene Ontology: Mol. function=Rab GTPase activator activity; Cellular component=intracellular; Biological process=regulation of Rab GTPase activity
  Homolog annotation: Hit_ID=Q9LVD7; Match level="QueryCoverage=65%, HitCoverage=11%, E-value=3e-22, Identity=61%"; Hit description =Microtubule-associated protein-like
  Subcellular localization annotation: CTP_CleavageSite=63; ConfidenceScore=5.68e-01
MPSALMDPPLPQSSSVPSLSSDATSPGSAPDSRRFGDLRGLQWRINLGVLPSSSSSSFIDDLRRATANSRRRYASLRVRLLVDPHMPKDGSSSPNLVMDNPLSQNPVKGEGRRKRSWVEIPSLTKTNN

SEQ ID NO: 173698 - protein, 185 aa, Glycine max
  Coding DNA Sequence Number=SeqID_56920
  Gene Ontology: Mol. function=protein binding; Biological process =steroid metabolic process
  Homolog annotation: Hit_ID=Q2HUM2; Match level="QueryCoverage=86%, HitCoverage=41%, E-value=1e-66, Identity=78%"; Hit description =Oxysterol-binding protein
MTQCTIDLLININVTVEGDMKVTKGKETKIVLTKPFQLEGESDLEPSYRAPNLLHRLLSLLKNVRPGSDLTHFQLPAVFNFPKSQLQCYGESVYCTSSNLLSKCNNGQSPLDRFTSVVAWSISTTRPTSFGVAPYNPTLGETHHVSKGNLNVLVEQVSVNPPVSALHATDEKENIEMIWSQQPVP

SEQ ID NO: 173699 - protein, 67 aa, Glycine max
  Coding DNA Sequence Number=SeqID_56921
MGDEQTGPPGHKGEKGRRKAKVSRQNKCDDHKGPPESGNIGKKFARKRCGEYKDPPETAGPPMGCPL

SEQ ID NO: 173700 - protein, 241 aa, Glycine max
  Coding DNA Sequence Number=SeqID_56922
  Gene Ontology: Mol. function=oxysterol binding; Cellular component =integral to membrane; Biological process=steroid metabolic process
  Homolog annotation: Hit_ID=Q2HUM5; Match level="QueryCoverage=87%, HitCoverage=64%, E-value=1e-73, Identity=56%"; Hit description =Oxysterol-binding protein
MIPLYKYIKEGKRMRGSGRKRHLRGREKGGVSHHPPVSALHATDDKENIEMTWCHSPVSKFTGTSVETKVHGKRQLKLHNHGETYEMDSPNLVIRILPISGTDWVGNVSIRCLETGLVAELNYIGQSFFGFRADRRLIKGKIFDSWFMKILYRLEGHWDSVWPTETALVWGELSQAILSKDWEKARETKKSVEERQREVLRERESRGKNWVPKHLVSYSKEEGWECSPIHKSVPNAPIATL

SEQ ID NO: 173701 - protein, 185 aa, Glycine max
  Coding DNA Sequence Number=SeqID_56923
  Gene Ontology: Mol. function=structural molecule activity; Cellular component=extracellular region; Biological process=keratinization
  Homolog annotation: Hit_ID=Q86AI8; Match level="QueryCoverage=85%, HitCoverage=38%, E-value=1e-13, Identity=32%"; Hit description =Similar to Homo sapiens (Human). Mucin 2
MSKSFEFGMIGPLDESISCILIRVDPWVHALTFRGLHALTFRGLHVLAFRGLHVLTFRGLHTLTFRGLHVLAIKGLHALTFRGLHVLAIKGLHVLTIKGLCALAFRVLHVLRELHALTFRGLHVLAFRGLRILTFRGLHICALREFKGLRPQDTQRTRRSPTGPWGFQLWLRASVSPTGCPFPPA

SEQ ID NO: 173702 - protein, 67 aa, Glycine max
  Coding DNA Sequence Number=SeqID_56924
MMTEREPSPPEPFIFETDLVIVQEDVAIPEPSPQPEPQPFAPVLDLPISQDPPSAPALDLNDVAQDD

SEQ ID NO: 173703 - protein, 135 aa, Glycine max
  Coding DNA Sequence Number=SeqID_56925
  Gene Ontology: Mol. function=RNA-directed DNA polymerase activity; Biological process=RNA-dependent DNA replication
MEIGHAKQSLIFLTLWVHFLFLMIFDISCLLFDYSRGIEVKGTITNDSKIVVDFVRTNIFLGLVCLKPLSVIRGAISITAHQGSDQGSHFYNNSSGESLSVIREIKQVLQKVVQPIRKDWSKKLEDAIWAHRIAY

SEQ ID NO: 173704 - protein, 310 aa, Glycine max
  Coding DNA Sequence Number=SeqID_56926
MVLPNLEQGKRKSSVDEGIGGHVLGSDYKIETQSILGGDEAIRAIYMQGKGNEDDKSDNTATCQGHHVRAPVLGLTWRVDVCIKVSHSLMRVLCGPWTIPNPPSSEIACGQKRLSSVEGDYLVSRSDNLDKCKSCRSMRLVKPPNLDKCCSDCFCQVVRGGHTFGFAREIRRVRLVQCMRVALAYMSLVEWAPTEDAVSGNPWWTERSSPMTIPHQWRLIVGLLIASPLPRRGSRSHATLLETPCLRRRAQPFASSLGEPIPGTMILFSSISGRAKRSGGGDVMMQSYPARALDRRLQEDWAKDAREGPR

SEQ ID NO: 173705 - protein, 95 aa, Glycine max
  Coding DNA Sequence Number=SeqID_56927
MGKVEEAQEQMKADMEAMKVQMATMMEAMMSMKKIMEANAVAVAATRAVAKVNLMPPSDLNQMNHPTLDMVGKDLESTDDPMMCKFKMSTPSRHM

SEQ ID NO: 173706 - protein, 314 aa, Glycine max
  Coding DNA Sequence Number=SeqID_56928
  Gene Ontology: Mol. function=phosphoribosylformylglycinamidine synthase activity; Cellular component=cytoplasm; Biological process =purine nucleotide biosynthetic process
  Homolog annotation: Hit_ID=Q8ZCQ2; Match level="QueryCoverage=66%, HitCoverage=16%, E-value=1e-108, Identity=91%"; Hit description =Phosphoribosylformylglycinamidine synthase
EKAAGSVNRAHRPGLPTACGPGNINRCENESVGIASAFEGIGNATGISAALRNDIGARNLPQRKESVDALKSRPQGDVAQRLASNRTNSIRKYPGLMNPSSQLDTGAQLLTGVAEHAHPRAVLAPLFRVPGVADGAEHTFRVRHHHRGAPVGAGHGGNAVRRTVRVGRVSFRHLTGVVDETQRHQAVAFQRGQMRRIAHFNMPLAVGNGDRHARTGHALQEQRRAGRHFHQAETRLEAIRQVAHKARPVFGARDQLAQVGHHLAAVAHAQRQRLRTVEERFELVAHPLVEQDGLRPAFAGAQYVAVREATAGHQ

SEQ ID NO: 173707 - protein, 488 aa, Glycine max
  Coding DNA Sequence Number=SeqID_56929
  Gene Ontology: Mol. function=transporter activity; Cellular component= outer membrane-bounded periplasmic space; Biological process=transport
  Homolog annotation: Hit_ID=UPI00005F74A5; Match level="QueryCoverage =74%, HitCoverage=80%, E-value=1e-167, Identity=77%"; Hit description= COG4623: Predicted soluble lytic transglycosylase fused to an ABC -type amino acid-binding protein
  Pfam annotation: Domain name=dCMP_cyt_deam_1; Domain location=1-79; Score=82.8; E_value=1.1e-21; Accession=PF00383.13; Description =Cytidine and deoxycytidylate deaminas
VPVGALLVLDNQVIGEGWNRPIGRHDPTAHAEIMALRQGGAVLQNYRLLNATLYVTLEPCVMCAGAMVHSRIRRLVYGAADEKTGAAGSLVDILRHPGMNHQVEIVSGVLAEECAATLSNFFRLRRFTPARIAVGQLRVVALLAEHRQALFDVDPAVRIAFLRLGQLASVQHVAPAHVVGRQREPDALVFRHAVRHLGHQPLQVKGAALNALFRIEAVVDPEAVGGGAGQHHQAAHAGDGRQQLPVDLVGVLLEQRAEVGQHRVDGRQEGFGVHIVEAANVAEVFLFEPRQGAVVHHLAVEVQHRRVQAVVAVAFQIPGNRLFVGDVERHRQLRMDALQQRDGHRIAEGVVQLAVGHSLQQLFGGEIAGGLPGEIRVFILFELLEGADVRGTGSDRQLAFNVGETFRPRGAQPVHQLLGNGVVGRAGTRAAEALLVVDQARRQQVGVVVVQIVEQVIDVLMGDHHQLHPEVVGEALRQFVVEPTRPLL

SEQ ID NO: 173708 - protein, 126 aa, Glycine max
  Coding DNA Sequence Number=SeqID_56930
MRVGNSDIYGFLEPQSIQRFGQSQFETKSYIKSWMQSSKCDVYLGAYLNGGHWQMVVILPKEHLVVWFCSLHNRPNNYLKGINNRQKGSTECGFYVMHWMSIIILGSFRNNWKRILTILDHWSQRD

SEQ ID NO: 173709 - protein, 709 aa, Glycine max
  Coding DNA Sequence Number=SeqID_56931
  Gene Ontology: Mol. function=peptidyl-prolyl cis-trans isomerase activity; Cellular component=integral to membrane; Biological process=protein folding
  Homolog annotation: Hit_ID=Q8ZRB8; Match level="QueryCoverage=82%, HitCoverage=93%, E-value=0.0, Identity=63%"; Hit description =Peptidyl prolyl isomerase
  Pfam annotation: Domain name=Bac_DNA_binding; Domain location=4-93; Score=140.0; E_value=6.3e-39; Accession=PF00216.11; Description =Bacterial DNA-binding protein
  Pfam annotation: Domain name=Rotamase; Domain location=396-477; Score= 67.5; E_value=4.2e-17; Accession=PF00639.11; Description=PPIC-type PPIASE domain
  Pfam annotation: Domain name=SurA_N; Domain location=189-306; Score= -94.5; E_value=0.018; Accession=PF09312.1; Description=SurA N -terminal domain
  Pfam module annotation: Pfam domain module=Bac_DNA_binding::Rotamase:: SurA_N; Domain location=4-93::396-477::189-306
MKRVNKSQLIDKIAADADISKAAAGRVLDAFMGSVSDALKGGDEVALVGFGTFSVRERAARTGRNPQTGKEITIPAGKVPGFRAAAGFSLRMVASCQPEPQLHDDDIVSELYIHTTAECCHTMMDNLRAASNHVVLKIILGLIILSFVLTGVGNYLIGGNSDYAAKVNGHEISRGELEQAFNNERNRQQQMLGDQFSQLASNDGYMQQMRQQALSQLIDQALLDQYIKDLHIGISDDQVKQAIFNQQAFQTNGKFDNAKYNGLIASMGFSADQYAEALRKQLATQQLINAIANTDFMLKGETSKLVDLVSQQREIRQAVIDVNALAAKQTASDDEINQYYQQHQSSFMAPEQFRVSYIKMDAASLQENASEADIQSWYDQHKADYSQPQRNRYSIIQIKTEADANAVLDALKKGEDFATLAKSISIDPISARKGGDMGWLEPNTTPDELKNANLTQKGQLSGVIKSSVGFLVVRLDDIQPEQVKPLAEVHDAVADKVKQEKAVDAFYKMQQKVSEAASNDNESLAGAAQASGLKVVETGWITRDNVPADLDFDAVKQAIFNGGLTGQNGAPGNNSDIISVDGDRAFVLRISEHKPEAVKPLDQVKAQIADSLKHDKATQQAKAQADKLLTELKAGKQDALQAAGLTLSASKTVDRNAQDPVAQAAFNLPQPADNQPSWGVSEDMQGNVVLVALDKVSAGNMPQAQIDEM

SEQ ID NO: 173710 - protein, 78 aa, Glycine max
  Coding DNA Sequence Number=SeqID_56932
MVASFGYRKECDGSWVIKGAQPNDDEGHLPVEGDSSLLQSILDSDTRFEEMNSRIAKVEEDVTIIRDYFDLPPPPPSV

SEQ ID NO: 173711 - protein, 113 aa, Glycine max
  Coding DNA Sequence Number=SeqID_56933
  Homolog annotation: Hit_ID=Q9SBR5; Match level="QueryCoverage=63%, HitCoverage=83%, E-value=5e-23, Identity=69%"; Hit description =Putative wound-induced protein
MAISIIGFMYFPVYKSHLLFITSFIHNSKILLEYNTTELEHGVVEALKDQGICRWNHALRSAQHHLKTHFGSFSQANRLSASAMLSTTLKHEKPKQSEESFRNVMYFSCWGPN

SEQ ID NO: 173712 - protein, 267 aa, Glycine max
  Coding DNA Sequence Number=SeqID_56934
  Homolog annotation: Hit_ID=O82347; Match level="QueryCoverage=30%, HitCoverage=34%, E-value=1e-18, Identity=49%"; Hit description =Expressed protein
  Subcellular localization annotation: CTP_CleavageSite=36; ConfidenceScore=5.04e-01
MSPPPLGPHNHSQTHLKLSGRLPLPALVSADLHTTNSQMGKTCSPVNDIGGLPYEFVDNLNEFVDNLNEDHEPNYELLPLARGAFSLDQEPKIPIKALVGLKEFDGHEGLDSEFNGDDDRQYLIDHHAATPITTIEPLENVILIRWNLRGVPQVPWEAKGEFQGTSRYKLDRNGKIYEHKVDNLAFNFPQILKPILVFDLVTACPASPNLTFSWGPLDSNSSSWLEFYQAVKDTVDQEERDAEECKFPILILEEMKVFMYGEFTQMR

SEQ ID NO: 173713 - protein, 55 aa, Glycine max
  Coding DNA Sequence Number=SeqID_56935
MADPELAFVLILWWKHEGIHMEMKKDFLHRFLTNVESTDVESIIVNIGFTKPMLT

SEQ ID NO: 173714 - protein, 122 aa, Glycine max
  Coding DNA Sequence Number=SeqID_56936
MKDYKYFLVSFYLCSVEAIDMELIRDRVLSKYDPLSEAASRLASKRNLEGNTPRHHALSASSARPARSLSLLALSVPVSLSQNPLTCAKCENDPNCSFEYKGDILPWKTKLLQLGNPAENLM

SEQ ID NO: 173715 - protein, 63 aa, Glycine max
  Coding DNA Sequence Number=SeqID_56937
FPCLELNEMWRQFLDELQTVLDKFLNLLGTNSCSDVILTRSGSLDASHRVWMTPLLDREDKSG

SEQ ID NO: 173716 - protein, 323 aa, Glycine max
  Coding DNA Sequence Number=SeqID_56938
  Gene Ontology: Mol. function=DNA binding; Cellular component=nucleus; Biological process=regulation of transcription
  Homolog annotation: Hit_ID=Q2LME6; Match level="QueryCoverage=99%, HitCoverage=99%, E-value=2e-91, Identity=53%"; Hit description=MYB18
  Pfam annotation: Domain name=Myb_DNA-binding; Domain location=14-61; Score=45.4; E_value=1.9e-10; Accession=PF00249.21; Description=Myb -like DNA-binding domain
  Pfam annotation: Domain name=Myb_DNA-binding; Domain location=67-112; Score=49.9; E_value=8.5e-12; Accession=PF00249.21; Description=Myb -like DNA-binding domain
  Pfam module annotation: Pfam domain module=Myb_DNA-binding::Myb_DNA -binding; Domain location=14-61::67-112
MGRVPCCDKNGLKKGPWTPEEDLKLTNYIQFHGPGNWRSLPKNAGLKRCGKSCRLRWTNYLRPDIKRGRFSLEEEDIIIQLHSILGNKWSAIASRLPGRTDNEIKNYWNTHIRKRLLRMGIDPVTHTPRLDLLDMSSILRSVFGKPSLLNMQGLLRAQALMNQGLLKLASTASLLSTINNDENPNLASHNYVQNQVTTPPSLDSAQFQFQMPTTQTNNVEVFSGTVANLSCSSSPSGDENLVLQQNQVGLSGNHDALVHSLNNANQNMECDSVLPTPVSSPNRLNSSSNYVRSGTDEERDSFFSDLFEFEIPESLDDIADIFL

SEQ ID NO: 173717 - protein, 174 aa, Glycine max
  Coding DNA Sequence Number=SeqID_56939
  Gene Ontology: Mol. function=ribonuclease H activity; Biological process=RNA-dependent DNA replication
  Homolog annotation: Hit_ID=Q1S3X4; Match level="QueryCoverage=72%, HitCoverage=69%, E-value=2e-16, Identity=38%"; Hit description =Ribonuclease H
MRVEWWQGGKWCVLEEETIIHLLHDCNSAKIVWRVLDIDGANNFFISAVKQWISEQLSTSNGSLFACACWWIWRARNSGNPGDYGFGGILRDSGGQWLVVYSGFCGHTTNVLVEIMTTYQGLFLAWNSGYRHVICESDSMNALNLINNQNSALHPHAPLINRIRSFLDKPWTLS

SEQ ID NO: 173718 - protein, 528 aa, Glycine max
  Coding DNA Sequence Number=SeqID_56940
  Gene Ontology: Mol. function=magnesium ion binding; Cellular component=chloroplast; Biological process=metabolic process
  Homolog annotation: Hit_ID=Q64K29; Match level="QueryCoverage=95%, HitCoverage=90%, E-value=1e-120, Identity=44%"; Hit description=(-) -germacrene D synthase
  Pfam annotation: Domain name=Terpene_synth; Domain location=1-196; Score=212.5; E_value=9.9e-61; Accession=PF01397.11; Description =Terpene synthase, N-terminal domain
  Pfam annotation: Domain name=Terpene_synth_C; Domain location=201 -470; Score=345.4; E_value=9.3e-101; Accession=PF03936.6; Description= Terpene synthase family, metal binding domain
  Pfam module annotation: Pfam domain module=Terpene_synth::Terpene _synth_C; Domain location=1-196::201-470
MELYLQEVSENVKQQADILKEEVKMMFQSSNQNIMQKLNFIDSIQRFGISYHFQEEINETLEQIHNTFTKNNTIIISEDSNHHFLALLFRLLRQQGYQISSNVFNKFKNDQGKFNETLANDIQGLCSLYEAAHLRTHKDAILEEACDFANTQLKSLADKLSPSIATQINHCLRQPFNKSLPKFEARYHMTLYEEDPSHNKTLLTFARVDLNILQKMHQKEIGIITKWWKKLNIVKKVPYARDRLVEGYLWALAFSSQPEYNKARMFVGKLMALAAILDDTYDAYGTIQELELFTEAIQRWDISPIESLPQCMKVVFETILELCEEIKLETSESGKSSFVVPRFTQAICELVKGYMVEAKWCQEGFVPTYDEYKVNGILTAAFIPLMISLIGLGEFTTKDVFDWFFNDLKIVEAVSIIGRLLNDTSSHKFEQQRVHVASAVECCMKQYNISQSEAYNFIRKDVEDYWKVINEECLKLNDIPKSVLEIVVNYARVAEVTYENHQDKFTNADLLKDYISSLLLDPVRINEH

SEQ ID NO: 173719 - protein, 165 aa, Glycine max
  Coding DNA Sequence Number=SeqID_56941
  Homolog annotation: Hit_ID=Q9FLU4; Match level="QueryCoverage=86%, HitCoverage=60%, E-value=1e-14, Identity=30%"; Hit description =Arabidopsis thaliana genomic DNA, chromosome 5, TAC clone:K18P6
  Pfam annotation: Domain name=DUF599; Domain location=1-155; Score =146.3; E_value=7.9e-41; Accession=PF04654.3; Description=Protein of unknown function, DUF599
MGSTLMATTSILLSAGLAAVISSTYSVKKPLNDAVYGAHSEFMVALKYVTLLTIFLFSFFCHTLSIRFFNQVSILICTPQQDVIMSSAVTPQYLTELLEKGTILSTVGNRLFYSALPLLLWIFGPVLVFMSSVAMLPVLYNLDFVCGNNNGKGKIMKNDKGEDYV

SEQ ID NO: 173720 - protein, 261 aa, Glycine max
  Coding DNA Sequence Number=SeqID_56942
MGNPVDQPTSPPAQPAIEVQQNVSVEEIPSHARTSPAPETDAVNVEEQGEGQGMGPSSPHGSSQKSSSEENFSDEEAIQEAEAGGSDIFPASSTSKLSASIGIAEDTFIQMQDEDPAAALRLLLNTSQANTSSEKIPGASSSSDADITSSVRQDCLLLKLSMEYAREDVLKSIEENPSAAFGHLNFLKKLHNPLTSDEILGKVIQIEAIIDQFASTVQKKRENSARLDAQKQAHILLLEKAQAAQREVERLTKEAKEGSSE

SEQ ID NO: 173721 - protein, 52 aa, Glycine max
  Coding DNA Sequence Number=SeqID_56943
MEIDRWKKQNRSGANVRCLSSESGGNWVDQLINTVVPLIIDGEPAVPAKMRF

SEQ ID NO: 173722 - protein, 78 aa, Glycine max
  Coding DNA Sequence Number=SeqID_56944
MDKSYLVLRVVTSTSEKVIGVCDAPTVLLHAYHLWSGHVLKKWCMDEWGCVMVRNIRAPFQLPPIAEESTSTLNGMDV

SEQ ID NO: 173723 - protein, 87 aa, Glycine max
  Coding DNA Sequence Number=SeqID_56945
MQSLKGGGRVHVGDVVCGGIMMVERDCVCGALKVEVTRVHELCAIVMVGTVHGGDGIRWWRNAEVASSDDGCVTMMWGRWSCDSRFG

SEQ ID NO: 173724 - protein, 151 aa, Glycine max
  Coding DNA Sequence Number=SeqID_56946
  Gene Ontology: Mol. function=carboxylesterase activity; Biological process=metabolic process
  Homolog annotation: Hit_ID=Q0ZPW4; Match level="QueryCoverage=92%, HitCoverage=69%, E-value=9e-20, Identity=32%"; Hit description=CXE carboxylesterase
  Pfam annotation: Domain name=Abhydrolase_3; Domain location=1-145; Score=-42.4; E_value=6.2e-05; Accession=PF07859.3; Description =alphabeta hydrolase fold
MSPQFAEAKVVAVSVDYRLAPELPIPAAYEDSWAALQWVASHRNKDGQEPWLNEHADFGRDIEVEILGVVLVHPYFWGSVRGGGGGQAVAVWWLYYNALSRSGWIGVVVVEVEETLGEGQAFHLHDLVRDKAQSLIKRLGLFFNRDQPPAI

SEQ ID NO: 173725 - protein, 380 aa, Glycine max
  Coding DNA Sequence Number=SeqID_56947
VVYRPDQIRKMEESNRIRKAYKPVELMKLVKEFEGEFSGETVVVELPRHLKQKIIDEVLQRLGSLNGSSKNISHSQVMAKERGERVLVGSQRMRLYDVQLKLLSGPVDCLDLSFLFGEAIENWRKEKLEEVKLAVVRGTSNSTIPHEEAGMLVRALESDWAVLSEEIGLWIPIEVANEEHNDKPEGASEIEEEVLPGRPLPPECNPELHTDYDGTAVRWGLTHHKDSAADCCQACLDQAKRAKEDDVMGRLTTTKGCVGYAFGKPSSCWEDEFFNPPEPLHLDLLPEWSNLCLKFGILVLSFSMALQLKAELGSPPMFASTTHKNYKEMSISQLVSVLRVAFQTNDFHKVEEDLVNMDTKLKVEIGPLREKIEVERAQED

SEQ ID NO: 173726 - protein, 460 aa, Glycine max
  Coding DNA Sequence Number=SeqID_56948
  Gene Ontology: Mol. function=DNA binding; Biological process=DNA integration
  Homolog annotation: Hit_ID=Q1T192; Match level="QueryCoverage=53%, HitCoverage=54%, E-value=3e-17, Identity=31%"; Hit description =Polynucleotidyl transferase, Ribonuclease H fold
TNLGLDKPLEKRDSPRADLGYDEPMRLTKDIPWEHVCPVFSSFCCSWEKSLVVDGSLTSTGIKAFVPYGLEDNFVGCLYLTISLRMLTEEVFVRLSFELGVVVGDNGVREAIPTYEVFLATNKYLTALGAFGSGPTSLGEVRGVCPECWPVVAVTHHFGGKGVSPGVKAAHLFMKLSYDIVCYWLFKHFNKGIVKPLLNSLPSRMTGYPVWFHLFSNYNFLGVYGRGWERLLDDNLEVLGLFGDDQFGEQVYSSVAFPSIYWQLAPGQAMGDIVKAFKDDSCLTSLHVGCTVNIEAPPVSGALLGAMKYAAGEVDGKLVFPFLLSKGTPDLGLVNSFAFLASLVRNLDMDASVPFSFWTSWMLVGLCISNMAIHLSGLAFIPRCVIMKPGNLSPPTSKIGVVGANPPFVVGLFDQDDIGELGGILDFSDEVGFEELVHYSLTILRHSSPIFLFFYDTGLA

SEQ ID NO: 173727 - protein, 94 aa, Glycine max
  Coding DNA Sequence Number=SeqID_56949
  Gene Ontology: Mol. function=phospholipase A2 activity; Biological process=lipid metabolic process
  Homolog annotation: Hit_ID=Q9FZ09; Match level="QueryCoverage=98%, HitCoverage=27%, E-value=4e-25, Identity=53%"; Hit description =Patatin-like protein 1
MAAKWGLLDWLTQSGSTPLINVFTQSSADMDDTLTGTDSSVDIATKENLEKLSQIRENLLKKPVSGVNLENGLFQPLKNGQTNEHALKRFAKVL

SEQ ID NO: 173728 - protein, 128 aa, Glycine max
  Coding DNA Sequence Number=SeqID_56950
  Gene Ontology: Mol. function=phospholipase A2 activity; Biological process=lipid metabolic process
  Homolog annotation: Hit_ID=Q9FZ09; Match level="QueryCoverage=47%, HitCoverage=14%, E-value=9e-12, Identity=59%"; Hit description =Patatin-like protein 1
MINCEVQSEEVHKEKMIWNLEIENEGIACYVEALGGDKVFLNKVSKVEKKTIMEKAHDVIILNLGDRVIWQLEKLLKKPVSRINLENGLFEPLKNRETNEDALERFAKILSQERRLREMRSPHTKKTF

SEQ ID NO: 173729 - protein, 239 aa, Glycine max
  Coding DNA Sequence Number=SeqID_56951
  Gene Ontology: Mol. function=heme oxygenase (decyclizing) activity; Biological process=heme oxidation
  Homolog annotation: Hit_ID=UPI000034ED9F; Match level="QueryCoverage =63%, HitCoverage=48%, E-value=9e-44, Identity=53%"; Hit description =HO2; heme oxygenase (decyclizing)
  Subcellular localization annotation: CTP_CleavageSite=84; ConfidenceScore=5.32e-01
MWLTAKPIRQLCFPLPISVPNKFCNCSLSITATTNTNTNAEITTTLTQTPKPKPNPKSTLKKRKRYRKLYPGETTGITEEMRFVAMRLRTNDTVSQQEHQSHSDAWQASMEGFLSYLVDSHLIFATLQRIVDESDNVSYAYMRKTGLERSEGLLKDLKWLEEEGNMIPTPGSPGLTYAKYLEELAEISAPLFLSHFYNIYFSHIAAGQVIGKKVGHVREIYCKIDRYQTITQILDAEVI

SEQ ID NO: 173730 - protein, 1137 aa, Glycine max
  Coding DNA Sequence Number=SeqID_56952
  Homolog annotation: Hit_ID=Q10QS2; Match level="QueryCoverage=93%, HitCoverage=88%, E-value=0.0, Identity=55%"; Hit description =Expressed protein
LSAVSISAVVASAALLSDSDRGGGTNPLYEGAERAARKAADSCDRIFQHAKRTGVAAAVLWKSLRSVLSSANHEVRSGFEIRVAALLADISAANSGRRAAIVGAGSGAVVDWLLDSVAVAKDGGATQAESARALAYLIADPNVSAAVLGRPHAVPSLLRFIFSCQPRRSKNNKKHSRHSAFDISDSLKGRSMLVAAIMDIVTSSCDNAEEVSFKPSLPGNAEIRDIAAALEVIEDGGLHLDEPPEGEDDGGGSGRKGIGIKILEGTPVLGLSRTNSDACHEELKHQTPKTLIYPNKYDNSPEQKNVSSAVVPGLWDDLHCEHVAVPFATWALANWATASQLNRSRIQELDRDGNAIMSALMAPERSVKWHASLVVWLLLEDRNTPLNESVSDWASSLLSTISQACKHEDVSLAQVASSAFLLSVERSPGVQKVVMEKGVNPMRDIAKQMTKHKQVQEPMAKALELVCTGELRLSLEESQKWSGILLPWVFGKFSSDTIRSSAIKILSQILEDYGPTCVPLSQGWLAMMLSEVQSSIKKSNDKGTNQPKSDNVKTLINNANIASAAQVANQLSSAVVNLAAKQLGNASNSGDASPLADFLSLEPLAGPFRSLKKDNLPKLDAADSALATLKGIKALTEVCAEDSVCQDMIVDFGILCLLRRFLLSDDYEKLAAIEAYDASSRAHEGKERISNVDGEPAISDVNDPASVRVPPTAHIRKHAARLLTILSLLPRVKKVITVDETWCKWLDDCANGRIPGCSDLKMQSYARAALLNMFCNDQPNGKSESGRGGPSDGGVKNYRNSCPRYDDMIFLINSHLPHWKCPKETDQQEAFSKEISLFTSTEMGDVIESVNGSNCSISNDSTKNNPDADCPPLDIVFVHGLRGGPYKTWRIAEEKSSTSSPLVEKIDEEAGKLGTFWPGEWLSSDFPEARMFTLKYKTNLTQWSGASLPLQEVSSMLLEKLVAAGIGNRPVVFVTHSMGGLVVKQILHKAKEERFDNLMKNTIGIVFYSCPHFGSKLADMPWRMGFVLRPAPTIGELRSGSSRLIELNDYIRHLHKKGLLDVLSFCETKVTPIVEGYGGWAFRTEIVPIESAYPGFGELVIKELVQKFFFHPSCSPTKGGGLSFKHPTSQLKRKPSY

SEQ ID NO: 173731 - protein, 60 aa, Glycine max
  Coding DNA Sequence Number=SeqID_56953
  Homolog annotation: Hit_ID=O48722; Match level="QueryCoverage=77%, HitCoverage=15%, E-value=6e-08, Identity=63%"; Hit description=Heme oxygenase 2
MALERDVGLRIRGHQAIMDNIVSEELLEGKELEFYKWEGDVPDLLKDVRDKLNMLSEVDY

SEQ ID NO: 173732 - protein, 587 aa, Glycine max
  Coding DNA Sequence Number=SeqID_56954
  Gene Ontology: Mol. function=hydrolase activity
  Homolog annotation: Hit_ID=Q0KB35; Match level="QueryCoverage=56%, HitCoverage=50%, E-value=1e-38, Identity=32%"; Hit description =Hypothetical membrane spanning protein
  Pfam annotation: Domain name=Metallophos; Domain location=228-459; Score=37.8; E_value=3.7e-08; Accession=PF00149.18; Description =Calcineurin-like phosphoesterase
MGVDMRMNLSLFLTIYLSSILFLLVFHIIFLGLWYIGFVSRVAGKRPEILTILQNCAERNTWLAKFLRMNELKDQVCSSWFAPVGSASDYPLLSKWVIYGEIACNGSCPGSSDEISPIYSLWATFIGLYIANYVVERSTGWALTHPLSVKEYEKLKKKQMKPDFLDMVPWYSGTSADLFKTVFDLLVSVTVFVGRFDMRMMQAAMSRVSDGNHQGDLLYDHFSEKDDFWFDFMADTGDGGNSSYAVARLLAKPFIRTLKDDSELTLPRGNLLLIGGDLAYPNPSAFTYERRLFVPFEYALQPPPWYKAEQIAVNKPEVPFGAQLKQYNGPQCFVIPGNHDWFDGLQTFMRYICHRSWLGGWLMPQKKSYFALQLPKRWWVFGLDLALHGDIDVYQFKFFTELITEKVQEDDSVIIITHEPNWLTDWYWNDVTGKNISHLISDYLRGRCKLRMAGDLHHYMRHSHVKSDGPVHVHHLLVNGCGGAFLHPTHVFSKFNKLDEVSYECKAAYPSFEDSSRLNHILQDDTFSGHIRSFLAYSFVPPKLSRKKRAIIGVLHVSAHLAAALILMLLLEIGIEICIQHKLLATS

SEQ ID NO: 173733 - protein, 86 aa, Glycine max
  Coding DNA Sequence Number=SeqID_56955
MAPLPLVIVVLLVPLSSLCILLSTWWLLLPLHMLVELLKEMLAELNADEEDLVEFTTELVTTCCGCAVEVPWWCSGCTEEEGEGII

SEQ ID NO: 173734 - protein, 108 aa, Glycine max
  Coding DNA Sequence Number=SeqID_56956
MANLKLVFTMSSILLVLVFFNGILPAMGRPLKKEHITTTYENSVKEMGTVEDNNILLWRRSIIENNAANDGGVDKWIDDFRPMDPGHSPGAGHSSPTPKDATNGAPRP

SEQ ID NO: 173735 - protein, 125 aa, Glycine max
  Coding DNA Sequence Number=SeqID_56957
  Gene Ontology: Mol. function=nucleic acid binding
  Homolog annotation: Hit_ID=Q1SLA4; Match level="QueryCoverage=82%, HitCoverage=19%, E-value=6e-24, Identity=53%"; Hit description=Zinc finger, CCHC-type; Lipocalin
MANPSVPLYYTGAMGNDGSDLVFERLCTPWQDALVVKLLGKKINFILIKERLTKIWKLKAVFYLMDFGNNFYMAKFDMEEDRTKIIGEGSWMIIDHYLIIQTLSFSFVFPKATIDKPWCGLDSLV

SEQ ID NO: 173736 - protein, 133 aa, Glycine max
  Coding DNA Sequence Number=SeqID_56958
  Gene Ontology: Mol. function=nucleic acid binding
  Homolog annotation: Hit_ID=Q93YF1; Match level="QueryCoverage=91%, HitCoverage=31%, E-value=1e-14, Identity=32%"; Hit description =Nucleic acid binding protein
MQQSNGSDSSTTEQKAPPPRQSPAVARPQQWLPMQYPAAAMVMPHHMLPPQHYAPPPYVPFHHHHHHHQYAAPHVPNQHQQQQQHHHHQNGSGGENKTIWIGDLHHWMDENYLHRCFASTGEVCIKDPYTLLK

SEQ ID NO: 173737 - protein, 164 aa, Glycine max
  Coding DNA Sequence Number=SeqID_56959
  Gene Ontology: Mol. function=nucleic acid binding; Cellular component= nucleus; Biological process=selenocysteine incorporation
  Homolog annotation: Hit_ID=Q93YF1; Match level="QueryCoverage=93%, HitCoverage=33%, E-value=5e-71, Identity=83%"; Hit description =Nucleic acid binding protein
  Pfam annotation: Domain name=RRM_1; Domain location=70-142; Score =69.6; E_value=1e-17; Accession=PF00076.12; Description=RNA recognition motif. (a.k.a. RRM, R
ISSIKVIRNKQTGLSEGYGFVEFYSHATAEKVLQNYAGILMPNTEQPFRLNWATFSTGDKGSDNVPDLSIFVGDLAADVTDSLLHETFASVYPSVKAAKVVFDANTGRSKGYGFVRFGDDNQRTQAMTQMNGVYCSSRPMRIGAATPRKSSGHQQGMPNHFTCF

SEQ ID NO: 173738 - protein, 324 aa, Glycine max
  Coding DNA Sequence Number=SeqID_56960
  Gene Ontology: Mol. function=serine carboxypeptidase activity; Cellular component=cellulose and pectin-containing cell wall; Biological process=proteolysis
  Homolog annotation: Hit_ID=Q6W6R6; Match level="QueryCoverage=97%, HitCoverage=70%, E-value=1e-122, Identity=62%"; Hit description =Putative serine carboxypeptidase
  Pfam annotation: Domain name=Peptidase_S10; Domain location=1-316; Score=375.1; E_value=1.1e-109; Accession=PF00450.12; Description =Serine carboxypeptidase
MQELGPFRVNSDGKTLYRNQYAWNNVANVIFLESPAGVGFSYSNTSSDYTKTGDKSTAMDSYTFLLNWLERFPQYKTRDLFITGESYAGHYVPQLADTILTYNKLTNHTVINLKGIAVGNGWIDDNMCGKGMYEYFWTHALNSDETHEGIQRYCDFESGNLTGECSKYQSRGDTEIGSIDIYDIYAPPCDSAAKKPGSSPATNYDSNFDPCSDDYTNSYLNLAEVQEALHAKASVWYPCSGDTDGRVPITSSRYSVNALKLPVETTWRPWYSSNEVGGYLVGYKGLTLITVRGAGHMVPSYQPQRALTMISFFLLGELPPEFTS

SEQ ID NO: 173739 - protein, 162 aa, Glycine max
  Coding DNA Sequence Number=SeqID_56961
  Gene Ontology: Mol. function=nucleic acid binding; Cellular component= cytoplasm; Biological process=regulation of mRNA stability
  Homolog annotation: Hit_ID=Q93YF1; Match level="QueryCoverage=78%, HitCoverage=28%, E-value=3e-50, Identity=75%"; Hit description =Nucleic acid binding protein
  Pfam annotation: Domain name=MPPN; Domain location=8-94; Score=-14.1; E_value=0.0034; Accession=PF05172.3; Description=MPPN (rrm-like) domain
  Pfam annotation: Domain name=RRM_1; Domain location=19-84; Score =86.1; E_value=1.1e-22; Accession=PF00076.12; Description=RNA recognition motif. (a.k.a. RRM, R
  Pfam module annotation: Pfam domain module=MPPN::RRM_1; Domain location=8-94::19-84
GQSNGTANQSEADSTNTTIFVGGLDPNVSDEDLRQPFSQYGEIVSVKIPVGKGCGFVQFANRNNAEEALQKLNGTSIGKQTVRLSWGRNPANKQFRMDFGNPWTGAYYGAPMYDGYGYALTPRHDPSIYAAAYGAYPLYGGHQQQTRIPPNCGAEMNFDSLR

SEQ ID NO: 173740 - protein, 527 aa, Glycine max
  Coding DNA Sequence Number=SeqID_56962
  Gene Ontology: Mol. function=transcriptional elongation regulator activity; Cellular component=cytoplasm; Biological process =regulation of transcription, DNA-dependent
  Homolog annotation: Hit_ID=Q45GG2; Match level="QueryCoverage=97%, HitCoverage=92%, E-value=1e-105, Identity=43%"; Hit description =Expressed protein
  Pfam annotation: Domain name=DUF547; Domain location=309-449; Score =274.8; E_value=1.7e-79; Accession=PF04784.5; Description=Protein of unknown function, DUF547
MMHGSLRNANKSRKASSRERKLALQQDLATELNSPTFQVDTLKKKLRHEENIHRALERAFNRPLGALPRLPPYLPPYIPALLAEVAVLEEEIVRLEEQVVHFRQDLYQEAVYMSSSMRKLENSVSAPPNKSNPTMDSPKLDKLKSLTQTTGNSTATSATKPTTTLPDDNRQGKENQSCTNSSKSRKQSSNQTNKTPIKKINNQSLQKKLDHPKRKKEPKVKNQQVADVRNHSPHKNSPEAQSPNIISENILKCLSNIILRMSALKNPGSTCDMPPVWDLKPHNRDEGTEFGDPYGICLEFGKRDIGPYKQLWKLASVNLENLNHQEKLAFWINIYNSCMMNAFIENGIPENPQMAVALMRKATINVGGHVLSATTIEHFILRLPYHWRFTFSKGTKNHEMKARSIYGMELSEPLVTFALSSGTWSSPAVRVYTASQVENELEVAKREYLQAAIGFSTSKFAIPKLLDWYLLNFAKDLESLLDWICLQLPSELGKEALKFLEERKTEPLSQFVQIMPYEFSFRYLICT

SEQ ID NO: 173741 - protein, 171 aa, Glycine max
  Coding DNA Sequence Number=SeqID_56963
MALCSICLVLGTIRQNSASIKGIVKGKELVISPITIIFAFGCVEEDEVILEFLKTLFVEEEQRHNAEKATMMDIDEMKNAQMEELERVQSAAQLAAQIFSPNVVQRQAKIKVATVPEEINLAKREALEEAILQSVIEASFVEENDEQLFATQSDTTNEDELRRLEEIYIAP

SEQ ID NO: 173742 - protein, 458 aa, Glycine max
  Coding DNA Sequence Number=SeqID_56964
  Gene Ontology: Mol. function=protein serine/threonine kinase activity; Cellular component=integral to membrane; Biological process=protein amino acid phosphorylation
  Homolog annotation: Hit_ID=Q9SZE6; Match level="QueryCoverage=72%, HitCoverage=36%, E-value=3e-47, Identity=39%"; Hit description =Putative serine/threonine-specific receptor protein kinase
MLKCREHELASIYAIIDLRKVCLVIVLYMHTDSMRSALVWIFTLNVCLQILFIPGGDSKPHPRFREKITEEYNPGFISIDCGASNDYLDEETSIFYKTDTDFIETGENLLTSSVFINTNIPGLGRQLHTLRSFPEGNRNCYTLKPEYKQGEQQSYLIRAMFGYGNYDGKNHAPTFDLYLGVNYWKNVNTADRSYIWAEIIHAPTTDTIQVCLVNIDTGTPFISSLELRPLSTSIYQIMSQSYLYLHGRFDVGGPVETYYKRYKDDIYDRRWYWRDVKDWYKINTTIDVNKSGNDIYKVPAEVLKTAVQSFNRSYDLYYDYEIEWNVLLDKYSRYYVYFHFAEIQQLAPGLRRIINITLNDENILSEPITLEYMKPVTISNKYATQGSVRFLIRATAESDAPPILNAFEVYQLITDLNSTTDIKDGMYVFHLYICLSILLFNSPANLFPSISRLLHGYA

SEQ ID NO: 173743 - protein, 291 aa, Glycine max
  Coding DNA Sequence Number=SeqID_56965
  Gene Ontology: Mol. function=protein serine/threonine kinase activity; Cellular component=integral to membrane; Biological process=protein amino acid phosphorylation
  Homolog annotation: Hit_ID=Q9LIG2; Match level="QueryCoverage=95%, HitCoverage=33%, E-value=4e-88, Identity=54%"; Hit description =Receptor-like protein kinase
  Pfam annotation: Domain name=Pkinase; Domain location=21-271; Score =106.1; E_value=1e-28; Accession=PF00069.15; Description=Protein kinase domain
  Pfam annotation: Domain name=Pkinase_Tyr; Domain location=22-267; Score=66.5; E_value=8.6e-17; Accession=PF07714.7; Description =Protein tyrosine kinase
  Pfam module annotation: Pfam domain module=Pkinase::Pkinase_Tyr; Domain location=21-271::22-267
MEYVDSKKQEFSYSEVQSITNNFERVVGKGGFGTVYYGCIGETQVAVKMLSHSTQGVRQFQTEANILTRVHHRCFTPLIGYCNEGTRTALIYEYMTNGDLAEKLSGLEYLHNGCKPPIIHRDVKTRNILLDENLRAKISDFGLSRIFSDDGDTHVSTAIAGTPGYLDPEYNITNRLNEKSDVYSFGIVLLEIITGRTVILKTQVRTHIIKWVSSMLADDGEIDGVVDTRLQGEYDSEAARKVIDVAMACVAPSSVNRPTMNQVVMELKQCFPVGKLGTTSTGSSEIVSAGE

SEQ ID NO: 173744 - protein, 288 aa, Glycine max
  Coding DNA Sequence Number=SeqID_56966
MKLAKQEAITRILPLRPLVQKQLDIQVRPNLHAKLYHEEEYAFGIYEDKEPIIKEFPLRQTIAPNPNSLIFEHRPIDKKMYPSSASVWKSSEVEFAKMSFLPYNELLTENDEDSPPTGYVKTCPGHLFKHEVEALKHKSELITNLDSTFSFMVFLPFFIFFFTHHVDSTIDEVKLDIKAASNSMVFQVYDPPPSCAYVSLLEAELARTTKALAQALKDCAPTKKKARKWFMIGDYFYKNITSWKPPRPLMPPRSLIHLSSNSDDSIDEFHRKLNEEVAKQKKGIKSKS

SEQ ID NO: 173745 - protein, 112 aa, Glycine max
  Coding DNA Sequence Number=SeqID_56967
MVTWDDSNIEKSINSDNEQVNICLMAYIDKKVKHSNDKSGIGLEKEASSSKAQFDLDKCDFYSKFGHSNFRCIHQKKQMSKGTNAHGPKNIWVPKSLIVPIADIFGRKRSEC

SEQ ID NO: 173746 - protein, 294 aa, Glycine max
  Coding DNA Sequence Number=SeqID_56968
  Homolog annotation: Hit_ID=Q9ZQD8; Match level="QueryCoverage=97%, HitCoverage=93%, E-value=9e-16, Identity=26%"; Hit description =Expressed protein
  Pfam annotation: Domain name=DUF1645; Domain location=104-280; Score =103.6; E_value=5.7e-28; Accession=PF07816.2; Description=Protein of unknown function (DUF1645)
  Subcellular localization annotation: CTP_CleavageSite=66; ConfidenceScore=5.26e-01
MEVVVQSPSSPNMDTFDFGGNMGSIFQSVPSSPKGFGNYYLSAPASPSRMSELYTEFEYYSSASPSSFEAGNKIDDDDEDENNNDYSFAFYVNRDQSDKSSRSAEELFDGGKIKPLNESSRATSVAEQKRGRERERSSSSTTTTKLSSSNSGVRRVARSLSPYRKSWEVEQQKEQPRIISKEESSASVLSSSTSSSKGSKRWSLKDFLLFRSASEGRGSSKDALKKYYNKKNSNEEVKGSSSFRSSDSSRSRKGTISAHELHYAMKKAESEDMKKRTFLPYKQGILGRLAGFGI

SEQ ID NO: 173747 - protein, 44 aa, Glycine max
  Coding DNA Sequence Number=SeqID_56969
MEEVDSSLSAFSHLAGNLRLSMKKAHNEAQRDLRERIDKLDSSS

SEQ ID NO: 173748 - protein, 66 aa, Glycine max
  Coding DNA Sequence Number=SeqID_56970
MQTSCCRIFCQTGPRLNHHQQLAREVNAPVHTWRPTIGGTPDEIALSHVPCKIKTRTISFIRIQVS

SEQ ID NO: 173749 - protein, 97 aa, Glycine max
  Coding DNA Sequence Number=SeqID_56971
MELMMGSRRSRRRLHSERAIMTPFQENWLRQERGLRTIGQIELAYGRIEVKATRFLDLAQFLTKLHKISSTSSNVGNRSKEQLCACKVYVAGHLALG

SEQ ID NO: 173750 - protein, 712 aa, Glycine max
  Coding DNA Sequence Number=SeqID_56972
  Gene Ontology: Mol. function=protein serine/threonine kinase activity; Cellular component=barrier septum; Biological process =protein amino acid phosphorylation
  Homolog annotation: Hit_ID=Q10EQ9; Match level="QueryCoverage=60%, HitCoverage=55%, E-value=1e-107, Identity=47%"; Hit description =Protein kinase domain containing protein, expressed
  Pfam annotation: Domain name=Pkinase; Domain location=326-597; Score =279.0; E_value=9.5e-81; Accession=PF00069.15; Description=Protein kinase domain
  Pfam annotation: Domain name=Pkinase_Tyr; Domain location=326-597; Score=121.7; E_value=2.1e-33; Accession=PF07714.7; Description =Protein tyrosine kinase
  Pfam module annotation: Pfam domain module=Pkinase::Pkinase_Tyr; Domain location=326-597::326-597
MSLSRKPLSPSPSTPAKQIDAGDLAPAPRLTRQRKLRHLTHQDIGFFHSDESSFLPGLPEFRSHAGSDHRSFSALPQPLPLPEAPLTRRAKSISSSSVNRRRLSSSLEQHGFAISRSTVYQEAVARTKPTLNLDKSCLDSTLANANYNLREHTPAASFLTGNSSWKNRRAVSHDDDSEGNSHLKYGVAAKPKSAPTSVLTSPDTSPCRSSNVDFFDPTANFSLEVNDKSKMLSAKTVHSPDQFSIHCPLSLTRYFNPKIEEGSQNHKFLSRVCPENNLLDSHPLPLPPRASSPEQLSVVLHQSSTMNQSSIMHHATENLPSVKGRWQKGKLIGRGTFGSVFHATNIETGASCAMKEVNLIHDDPTSAECIKQLEQAVILKSSVFQEIKILRQLHHPNIVQYYGSETVGDHLYIYMEYVYPGSISKFMREHCGAMTESVVCNFTRHILSGLAYLHSNKTIHRDIKGANLLVNESGTVKLADFGLAKILMGNSYDLSFKGSPYWMAPEVVKGSIKNESNPDVVMAIDIWSLGCTILEMLTGKPPWSEVEGPSAMFKVLQESPPIPETLSSVGKDFLQQCFRRDPADRPSAATLLKHAFVQNLHDQHVLVHSQSYPRGDLGPGGNSASPRDTTKNRRGIMQASISTRIFNNIQKLIGDTSEQSNAKESNHIIPYLHSHVPEVKILQSPLESGTLNFMSVANSKNISSVMRMITNF

SEQ ID NO: 173751 - protein, 284 aa, Glycine max
  Coding DNA Sequence Number=SeqID_56973
  Gene Ontology: Mol. function=single-stranded DNA binding; Biological process=DNA replication
  Homolog annotation: Hit_ID=Q75GK2; Match level="QueryCoverage=79%, HitCoverage=74%, E-value=9e-21, Identity=32%"; Hit description =Putative single-strand binding protein
  Pfam annotation: Domain name=SSB; Domain location=69-163; Score=24.2; E_value=0.00012; Accession=PF00436.15; Description=Single-strand binding protein family
  Subcellular localization annotation: CTP_CleavageSite=45; ConfidenceScore=5.38e-01
MKPKPFIFAKRFPIPLLFSYPFSPQQQRFPFSTHNRHSFDEAVPGCSAVYQHVLKFQRPPTIRWSPHLENTASFIGTVAREPTRVNSTTGKCGVYTVLKVPKSNQSNSSFFRLLLMMRNNVAKLASEHLKLNDFIQVLGSLGSFTKPDANGILRLNYKCTEILGSCLNGALLEVKEFEFVAQRSGYLGDKKLESVEADAGMQKNQNRLHLWQVFFSNPNEWWDQRKSKRNPKQPDFKHKDTGEALWLSEYDPPWVKRQLQLFDSKIAGGSAGRRSRVTNWVYDE

SEQ ID NO: 173752 - protein, 131 aa, Glycine max
  Coding DNA Sequence Number=SeqID_56974
  Gene Ontology: Mol. function=helicase activity; Cellular component =nucleus
  Homolog annotation: Hit_ID=Q1RTU9; Match level="QueryCoverage=98%, HitCoverage=13%, E-value=7e-44, Identity=68%"; Hit description =DEAD/DEAH box helicase, N-terminal
MKLERQQILSQFIKIMKKFYKYLNGIESTLPRLKDIVMEPLGVSVDEDLNNAAKQVEDDMKSKVEAPFTPELLQRYAIDGGESDFETVLKHNGGNIPTGGLISVISSRSGIKPEKENGSGKKRRKDNHSHN

SEQ ID NO: 173753 - protein, 122 aa, Glycine max
  Coding DNA Sequence Number=SeqID_56975
MQQRTTKLESILTINGDNHDSDILMAFTAANSSAQSAKVLPICLEKHPIMIPQLRQERGLRTIGQIELAYGRIEVKATRFLDLAQFLTKLHKISSTSSNVGNRSKEQLCACKVYVAGHLALG

SEQ ID NO: 173754 - protein, 179 aa, Glycine max
  Coding DNA Sequence Number=SeqID_56976
  Gene Ontology: Mol. function=iron ion transporter activity; Cellular component=outer membrane-bounded periplasmic space; Biological process=G-protein coupled receptor protein signaling pathway
  Homolog annotation: Hit_ID=P46383; Match level="QueryCoverage=56%, HitCoverage=41%, E-value=3e-36, Identity=77%"; Hit description =Protein tonB
  Pfam annotation: Domain name=TonB; Domain location=117-151; Score =66.5; E_value=8.5e-17; Accession=PF03544.4; Description=Gram -negative bacterial tonB protein
MVAPADLEPPQAAQPVVEPVVEPEPEPEPEVVPEPPKEAPVVIHKPEPKPKPKPKPKPKPEKKVEPKREVKPAEPRPVSPFENNNTAPARTAPSTTAATAKPMTTAPSGPKALKRGDPSYPQRAQALRIEGDVRVKFDVTADGRVENIQILSAKPANMFERDVKTAMRKWRYEAGRPGT

SEQ ID NO: 173755 - protein, 54 aa, Glycine max
  Coding DNA Sequence Number=SeqID_56977
MNRLMTMKNLMLEDMGTQRSDRMVSQVSPRIFPPLESAPVSLALARPRRARCDN

SEQ ID NO: 173756 - protein, 190 aa, Glycine max
  Coding DNA Sequence Number=SeqID_56978
MVKVGTSYVPINVSFSPKVGPGLPGINRDTRIYLFCEVIFRHSCPSCSATDGVGELELHRGGGRSRTSGSPGLQEFDSTWQLATVSGEIDSSVNQRYARIEQLHAQRAQAQAGQPADLSRIDGQIAAQSAQMRAAAGAAIRRAHDTSVLIIALGVVGGVLSLATAWRSSLSIPSTSRGGPVPAFVPFSEG

SEQ ID NO: 173757 - protein, 277 aa, Glycine max
  Coding DNA Sequence Number=SeqID_56979
  Gene Ontology: Mol. function=nucleotide binding; Biological process =unidirectional conjugation
  Homolog annotation: Hit_ID=Q7CW18; Match level="QueryCoverage=99%, HitCoverage=21%, E-value=1e-122, Identity=82%"; Hit description=AGR _L_66p
MTTRQVGRTRLGEKTYLEHKNARLLSNGMATTDMQLRDIRQAWEGIANRQLQREGLDVRIDHRSHVERGLELSPTEHMGVHASQMQQQGLAVERGRLDDEAARQNAELIRQKPQQVLTLISNEKSVFDRHDIAKTLHRYINDDAQMFRNAFAAVLASPALVELQAEHIDPENGEVSNARYSTRDMINLELAMARSAERLHQAQSHGVDHRHVERAMERQDHALRTSAGGPSAASDPSSRLSDEQRQAIEHITGRERIAAVVGFAGAGKSTMLAAARE

SEQ ID NO: 173758 - protein, 107 aa, Glycine max
  Coding DNA Sequence Number=SeqID_56980
MTEGCGEGFCLANLLGDAFSLWGNFFEAKKQMMADAKFAGLLGLGKPLVEILPPGQLRGFCPLLARLGLAVLGFVGDLEGRDESKRQGLNLSGSWQQGHSATYNTPS

SEQ ID NO: 173759 - protein, 174 aa, Glycine max
  Coding DNA Sequence Number=SeqID_56981
  Homolog annotation: Hit_ID=Q1T493; Match level="QueryCoverage=88%, HitCoverage=35%, E-value=8e-15, Identity=27%"; Hit description =Nucleic acid-binding, OB-fold, subgroup
  Pfam annotation: Domain name=DUF223; Domain location=1-89; Score= -14.3; E_value=0.061; Accession=PF02721.5; Description=Domain of unknown function DUF223
MGDQIHVVCKANQLKSWKAYLKENSTYVMHNFKVVKNDGQFRVCEHQYKLVFIGVTVVRKADLHELPFKEFRFVEFGNVVGGNFVAGLLVDIIGVIDQFLAYLNERGNDGPIIIILTHARIKDAQGSNPASVSNSFKASKLLINEPVLEIQEFRERYFGHRLYSVAVKLVYQLC

SEQ ID NO: 173760 - protein, 54 aa, Glycine max
  Coding DNA Sequence Number=SeqID_56982
MRHADKEIVIVKSKSLTIKGEITIEAQKYHLKPHSEGASHQWHTTKIQEKQQGE

SEQ ID NO: 173761 - protein, 95 aa, Glycine max
  Coding DNA Sequence Number=SeqID_56983
MNRKQIFTVVATYPSAGGRRVARGMRVPRKEYARSRHQRLFEENVEKTGKDAIYELLSERFGSCIYARGRCRTGCHDIALQNMQIVYDSMNRLNK

SEQ ID NO: 173762 - protein, 96 aa, Glycine max
  Coding DNA Sequence Number=SeqID_56984
PHQLDPAPYASGPYNAQWNAPGLLHDKHTLRLSRILGEMEIDEPWLGLFHCKIHFLVGVLVYAKGMAFVDNWAVGKEKVGYWLSNDIVGLVGNLAV

SEQ ID NO: 173763 - protein, 62 aa, Glycine max
  Coding DNA Sequence Number=SeqID_56985
MVFEMSNEDGMPWLLSSGTTSWLDRVELDVLDSAEIAIEGWNGKFSDEGGGGDVGGDPHLPP

SEQ ID NO: 173764 - protein, 76 aa, Glycine max
  Coding DNA Sequence Number=SeqID_56986
MWIWHGDLIDMQSGSQSKPFDVEMGDCLEDMIRDLGQESFQQAHAPMYEGLQSDSKKPLYTGCKNSLMLLSVVLSL

SEQ ID NO: 173765 - protein, 196 aa, Glycine max
  Coding DNA Sequence Number=SeqID_56987
  Pfam annotation: Domain name=Copper-bind; Domain location=16-110; Score=5.1; E_value=0.00036; Accession=PF00127.11; Description=Copper binding proteins, plastocyanina
  Pfam annotation: Domain name=Cu_bind_like; Domain location=33-103; Score=-28.2; E_value=0.062; Accession=PF02298.8; Description =Plastocyanin-like domain
  Pfam module annotation: Pfam domain module=Copper-bind::Cu_bind_like; Domain location=16-110::33-103
  Subcellular localization annotation: CTP_CleavageSite=85; ConfidenceScore=5.52e-01
MFVLTAIALSLSVASAATNHVVTTVGLTFSPAKINVSVGDTVTWNFAGTHSVIKTADAQSCAAVPNAFNSGMKAAGTSFVWKAATAGTVWYACGIPAHCAANMKGVIVVNALAGPAPAPGAPAPAPAPGAPAPGAPAPAPAPGAPAPAPGTSSETAPASAPSATFAPAAAAKSDAQLNGRSAVAAVGVAVAGLLML

SEQ ID NO: 173766 - protein, 174 aa, Glycine max
  Coding DNA Sequence Number=SeqID_56988
  Subcellular localization annotation: CTP_CleavageSite=27; ConfidenceScore=5.31e-01
MFLNSWLFPHADDPLLQETSGTCRTVLTSQGSSRRCLSRGGGSRRCRGPGPYLASLIECCGRFSYDSPCCINTLLFVEVKLHDESRLIQRCFDDNKDDDKGDDKKLKGQSKNEFKIESITLQDSRGKLKNTSRFKRKVDFKNQESRIKNQDSRIKLSRIKIKIQDSRFKNQKKA

SEQ ID NO: 173767 - protein, 221 aa, Glycine max
  Coding DNA Sequence Number=SeqID_56989
MATRRLAAVLALPVLHQRPTEFRTITSDNTKSLFYNNIKSSIGMILSVLSPSQDGYKGGDGLDSFIREPEPNLISQVKESTKLLPFKGIIKIMVTNFIPTYIMILAYLCAPNLSVRVSSQVHPPSSVEELMEEQHREEVLPSSESTIHGMPTMSAPKKGNPTNVIHLARTNEADTTWSEGTPFITQLVQRAINADTWLHPFVDGIMEAQLPPEWKMLTIDR

SEQ ID NO: 173768 - protein, 119 aa, Glycine max
  Coding DNA Sequence Number=SeqID_56990
MFSDAILPPGALDRRLQEDWTRDTGEGPRVLMSLKELKRESVVKGKSDKHHTKAYIESIKHECASIKERNTILCSLIMAGAGDTGGKYHQLDESQHFLLDVVTTQMQRLLNCNNEELYG

SEQ ID NO: 173769 - protein, 129 aa, Glycine max
  Coding DNA Sequence Number=SeqID_56991
MRCTTVTQMSELPPWVPLCSVDNRSDPRVAQQCQQVVRTRGKQQLEREKSRSRVLEEVCSAEVIRVPTKNRPSPRVDKFKYCCYHRVAGHNTEECTTLKDKIKKLIQNGQLQRFIKDKDFSQDQDCEMD

SEQ ID NO: 173770 - protein, 53 aa, Glycine max
  Coding DNA Sequence Number=SeqID_56992
MNYVPMVGNDNNWSLVVISIKAHKVYHLLATHNQDHTEQIATKVHRVVSLGTM

SEQ ID NO: 173771 - protein, 148 aa, Glycine max
  Coding DNA Sequence Number=SeqID_56993
MSSSEGVVELGIEFSEANNFLLMSLMEETQEEEYDGDDRLVSMIQSLEAEISDTEMSQMYEMSHVDDQDCSTSVSGPDHWVDMELISSLTFDGMNAWIPCGDEMMEHAAMEYEAGNDINDFQLCYGVFLEQQYRETNYLAQGPCDAVF

SEQ ID NO: 173772 - protein, 200 aa, Glycine max
  Coding DNA Sequence Number=SeqID_56994
MDRLKKLIRNPHGPWAPRASPWTWAYLPTPMHQFGYVQSIPPHPVDSWESFDEIDVRWMHYSNHLALAGEMCVVPGQCVADYMDWFFVISHPFMTAAQPSNPPRDPLATHDASFVEPHIPQILKPAAASTHARSEVDEPRHAVACHAIAERLERNLNLRIVTPSTKTHEVMEQRLKIARGVIEDHIVYVRSRRRWCTDQP

SEQ ID NO: 173773 - protein, 1484 aa, Glycine max
  Coding DNA Sequence Number=SeqID_56995
  Gene Ontology: Mol. function=protein binding; Biological process =defense response
  Homolog annotation: Hit_ID=Q2HUU3; Match level="QueryCoverage=94%, HitCoverage=98%, E-value=7e-86, Identity=24%"; Hit description =Disease resistance protein; Calcium-binding EF-hand; AAA ATPase
  Pfam annotation: Domain name=LRR_1; Domain location=1010-1034; Score =0.2; E_value=2.7e+02; Accession=PF00560.23; Description=Leucine Rich Repeat
  Pfam annotation: Domain name=LRR_1; Domain location=1036-1056; Score =5.5; E_value=26; Accession=PF00560.23; Description=Leucine Rich Repeat
  Pfam annotation: Domain name=LRR_1; Domain location=1070-1092; Score =1.7; E_value=1.4e+02; Accession=PF00560.23; Description=Leucine Rich Repeat
  Pfam annotation: Domain name=LRR_1; Domain location=1212-1234; Score =1.4; E_value=1.6e+02; Accession=PF00560.23; Description=Leucine Rich Repeat
  Pfam annotation: Domain name=LRR_1; Domain location=1261-1285; Score =7.3; E_value=12; Accession=PF00560.23; Description=Leucine Rich Repeat
  Pfam annotation: Domain name=LRR_1; Domain location=1287-1321; Score =3.9; E_value=53; Accession=PF00560.23; Description=Leucine Rich Repeat
  Pfam annotation: Domain name=LRR_1; Domain location=1346-1369; Score =2.3; E_value=1.1e+02; Accession=PF00560.23; Description=Leucine Rich Repeat
  Pfam annotation: Domain name=LRR_1; Domain location=519-541; Score =2.6; E_value=94; Accession=PF00560.23; Description=Leucine Rich Repeat
  Pfam annotation: Domain name=LRR_1; Domain location=543-562; Score =1.3; E_value=1.7e+02; Accession=PF00560.23; Description=Leucine Rich Repeat
  Pfam annotation: Domain name=LRR_1; Domain location=564-585; Score =12.1; E_value=1.6; Accession=PF00560.23; Description=Leucine Rich Repeat
  Pfam annotation: Domain name=LRR_1; Domain location=587-610; Score =9.8; E_value=4.2; Accession=PF00560.23; Description=Leucine Rich Repeat
  Pfam annotation: Domain name=LRR_1; Domain location=612-629; Score =0.5; E_value=2.3e+02; Accession=PF00560.23; Description=Leucine Rich Repeat
  Pfam annotation: Domain name=LRR_1; Domain location=774-797; Score =2.1; E_value=1.1e+02; Accession=PF00560.23; Description=Leucine Rich Repeat
  Pfam annotation: Domain name=LRR_1; Domain location=801-824; Score =3.6; E_value=62; Accession=PF00560.23; Description=Leucine Rich Repeat
  Pfam annotation: Domain name=LRR_1; Domain location=986-1008; Score =0.7; E_value=2.1e+02; Accession=PF00560.23; Description=Leucine Rich Repeat
  Pfam annotation: Domain name=NB-ARC; Domain location=136-432; Score =128.1; E_value=2.5e-35; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::NB-ARC; Domain location=1010-1034::1036-1056::1070 -1092::1212-1234::...
  Pfam module annotation: Domain location=1261-1285::1287-1321::1346 -1369::519-541::543-562::564-585::587-610::612-629::774-797::801 -824::986-1008::136-432
MDAIANVPGVSEIANYVITFIKGQIGYISSYDENLEKLITEAQTLKDTQDGVQHRVVEAERNGDKIENIVQNWLKKANEMVAAANKVIDVEGTRWCLGHYCPYLWTRCQLSKSFEKITKEISDVIEKGKFDTISYRDAPDLTITPFSRGYEALESRTSMLSEIKEILKDPKMYMIGVHGMGGVGKTTLVNELAWQVKNDGSFGAVAIATITSSPNVENVQDQIVVAICGKNLEHTTKVGRMGELRRRIKAQNNVLIILDDIWSELDLTEVGIPFGDEHNGCKLVITSREREVLIKMDTQKDFNLTALLEEDSWNLFQKIAGNVVNEVSIKPIAEEVAKCCAGLPLLITAVAKGLRKKEVHAWRVALKQLKEFKHKELENNVYPALKLSYDFLDTEELKSLFLFIGSFGLNHILTEDLFRCCWGLGFYGGVDKLMEARDTHYTLINELRASSLLLEGELDWVGMHDVVRDEAKSIASKSPPIDPTYPTYADQFGKCHYIRFQSSLTEVQADNLFSGMMKEVMTLSLYEMSFTPFLPPSLNLLIKLRSLNLRCKLGDIRMVAKLSNLEILSLEESSIEELPEEITHLTHLRLLNLTDCYELRVIPTNLTSNLTCLEELYMGGCNSIEWEVEGSRSESKNASLSELQNLHNLTTLEISIKDTSVLSRGFQFPAKLETYNILIGNISEWGRSQNWYGEALGPSRTLKLTGSSWTSISSLTTVEDLRLAELKGVKDLLYDLDVEGFPQLKHLHIHGSDELLHIINSRRLRNPHSSAFPNLKSLLLYNLYTMEEICHGPIPTLSFAKLEVIKVRNCHGLDNLLLYSLARNLSQLHEMEINNCRCMKEIIAMEEHEDEKELLEIVLPELRSLALVELTRLQSFCLPLTVDMGDPSIQGIPLALFNQQDQFPNSETVEISIMNDWKSIRPNQEPPNSFHHNLKINIYDCESMDFVFPVSAAKELRQHQFLEIRSCGIKNIFEKSDITCDMTHVYLEKITVEKCPGMKTIIPSFVLFQCLDKLIVSSCHTLVNIIRPSTTTSLPNLRILRISECDELEEIYGSNNESDDAPLGEIAFRKLEELTLKYLPRLTSFCQGSYDFRFPSLQIVIIEECPVMDTFCQGNITTPSLTKVEYRLSRDNWYRIEDHWYGDLNTTVRTAFTKKYLYDDWETLDIRNNNNLKSIWPNQVTPNFFPNLTKIVIYRCESQYVFPIYVAKVLRQLQVLEIGLCTIENIVEESDSTCEMMVVYLEVRKCHDMMTIVPSSVQFHSLDELHVSRCHGLVNIIMPSTIANLPNLRILMISECDELEEVYGSNNESDEPLGEIAFMKLEELTLKYLPWLKSFCQGSYNFKFPSLQKVHLKDCPMMETFCHGNLTTTSHIEVRCLYGWSNEESEDHWDGDLNTTIRTIFTKEPLSNSSIIVKYEILVNSITTLIFMNVIVSIVFNFGEIELANATPYVLLSNSSAAVKKIVDQKDKVHMFLAVRGSITGILK

SEQ ID NO: 173774 - protein, 74 aa, Glycine max
  Coding DNA Sequence Number=SeqID_56996
MTLEAFLSQVEVASLYVAEPSPWTVPFDAEPSPVISPATSDDTKGISISGYLARSLASFYKGGDTSGVNVSDGV

SEQ ID NO: 173775 - protein, 156 aa, Glycine max
  Coding DNA Sequence Number=SeqID_56997
  Subcellular localization annotation: CTP_CleavageSite=53; ConfidenceScore=5.22e-01
MEPPTKQSSSHSVVVQSRVGATLVASTFAIFNTPMIYPGRLCRQLGRVSKHYRASARDGNTCPFYCLPENRHGIHDIMQQLSGKLGDIVKPMVLNKFQKAREEEHHHGQLEATTNSTPRNQLCQPLVTTLVIGIEAFEPPPIQFGTCKWLGIYLMS

SEQ ID NO: 173776 - protein, 144 aa, Glycine max
  Coding DNA Sequence Number=SeqID_56998
  Pfam annotation: Domain name=zf-CCHC; Domain location=72-89; Score =21.4; E_value=0.00029; Accession=PF00098.13; Description=Zinc knuckle
MKKITRRKKGIAFKALSSIQEESDKEDLNEIEEDDDFRLFVKRFNKFLTNKGNQRRSNFNPKKKGEDSSLAPKCYECDQPGHLRFDCLVFKRRMEKSNKKNFKDKKENKACITWKDNDMDSSSDSENEIINLGLMVIDYESGEE

SEQ ID NO: 173777 - protein, 217 aa, Glycine max
  Coding DNA Sequence Number=SeqID_56999
  Gene Ontology: Mol. function=RNA-directed DNA polymerase activity; Cellular component=intracellular; Biological process=RNA-dependent DNA replication
MVQEGILLGHKILARGIEVDKAKIDVIKKLPPPVNVNGIMSFLEHARLYRRFVKDFSKIARPLCNLLNKDAVFQLDEEFLTSFRALKNSLVSASIMVAPDWSKEIDLMCDTNDYAVGVILRQWREKLSYATTEKEMLAIVYALEKFGSYLVGSKVVIFIDYAIIKYLLTKADLKPRLIRWFLLIEEFDIVIKDKKGSKNVVVDHLSRLVNKEVTQEE

SEQ ID NO: 173778 - protein, 296 aa, Glycine max
  Coding DNA Sequence Number=SeqID_57000
  Gene Ontology: Mol. function=RNA-directed DNA polymerase activity; Biological process=RNA-dependent DNA replication
  Homolog annotation: Hit_ID=Q1S3H4; Match level="QueryCoverage=99%, HitCoverage=70%, E-value=3e-38, Identity=47%"; Hit description =Integrase, catalytic region
MANYKAASIIPNDFNWNQRKKFLHDARFYVWDDPYLFKIGVDNILRRCVTMEEARSILWHYHNSPYGGHYSGDRTDAKELQAEVFGLLSSRMPIIMCFIVIKARELGAFLREMKCHCKTSWKSYSSTPKNDAKTAIKFLKKNTFSHFGVPSVLISDEGSYFCNAQLLRVLGNYHVRPKDCFRYFHLTITISDGLWESEKWKLQLLELEEMRLNAYESSMIYKQKIKVYHERKLMKKTFQSGQQVLLFNSRLRLFLGKFDCKWSGPTIIKEVKPYGAVELVDPAPSQPNQSWIVNGQ

SEQ ID NO: 173779 - protein, 156 aa, Glycine max
  Coding DNA Sequence Number=SeqID_57001
MPYQDSIHLQNILLEKNVEFMPDMSFTPTSMIRRMVLQSSANYTDSPLQYVQGVDLDTLTYESLSLVKAAFFLLVGVAHPDDAKPLPCPTPHHSEPTPAFHPATTDDTRGLPTTKTRGGDTFGIGNDDVPKTRADEDYVADITATQGSWDPWPAQD

SEQ ID NO: 173780 - protein, 251 aa, Glycine max
  Coding DNA Sequence Number=SeqID_57002
  Gene Ontology: Mol. function=protein binding; Cellular component =integral to membrane; Biological process=xylan catabolic process
  Homolog annotation: Hit_ID=Q1T435; Match level="QueryCoverage=68%, HitCoverage=17%, E-value=1e-38, Identity=49%"; Hit description =Leucine-rich repeat; Leucine-rich repeat, cysteine-containing type
  Pfam annotation: Domain name=LRR_1; Domain location=107-128; Score =8.6; E_value=7.1; Accession=PF00560.23; Description=Leucine Rich Repeat
  Pfam annotation: Domain name=LRR_1; Domain location=35-57; Score =12.0; E_value=1.6; Accession=PF00560.23; Description=Leucine Rich Repeat
  Pfam annotation: Domain name=LRR_1; Domain location=59-81; Score =13.9; E_value=0.59; Accession=PF00560.23; Description=Leucine Rich Repeat
  Pfam annotation: Domain name=LRR_1; Domain location=83-105; Score =16.1; E_value=0.13; Accession=PF00560.23; Description=Leucine Rich Repeat
  Pfam module annotation: Pfam domain module=LRR_1::LRR_1::LRR_1::LRR _1; Domain location=107-128::35-57::59-81::83-105
MSEQFYCNEGKESNLKKNCYETKGQEYLYLNPEFLLKSIDLSSNDLTGEIPKEVRYLLELVSLNLSRNRLSGEILPEIGNLTSLEFLDLSRNHFSGEVPSTFSKIDRFVVLDLSNNYLVGRIPWGRQLQTFSASTFEGNTDLCGEPLNKSFPGNDTATKPQGPAIHGDDDNSIFYDALYMSLGLGFFTGFWRLIGYPGQSFQRIQILTFIVGLHISDEHVVWEDIHEQRALNVFLVVGDCVLVGFQVINFS

SEQ ID NO: 173781 - protein, 48 aa, Glycine max
  Coding DNA Sequence Number=SeqID_57003
MQHVIITKSNEREIREKHAASTSTNPNPKKAQKMQREENDLKQREGAE

SEQ ID NO: 173782 - protein, 123 aa, Glycine max
  Coding DNA Sequence Number=SeqID_57004
MATTHHSLNEHSFDLGIENDLQDLSLLIVEDSLDKEEKTDTVCKKLGHKGEGSQGVFRDCKGFTRIVENLKPPNLSQENDNLECIHRWIVVKFKQQVRNSILGILTIGNYEKKSEMREILFAS

SEQ ID NO: 173783 - protein, 203 aa, Glycine max
  Coding DNA Sequence Number=SeqID_57005
SSNLAQVSEEDLIVMWAFHTGRQIDWAHLVRIPLDSEPYIPIKRSFLIGAAAVASFGYRKERDDSWVKKVAQPNDDEGQLSVEGDSSLLQSILDRFDGLQTYVGERFDALEQQVDMRFDAMDSRITNVEEYVTIIRDCLDLPPPPPSNKRGYISCGLVQVEGTSTWLFKENKGGYIPCGSLACKGFYKVERNLKNRRLLGDWM

SEQ ID NO: 173784 - protein, 63 aa, Glycine max
  Coding DNA Sequence Number=SeqID_57006
MSISSAFMPYRTPMPSILCFIGLQAQGQVVVQGFDGCLSVPETKATRKRQNGHFLEFVDPKLA

SEQ ID NO: 173785 - protein, 90 aa, Glycine max
  Coding DNA Sequence Number=SeqID_57007
MTKPSKAAGWDKEGTKENTHLLEEIEKILCYVCDEVYMCLLHSYGLLHSYHHRVVAVKCLKNVTSGDAEFWAKVTIIARMHHLNMELNLS

SEQ ID NO: 173786 - protein, 246 aa, Glycine max
  Coding DNA Sequence Number=SeqID_57008
  Subcellular localization annotation: CTP_CleavageSite=29; ConfidenceScore=5.73e-01
MASPPASPPPPPPSPPPPSDASPLPSTVKQTRKASRLQSLSTRPPSAERPVVHIDPSIGKADGPHRKKLRTYLGIVARDKVDVTYENWKEVPIAQKDLIWEDIRAEFEILEASDSRTKRKLLQTVDERWRQFKSELMRKWALAADQDGCAEKRHRPSRNRTLPLTFCLVGVMNIWSRSSWLRRGRRSWRKMHSQEALMVSSTLHPPSDGHVSGEMTIEATKEIAEKIDSLEEQATQGSFVPHGHQD

SEQ ID NO: 173787 - protein, 49 aa, Glycine max
  Coding DNA Sequence Number=SeqID_57009
MGAQSSKLSPRVATSVDLSLLFLCVHPIPSTRPHKPNVQASKTVDFSYT

SEQ ID NO: 173788 - protein, 95 aa, Glycine max
  Coding DNA Sequence Number=SeqID_57010
MEYVEEANRAAGAIVRFKKVVSLLNSGLGHARVRLTAIVAAIVVVGFECRGDRRIIPPVLSISKARTTVLPLSCVIALIGSSYDRSTPQPLPVNK

SEQ ID NO: 173789 - protein, 627 aa, Glycine max
  Coding DNA Sequence Number=SeqID_57011
  Gene Ontology: Mol. function=nucleoside-triphosphatase activity; Cellular component=membrane; Biological process=defense response
  Homolog annotation: Hit_ID=Q1STU9; Match level="QueryCoverage=100%, HitCoverage=55%, E-value=3e-90, Identity=35%"; Hit description=H+ -transporting two-sector ATPase, alpha/beta subunit, central region; Disease resistance protein
  Pfam annotation: Domain name=LRR_1; Domain location=518-540; Score =1.1; E_value=1.8e+02; Accession=PF00560.23; Description=Leucine Rich Repeat
  Pfam annotation: Domain name=LRR_1; Domain location=542-562; Score =10.6; E_value=3; Accession=PF00560.23; Description=Leucine Rich Repeat
  Pfam annotation: Domain name=LRR_1; Domain location=564-585; Score =10.4; E_value=3.3; Accession=PF00560.23; Description=Leucine Rich Repeat
  Pfam annotation: Domain name=LRR_1; Domain location=587-610; Score =9.8; E_value=4.2; Accession=PF00560.23; Description=Leucine Rich Repeat
  Pfam annotation: Domain name=NB-ARC; Domain location=136-431; Score =140.0; E_value=6.6e-39; Accession=PF00931.13; Description=NB-ARC domain
  Pfam module annotation: Pfam domain module=LRR_1::LRR_1::LRR_1::LRR _1::NB-ARC; Domain location=518-540::542-562::564-585::587-610::136 -431
MDAIAHVPGVSQIANYVITFIKDQIGYISSYEENLEKLMTQVQTLEDTQVLVKNRVAEAERNGYKIENIVQNWLKNANEIVAEAKKVIDVEGATWCLGRYCPSRWIRCQLSKRLEETTKKITDHIEKGKIDTISYRDAPDVTTTPFSRGYEALESRTSMLNEIKEILKDPKMYMIGVHGMGGVGKTTLVNELAWQVKKDGLFVAVAIANITNSPNVKKIQGQIADALWDRKLKKETESGRAIELRERIKKQEKVLIILDDIWSELDLTEVGIPFGDEHNGCKLVITSREREVLIKMDTQKDFNLTALLEEDSWNLFQKIAGNVNEVSIKPIAEEVAKCCAGLPLLITALGKGLRKKEVHAWRVALKQLKEFKHKELENNVYPALKLSYDFLDTEELKSLFLFIGSFGLNEMLTEDLFICCWGLGFYGGVDKLMEARDTHYTLINELRASSLLLEGKLDWVGMHDVVRDVAKSIASKSPPTDPTYPTYADQFGKCHYIRFQSSLTEVQADKSFSGMMKEVMTLILHKMSFTPFLPPSLNLLINLRSLNLRRCKLGDIRIVAELSNLEILSLAESSFADLPVEIKHLTRLRLLNLTDCYDLRVIPTNIISSLMCLEELYMGGCNNIEWE

SEQ ID NO: 173790 - protein, 657 aa, Glycine max
  Coding DNA Sequence Number=SeqID_57012
  Gene Ontology: Mol. function=nucleoside-triphosphatase activity; Biological process=defense response
  Homolog annotation: Hit_ID=Q1STU9; Match level="QueryCoverage=66%, HitCoverage=39%, E-value=2e-42, Identity=29%"; Hit description=H+ -transporting two-sector ATPase, alpha/beta subunit, central region; Disease resistance protein
  Pfam annotation: Domain name=LRR_1; Domain location=154-177; Score =2.5; E_value=96; Accession=PF00560.23; Description=Leucine Rich Repeat
  Pfam annotation: Domain name=LRR_1; Domain location=258-280; Score =5.7; E_value=24; Accession=PF00560.23; Description=Leucine Rich Repeat
  Pfam annotation: Domain name=LRR_1; Domain location=285-309; Score =4.5; E_value=41; Accession=PF00560.23; Description=Leucine Rich Repeat
  Pfam annotation: Domain name=LRR_1; Domain location=311-335; Score =0.4; E_value=2.4e+02; Accession=PF00560.23; Description=Leucine Rich Repeat
  Pfam annotation: Domain name=LRR_1; Domain location=418-440; Score =0.8; E_value=2e+02; Accession=PF00560.23; Description=Leucine Rich Repeat
  Pfam annotation: Domain name=LRR_1; Domain location=442-467; Score =2.1; E_value=1.2e+02; Accession=PF00560.23; Description=Leucine Rich Repeat
  Pfam annotation: Domain name=LRR_1; Domain location=523-545; Score =4.6; E_value=39; Accession=PF00560.23; Description=Leucine Rich Repeat
  Pfam annotation: Domain name=LRR_1; Domain location=573-595; Score =4.0; E_value=51; Accession=PF00560.23; Description=Leucine Rich Repeat
  Pfam annotation: Domain name=LRR_1; Domain location=599-622; Score =1.1; E_value=1.7e+02; Accession=PF00560.23; Description=Leucine Rich Repeat
  Pfam annotation: Domain name=LRR_1; Domain location=97-118; Score =0.8; E_value=2e+02; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=154 -177::258-280::285-309::311-335::418-440::442-467::523-545::573 -595::599-622::97-118
DLHNLTTLEISFIDTSVLPMDFQFPANLERYHILISDLGEWELSSIWYGRALGRTLKLKDYWRTSRSLFTTVEDLRFAKLKGIKDLLYNLDVGGFSQLKHLYIQDNDELLYLINTRRLMNHHSAFLNLETLVLKLLYKMEEICHGPMQTQSLAKLKVIKVTYCNGLKNLFLYSLTGNLSQLHDMEISHCRGMTEIIAMEKQEDWKELQQIVLPELHSVTLEGLPELQSFYCSVTVDQGNPSGQSNTLALFNQQVVIPKLEKLKLYDMNVFKIWDDKLPVLSCFQNLKSLIVSKCNCFTSLFPYGVARALVKLQHVEISWCKRLKAIFAQEEVQFPNSETVKISIMNDWESIWPNQEPPNSFHHNLDIDIYDCKSMDFVIPTSAAKEFHQQHQFLEIRSCGIKNIVEKSDIICDMTHVYLEKITVAECPGMKTIIPSFVLFQCLDELIVSSCHGLEIGGIDIGILTEAHKLLPGKLWLQGNLTTPSLTKVEYEGIQYVWHSSKLSEDHWYGDLNTTVRTVFTKKLQVLNISWSTIENIVEESDSTCDMTVVYLQEIYGSDNESDAPLGEIAFMKLEELTLEYLPRLTSFCQGSYNFKFPSLQKVHLKDCPVMETFCHGNLTTTNHIEVRCLHGWRYEESEDQWDGDLNTTIRTIFTKK

SEQ ID NO: 173791 - protein, 121 aa, Glycine max
  Coding DNA Sequence Number=SeqID_57013
MHVEKNVCDSVIGMLLNIQGKTKDGLVNHEDFDDVKKNFLDKGAECGSSIVLMMSKRNHLIAIIKKEENVKIASTNKALFQDSLKIKPCLRKKGFKVMQGSGNRLQGSVIEYQKGRMKKSY

SEQ ID NO: 173792 - protein, 158 aa, Glycine max
  Coding DNA Sequence Number=SeqID_57014
  Gene Ontology: Mol. function=RNA-directed DNA polymerase activity; Cellular component=nucleus; Biological process=RNA-dependent DNA replication
GTIGHILNITPKEEKKDSKPQEVNISLPYFHGKYNVEAYLDREMKVEQLFPCHHISEERKVPLATLCFHGYALCWWTSLVMEQRIYGDPPIEYWNDLMSALRKRHISSYYERKHMDKFQRLRQGSMSVEEYRQQMELLLLRAGLREEERTSIVFVIVG

SEQ ID NO: 173793 - protein, 164 aa, Glycine max
  Coding DNA Sequence Number=SeqID_57015
  Gene Ontology: Mol. function=calpain activity; Cellular component =intracellular; Biological process=proteolysis
  Homolog annotation: Hit_ID=Q1RTJ9; Match level="QueryCoverage=89%, HitCoverage=45%, E-value=4e-16, Identity=38%"; Hit description =Cyclin-like F-box; F-box protein interaction domain
MPGYHLVGSCNGLHCGVSEIPEGYRVRFWNKATRVISRESPTLSFSPGIGRRTMFGFGYDPSSDKYKVVAIALTMLSLDVSQKTEMKVYSAGDSSWRYLKGFPVLWTLPKVGGVYLSGTLNWVVIKGKETIHSEIVIIFVDLEKEACRSLFLPDDFCFVDTNQF

SEQ ID NO: 173794 - protein, 69 aa, Glycine max
  Coding DNA Sequence Number=SeqID_57016
MTLMLCISAILGEKTCFCEENPSRCASITLPRCFCEQFREDFPSFFTVLRSSTAFIFISITCGFLFFYF

SEQ ID NO: 173795 - protein, 169 aa, Glycine max
  Coding DNA Sequence Number=SeqID_57017
MVNGRLACSIVGLQSISKQITTPKMRQPLANEAKVSIQATVAPEVESGGWKPVKKERVTFSDRTSEKVQKKKEPHTQKYIRGGRDCAIVIESDEEIDGGFSCLVQENAGVNLLGNLTKEALEETERILRKARRRKRKTKNSNMDVILMPLSWLCRRNLILSDAEGKTPG

SEQ ID NO: 173796 - protein, 941 aa, Glycine max
  Coding DNA Sequence Number=SeqID_57018
  Homolog annotation: Hit_ID=Q10T01; Match level="QueryCoverage=96%, HitCoverage=99%, E-value=3e-25, Identity=22%"; Hit description =Expressed protein
MTKKSQRRPVRYEKDKSGCIWGFISMFDFRHGHSTRKMIADKRRSSKHAVGVVHSKNKFEMLGNLGEVCQSSSDNRENRRPTVATAANKPSVKKLIEEEMFIDQNAMKDTDGAQIESKESRLRREVLLKLDSKRKKKSYKKNRDTEDTDDSNLDTTLKSEFTHNQHSRKQSKDNLDLDKMIEDFCHLKDACSMMHGNDGEVELDAQSNQKQAISEKATDAICEFVNQMILNGKDPAEARKFLCSHQLMEVLQLISSDKELFLSLIQNPNSLLLKCVQEFRNSQETNEKEYGCVTDSNFSEQDHGNMEQNREIVNHKKHNFFGKKTKSQSKTSTNENENTNLSSRIVIMKPGQIGFQNFETGNNLASSQDTHDSVKYNGSPGRGSSHFSLTEIKKKLKHAMGKERHRNPEGISKRHPAAECQNKWPTSKAIGKDNVGMRSPNKDHFFIEKIARPTTGAMQGDKTGTAKDSELIVEHENGTYSKQRVSNLYIEANKHLCEIVGNGDEKIDLSSRKISRTLGKILSLPEYNFSPLGSPGRDWEHHFVTATTRFSTSDKVPSKQGNSVGHLDQEMDNSEKQSSICHESSKDTVQEIKSDSNFADNLSHVHRVENFSRVRDEIITEGDIESAKEVNVLESSSEPVDLSAGKEDQNYGISETSDCARCSQCSKQDVTEVNKPTSPLSSPSHSSPTKKIEELSVTEVSGRPSPVSVLDTPFLEDDINPGYSRFQPVEVPARLLQFEEQNCSLLNQINRDKYCLKENEWIYDCIKAVLQASGLTVDQLLTKCLSSDKILDPSLFDLVEFLPNQFCNDQKLINDCINDVLMEVCRNYFGVSPCVSFVSPGIRPIPNMKKMILKVCEGVCWHFLPLPPPRTLDKIIKKDMDKNGAWLDHNLDAETIGFEMGEAILAELMEDTILSCVSKSPESECSQLQFEYKDNENSKTM

SEQ ID NO: 173797 - protein, 113 aa, Glycine max
  Coding DNA Sequence Number=SeqID_57019
MQKKKGEGDAYNGRLRVAAQWRGGTAARWRGEERPMANVWTLKRGGRKSSVSLGRERRPKRDLGSVVLGPCLPKNTPEPQHLILPAKRQSSSAARCRCALCLKHKEYDDYVQN

SEQ ID NO: 173798 - protein, 119 aa, Glycine max
  Coding DNA Sequence Number=SeqID_57020
MTSAAIVTVILKLRCEPASVASQGCTAMLHFYSTPNVVKIEILHGTGRGMKDCKLKDHSMDLCNNPVDARQRQSRNVVAVKLRVEGGEVRIKVIVFQNGLAWVDRAVLDEEDRNPPQSS

SEQ ID NO: 173799 - protein, 85 aa, Glycine max
  Coding DNA Sequence Number=SeqID_57021
  Homolog annotation: Hit_ID=Q2HTJ2; Match level="QueryCoverage=44%, HitCoverage=1%, E-value=7e-12, Identity=86%"; Hit description=2-oxo acid dehydrogenase, lipoyl-binding site
  Subcellular localization annotation: CTP_CleavageSite=43; ConfidenceScore=5.65e-01
MQRYHAGSCTSAVNNSTIGGPSTRDAGRSDSSSLPANFSWSLLSNQKKGRNKAAVLSQPGQKKQEILPEKGGGRGSSRFRKTVPS

SEQ ID NO: 173800 - protein, 40 aa, Glycine max
  Coding DNA Sequence Number=SeqID_57022
MLDGWVIDASAGDADPRYRYLLLSSNLYCEVTWDVRSCLD

SEQ ID NO: 173801 - protein, 136 aa, Glycine max
  Coding DNA Sequence Number=SeqID_57023
  Subcellular localization annotation: CTP_CleavageSite=63; ConfidenceScore=5.79e-01
MTLASSTTSASAFAPWNNPSLGNPSGSPFRPPQNPLYGMPTSLMVGLQNSQPNIENLNMASPSGSVAGNQGRQPPIRQIQIQAPVQEIQMPNNPGMQMAQAPQPAARIEPPVQQVEPNPGIVLIQTLKGKVFHPSP

SEQ ID NO: 173802 - protein, 84 aa, Glycine max
  Coding DNA Sequence Number=SeqID_57024
MRAGNSDVYGFLEPQSIQRFGQSQFESESYIKSWMHSSKRNVYLGAYLNGSDNYLKGIMNSALKGLDDTPQPKSKAGARWIVVK

SEQ ID NO: 173803 - protein, 392 aa, Glycine max
  Coding DNA Sequence Number=SeqID_57025
  Homolog annotation: Hit_ID=Q2HTJ2; Match level="QueryCoverage=98%, HitCoverage=15%, E-value=1e-145, Identity=67%"; Hit description=2 -oxo acid dehydrogenase, lipoyl-binding site
MQLLFLRLGAPDFHPQTPNCPEETLTREYLQSGYRDTVEGLEEAREISLTQVPHFNKKVVLSCKEAIRKRLRAINESRAQKRKAGQVYGVALSGSQLGRSGIFPELRPYGEDFQKKWIETSVNRAVSSRKERAVASTVPLGDRKRRGGRLAQIVKVVVAGLSQQHKRLRSLADHVPHGYKRTSLLEVLIRNNVPLLRATWFIKVTYLNQVRPGSVGISSGAADKIQLSRSDVWTKDVINYLQTLVDEFLSKNALHSASHGRERSPQMSYTGSLQNKNDPLLSVSDGEGPSLHFRWWYIVRLLQWNHAEGLLHPSLVIDWVFNQLQEKDLLEVWQLLLPIIYGFLETIVLSQTYVRTLAGLALHVIRDPAPGGSDLVDNSRRAYTAYAVIEML

SEQ ID NO: 173804 - protein, 1758 aa, Glycine max
  Coding DNA Sequence Number=SeqID_57026
  Homolog annotation: Hit_ID=Q2HTJ2; Match level="QueryCoverage=99%, HitCoverage=80%, E-value=0.0, Identity=64%"; Hit description=2-oxo acid dehydrogenase, lipoyl-binding site
MNDGNFVLKSTEAAGKIKNSSDDFGHIISCIQKHTEDLVKAASPGYPGHCLAKVAKALDKALVLGDLRVAYKFLFEDLCGGTVSEGWISKVSPCLRDFCSTPPRDIKFTGRKDLSQVHIAVRLLKMKIRDVKISQKQTNENHRASHLAKHSSQRHNWNYVGNVSRLRSSSKSTGSSVFESPGPLHDIVVCWIDQHVVQKGEGPKRLNLFMVELIRAGIFYPLAYVRQLIVSGIMDVNVNVVDLERQRRHYRILKQLPGCFIHDVLEESGIVEGSQLKEALQIYLNERRLILRGHLSVSCGSNLSALKKKKYPASTKDEVFAVPIDQRNVISTTISSKNAKDTNIEELRTAISVLLQLPNCSSNLSTTGDESEGSDRRAIGSPYGKIDPVEGTPGCEECSRAKRQRLSEERSTFVQGHSPVQSDDDDTWWVKKGMKSPEPLKVDQPQKSTKQVTKSRLKNVRKTQSLAQLAASRIEGSQGASTSHVCGNRVSCPHHKTAMDGDGQRSVDSIRTSHFGDIVSIGKALKQLRFVEKRAIAAWLLTVVRQVIEDVEKNIGKVGQFSKPFPVVDDRGSIQWKLGEDELSVILYLMDISDDLVSVVKFLLWLLPKVLNSPNSTIHSGRNVVMLPRNVENQVCDVGEAFLLSSLRRYENILVAADLIPEALSSAMHRVATVIASNGRVSGSGALAFARYLLRKYSNVASVIEWEKTFKTTSDARLSSELESGRSVDGELGLPLGVPAGVEDHDDFFRQKISGGRLPSRVGAGMRDIVQRNVEEAFHYLFGKDRKLFAAGTPKGPTLEKWDNGYQIAQQIVMGLIDCIRQTGGAAQEGDPSLVSSAVSAIVGSVGPTLAKMPDFSSGNSHSNTMPATNALNYARCILQMHIACLCLLKEALGERQSRVFDIALATEASNALAGVFSPSKASRSQFPMSPEAHDSSNTISNDMGSNSSKVVAKTTKIAAAVSALLVGAIIYGVTSLERMVTVLRLKEGLDVVQFVRSTRSNSNGNARSLMAFKVDNSIEVHVHWFRLLVGNCRTICEGLVVELLGEPSIMALSRMQHMLPLNLVFPPAYSIFAFVRWRPFILNATVREDMNQIYQSLTMAITDAIKHLPFRDVCFRDCQGLYDFMAADASDSEFATLLEFNGSDMHLRSTAFVPLRSRLFLNAMIDCKMPQSIYTKDDGSRMSGPGESKIKFTDSESKLQDMLVHVLDTLQPAKFHWQWVVLRLLLNEQALIEKLENRDVSLADAIKLSSPSTEKAAAASENEKNFIQILLTRLLVRPDAAPLFSELIHLFGRSLEDSMLSQAKWFLAGQDVLFGRKTIRQRLHNIAVKKNLSVKTQFWEPWGWCSLSTDPLTVKGDNKKFDSTSLEEGEVVEEGMDLKRCQLQVTERALIEMLLPCIDQSSDESRNSFASDMVKQLSYIEQQITAVTGGSKSVGSAPPGVEGQPNKVNNRKNMRGGSPALTRRQTVATDSSPPSPAALRASMSLRLQLLLRFLPILCTDREPSVRSMRQFLATVIFRLLGSRVVHEDVDISVNAVPSLSIREAESSSEVASAAFVDSSSGSLFDRLLLVLHGLLSSYPPSWLRAKPVSKTISEPTREISGIDRELLETLQNDLDRMQLPDTIRWHIQAAMPILIPSMRCSLSCQPPSISNSALVCLQPSITNPGSNSSSSTIPQRNPVLSRVASNASGKSKQQDNDLEIDPWTLLEDGTGSYSSAGNTASIGSGDHANIRATSWLKGAVRVRRTDLTYVGAVDDDG

SEQ ID NO: 173805 - protein, 302 aa, Glycine max
  Coding DNA Sequence Number=SeqID_57027
  Gene Ontology: Mol. function=nucleotide binding; Cellular component =cytosol; Biological process=sulfate assimilation
  Homolog annotation: Hit_ID=Q8H2D4; Match level="QueryCoverage=99%, HitCoverage=98%, E-value=1e-121, Identity=70%"; Hit description=DRL1 protein
  Pfam annotation: Domain name=KTI12; Domain location=1-296; Score =391.4; E_value=1.3e-114; Accession=PF08433.1; Description=Chromatin associated protein KTI12
MALVVMCGQPCSGKSKAAVCLAEALKESESKLQVRIIDEACFHLNRNQSFANMPSEKNLRGVLRSEVDRSLSKDSIIIVDSLNNIKGYRYELWCLARAAGIRYCVVFCDVEETICRKWNEERREKGEANYDDSIFEDLARRFEKPDRRNRWDSPLFELWPHREATEKSSPAVVDAVSYLTKKVDSKTRDVKILQPTIATQTSRFSDANSLYELDKATQEVTNAIVEAQSQALGGPLNGVSIGKDLPVINISRSVGLPELRRMRRTFIKLTGQTSLSGPPPPSDADSAKRMFIDYLNRELGTS

SEQ ID NO: 173806 - protein, 65 aa, Glycine max
  Coding DNA Sequence Number=SeqID_57028
MDVESPKTRLNIGFYFLHLSFLLDAPPKHPNRQNYSSSLPPNTIVDNSNAGKKVQTKSKMKERTL

SEQ ID NO: 173807 - protein, 103 aa, Glycine max
  Coding DNA Sequence Number=SeqID_57029
  Subcellular localization annotation: CTP_CleavageSite=10; ConfidenceScore=5.24e-01
NCISKFRERRATITAPPPSPPAPREPAAVLSPLTPATPLLLRIENAPRKSKQTRKALRRPGQPARGSEQSRQSSAAPPPPLNFLFPQRHPEGLPLVREGGGLN

SEQ ID NO: 173808 - protein, 262 aa, Glycine max
  Coding DNA Sequence Number=SeqID_57030
  Gene Ontology: Mol. function=transferase activity
  Homolog annotation: Hit_ID=Q0M176; Match level="QueryCoverage=52%, HitCoverage=57%, E-value=1e-53, Identity=71%"; Hit description =Glutathione S-transferase-like
MGGGQAARDGRQVALRFGGAVIAPEHAGQEGRLQRGLGPVHPAIGARASRRIGRPEGVGAMARGQVAQDRVRLPHHRVAVAQQRHPAMGIHPQEVGRIEQPELAAGRHVLIRQAQFARQPQDLLHVEGTAPAPDRQHRKPPSSGASAGHDDARLAQHGEVDRIGDEAEMMRAGMQGLGQAGVAARGDGRDDDVLDRAKVQIPELVAGRQRGHQQVLGIPARRVAAECGIGRTGDIGLARRLDHVVAGINGVAGGALAGIAGP

SEQ ID NO: 173809 - protein, 59 aa, Glycine max
  Coding DNA Sequence Number=SeqID_57031
MPKLMEADVQFESPTCPSNTAVDPELNSEDQVLCSVSIAPLRPTTESQLVLPLSTTELT

SEQ ID NO: 173810 - protein, 393 aa, Glycine max
  Coding DNA Sequence Number=SeqID_57032
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=P56757; Match level="QueryCoverage=100%, HitCoverage=89%, E-value=0.0, Identity=79%"; Hit description=ATP synthase subunit alpha
  Pfam annotation: Domain name=ATP-synt_ab; Domain location=149-305; Score=236.0; E_value=8.3e-68; Accession=PF00006.15; Description=ATP synthase alphabeta family, nucleotide-binding domain
  Pfam annotation: Domain name=ATP-synt_ab_C; Domain location=317-393; Score=100.9; E_value=3.7e-27; Accession=PF00306.17; Description=ATP synthase alphabeta chain, C terminal domain
  Pfam annotation: Domain name=ATP-synt_ab_N; Domain location=25-93; Score=77.2; E_value=5e-20; Accession=PF02874.13; Description=ATP synthase alphabeta family, beta-barrel domain
  Pfam module annotation: Pfam domain module=ATP-synt_ab::ATP-synt_ab _C::ATP-synt_ab_N; Domain location=149-305::317-393::25-93
MVTIRADEISKIIRERIEQYNTEVKIVNTGTVLQVGDGIARIYGLDEVMAGELVEFEEGTIGIALNLESKNVGVVLMGDGLMIQEGSSVKATGRIAQIPVSEAYLGRVINALAKPIDGRGEISASESRLIESPAPGIISRRSVYEPLQTGLIAIDSMIPIGRGQRELIIGDRQTGKTAVATDTILNQQGQNVICVYVAIGQKASSVAQVAYRQMSLLLRRPPGREAYPGDVFYLHSRLLERAAKLSSQLGEGSMTALPIVETQSGDVSAYIPTNVISITDGQIFLSADLFNAGIRPAINVGISVSRVGSAAQIKAMKQVAGKLKLELAQFAELEAFAQFASDLDKATQNQLARGQRLRELLKQSQSAPLTVEEQIITIYTGTNGYLDSLEIGQ

SEQ ID NO: 173811 - protein, 132 aa, Glycine max
  Coding DNA Sequence Number=SeqID_57033
  Gene Ontology: Mol. function=DNA binding; Biological process=DNA integration
MSPDRVVFGKACHLPVEIEHKAYWAVKTYNFSMDQAGEERKLQLTYENATFYKEKTNKFHDSMIIKKDFMVGQKVLLYNSKLGLMSVEIKSDATNKSFKVNGHRLKPFLTNPSLVDVVVEETSLLHPTLPPP

SEQ ID NO: 173812 - protein, 69 aa, Glycine max
  Coding DNA Sequence Number=SeqID_57034
MGSKIYPEDHENTKAFFSSSSPILLDSSIQYPWGVPPLVLLTKATLSPTREILEPTFATSTLTRDNSRF

SEQ ID NO: 173813 - protein, 139 aa, Glycine max
  Coding DNA Sequence Number=SeqID_57035
  Gene Ontology: Mol. function=gluconolactonase activity; Biological process=metabolic process
  Homolog annotation: Hit_ID=UPI00006B2174; Match level="QueryCoverage =96%, HitCoverage=44%, E-value=5e-37, Identity=47%"; Hit description =possible gluconolactonase precursor
MPEKISDRFGFTEGPSSDKEGNVYFTDQPNDKIYYWDWKTNEIREFLSKTGRANGTHFDQDDNLITCSDDQGEIWKISKDKKIQILLKGFEGKRLNGPNDVWGDSSGGMYFTDPLYKRDYWIDFKQEIPHKSLYYRNKE

SEQ ID NO: 173814 - protein, 146 aa, Glycine max
  Coding DNA Sequence Number=SeqID_57036
MVGIEAVCASKGAVWLTFGTPNWERMEVCETSDGGAVAGSGHVDLRRPKSSGCLLENLSELQWQPMTMEIKFEPNVMCEPIDKKVTFRTSQVGSGWIPVICHQLSTSDEAEVGGILTVVDYGDVGKRCLPLPVNGSGIELPRCGNL

SEQ ID NO: 173815 - protein, 119 aa, Glycine max
  Coding DNA Sequence Number=SeqID_57037
  Subcellular localization annotation: CTP_CleavageSite=27; ConfidenceScore=5.23e-01
MMLSSLLIFASYASALHSSLSQRALLRASEARLTGALSKGGKDARSRHQRLFVENVGKTEGNRKVLAPLTFVSKDNNLFFRIVEIVDKSGAFAPMYPPLERKSDLRSSFLRVNQAILFT

SEQ ID NO: 173816 - protein, 386 aa, Glycine max
  Coding DNA Sequence Number=SeqID_57038
  Homolog annotation: Hit_ID=Q2HTR6; Match level="QueryCoverage=39%, HitCoverage=50%, E-value=5e-16, Identity=33%"; Hit description=RNA -directed DNA polymerase
MVTKERRDKIGIKEVKRNHREGNIEAKSVLSLKDTLLEEGILILKEFKWQQVCLSGCGINCLVTEAQEMQREGRFGASQRDSLCFNKFVEEMELEDVPEEHAKILKRSLLDHCPILLRISNIEEVKRGKGKEDLEQVNEIVCALINLWRKWNWKMFLRKDWGIGEVGGRKSANGKGNQPKNLLTRIILESGKNLIQGLKIGEKWEEDPNKVMEEVKKSFQLVLRKRVKGDNFGSVEVVKVLIQKDLTLNSSKPRREVLKGDIMRYMNEFHTNGIILRGCNSSFITLIPKVEEPQDLGEVCPISLVGCWIKKFLESTYIQVLDNGFPMMEFAPQRGLRQGDPFAPFMFTIVMEGKNGVMVDLLQYVDDTIFFVKASDGNVMVIKSML

SEQ ID NO: 173817 - protein, 87 aa, Glycine max
  Coding DNA Sequence Number=SeqID_57039
MKKILGLQSPMEIHHHGENVNVCIHDFDDAKEESNKATSKDKHCSEIDTRLLQQTKPCFKISSRSSLASKQRVSKSSKALIIDYQAV

SEQ ID NO: 173818 - protein, 138 aa, Glycine max
  Coding DNA Sequence Number=SeqID_57040
MQQRVPSISKRPIKGCVSSNNNPRTKLGYDNDHNLSLRAIGHGRLRMAKRCGMTIICLRMSSGSPPLDDKRRRMTIICLCMPSDTIVSGWRKGCGMTIICLCMSSGSPPLDGKRCRMTIICLCVPSDTIVSGWQKGAK

SEQ ID NO: 173819 - protein, 606 aa, Glycine max
  Coding DNA Sequence Number=SeqID_57041
  Gene Ontology: Mol. function=nucleic acid binding
  Homolog annotation: Hit_ID=Q2R2A2; Match level="QueryCoverage=50%, HitCoverage=93%, E-value=1e-32, Identity=31%"; Hit description=Zinc knuckle family protein, expressed
  Pfam annotation: Domain name=zf-CCHC; Domain location=165-182; Score =22.6; E_value=0.00019; Accession=PF00098.13; Description=Zinc knuckle
  Pfam annotation: Domain name=zf-CCHC; Domain location=187-204; Score =25.7; E_value=5.7e-05; Accession=PF00098.13; Description=Zinc knuckle
  Pfam annotation: Domain name=zf-CCHC; Domain location=206-223; Score =24.4; E_value=9.4e-05; Accession=PF00098.13; Description=Zinc knuckle
  Pfam annotation: Domain name=zf-CCHC; Domain location=233-250; Score =12.0; E_value=0.01; Accession=PF00098.13; Description=Zinc knuckle
  Pfam annotation: Domain name=zf-CCHC; Domain location=284-303; Score =3.6; E_value=0.25; Accession=PF00098.13; Description=Zinc knuckle
  Pfam annotation: Domain name=zf-CCHC; Domain location=367-384; Score =36.6; E_value=8.4e-08; Accession=PF00098.13; Description=Zinc knuckle
  Pfam module annotation: Pfam domain module=zf-CCHC::zf-CCHC::zf -CCHC::zf-CCHC::zf-CCHC::zf-CCHC; Domain location=165-182::187 -204::206-223::233-250::284-303::367-384
MGRKEKQNAKAIDEEHDVVNFNGASTPSLVFSSDDDEANQDLSLKIVEKAMRMRAAKHAPNDDVSSPFSQKSELAVPLNDVVSDLPSAIADSEVTEKKKTAKLKREAAGDQSVVIAEEQEMEETSNATENHEFVEGSPVLIGHNMVLRKLLRGPRYFDPPDSSWGACFNCGEDGHAAVNCSAAKRKKPCYVCGGLGHNARQCTKAQDCFICKKGGHRAKDCLEKHTSRSKSVAICLKCGNSGHDMFSCRNDYSPDDLKEIQCYVCKRVGHLCCVNTDDATPGEISCYKCGQLGHTGLQPWCGRFFVNRHRQFVKGGHHGGAIWHNGGAIWHNGMLIWQNFGLTPLITLGPQACSRLRDEITSGATPSSCFKCGEEGHFARECTSSIKSGKRNWESSHTKDKRSQKENDYMGNRSASNDMVGARRKKRSPTEERGFSTPKKSKSRGGWTAEYPTEERGFTTPKKSKSRGGWTTEHPTEERGFTTPKKSKNRGGWTSEHPLEQKDYTTPKKSKSRGGWMSEHPEEFFPPMSSRSNGYRSLGTPSSRNNKIHSFGGGSHTPSYKSSKVWNDHAGTSMSQGSARSNHHRFSASRFGNSSSDGHGRNYNWW

SEQ ID NO: 173820 - protein, 298 aa, Glycine max
  Coding DNA Sequence Number=SeqID_57042
  Homolog annotation: Hit_ID=Q1RWU1; Match level="QueryCoverage=70%, HitCoverage=68%, E-value=9e-13, Identity=26%"; Hit description =Resistance-like protein HAAS-2-related
MKEGHIPAELGALFDTNQGSVHKKQEMIHFNAMRHMFGYPDCKTFILSVTHVHVVFLDAFCDLNQAGSYSWGAAALVHMYENLNDASKRNIKQLAGYITLLQCWIYEHFPTIAPCIAAKDYHERKSRACHWKFGKALPVSTYRKRLDRLTSDVLGDPPRHPPVVHNDTFIEPDPSQQVVVALAMPKPPADELADVDMPRHALACHEIVERLEGLINLRVVTKGTEAYTVTEECLRIARGVTAQGNEVEEGFQGSKVDGIERIKKEEERRGNEAEALPNRDRNHSLNRSLFDVLRVTVG

SEQ ID NO: 173821 - protein, 96 aa, Glycine max
  Coding DNA Sequence Number=SeqID_57043
QGPCFSSSQSGVNNKGIYLENGGVFGSLNIGAEEDVGTTSYLDEQLQVATPLKGARLRQRGGGGTNTTFGGRTGAVGFVNVREMEECDGKGTMSGW

SEQ ID NO: 173822 - protein, 100 aa, Glycine max
  Coding DNA Sequence Number=SeqID_57044
METAGVVAGVGEGHKALSVDSPNRGAAAKLAIGCDFLNRDSSYSRAIQLQEKYAIRFASLDLRIASYRMNRIAILVILTTMVEGWSKMRLVICQTEEEKL

SEQ ID NO: 173823 - protein, 71 aa, Glycine max
  Coding DNA Sequence Number=SeqID_57045
MLLPSAVHVFSIIKCEASGDWEARYSVVFQIGSFAKRKKEEVETRVVIMERQGGRNQCPIFAFLLSPMRGK

SEQ ID NO: 173824 - protein, 67 aa, Glycine max
  Coding DNA Sequence Number=SeqID_57046
MYEMAPRKLASKRSRKDKAAEGTSSAPEYDSHRFRSAEHQQRFEAIKGWSFLRERRVQLRDNKYTDF

SEQ ID NO: 173825 - protein, 650 aa, Glycine max
  Coding DNA Sequence Number=SeqID_57047
  Gene Ontology: Mol. function=transferase activity; Cellular component= integral to membrane; Biological process=transport
  Homolog annotation: Hit_ID=Q5ZCH7; Match level="QueryCoverage=83%, HitCoverage=99%, E-value=0.0, Identity=70%"; Hit description=O -acetyltransferase-like
  Pfam annotation: Domain name=Cas1p; Domain location=160-399; Score =551.2; E_value=1.1e-162; Accession=PF07779.2; Description=Cas1p-like protein
MASESLTVAAESLFLSASVPVISGESENSELWCDSSAASSRFSEMLLLSPVTPGQVSFLLGIIPVVVAWIYSEILEYRKNSVSSRAQSDINLVEMGSDVVKDEDRAVLLEGGALQSGSPKARSLTGSPSIIRFLLMDECFLLENRLTLRAMSEFGLILAYFYLCDRTDFFASSNKSYNRDLFLFLYFLLIIVSAMTSFKIHHDKSPLSGKSILYLNRHQTEEWKGWMQVLFLMYHYFAASEIYNAIRLFIAAYVWMTGFGNFSYYYVRKDFSLARFAQMMWRLNFFVVFCCIVLNNSYMLYYICPMHTLFTLMVYGALGILHKYNEIGSVIAVKIIACFLVVILVWEIPGVFEWVWSPFTFFLGYTDPNPAKSHLSRLHEWHFRSGLDRYIWIIGMIYAYYHPTVERWMEKLEEAEIKRRISIKATVVLICSLVGYLWFEHIYKLDKIAYNKYHPYTSWIPITVYICLRNVTQSFRSYTLTLFAWLGKITLETYISQIHIWLRGEGGVPDGQPKLLLSLIPDFPMLNFMLTTSIYVAISYRLFDLTNTLKMAFVPSKDDKRFIHNLITATTISVVLYSLSLGFLRVPQMLLPVDSEEFWAVATIGLSGQLFTERCIHLFFKTSTSWWHIQAYIISLCWESGTSYYCWLIG

SEQ ID NO: 173826 - protein, 278 aa, Glycine max
  Coding DNA Sequence Number=SeqID_57048
  Gene Ontology: Mol. function=protein serine/threonine kinase activity; Biological process=protein amino acid phosphorylation
  Homolog annotation: Hit_ID=Q1SZH0; Match level="QueryCoverage=97%, HitCoverage=42%, E-value=4e-74, Identity=60%"; Hit description =Protein kinase; UspA
  Pfam annotation: Domain name=Usp; Domain location=6-147; Score=34.3; E_value=4.3e-07; Accession=PF00582.16; Description=Universal stress protein family
MVLPCPAQILVGLSLDPDDSKELLSWAIRVLANPNDTIVAVHVLVAADKKKRVSVRRRQSQLRQAKAYVISVLGEFAQSSWSKQVNLEARVALNSTVGEGLVEEVKSINADYLLIRGSRNRTNKIGTSKGITKYCFEHAHDGCTMVSVGRRTKADQNANSNSTRFQDKKQPSSRWFKKNNQYGKGASPILEDYISGTKAQNRSPRTVLDGLEGQSNSTEDDTFSTRVSSTTNTPSSDSKRRSKIRTPQFPFRFIVSFLASPFRSKNFSISTNESVSLC

SEQ ID NO: 173827 - protein, 380 aa, Glycine max
  Coding DNA Sequence Number=SeqID_57049
  Gene Ontology: Mol. function=protein serine/threonine kinase activity; Cellular component=membrane; Biological process=protein amino acid phosphorylation
  Homolog annotation: Hit_ID=Q1SSP5; Match level="QueryCoverage=97%, HitCoverage=99%, E-value=0.0, Identity=87%"; Hit description=Protein kinase
  Pfam annotation: Domain name=Pkinase; Domain location=42-313; Score =116.8; E_value=6.2e-32; Accession=PF00069.15; Description=Protein kinase domain
  Pfam annotation: Domain name=Pkinase_Tyr; Domain location=42-313; Score=91.8; E_value=2.1e-24; Accession=PF07714.7; Description =Protein tyrosine kinase
  Pfam module annotation: Pfam domain module=Pkinase::Pkinase_Tyr; Domain location=42-313::42-313
MGSSISCCGSERVEEVPTSFGVVHNSWRIFTYKELHAATNGFNDDNKLGEGGFGSVYWGRTNDGLQIAVKKLKAMNSKAEMEFAVEVEVLGRVRHKNLLGLRGYCVGDDQRLIVYDYMPNLSLLSHLHGQFAVEVQLNWQRRMKIAIGSAEGLLYLHREVAPHIIHRDIKASNVLLNSDFEPLVADFGFAKLIPEGVSHMTTRVKGTLGYLAPEYAMWGKVSESCDVYSFGILLLELVTGRKPIEKLPGGLKRTITEWAEPLITNGRLRDLVDPKLRGNFDENQVKQTINVAALCVQSEPEKRPNMKQVVNLLKGYEFEEKKVTAMRIDSIKYNEELLALDQPSDDDDHDDATASYGVFSAIEVQKMKDPYMRGDNKNIG

SEQ ID NO: 173828 - protein, 330 aa, Glycine max
  Coding DNA Sequence Number=SeqID_57050
  Gene Ontology: Mol. function=peroxidase activity; Cellular component =vacuole; Biological process=response to oxidative stress
  Homolog annotation: Hit_ID=Q1SWB6; Match level="QueryCoverage=95%, HitCoverage=95%, E-value=1e-142, Identity=79%"; Hit description=Haem peroxidase, plant/fungal/bacterial
  Pfam annotation: Domain name=peroxidase; Domain location=50-294; Score=419.9; E_value=3.6e-123; Accession=PF00141.13; Description =Peroxidase
MQLVILCLLILKLTPAFATTLNDAYGDDSSGCPLGTDIYQYTCPEAEAIIFSWVEQAVSHDSRMAASLLRLHFHDCFGCDGSVLLDDTQDFVGEKTAGPNLNSLRGFEVIDQIKSELELVCPQTVSCADILATAARDSVLLSGGPIWEVQMGRKDGITASKNAANNNIPGPNSTVDVLVAKFENVGLTLKDMVALSGAHTIGKARCRTFSSRFQTSSNSESANANIEFIASLQQLCSGPDNSNTVAHLDLATPATFDNQYFVNLLSGEGLLPSDQALVNGNDQTRQIVETYVENPLAFFEDFKLSMLKMGSLASPTQTSGQIRRNCRTIN

SEQ ID NO: 173829 - protein, 125 aa, Glycine max
  Coding DNA Sequence Number=SeqID_57051
MKATKELSEQVEENEVKVLVEEDDEEYESVDEVVDDAEDDEDEEEDDDDDEGDDNDDEEDDAPDGGDDDDDEDDEEEGDVQRGGEPDDDDNDSDDDSDDDEDEDEEDEEEQGEEVVISDFLFQNP

SEQ ID NO: 173830 - protein, 291 aa, Glycine max
  Coding DNA Sequence Number=SeqID_57052
  Gene Ontology: Mol. function=protein serine/threonine kinase activity; Cellular component=cytoplasm; Biological process=protein amino acid phosphorylation
  Homolog annotation: Hit_ID=Q1SZH0; Match level="QueryCoverage=99%, HitCoverage=50%, E-value=1e-158, Identity=91%"; Hit description =Protein kinase; UspA
  Pfam annotation: Domain name=Pkinase; Domain location=2-264; Score =102.3; E_value=1.4e-27; Accession=PF00069.15; Description=Protein kinase domain
  Pfam annotation: Domain name=Pkinase_Tyr; Domain location=1-264; Score=82.7; E_value=1.1e-21; Accession=PF07714.7; Description =Protein tyrosine kinase
  Pfam module annotation: Pfam domain module=Pkinase::Pkinase_Tyr; Domain location=2-264::1-264
NLVGRGGYSEVYKGDLSDGRTIAVKRLAKDNKDPNKEKEFLMELGVIGHVCHPNTATLVGCCIENGLYLIFNYSQNGNLATALHGKAGDPLDWPIRYKIAIGVARGLHYLHKCCKHRIIHRDIKASNVLLGPDYEPQITDFGLAKWLPNKWTHHAVIPVEGTFGYLAPEYFMHGIVDEKTDVFAFGILLLEIVTGRRPVDSSKQNLLLWAKPLMESGNIAELADPRLEGKYDGEQLYRVVLTASYCVRQTATWRPPMSEVLELLTSGQESEVGKSWRIPKFTSDELDDYSM

SEQ ID NO: 173831 - protein, 426 aa, Glycine max
  Coding DNA Sequence Number=SeqID_57053
  Gene Ontology: Mol. function=nucleotide binding; Cellular component =membrane; Biological process=small GTPase mediated signal transduction
  Homolog annotation: Hit_ID=Q10MD7; Match level="QueryCoverage=85%, HitCoverage=85%, E-value=1e-126, Identity=65%"; Hit description=XPA -binding protein 1, putative, expressed
  Pfam annotation: Domain name=ATP_bind_1; Domain location=65-305; Score=353.5; E_value=3.5e-103; Accession=PF03029.7; Description =Conserved hypothetical ATP binding prot
  Pfam annotation: Domain name=MMR_HSR1; Domain location=61-233; Score=- 10.9; E_value=0.0098; Accession=PF01926.13; Description=GTPase of unknown function
  Pfam module annotation: Pfam domain module=ATP_bind_1::MMR_HSR1; Domain location=65-305::61-233
MDAGNGSGDAKLDNTPTQMDSDSGAQAKDKEKEELTENMNKLHIEGSSSGSGSSNIRRKPVIILVVGMAGSGKTTLMHRLVCHTHLKDIRGYVMNLDPAVMTLPYAANIDVRDTVKYKEVMKQFNLGPNGGILTSLNLFATKFDEVISVIEKRADQLDYVLVDTPGQIEIFTWSASGAIITEAFASTFPTVVAYVVDTPRSEDPTTFMSNMLYACSILYKTRLPLILTFNKVDVAAHQFALEWMEDFEAFQTAASSDQSYTSTLTQSLSLVLDEFYNNLKSVGVSAVSGVGMEAFFNAVEASAEEYMETYNMYSRVFEMTNQITSLYRGLSRADLDKRREEKQRLEEDRRRESMDKLRRDMEKSGGETVVLSTGLKNKEASKSMMDEEDEEGEDEEMDDDDDLGIYTEEEDAIDEDEDEEIDRFGF

SEQ ID NO: 173832 - protein, 135 aa, Glycine max
  Coding DNA Sequence Number=SeqID_57054
  Gene Ontology: Mol. function=nucleic acid binding; Cellular component= ribonucleoprotein complex; Biological process=multicellular organismal development
  Homolog annotation: Hit_ID=Q531A8; Match level="QueryCoverage=66%, HitCoverage=12%, E-value=1e-44, Identity=96%"; Hit description=FCA gamma
MVSNSDWRCEIAVYLLNKKVVIDLCLSYIDEFYCGCSCCFIKYATSEEADQAIRALHNQHTLPGGVGPIQVRYADGERERLGAVEYKLFVGSLNKQATVKEVEEIFSKYGRVEDVYLMRDEKKQSRGMFPTYMGY

SEQ ID NO: 173833 - protein, 78 aa, Glycine max
  Coding DNA Sequence Number=SeqID_57055
MDHTQSVKGAWIWLGIWKTGWLGEVSHLSGDRHVAVSDLRVEGNSIYCKRGPVVGPSGRAYLTGNRFGCEQGECTRGL

SEQ ID NO: 173834 - protein, 460 aa, Glycine max
  Coding DNA Sequence Number=SeqID_57056
  Gene Ontology: Mol. function=nucleic acid binding; Cellular component= intracellular; Biological process=DNA integration
  Homolog annotation: Hit_ID=Q1S7C5; Match level="QueryCoverage=82%, HitCoverage=33%, E-value=6e-98, Identity=46%"; Hit description =Integrase, catalytic region
  Pfam annotation: Domain name=rve; Domain location=15-176; Score =102.1; E_value=1.7e-27; Accession=PF00665.16; Description=Integrase core domain
  Pfam module annotation: Pfam domain module=RVT_2::rve; Domain location=303-460::15-176
MGKACQFPFFTSQSIYASPLDLVFTDIWGLTPLTSSNGSRYYIIFVDAFFRYTWMYLLQNTSQAFTVFLQFKSLAEKQLGTTLKALQFDNAKEYLTFTPYLTEQGIHHRLTCSYTHEENGTPERKHRHLTETGLTLLASTSLPSNFWGESFNIAAIIINYFPSPALNNISPFEFSFHKNPDYKFLRVFGCGCYPMLRPYNKHKLDFRSHMCLFIGYSSQYKGYKCLSPSGKCYISRHVIFHESVFPYKLPGFVPQNTHPMTTRAKVGVFKLKTYASYKEGSYDHTVEPHIVKEAMAKPEWLKAMKEEHDALIRNDIWPLVDPPPGCKPIGCKWVFKSKFNVDGSFQRHKARLVAKRYHQREGFGFKETFSLVIKPSMIRTVLSLVASQHWPIHQVDINNAFLHGDLQETVYMTQPPGFVSSDKHKVCKLLKALYGLKQAPRSWFHKLSLTLRSLEFNSAK

SEQ ID NO: 173835 - protein, 391 aa, Glycine max
  Coding DNA Sequence Number=SeqID_57057
  Gene Ontology: Mol. function=sequence-specific DNA binding; Cellular component=nucleus; Biological process=regulation of transcription
  Homolog annotation: Hit_ID=Q1RTZ7; Match level="QueryCoverage=49%, HitCoverage=56%, E-value=2e-40, Identity=49%"; Hit description=DNA -binding WRKY
  Pfam annotation: Domain name=WRKY; Domain location=209-268; Score =149.9; E_value=6.9e-42; Accession=PF03106.6; Description=WRKY DNA -binding domain
  Subcellular localization annotation: CTP_CleavageSite=76; ConfidenceScore=5.04e-01
MEEKREKEGNSKSSSTMANSVAFSDEIPNMSMSTSFPFSPAFSSIFDMMPPPPPSSSHDPKAPNNFAGFMDLLAVPADYYAPSLFDWPQNTTATSAPPPLTAQINHPLPSPASSNVPDGSEVLNTPASPNYSSISSSSNEAAAAAAANKATGNDNDVDDETTIDAAAGRGEEDQDQDKTKKQLKPKKKNQKKQREPRFAFMTKSEVDHLDDGYRWRKYGQKAVKNSPHPRSYYRCTTATCGVKKRVERSSEDPTVVVTTYEGQHTHPCPATSRASLGFMHSEASGGFGPTSGLGSAHFMLPQQQQFRDQAQAAMLLYNSNSSSLSLPLNVVNSASCVNNSYPNTSSLSGFLQGQENHQRSVLAPHAFLRDNGLLQDIVPTHMRNEESEDRV

SEQ ID NO: 173836 - protein, 584 aa, Glycine max
  Coding DNA Sequence Number=SeqID_57058
  Gene Ontology: Mol. function=nucleic acid binding; Biological process= multicellular organismal development
  Homolog annotation: Hit_ID=Q1SWB7; Match level="QueryCoverage=89%, HitCoverage=65%, E-value=1e-125, Identity=50%"; Hit description =WW/Rsp5/WWP; Paraneoplastic encephalomyelitis antigen
  Pfam annotation: Domain name=WW; Domain location=393-422; Score=49.1; E_value=1.5e-11; Accession=PF00397.16; Description=WW domain
MALAAINALNGIYTMRGCEQPLIVRFADPKRPRQGDSRGLAFGGPGFGPRFDAPGTRHPSNITDPMGDRMPPSNAWHPLHPPNMGPSSNAGFHGMGSPLLPRSGDMALPTDAPLQLEGKAAYIYPFETPQGGSNLVTWRSQGGPMTSLGGPIDGRFQVQSIPMSQQNFNQPMPQIPPVNQQISPLQKPVQSSQELPPSHQLYPQAPVPYPQTSLRQHGQPQLSLSAGPLPSQKIHGVSGQFLTSQPQTQQSALSAAIPQTHLDTGMQSHTTLTTPNQQQVPPSVQQQQPLQQSPSPLAQMLSQQTQTLQASFHSSQQAFSQLQQQLQMMQPSSQALTLQQNAEANKKQSQWAGPGPVAQTVASTLAAAPAADVPSSTPANSALPAINQNMALVKCNWTEHISPEGFKYYYNSVTGESRWEKPEELTLHEQQKQQQRPSVQQSQTQSQPSILPAQQVPQIQQVQPQSHLQGQVLHQQQIQQPSLSSLFQAYGVTGPQNVQEVGYKQLQASVISAGDPGRYSQVGNHRFILIPCDPVTIYLHWRVILVLVVEVSLSLTGSALRICGIQNTWQGNALPRSSCTIIFA

SEQ ID NO: 173837 - protein, 309 aa, Glycine max
  Coding DNA Sequence Number=SeqID_57059
  Gene Ontology: Mol. function=nucleic acid binding; Cellular component= chromatin; Biological process=DNA integration
  Homolog annotation: Hit_ID=Q1SRN1; Match level="QueryCoverage=50%, HitCoverage=11%, E-value=9e-19, Identity=29%"; Hit description =Integrase, catalytic region
  Pfam annotation: Domain name=zf-CCHC; Domain location=234-251; Score =23.2; E_value=0.00015; Accession=PF00098.13; Description=Zinc knuckle
MQQVLATIRGLKLSKYLHEEHVLKKFESKEYEEVGMISEAFLNFKQQDQLLVSWLIASMLAPILTKMVGLEQSWQIWKRLEVYYASQTRAKKIVDSLAAIGFAISNDDHIEAILDGLPEDYDSFVTSITSHLDPYTVDDIEALQLAQEERFEKHKKAYSNLILANTAYGPSYSSGRGRGDNSNFRGEYNNRSGRSNFRGGYNSNRGGRYNNGRGNDRSNWGQNSNNSWNQNNRPQCQICGKPGHLAIDCWYRFNYNFQGPSQANHNQYQRFSQSDQAFMSTPTTVMDPLWYPDSRASHHITNDESNFSV

SEQ ID NO: 173838 - protein, 111 aa, Glycine max
  Coding DNA Sequence Number=SeqID_57060
  Homolog annotation: Hit_ID=Q8GU61; Match level="QueryCoverage=56%, HitCoverage=4%, E-value=2e-10, Identity=64%"; Hit description=MRP -like ABC transporter
  Subcellular localization annotation: CTP_CleavageSite=37; ConfidenceScore=5.01e-01
MTFSGAHKAALSLIKSLERRPTFKTSTTTKEDTSSVSCFELDKNVVRSNDTSDDIVKPKGKLVQEEEWEKGRVGFNVYWKYITTAYGGALVPIYYFQRYSLWLFRLLAIIG

SEQ ID NO: 173839 - protein, 80 aa, Glycine max
  Coding DNA Sequence Number=SeqID_57061
MVIKLQLMPKGVLALWRSKSQEDERRLLESHVWGVITPAIIFAVNPASSPPSSFCLCRYHFFNKSIKAILEEKKNSVYLD

SEQ ID NO: 173840 - protein, 247 aa, Glycine max
  Coding DNA Sequence Number=SeqID_57062
  Gene Ontology: Mol. function=1-deoxy-D-xylulose-5-phosphate synthase activity; Biological process=terpenoid biosynthetic process
  Homolog annotation: Hit_ID=Q5MJZ4; Match level="QueryCoverage=89%, HitCoverage=32%, E-value=3e-80, Identity=63%"; Hit description=1 -deoxy-D-xylulose-5-phosphate synthase
  Pfam annotation: Domain name=Transket_pyr; Domain location=2-104; Score=-32.3; E_value=0.00036; Accession=PF02779.14; Description =Transketolase, pyrimidine binding dom
  Pfam annotation: Domain name=Transketolase_C; Domain location=102 -225; Score=151.3; E_value=2.5e-42; Accession=PF02780.10; Description= Transketolase, C-terminal domain
  Pfam module annotation: Pfam domain module=Transket_pyr::Transketolase _C; Domain location=2-104::102-225
MVEIICGIHNSPLTLWLCAWCMQVAHDVDLQKLPVRFALDAAGLVGADGPTHCGAFDTTFMACLPNMVVMAPSDETELMHMIATAAAIDDRPSCFRYPRGNGIGRILKEGSRVALVGYGTMIQSCMEVAKVLEAHGISTTVADARFCKPLDGDLMTRLAREHEILITVEEGSIGGFGSHVSHFLGLNGLLDGNLKWLALTLPDRYINHGSQTDQIEMAGLSSNHIAVTALSLTNVHWDSRLLLSLQK

SEQ ID NO: 173841 - protein, 115 aa, Glycine max
  Coding DNA Sequence Number=SeqID_57063
MVRERSREVGSVQRIVVLPALSRPRTRIRASLLPKREENNLVNTNPIFRFGTGTLAVQLQLAHKSVTRVSFLNENAIGSQSRAEQSRVVEANEEKGYIPVVEAPKIDTEFAYELK

SEQ ID NO: 173842 - protein, 96 aa, Glycine max
  Coding DNA Sequence Number=SeqID_57064
  Gene Ontology: Mol. function=identical protein binding; Cellular component=Golgi-associated vesicle; Biological process=small GTPase mediated signal transduction
  Homolog annotation: Hit_ID=P40940; Match level="QueryCoverage=38%, HitCoverage=20%, E-value=4e-14, Identity=100%"; Hit description=ADP -ribosylation factor 3
  Pfam annotation: Domain name=Arf; Domain location=1-91; Score=-87.1; E_value=0.0048; Accession=PF00025.11; Description=ADP-ribosylation factor family
MGEVVSTIPTIGFNVETVQYNNIKFQVWDLGGQTSIRTDYETIGGGIEILSSDWKHPVGERKTQHSCGAHLVLPVNGEAPDSRRSYRVDTFEAQAL

SEQ ID NO: 173843 - protein, 489 aa, Glycine max
  Coding DNA Sequence Number=SeqID_57065
  Gene Ontology: Mol. function=transferase activity, transferring glycosyl groups; Cellular component=cytoplasm; Biological process =metabolic process
  Homolog annotation: Hit_ID=Q2PGW4; Match level="QueryCoverage=89%, HitCoverage=95%, E-value=1e-124, Identity=51%"; Hit description=UDP -glucose: flavonol 3-O-glucosyltransferase
  Pfam annotation: Domain name=UDPGT; Domain location=11-452; Score =57.4; E_value=4.8e-14; Accession=PF00201.9; Description=UDP -glucoronosyl and UDP-glucosyl transferase
  Subcellular localization annotation: CTP_CleavageSite=33; ConfidenceScore=5.15e-01
MTVCPTDDRHVAVLAFPYGTHAAPLLNLVRRVAAEAPQVTFSFFSTKRSNASVFAGLNEEQLFNIKPYEVDDGLPENYVPSKNPKDAVEFFVKSMPMNYMTSMDEAVAKTGRHITCLVSDAFFWFCADLADEMHAKWVPLWTAGPHPLLAHISSKHIREKLGPEGVRENKEIDFLTGFSGLKASDLPGGLTEEPEDPISMMLEKMGEALPRATAVAINSFATVHLPIAHELESRFHKLLNVGPFILTTPQTVPPDEEGCLPWLNKQEDRSVVYLSFGSSIMPPPHELAAIAEALEEGKYPFIWAFRGNPEKELPQGFLERTNTQGKVVGWAPQMLILRHSAVGVCMTHGGWNSVLDCIVGGVPMISRPFFGDQMLNTATMEHVWEIGVGLENGIFTKEETLRALELIMSSEKGKMMRQKMDELKDFAMAAAGHEGDSTKNFCTFSEIVTGSTYEQLHVQQHGFRGIRNKIAGAFAAAHSRFTRRNNPKH

SEQ ID NO: 173844 - protein, 182 aa, Glycine max
  Coding DNA Sequence Number=SeqID_57066
  Gene Ontology: Mol. function=electron carrier activity; Cellular component=extracellular region; Biological process=response to biotic stimulus
  Homolog annotation: Hit_ID=Q40374; Match level="QueryCoverage=75%, HitCoverage=80%, E-value=3e-73, Identity=84%"; Hit description =Pathogenesis-related protein PR-1 precursor
  Pfam annotation: Domain name=SCP; Domain location=51-170; Score=87.3; E_value=4.7e-23; Accession=PF00188.16; Description=SCP-like extracellular protein
  Subcellular localization annotation: CTP_CleavageSite=53; ConfidenceScore=5.39e-01
MDATKAKTVDNAGTLTLPPPLYITSHVATTYATVVPTTTQKPPRSFANQFLIPQNAARAVLRLRPLVWDSKLAHYAQWYANQRRNDCALEHSNGPYGENIFWGSGTGWKPAQAVSAWVEERQWYNYWHNSCANGQMCGHYTQIVWSTTRKIGCASVVCSGGKGTFMTCNYDPPGNYYGERPY

SEQ ID NO: 173845 - protein, 111 aa, Glycine max
  Coding DNA Sequence Number=SeqID_57067
  Gene Ontology: Mol. function=unfolded protein binding; Cellular component=prefoldin complex; Biological process=protein folding
  Homolog annotation: Hit_ID=P57741; Match level="QueryCoverage=56%, HitCoverage=42%, E-value=4e-13, Identity=56%"; Hit description =Probable prefoldin subunit 3
MTTTTKPFPIAKARKFRVKITASIMSVALTADFEVSEEKYSQARIEETDSVCLWLGAIVMLEYSLEEVLPYIQFWRDQVTITQVTSRCYNCSKTGKQKSIPASKVRSFNTC

SEQ ID NO: 173846 - protein, 362 aa, Glycine max
  Coding DNA Sequence Number=SeqID_57068
  Gene Ontology: Mol. function=DNA binding; Cellular component=nucleus; Biological process=regulation of transcription
  Homolog annotation: Hit_ID=Q0PJD1; Match level="QueryCoverage=56%, HitCoverage=98%, E-value=1e-102, Identity=87%"; Hit description=MYB transcription factor MYB71
  Pfam annotation: Domain name=Myb_DNA-bind_2; Domain location=16-70; Score=-5.9; E_value=0.045; Accession=PF08914.1; Description=Rap1 Myb domain
  Pfam annotation: Domain name=Myb_DNA-binding; Domain location=14-62; Score=47.1; E_value=6e-11; Accession=PF00249.21; Description=Myb -like DNA-binding domain
  Pfam annotation: Domain name=Myb_DNA-binding; Domain location=68-113; Score=40.2; E_value=7.3e-09; Accession=PF00249.21; Description=Myb -like DNA-binding domain
  Pfam module annotation: Pfam domain module=Myb_DNA-bind_2::Myb_DNA -binding::Myb_DNA-binding; Domain location=16-70::14-62::68-113
MGRAPCCDKANVKKGPWSPEEDAALKAYIEKNGTGGNWIALPQKIGLKRCGKSCRLRWLNYLRPNIKHGGFTEEEDNIICSLYISIGSRWSIIAAQLPGRTDNDIKNYWNTRLKKKLLGRRKQSNLSAKDTNNGIEENSYSNALSSSALERLQLHMQLQSLQNPFSFYNNPALWPKLHPFQEKMIQSLQSLNDGSSPVMQNALPNSPHVEQGQKDEFCKPQHDGAKINNPQVHLLENIPLSNGGVPFVASGSSKNPMHSSLAPRSEAIHEQTNSVGFQQLGALQTELDDILNNRIMGYVPHEDHDMAGFDCFREMNSSKDSLIWWSNDSDTKSVSSNSWDSSATPALLPQGMFQDYELGYSL

SEQ ID NO: 173847 - protein, 106 aa, Glycine max
  Coding DNA Sequence Number=SeqID_57069
MAFLGETSSQTIVNSRLAFIYPNGSIIHNDTGVYFQTSTPVPIRVPNRCDFASLKTRIHNTLQLSDKQFLDEIHYRKPFTDTEILVVFTKYVVKIEDEVTRTSLNN

SEQ ID NO: 173848 - protein, 68 aa, Glycine max
  Coding DNA Sequence Number=SeqID_57070
  Subcellular localization annotation: CTP_CleavageSite=33; ConfidenceScore=5.08e-01
MRLQNLGSEFATLHLVPPSGLARTTAAFSALISRAKRGVLIPSVRFFCHAKRDEAVLRGGCALSPLKI

SEQ ID NO: 173849 - protein, 327 aa, Glycine max
  Coding DNA Sequence Number=SeqID_57071
  Homolog annotation: Hit_ID=Q0XL01; Match level="QueryCoverage=37%, HitCoverage=73%, E-value=1e-14, Identity=40%"; Hit description =Hypothetical protein precursor
STLEDPTAGCAAVRAVHQPVADPRVRPLRRDLALHRGGITFVIVTGNHVQGVALVDALHVRGLFGVGVFVDRGHRPGLGEALRIDTVQVDEDALLALGDVHIGMGDGTAEQGDWRGFRLERAARLPGQAGCLQGIDGLGFAEVRTCLAGQQGLQRCGAGGGDGRRGCVGSRARGQSGHDHGERGIGCATKAQRPCRAAAPCHQLLAAFTASAASTMPGPQPPGQFAAAIGRAVRRRMSLTWSVVLGTGATACISATMPATCGAAIEVPDMKSKALLPTVDRMPCAGCWRVGAQLVWFGGVASGRNSPTDARQDQVSPPGAVMWMPAP

SEQ ID NO: 173850 - protein, 40 aa, Glycine max
  Coding DNA Sequence Number=SeqID_57072
MARKLCYLSPSIKNPESERTLEDGKGDPLRHFLYNSERYI

SEQ ID NO: 173851 - protein, 90 aa, Glycine max
  Coding DNA Sequence Number=SeqID_57073
MAKIARNSWGRIYIGHLQQSSRWEMHIPKEQVGRYAYQSASTKFQKTGRMKHQGTWNKLAMMFQEADVSWKPEDTSGSIIWSCPAGNKLV

SEQ ID NO: 173852 - protein, 439 aa, Glycine max
  Coding DNA Sequence Number=SeqID_57074
  Gene Ontology: Mol. function=DNA-dependent ATPase activity; Cellular component=nucleus; Biological process=DNA replication initiation
  Homolog annotation: Hit_ID=Q8H0G9; Match level="QueryCoverage=83%, HitCoverage=49%, E-value=1e-138, Identity=72%"; Hit description=MCM protein-like protein
  Pfam annotation: Domain name=MCM; Domain location=47-335; Score =261.9; E_value=1.3e-75; Accession=PF00493.13; Description=MCM235 family
MEDPRAAETELDARDELDYIACPVPSDDDLDGMQTSPGRSQQGHKDDVPMTIETENDGDDVLVEDYQVYFAPSIYGQKDIKTAIALAMFGGQEKDGEGKHRLRGDINILLLSDPGTAKSQFLKAVYTTGKGASAVGLTAAVHKYLVTREWTLDGGTLIVLTAAVRGICLIDELDKMNDQDRHSVRLLWLQILWWKDVVDPVTDEMLATFVVDSHFESQPKGANQDDKSFSKSQDVHASAMPADPEILPQQLLKKYIIYAKLNIFPRLQDADMDKLSHVYAELWRESSHGQGVSISVRHIESMIRMSEAHARMHLRQHVTQEDVGMAIRVLLESFISTQKFGVQKALQKSFRQYMTFKKDYNDLLLFILSNLVQNALHFEEIITGSVAVLTHIDVRVDDLYNKAQEHDIYDLTTFFNSSQFSRAYFVLVEERRVIRHHLA

SEQ ID NO: 173853 - protein, 779 aa, Glycine max
  Coding DNA Sequence Number=SeqID_57075
  Gene Ontology: Mol. function=RNA-directed DNA polymerase activity; Cellular component=extracellular region; Biological process=RNA -dependent DNA replication
  Pfam annotation: Domain name=RnaseH; Domain location=636-747; Score= -11.4; E_value=0.00066; Accession=PF00075.14; Description=RNase H
MAGDMNEILNATEVDGGNFIASKSNLFRNVVDSCDFIDVQASTVSTRLSGVITLESNSDHNPLLISCHKAKRKKYKSFRFQATWISHPDYATLVSNAWHRTVGNRKHIIEARLKGIHRQLDYCFLSDLPITLTDVKDAFSSMNQYKAPGPDGFQPIFYQTYWDNIGGEVAEFIAQVFTTGNIPPGLTETRIVPIPMVDSPLSLKDFRPISLWHNALIAQEVVRHMHKKQGKSGIMMLKIDFEKAYHCVDWKFLQLTLHEFGFPESIVKLIMNYDCLLLAQAKPSQARVIRKVLDDFCQASGLRINFQKSSQHSHWVTRETVTKPMTQRGLGVRTARNTNTSLLGKHYKRCSYTWLSITKAAELLEPGFRFRVGTGDMPVWYDRWNPNGFLCDMVDYVNIQDFNLTLKDVYENGMWLWNNMATIIPSQVPQEFNSLFLNSTIADTVIWSAAQNHVFMAKTAYWWLQSQANVSLGAQAENNSWMWLMKIPQNIKFFLWLTSHKSLPTKFFLVYRHLSSNPFCCRCSNQVESVLHLLRDCDKACSVWSMFQPTLVVDFAEHDSSVWLHKHATCATGALFCLICWFIWRDRNAMTFSNENWQEWFIASQVNNMLNIISNQQECQPRNRYTVQVAWKPPPPTVLKLNTDGSSLVNPGQSGFGGVIRDSQRDWIIGYTGVELAWFRGYSNIICETDSKLTLDLISGEITTCHPYAALLTCMRSYKGQNWSISFALTFREGNHVADWMAKKGASSEEPLQLWDSCPPTLDTILFSDAIGITVPRLV

SEQ ID NO: 173854 - protein, 873 aa, Glycine max
  Coding DNA Sequence Number=SeqID_57076
  Gene Ontology: Mol. function=DNA-dependent ATPase activity; Cellular component=nucleus; Biological process=DNA replication initiation
  Homolog annotation: Hit_ID=Q8H0G9; Match level="QueryCoverage=91%, HitCoverage=99%, E-value=0.0, Identity=70%"; Hit description=MCM protein-like protein
  Pfam annotation: Domain name=AAA_3; Domain location=482-623; Score= -7.5; E_value=0.0021; Accession=PF07726.2; Description=ATPase family associated with various
  Pfam annotation: Domain name=AAA_5; Domain location=482-629; Score =11.4; E_value=0.00024; Accession=PF07728.4; Description=ATPase family associated with various
  Pfam annotation: Domain name=MCM; Domain location=424-768; Score =732.3; E_value=3.2e-217; Accession=PF00493.13; Description=MCM235 family
  Pfam annotation: Domain name=Mg_chelatase; Domain location=448-635; Score=-132.7; E_value=0.00096; Accession=PF01078.11; Description =Magnesium chelatase, subunit ChlI
  Pfam module annotation: Pfam domain module=AAA_3::AAA_5::MCM::Mg _chelatase; Domain location=482-623::482-629::424-768::448-635
MASDPESPTSPSVGFNTDQLPHTHTSRASEDDEASVDPDIVRDEIEEQPEEEEDGEDLYNDNFLDDYKRMDEADQFESFGLDDSLEDDRDFDQIMQDRRAAEIELEARDGRASNRNKLPQLLHDQDTDDDNHRSSKRARADFRPSAASDDDLDGMQSSPGRSQRGHPREDVLMTDQTEDDRDDDDFDDGYEMYHVQGTLREWVTRDEVRRFIARKFKDFLLTYVNPKNEHRDKEYVWLINEMVSASKCSLEIDYKQFIYVHPNIAIWLADAPQSVLEADPLEYNDPNWGSSNQTFWSFPPVAAGENSYSEVKVGSCPECQSKGPFTVNIEQTIYRNFQKLTLQESPGIVPAGRLPRYKEVILLNDLIDCARPGEEIEVTGVYTNNFDLSLNTKNGFPVFATVVEANYVTKKQDLFSAYKLTQEDIEEIENLAKDPRIGERIVKSIAPSIYGHDDIKTAIALAIFGGQEKNVEGKHRLRGDINVLLLGDPGTAKSQFLKYVEKTGQRAVYTTGKGASAVGLTAAVHKDPVTREWTLEGGALVLADRGICLIDEFDKMNDQDRVSIHEAMEQQSISISKAGIVTSLQARCSVIAAANPVGGRYDSSKTFSQNVELTDPIISRFDILCVVKDVVDPVTDEMLATFVVDSHFKSQPKGANQDDKSFSESQDVHASAMPADPEILPQQLLKKYITYAKLNIFPRLQDADMDKLSHVYAELRRESSHGQGVPIAVRHIESMIRMSEAHARMHLRQHVTQEDVDMAIRVLLESFISTQKFGVQKALQKSFRKYMTFKKDYNELLLYILRELVKNALHFEEIVTGSASGLTHIDVKVDDLYNKAQEHDIYDLKPFFNSSHFSRANFVLDEERRVIRHHLTR

SEQ ID NO: 173855 - protein, 1163 aa, Glycine max
  Coding DNA Sequence Number=SeqID_57077
  Gene Ontology: Mol. function=transmembrane receptor activity; Cellular component=membrane; Biological process=defense response
  Homolog annotation: Hit_ID=Q1T1A2; Match level="QueryCoverage=73%, HitCoverage=98%, E-value=0.0, Identity=56%"; Hit description=TIR; Disease resistance protein; AAA ATPase
  Pfam annotation: Domain name=LRR_1; Domain location=550-570; Score =0.2; E_value=2.6e+02; Accession=PF00560.23; Description=Leucine Rich Repeat
  Pfam annotation: Domain name=LRR_1; Domain location=619-640; Score =2.1; E_value=1.2e+02; Accession=PF00560.23; Description=Leucine Rich Repeat
  Pfam annotation: Domain name=LRR_1; Domain location=665-687; Score =6.0; E_value=22; Accession=PF00560.23; Description=Leucine Rich Repeat
  Pfam annotation: Domain name=LRR_1; Domain location=689-708; Score =10.1; E_value=3.6; Accession=PF00560.23; Description=Leucine Rich Repeat
  Pfam annotation: Domain name=LRR_1; Domain location=712-733; Score =8.6; E_value=6.9; Accession=PF00560.23; Description=Leucine Rich Repeat
  Pfam annotation: Domain name=LRR_1; Domain location=785-807; Score =5.6; E_value=26; Accession=PF00560.23; Description=Leucine Rich Repeat
  Pfam annotation: Domain name=LRR_1; Domain location=809-830; Score =6.1; E_value=21; Accession=PF00560.23; Description=Leucine Rich Repeat
  Pfam annotation: Domain name=LRR_1; Domain location=832-853; Score =5.8; E_value=24; Accession=PF00560.23; Description=Leucine Rich Repeat
  Pfam annotation: Domain name=LRR_3; Domain location=619-638; Score =39.1; E_value=1.5e-08; Accession=PF07725.3; Description=Leucine Rich Repeat
  Pfam annotation: Domain name=NACHT; Domain location=221-374; Score= -13.7; E_value=0.00067; Accession=PF05729.3; Description=NACHT domain
  Pfam annotation: Domain name=NB-ARC; Domain location=191-475; Score =131.5; E_value=2.3e-36; Accession=PF00931.13; Description=NB-ARC domain
  Pfam annotation: Domain name=TIR; Domain location=25-158; Score =140.6; E_value=4.1e-39; Accession=PF01582.10; Description=TIR domain
  Pfam module annotation: Pfam domain module=LRR_1::LRR_1::LRR_1::LRR _1::LRR_1::LRR_1::LRR_1::LRR_1::LRR_3::NACHT::NB-ARC::TIR; Domain location=550-570::619-640::665-687::689-708::712-733::785-807::809 -830::832-853::...
  Pfam module annotation: Domain location=619-638::221-374::191-475::25- 158
MASTCSYVVGCASSSSLSVTKKYDAFITFRGDDTRSDFASHLHAALRRNNVDTYIDYRIEKGAKIWLEIERAIKDSTLFLVIFSENYASSSWCLNELLQLMQCKKQEENVHVIPVFYKIDPSQVRKQSENYHVAFAKHKKDGKVSEEKMQKWKDALSEAANLSGFHSNTYRTEPDLIEDIIKVVLQKLDHKYPNDFRGPFISNENYTNIESFLNINSKEVRIIGIWGMGGIGKTTLAAAIFHKVSSHYEGTCFLENVAEESKRHDLNYVCNKLLSQLLREDLHIDTLKVIPSIVTRKLKRKKVFIVLDDVNTSELLEKLVGVGREWLGSGSRIIVTTRDKHVLIREVVDKIHEVKKMNFQNSLELFSLNAFGKTYPEKGYEELSKRAMDYAKGIPLALKVLGSFLRSRSENEWHSALSKLKKSPNVKIQAVLRLSYAGLDDDEKNIFLDIACFLKGQSRDHVTKILNDCDFSADIGIRSLLDKALITTTYSNCIDMHDLIQEMGREVVREESVKFPGQRSRLWDPVEIYDVLTNNRGTAAVEGIWLDMTQITHINLSSKVFRKMPNLRLLTFKSHNGDSERINSVYLPKGLEFLPKNLRYLGWNGYPLESLPSRFFPEKLVELSMPYSNVEKLWQGVQNLPNLERIELCGSKHLVECPRLSHAPNLKYVSMRDCESLPHVDPSIFSLPKLEILNLSGCTSLESLSSNTWPQSLQVLFLAHSGLNELPPSILHIRNLHMFSFLINYGLADLPENFTDQISLSDSRKHECNAFFTLQKLMPSSGFQSVTRLAFYDCHNLCEIPDSISLLSSLKCLSFRYSAIISLPESFKYLPRLKLLEIGKCEMLRHIPALPRSIQLFYVWNCQSLQTVLSSSAESSKRPNCTFLVPNCIKLDEHSYDAILKDAIARIELGSKSLSAVVLENEEDASSDNEGTDFYFFKLARNGTICYCLPARSGKVRDWFHCNFTQSLVTIELPPNLLCFIFYMVVSQVQSCNIGCYGSIGCECYLETSWDERIKIPSFFVEENILSSLDPQFGFMADHIFLWYDAQCCKQIMEVIKERKAINDKSTTHPPKLTFKFFAQTEDNNEAVVIKECGFRWMFSLEERECKFKRSREIHEVEANVFRNQVKDSESNEQEETFPPTKKIKQGVFRTSNLEAEEKEDLR

SEQ ID NO: 173856 - protein, 267 aa, Glycine max
  Coding DNA Sequence Number=SeqID_57078
  Gene Ontology: Mol. function=DNA binding; Cellular component=nucleus; Biological process=multicellular organismal development
  Homolog annotation: Hit_ID=Q6H976; Match level="QueryCoverage=52%, HitCoverage=18%, E-value=1e-32, Identity=46%"; Hit description =STYLOSA protein
  Pfam annotation: Domain name=SSDP; Domain location=11-211; Score= -54.4; E_value=5.5e-05; Accession=PF04503.4; Description=Single -stranded DNA binding protein, SSDP
MFERILLLYIARANQKHPEAAVSYSKSQQIKAQLLQKQQEQELQNTNQNQQIQLLLQRHAQKQQCLRGARLISGSASCPISNDPLMRQNGATSNAMATKTYEDRLKLSLQKDALDDASIKQKVADDVGHLLNPNHALLLKAATAIGSTQDIKSDMNGMMRSQAVVSERSFIGFHGSNQGGSNLAPKGWPLAGLDELRSGFLQPNNGMHSSQSFNQLSLQQQLMLQELQNLIFRSASYFESWNIFLIPINDQRLRNNNLIPIQRFPEA

SEQ ID NO: 173857 - protein, 546 aa, Glycine max
  Coding DNA Sequence Number=SeqID_57079
  Homolog annotation: Hit_ID=Q2QYU1; Match level="QueryCoverage=98%, HitCoverage=91%, E-value=1e-118, Identity=47%"; Hit description =Nodulin-like family protein, expressed
  Pfam annotation: Domain name=MFS_1; Domain location=75-517; Score= -13.2; E_value=0.0013; Accession=PF07690.6; Description=Major Facilitator Superfamily
  Pfam annotation: Domain name=Nodulin-like; Domain location=7-284; Score=265.9; E_value=8.2e-77; Accession=PF06813.4; Description =Nodulin-like
  Pfam annotation: Domain name=PUCC; Domain location=200-536; Score= -232.6; E_value=0.083; Accession=PF03209.6; Description=PUCC protein
  Pfam module annotation: Pfam domain module=MFS_1::Nodulin-like::PUCC; Domain location=75-517::7-284::200-536
MVGESRKWVILLASIWVQAFTGTNFDFSSYSSELKSVLDITQLQLNYLSVASDMGKAFGWCSGVSLMYFPLWVVMFMAAFMGLFGYGFQWLVIHRLITLPYVVLKVETLTTTQYPMVLEALLYCSGKYTAVSRCSALQCHGRPQCICWFNTICYVLCIRHFPANRSLALSLSISFNGVSAALYTLIANAINTNDDTVYLLLNAIVPVLISGLVLIPILNQPQPQPHSVDTIQRDTSVFLCLNILALVTGLYLLFLYSFSYTMAIARVILIGAIFLLVLLLFLPGIVYSREWSFFTVPTSFSFYYSRFTRADPNDDELYKEFISIEDSVRNRSAQSTREKKCCIMNVLEREQFSMLGEEHSAKLLVRKWDFWLYYIAYFCGGTIGLVYSNNLGQISQSLGHYSQTSSLVTLYSTCSFFGRLLAASPDFLSRKIHIARTGWFGAGLVLTPIAFILLAISGSGAALHIGTALIGLSSGFVFSAAVSITSELFGPNSVGVNHNILITNIPLGSCLYGLLAALEVLPTNFHMVELYFNDRIGFKLLPFHKD

SEQ ID NO: 173858 - protein, 773 aa, Glycine max
  Coding DNA Sequence Number=SeqID_57080
  Gene Ontology: Cellular component=membrane
  Homolog annotation: Hit_ID=Q10MF7; Match level="QueryCoverage=97%, HitCoverage=90%, E-value=0.0, Identity=67%"; Hit description =Expressed protein
MAPRSFLLALLSLLLTQSDSAPQAFKRESSHPQWHHGAFHDVRDSVRSDVRRMLHSRAEVPFQVPLEVNVVLIGFSGDGGYRYNIDAHRLEQFLKTSFPVHRPSCLETGELLDIEHHMVYNAFPAGQPELIALEKELKEAMVPAGKARETEFGREVPLFEVEATAVEPVFQRLYSYIFDTDSVGSSVTEMDRPVPSAIFIVNFDKFNKCAGALANSACHMEEDLVMFQQVRLDPRNKEIDLDSSMYEKIPDLTEEDMKKQEGDYIYRYRYNGGGATQVWLSSGRFVVIDLSAGPCTYGKIEAEEGSVCSRTLPRLQNVIRPSSLHTTSHQSSNDIFLGQLASLVSTTVEHVIAPDVRFETVDLTSRLLVPIIVLQNHNRYNIMEKGHNYSINIEEIEAEVKSMLHDGQELVIIGGVHSLHRHEKLAIAVSKAMRGHSLQETKNDGRFHVHTKTYLDGAILKEEMERSADVLAAGLLEVSDPSLSSKYFLRQNWMDESEGSTDSILKHKSLWASYNSKYSKKRRKKVKKQGDLQPTYGTRVIPVFVLSLADVDPNLMMEDESMVWTSNDVVIVLEHQNEKIPLSYVSETQRRHALPSQAQRHILAGLASVVGGLSAPYEKASHVHERPVVNWLWAAGCHPFGPFSNTSHISQMLQDVALRNSIYARVDSVLRKIRDTSETVQTFAAEYLKTPLGEPVKGKKEKSNTELWLEKFYKKTTNLPEPFPHELVDRLEKYLDGLEELLVDMSSLLYDHRLQDAYLNSSDILQSTMFTEQ

SEQ ID NO: 173859 - protein, 133 aa, Glycine max
  Coding DNA Sequence Number=SeqID_57081
  Gene Ontology: Mol. function=RNA-directed DNA polymerase activity; Biological process=RNA-dependent DNA replication
MAMDVIDNIYPTSSKRHNFILVATNYFTKWVEAEPLINVTQELMIRFIRHNIVYRFGIPELIMTDQGTMLNGGMEWRRKGEMRRHFKEKMSLEEAYHRKRPWIRAWKKKEMNEGRGGEEHEILYSKRVLKSEV

SEQ ID NO: 173860 - protein, 118 aa, Glycine max
  Coding DNA Sequence Number=SeqID_57082
FLTTTNPSSCDALEVCDDEDVQCMISVFQSYAFTTRIKLYVDIDQGDSLLIPAGKMRMWRFQKKNHLTQKMRVSTSLINKDMVKHNNHFWIHLHIFFNMNWDHLDQEMDFPELDVPGS

SEQ ID NO: 173861 - protein, 90 aa, Glycine max
  Coding DNA Sequence Number=SeqID_57083
  Homolog annotation: Hit_ID=Q2HSL7; Match level="QueryCoverage=64%, HitCoverage=18%, E-value=8e-08, Identity=54%"; Hit description =Ubiquitin-conjugating enzyme, E2
MVTINEPVFSFSSHPLLNLNMANTKHIERFDVVQDDSDHYFLLPAGPNPYCFTKARSDVHKRIMKQWRILANNNLPESIYENRIDLRRGQ

SEQ ID NO: 173862 - protein, 60 aa, Glycine max
  Coding DNA Sequence Number=SeqID_57084
MTNQMFIIYLHSNSNDWGGKTARKPHYKRNLKESWASSSKGNNTRKSSIPWIQTENANET

SEQ ID NO: 173863 - protein, 324 aa, Glycine max
  Coding DNA Sequence Number=SeqID_57085
  Gene Ontology: Mol. function=small conjugating protein ligase activity; Cellular component=membrane; Biological process=protein modification process
  Homolog annotation: Hit_ID=Q2HSL7; Match level="QueryCoverage=93%, HitCoverage=97%, E-value=4e-91, Identity=54%"; Hit description =Ubiquitin-conjugating enzyme, E2
  Pfam annotation: Domain name=UQ_con; Domain location=40-186; Score =130.3; E_value=5.3e-36; Accession=PF00179.16; Description=Ubiquitin -conjugating enzyme
MENTNGFVHFDVVSDDADHHFLGSNKGKCFTDLKSEVYRTIMKEWKILEQNLPESIYVRVYERRIDLMRAVIVGAAGTPYHDGLFFFDIGFPSDYPKNPPKLHYHSFGYRHNPNLYSSGRVCLSLLNTWTGRKSEKWDPSGSTMLQVLLSIQALVLNKKPYYNEPGLASIASSEWRSRAYNENVFLITCSTSLHLLRRPPFNFEAFVSAHFRQRAFRILSACSDYTNGRARVGHYSFDLRLSSSSSKLHVSRSFKKQMIAFYPRLLQAFRQNGASLEGFAEHLELESKHSENKSGGIFKKVMEKIKKAFGLKKNKGQQSRLESA

SEQ ID NO: 173864 - protein, 66 aa, Glycine max
  Coding DNA Sequence Number=SeqID_57086
MKLDEKLGLDSDSGGDRTDLQEVEAHGALMRRREGGVEGDDAVGEGEVRREVEVRRGFQLCVAYEF

SEQ ID NO: 173865 - protein, 359 aa, Glycine max
  Coding DNA Sequence Number=SeqID_57087
LALVKEFYAKLYSSEDLSPKQVMGQRPPAYSRYCKLPTDYKEIEAALCIPGRGFILNSEGHPGKILRKDLTNLAQVWSVLSYSNLAPTSHTSDLTVDRARLIFGLVSQMDMNVGALISGQITSMAQSNSSRLGFPALIIALCKARGVNSNSLVFERLSSIINLAYIKKNCWNPDDLTVSIRGARRARTRPPEPPSTSTAPIPARTSSAPSVPASADFKRLKAMLQSIHQGKIILLESLQVVAPPGSIPSVEQEDEGPTAQVPQHVEDDSPEATIPKPFVRGMEAEETQEAAATPERSLEAASEPLAQGEDLPSPQPVADPSTPVLDLSEGQTTPVLTLNTSPPTTPVLHLTDEEDGQTQ

SEQ ID NO: 173866 - protein, 164 aa, Glycine max
  Coding DNA Sequence Number=SeqID_57088
MKEIVKKEVVKLLEARMIYPISNSQWVSPVQVVPKKVGMTVVKHEKNELIPTRTVTGWRMCIDYKKHNKATRKVARLTGASSKEGKCVELPPTFICGKRRKNRRKPVMKNIPDSGVVFTFEEGISTSHVNKSGALAPTYPPLKRKSDLRSSFKRANQAILFTLK

SEQ ID NO: 173867 - protein, 790 aa, Glycine max
  Coding DNA Sequence Number=SeqID_57089
  Gene Ontology: Mol. function=protein serine/threonine kinase activity; Cellular component=membrane; Biological process=regulation of transcription, DNA-dependent
  Homolog annotation: Hit_ID=Q9C902; Match level="QueryCoverage=99%, HitCoverage=99%, E-value=0.0, Identity=53%"; Hit description=Protein kinase, putative; 19229-23534
  Pfam annotation: Domain name=PAS; Domain location=115-226; Score =42.8; E_value=1.2e-09; Accession=PF00989.14; Description=PAS domain
  Pfam annotation: Domain name=PAS_3; Domain location=137-227; Score =23.0; E_value=0.00058; Accession=PF08447.1; Description=PAS fold
  Pfam annotation: Domain name=PAS_4; Domain location=121-231; Score =27.7; E_value=4.2e-05; Accession=PF08448.1; Description=PAS fold
  Pfam annotation: Domain name=Pkinase; Domain location=492-764; Score =246.9; E_value=4.1e-71; Accession=PF00069.15; Description=Protein kinase domain
  Pfam annotation: Domain name=Pkinase_Tyr; Domain location=492-764; Score=256.0; E_value=7.7e-74; Accession=PF07714.7; Description =Protein tyrosine kinase
  Pfam module annotation: Pfam domain module=PAS::PAS_3::PAS _4::Pkinase::Pkinase_Tyr; Domain location=115-226::137-227::121 -231::492-764::492-764
MGTPPTDELVKKIQQLEEGHAHLKQEMSKLKLSDVRHGHHRQRSHSVSPQRSRLGAPPKKRSDAPAAWKRGSCSFKQSSPLQRESRGGGDPQIHGGGGEEAAPRRGPSAVNFTERQYLNILQSMGQSVHILDLNCRIIYWNRSAENLYGYTAEEALGQDGIELLVDPRDLDLANNTVNRVMMGESWTGQFPIKNKMGEKFLAVATNTPFYDDDGSLVGLICVSIDLRPFLEMKVPMPSVRNIESDSDSGGTRPRSSITNKLGLDTQQPLQASIASKISNLASKVGNKVKSRIWTGENNLDRESGSGESHHSEHSLSESVFLEQREDANSSGASTPRGDVPPSHFGAFPHVEEKSQGKALRESGDESEGKSIHKIIPKAEAWIQRKTLSWPWRTKDREGSDAANVRVAGPWRQNDQENESVNQKILSSSLKQESQAGESNRPTNHEASGSWSSFNVNSTSSASSCGSAGSGAVNNKVDVDTDCLDYEILWEDLTIGEQIGQGSCGTVYHALWYGSDVAVKVFSKQEYSDDVILSFRQEVSVMKRLRHPNILLFMGAVTSPQRLCIVTEFLPRGSLCRLLHRNTSKLDWRRRVHMALDIARGVNYLHHCNPPIIHRDLKSSNLLVDKNWTVKVGDFGLSRLKHETFLTTKTGRGTPQWMAPEVLRNEPSDEKSDVYGFGVILWEIVTEKIPWDNLNSMQLEMVVKPNEWKSTAECGFILVIGAVGFMNQRLEIPKNVDPRWASIIESCWHSDPACRPTFPELLERLRDLQKQYAIQFQAARSTAKESTQKES

SEQ ID NO: 173868 - protein, 200 aa, Glycine max
  Coding DNA Sequence Number=SeqID_57090
  Pfam annotation: Domain name=GRP; Domain location=1-116; Score=-29.8; E_value=0.086; Accession=PF07172.2; Description=Glycine rich protein family
MGKLKSYISVLAVTFVLVIGVAECRKIKENELVDSFGGGGLGGGGGGGFGGGAGAGEGIGGGHGGGIGGGIGGAGGGAGGGFGGGKGGGVGGGIGGGGGVGGGAGGGAGGGFGGGKGGGVGGGIGGGGGAGGGFGGGHGGGVGGGIGGGAGGGGGAGGGFGGGAGGGAGGGFGGGAGGGAGGGFGGGAGGGAGGGFGGGG

SEQ ID NO: 173869 - protein, 692 aa, Glycine max
  Coding DNA Sequence Number=SeqID_57091
  Gene Ontology: Mol. function=catalytic activity; Cellular component =intracellular; Biological process=metabolic process
  Homolog annotation: Hit_ID=Q9C522; Match level="QueryCoverage=99%, HitCoverage=100%, E-value=0.0, Identity=87%"; Hit description=ATP citrate lyase, putative; 3734-7120
  Pfam annotation: Domain name=AT_hook; Domain location=299-311; Score =14.9; E_value=0.061; Accession=PF02178.9; Description=AT hook motif
  Pfam annotation: Domain name=Citrate_synt; Domain location=379-684; Score=-174.4; E_value=0.0026; Accession=PF00285.11; Description =Citrate synthase
  Pfam annotation: Domain name=Ligase_CoA; Domain location=155-404; Score=-0.9; E_value=7.9e-07; Accession=PF00549.10; Description=CoA -ligase
  Pfam module annotation: Pfam domain module=AT_hook::Citrate _synt::Ligase_CoA; Domain location=299-311::379-684::155-404
MATGQLFSRTTQALFYNYKQLPIQRMLDFDFLCGRETPSVAGIINPGSEGFQKLFFGQVEIAIPVHADIEAACAAHPTADVFINFASFRSAAASSMAALKQPTIRVVAIIAEGVPESDTKQLIAYARANNKVVIGPATVGGIQAGAFKIGDTAGTIDNIIHCKLYRPGSVGFVSKSGGMSNELYNTIARVTDGIYEGIAIGGDVFPGSTLSDHVLRFNNIPQSQHETKVGVAEMRMLRWMCGKTRQDKIRNGAIRERVGVAPIVEKMVENRLRWFGHVERRPVDSVVRRVDQMERRQTIRGRGRPKKTIREVIKKNLELNDLDRSMVKMMVVLGELGGRDEYSLVEALKQGKVTKPVVAWVSGTCARLFKSEVQFGHAGAKSGGEMESAQAKNQALKEAGAVVPTSFEAFEDAIKETFHKLVEEGNVTPIKEFTPPPIPEDLNTAIRSGKVRAPTHIISTISDDRGEEPCYAGVPMSTIIENGYGVGDICIMLCADHGPCVSGAHNSIVTARAGKDLVSCLVSGLLTIGPRFGGAIDDAARYFKDAYDRSLTPYEFVESMKNKGIRVPGIGHRIKNRDNKDKRVELLQKFARTHFPSVKYMEYAVEVENYTLTKANNLVLNVDGAIGSLFLDLLAGSGMFTKQEVDEIVEIGYLNGLFVLARSIGLIGHTFDQKRLKQPLYRHPWEDVLYTK

SEQ ID NO: 173870 - protein, 108 aa, Glycine max
  Coding DNA Sequence Number=SeqID_57092
MNSLFTIAVFVGLSLTILGQCNLENRSFCDTDVDVPKKVIVLEVVLFSFFLFSSLVAQGLKLTLNLLHSKEVDKAFQAHINLKALRLAWWAPPLAPSWAASFLSMALN

SEQ ID NO: 173871 - protein, 180 aa, Glycine max
  Coding DNA Sequence Number=SeqID_57093
  Gene Ontology: Biological process=response to biotic stimulus
  Homolog annotation: Hit_ID=Q67YM6; Match level="QueryCoverage=80%, HitCoverage=74%, E-value=1e-24, Identity=40%"; Hit description =Putative disease resistance response protein
  Pfam annotation: Domain name=Dirigent; Domain location=12-179; Score =139.3; E_value=1.1e-38; Accession=PF03018.5; Description=Dirigent -like protein
MGTPLNLTSNIFFFIFTLTILYVAYTFPRLQPNQTNLVFYVHDHFTGEHSTAATVAGKSGPASNILHFGTVAIVDDPVTVGPSDDSALIGRAQGMYVNSQLDGKGLYMVFSVIFTDGEFKGSSLEIQGSDIFTVKEREFGVVSGTGYFRFVKGYGIMETVFMDIANLRATLKLNVTVKHY

SEQ ID NO: 173872 - protein, 668 aa, Glycine max
  Coding DNA Sequence Number=SeqID_57094
  Gene Ontology: Mol. function=transferase activity; Cellular component= intracellular; Biological process=RNA processing
  Homolog annotation: Hit_ID=Q9LSP3; Match level="QueryCoverage=83%, HitCoverage=78%, E-value=0.0, Identity=59%"; Hit description =Similarity to O-linked GlcNAc transferase
  Pfam annotation: Domain name=TPR_1; Domain location=146-179; Score =0.2; E_value=5.1; Accession=PF00515.18; Description=Tetratricopeptide repeat
  Pfam annotation: Domain name=TPR_1; Domain location=180-213; Score =0.2; E_value=5.1; Accession=PF00515.18; Description=Tetratricopeptide repeat
  Pfam annotation: Domain name=TPR_1; Domain location=215-248; Score =9.2; E_value=0.42; Accession=PF00515.18; Description=Tetratricopeptid e repeat
  Pfam annotation: Domain name=TPR_1; Domain location=249-282; Score =11.9; E_value=0.2; Accession=PF00515.18; Description=Tetratricopeptid e repeat
  Pfam annotation: Domain name=TPR_1; Domain location=283-316; Score =10.8; E_value=0.27; Accession=PF00515.18; Description=Tetratricopepti de repeat
  Pfam annotation: Domain name=TPR_1; Domain location=317-350; Score =14.0; E_value=0.11; Accession=PF00515.18; Description=Tetratricopepti de repeat
  Pfam annotation: Domain name=TPR_1; Domain location=416-449; Score =2.0; E_value=3.1; Accession=PF00515.18; Description=Tetratricopeptide repeat
  Pfam annotation: Domain name=TPR_1; Domain location=453-486; Score =6.8; E_value=0.82; Accession=PF00515.18; Description=Tetratricopeptid e repeat
  Pfam annotation: Domain name=TPR_2; Domain location=146-179; Score =2.5; E_value=17; Accession=PF07719.7; Description=Tetratricopeptide repeat
  Pfam annotation: Domain name=TPR_2; Domain location=180-213; Score =7.8; E_value=4.1; Accession=PF07719.7; Description=Tetratricopeptide repeat
  Pfam annotation: Domain name=TPR_2; Domain location=215-248; Score =17.8; E_value=0.04; Accession=PF07719.7; Description=Tetratricopeptid e repeat
  Pfam annotation: Domain name=TPR_2; Domain location=249-282; Score =20.1; E_value=0.0082; Accession=PF07719.7; Description =Tetratricopeptide repeat
  Pfam annotation: Domain name=TPR_2; Domain location=283-316; Score =23.2; E_value=0.00096; Accession=PF07719.7; Description =Tetratricopeptide repeat
  Pfam annotation: Domain name=TPR_2; Domain location=317-350; Score =21.6; E_value=0.0028; Accession=PF07719.7; Description =Tetratricopeptide repeat
  Pfam annotation: Domain name=TPR_2; Domain location=351-384; Score =5.2; E_value=8.3; Accession=PF07719.7; Description=Tetratricopeptide repeat
  Pfam annotation: Domain name=TPR_2; Domain location=385-418; Score =4.2; E_value=11; Accession=PF07719.7; Description=Tetratricopeptide repeat
  Pfam annotation: Domain name=TPR_2; Domain location=421-449; Score =2.0; E_value=19; Accession=PF07719.7; Description=Tetratricopeptide repeat
  Pfam annotation: Domain name=TPR_2; Domain location=453-486; Score =13.2; E_value=0.93; Accession=PF07719.7; Description=Tetratricopeptid e repeat
  Pfam annotation: Domain name=TPR_2; Domain location=518-551; Score =5.4; E_value=7.8; Accession=PF07719.7; Description=Tetratricopeptide repeat
  Pfam module annotation: Pfam domain module=TPR_1::TPR_1::TPR_1::TPR _1::TPR_1::TPR_1::TPR_1::TPR_1::TPR_2::TPR_2::TPR_2::TPR_2::TPR _2::TPR_2::TPR_2::TPR_2::TPR_2::TPR_2::TPR_2; Domain location=146 -179::180-213::215-248::...
  Pfam module annotation: Domain location=249-282::283-316::317 -350::416-449::453-486::146-179::180-213::215-248::249-282::283 -316::317-350::351-384::385-418::421-449::453-486::518-551
  Subcellular localization annotation: CTP_CleavageSite=74; ConfidenceScore=5.81e-01
MNALPSSSSSTFTFLTQSKNPNYHFKFTHKVPILPLHSPSPCCSLSDSSSSSTTVLDKNALSPEQNSRIAGSPEDSSSKENLVVRRPVTDFSGEDSGKEEEEEEEEEDDPKASVIDEGLARFAKKMPMFEPERMESKERPLAINLDLALYRAKLLARRTFQYDEAESLLKKCISFWPEDGRPYVVLGKILSKQSKTSEAREIYEKGCQATQGENAYIWQCWAVLEMQMGNIRRAKELFDAATVADKRHVAAWHGWANLELKQGNLKKARILLGKGLQYCGQNEYIYQTLARLEARANRYQQARYLFNQATKCNPNSCASWLSWAQMEVEQENYHAARKLFEKAVQASPKNRYAWHVWGVFEANMGNIDMGRKLLKIGHNLNPRDAVLLQSLALLEYQYSTANVARVLFRRASELNPRHQPAWGWMEWKERNLNKARKLYQKTLSIDQNSETAARCLQAWGVLEHRVGNLSAARRLFKSSLNINSQSYVTWMTWASMEEDQGNSVRAEEIRNLYFQQRTEVVDDASWVMGFLGIFDPAIDSLKRILKLNPNSYNMPLDSLRNIAGTNKNRVDSSSDDEDDDDANGKNDFDLDAFIKQKLTLDLSNLEIQLETPKFYSVKRKIVSLENSVILSSRSIWFDCVSKNVMRAMQFTGTKKKKKNEGARQFQCC

SEQ ID NO: 173873 - protein, 452 aa, Glycine max
  Coding DNA Sequence Number=SeqID_57095
  Gene Ontology: Mol. function=chromatin binding; Cellular component =chromatin; Biological process=chromatin assembly or disassembly
  Homolog annotation: Hit_ID=Q1SAV4; Match level="QueryCoverage=86%, HitCoverage=98%, E-value=1e-118, Identity=54%"; Hit description =Integrase, catalytic region
  Pfam annotation: Domain name=Chromo; Domain location=353-402; Score =29.1; E_value=1.5e-05; Accession=PF00385.14; Description='chromo' (CHRromatin Organisation MOdifier
  Pfam annotation: Domain name=rve; Domain location=47-203; Score =108.9; E_value=1.5e-29; Accession=PF00665.16; Description=Integrase core domain
  Pfam module annotation: Pfam domain module=Chromo::rve; Domain location=353-402::47-203
TLARLSENFIWPGLRADVVTYVTNCRECQVTKYETKRIAGLLCPLPVPFRPWEDLSIDFVVGLPPFQGKTVLLVIVDRFSKGIHLGILPQAHTAHMVAQLFINIVVKLHGIPRSLVSDRDPLFISGFWQELFKLSGTHLRMSSAYHPQSDGQTEVMNRVIEGYLRAFVHRRPTSWGKFLPWVELSHNTSWNSSTGSTPYEITYGRKPFSFPDYIARSSKIDAVDDLLLSRDEVFTTIRRKLLKAQVSMKKTADAKRREVNYEPGSWVLLKLRPYRQSSVKGAQAVTGKLSKRFYGPFQIIERVGKVAYRLKLLDGARIHPVFHCSLLKPFHGDPILDSPNSLPTRFINGQPMLTPLAILDYRRHKERDTWEVLVQWHGLSPDESSWEDWEQLKQDHHLEDKVILQGPKEVDSSILTDVASEGQIGESINKEGVQLAKAKRKVTRPAYLKDYA

SEQ ID NO: 173874 - protein, 223 aa, Glycine max
  Coding DNA Sequence Number=SeqID_57096
  Gene Ontology: Mol. function=RNA-directed DNA polymerase activity; Cellular component=chromatin; Biological process=chromatin assembly or disassembly
MPAPDESSSSYDKLEDVLSRLTKQQLYLGESVNAMTLKIEELLHRVSPIVPPSQPTPTPLPHPQPATPIHRLKLEVPRFDGSEPMGWIYKINQFFDYHNTPEADKLTVASFHMEGRALAWFQWMNTTHQFPSWPAFLEALRTRFAPSQFEDPSGALCKLTQTGTVAQYLADFEDLANRTIGLPTPFLLSCFISGLTPEIRREVQAHQPATLVQAAGLARLQEE

SEQ ID NO: 173875 - protein, 335 aa, Glycine max
  Coding DNA Sequence Number=SeqID_57097
  Homolog annotation: Hit_ID=Q5XM22; Match level="QueryCoverage=14%, HitCoverage=27%, E-value=2e-11, Identity=64%"; Hit description =Resistance-like protein HAAS-2
MDRTRGLDWTLGKVIGRTLGREVSGDADESPRRRRPTTSAHRQREVASFVEDVEHVDHVVDEVHKQLEKATAEDVDADAQDFPDRPHDTSILMDYIHHVAVTVWNREERPELKLSSHGRKEEKFGRPVSDIEEVTITMDDVALLLHLSITCAFHSFKALHVDEVVDLLVDLLEFSLEEARDETLQCHEAHVRLSWLRDIYRSKCDAALWTVAAQAYLLHLIGCTLFANKSATHVHMYWIYEHFPTVSFSIAVEDYHERKLCAYHWNPTQPWDPPKHPHVVYNETFIELDPPKQLIAMAEPPATASSNVGIPRHAVEAYEAIAERLECLFNLRVVP

SEQ ID NO: 173876 - protein, 400 aa, Glycine max
  Coding DNA Sequence Number=SeqID_57098
  Gene Ontology: Mol. function=N-acetyltransferase activity; Biological process=metabolic process
  Homolog annotation: Hit_ID=Q1T0F6; Match level="QueryCoverage=71%, HitCoverage=98%, E-value=1e-108, Identity=71%"; Hit description=GCN5- related N-acetyltransferase
  Pfam annotation: Domain name=Acetyltransf_1; Domain location=69-153; Score=50.7; E_value=4.8e-12; Accession=PF00583.14; Description =Acetyltransferase (GNAT) family
  Pfam annotation: Domain name=FR47; Domain location=73-160; Score= -3.7; E_value=0.03; Accession=PF08445.1; Description=FR47-like protein
  Pfam module annotation: Pfam domain module=Acetyltransf_1::FR47; Domain location=69-153::73-160
MVDTFSIESGLLIREFDEDRDVKVVGKLERNCEIETKKGVSIFTNMMDDPLSRIRFYPLHVMLVAELLESKELVGVVRGCIKSMRTPSESLLKIGCILGLRVSPTHRRKGVGLKLVNSVEEWMLRNGAEYAFLATEKNNNASINLFTNKCKYMSLSSLVIFVHPIISFPAKHISKDIKIEKVNMDQAISLYRRTLRAKELYPLDMDSILKEKLSLGTWVSYYKDEGCRLNLQRMVESEDIITNEITSSWIIFSIWNTYEAYKLQLKKSQTTLRLLHTTLNHARDKIFPCLRMSVSESLCTPFGFLFLYGLHGEGENLGELMESIWRFTSRLGESLKDCRVVITELGFGDPLVNHVPQTASMSCFDDIWYTKRISSHGDEKDDELLMKRQIGNVFVDPRDF

SEQ ID NO: 173877 - protein, 35 aa, Glycine max
  Coding DNA Sequence Number=SeqID_57099
MARLKWGFPVDKGVRKTFKKVLIAVPNKEDICTPT

SEQ ID NO: 173878 - protein, 512 aa, Glycine max
  Coding DNA Sequence Number=SeqID_57100
  Gene Ontology: Mol. function=oxidoreductase activity; Cellular component=endoplasmic reticulum; Biological process=metabolic process
  Homolog annotation: Hit_ID=Q8H5F0; Match level="QueryCoverage=80%, HitCoverage=62%, E-value=1e-167, Identity=70%"; Hit description =Betaine aldehyde dehydrogenase-like
  Pfam annotation: Domain name=AT_hook; Domain location=33-45; Score =14.9; E_value=0.061; Accession=PF02178.9; Description=AT hook motif
  Pfam annotation: Domain name=Aldedh; Domain location=11-432; Score =177.5; E_value=3.2e-50; Accession=PF00171.12; Description=Aldehyde dehydrogenase family
  Pfam module annotation: Pfam domain module=AT_hook::Aldedh; Domain location=33-45::11-432
MVENRLRWFGHVERRPVDSVVRRVDQMERRQTIRGRGRPKKTIREVIKKDLELNDLDRIFATPQYCLLLQDFSSKFIGEGKVEIVNHSADTEKLPMPHISEHASWSGCFYFRIIQSALAAIGAPEDLVEVITGYGHLSYHSFFLFVLWLCLSSMALIEPSSRFAETGEALVSSVDKVIFVGSPGVGKMIMNNASNTLIPVTLELGGKDAFIVCEDVDLDHVAQIAVRAVLQSSGQNCAGAERFYVHREIYSSFVSKVTKIVKSVTAGPPLVGKYDMGALCMHEHSEKLEGLVNDALDKGAEIVARGNLGHIGEDAVDQYFPPTVIVNVNHTMRLMQEEAFGPIMPIMKFSSDEEVVRLANDSKYGLGCAVFSGNQSRAREIASQIHAGVAAVNDFASTYMCQSLPFGGVKHSGFGRFGGVEGLRACCLVKAVVEDRWWPFVKTKIPKPIQKLQWASCLLQYPVAENGFEFQESLVEALYGLGIWDRLRALVNVLKMLTEQNPGGSSNKRRND

SEQ ID NO: 173879 - protein, 659 aa, Glycine max
  Coding DNA Sequence Number=SeqID_57101
  Homolog annotation: Hit_ID=Q1T0F4; Match level="QueryCoverage=86%, HitCoverage=86%, E-value=0.0, Identity=76%"; Hit description=Nucleic acid-binding, OB-fold
MEHRDYYACNTKVGSAMDVDHCQEDQQKEKEEEQEEDPFLKFVDYARSELLSLEDDQNGDGEGSDGLGWSWIVSRILKTCVAYSSGVTPAILLSELSQAWSEQRRVGAPKKRLELISHLKKNYRRTKLPSTVTIDSIYEKNFLSLNSVLEAVIIDAFVLPGTNIHMLTLGDYWSSNIIDVYLHRRFYDLAGLQNGILKRGREIFLTGCYLRTSTGGSGHPRLLPTEYLVILLDENQDDDAMLLGAQFCSDSFSSISLDAVNGGASCSLYARIEKIESSEIQRKFETLQRKQVTLVDGDGVKLMFFLWGEQILLANLFRVGSMLALDKPYVNSSVDCDTETCKDLCLEYGSETQLYLVPYIQHEEQVCVTLTPNHRHGSRPLGSYNSGQDLKFSQVSLPRDSQGTIDFSNYPFRSFVVDLRNKMNGISLYGVVTDIIKENDQQTVFSLRIADTSGEIWTKLHFARFWSLGRVSFGHTVYVSGMTCTMSKQKCCLPALINSSCLHKLSRLSDISAQTSYAQVCRVWLDPSEYFYVNTIFSHSLCGHFVKRSDRLVECSFCRTIYDARIVRTFHLKITLADKDTGTKVLAWCTGQTAMDLLQISPEEFNELPEDEQVMYPSSLENERFMVALVNCKRNGCVIDGLSPDDSISWEITRAYKCE

SEQ ID NO: 173880 - protein, 84 aa, Glycine max
  Coding DNA Sequence Number=SeqID_57102
  Gene Ontology: Mol. function=metal ion binding; Biological process =metal ion transport
  Homolog annotation: Hit_ID=Q9ZRE7; Match level="QueryCoverage=67%, HitCoverage=18%, E-value=7e-09, Identity=59%"; Hit description=ATFP3
MGEAKVGSYMEVTKTSINGWKLHGTLGYHGCSESSHALGSLRPRNQETHREIERGRISGTRSKESREEMSPDTPNFFSCHLTPD

SEQ ID NO: 173881 - protein, 124 aa, Glycine max
  Coding DNA Sequence Number=SeqID_57103
MDAITKCAWLKEARLSARLSTKDLTKLPGLSDSASLSHRHLSKRMSVHPQKMNSLSAFDNAKRKHRCKMCKILERENAEKKLAKSGNCECNCRYTYLSSFRHCRLADRRAKRAREMFGFSLKLA

SEQ ID NO: 173882 - protein, 83 aa, Glycine max
  Coding DNA Sequence Number=SeqID_57104
  Homolog annotation: Hit_ID=Q9LT08; Match level="QueryCoverage=48%, HitCoverage=13%, E-value=8e-13, Identity=87%"; Hit description=26S proteasome non-ATPase regulatory subunit 14
MAEFLMIVKEKRDMLKFLKMDELKLSVWPSIKEGLISWLLSLALIHGLNWLYYSIAMNYRKIELEEKTLLNLHKKKWTDGLTL

SEQ ID NO: 173883 - protein, 223 aa, Glycine max
  Coding DNA Sequence Number=SeqID_57105
  Homolog annotation: Hit_ID=Q9LT08; Match level="QueryCoverage=40%, HitCoverage=29%, E-value=5e-38, Identity=84%"; Hit description=26S proteasome non-ATPase regulatory subunit 14
MRLKLKMDELKLSVWPSIKEGLISWLLSLFDAFRLINPQTMMLGQGPRQTTSNLGHMSKPSIQALIHGLNWLYYSIAMNYRKNELEEKTLFNLHKKKWTDGLTLWQFDTHSKTNEQTVQFSDLENGLISLVDYILIECQAAKRQKLEGGSLHKVGDVKQQLNFVHKAPKKWRFAFVLHGHPEYLQDSDFVSERFQRRDIYGAWEQYLGLEHADSAPKRSYVVN

SEQ ID NO: 173884 - protein, 128 aa, Glycine max
  Coding DNA Sequence Number=SeqID_57106
  Gene Ontology: Mol. function=motor activity; Cellular component =myosin complex
  Homolog annotation: Hit_ID=Q1SMP8; Match level="QueryCoverage=50%, HitCoverage=68%, E-value=2e-10, Identity=56%"; Hit description =Myosin S1, N-terminal
MFPIRTLGRSNWPHSEGSDYSTIKLECEHALTMLRCGNHTKGMKQLKEICAREEGLPHTVFINRVHSLMCFKTAMVVALSKNLFPQDANEEEHGGVKDMIRLAYLNELEVLYNLRRRYALNDIYVSVY

SEQ ID NO: 173885 - protein, 136 aa, Glycine max
  Coding DNA Sequence Number=SeqID_57107
  Gene Ontology: Mol. function=protein disulfide oxidoreductase activity; Cellular component=chloroplast; Biological process=cell redox homeostasis
  Homolog annotation: Hit_ID=Q7XIZ1; Match level="QueryCoverage=77%, HitCoverage=55%, E-value=6e-27, Identity=59%"; Hit description =Glutaredoxin-like protein
  Pfam annotation: Domain name=Glutaredoxin; Domain location=46-109; Score=53.4; E_value=7.4e-13; Accession=PF00462.14; Description =Glutaredoxin
  Subcellular localization annotation: CTP_CleavageSite=42; ConfidenceScore=5.31e-01
MQVMKSATQVETIQPSPPSLSSSLSLGLNKMRPYETVDHLVSCNAVVVFSMSDCCMSTVVKHLLFSLGVSPTVVELNEQADGPDIRSVLYQLARSHQPIPAVFIGGKFLGGVQTLMASHINGTLVPLLKEAGALWL

SEQ ID NO: 173886 - protein, 128 aa, Glycine max
  Coding DNA Sequence Number=SeqID_57108
  Homolog annotation: Hit_ID=Q9LD82; Match level="QueryCoverage=40%, HitCoverage=24%, E-value=9e-09, Identity=54%"; Hit description =Putative heme binding protein 2
MAASTIITLKFSFLLSLLLSVSLLGGVRSSHSHHVGEERFLQHAIASSAPPMISKAVWWTRKRFKCWVEAAALRASIAGTEWSSAIDKSHRAGHASVYTVAQYNDPFEYENVNEIWFLFEMESERHAM

SEQ ID NO: 173887 - protein, 100 aa, Glycine max
  Coding DNA Sequence Number=SeqID_57109
MVIIRVGNNWPGSSVVRVMPRAHGPSQDAANGQEKIDRGVLGEVEDALDEAAILAEDLEGKITSGCGGKIKRNICCGNLQRSQQQTEGDDSEGARVRTRD

SEQ ID NO: 173888 - protein, 74 aa, Glycine max
  Coding DNA Sequence Number=SeqID_57110
MFKDKTYLISVRMDESPKGTQLEFFLWSLWMHYMQQFFKVLASKGTEIVIPTDVLAWGEFGFVEGLMKWCYRVI

SEQ ID NO: 173889 - protein, 58 aa, Glycine max
  Coding DNA Sequence Number=SeqID_57111
MHSLTVFAFKVTRSVETGDGELSPQEDKTIKAIVDARVLLGVLELLLSTTKISHGMTM

SEQ ID NO: 173890 - protein, 68 aa, Glycine max
  Coding DNA Sequence Number=SeqID_57112
MAQIGLNMIIKIVQDPKIIGPDQRKLSVFFHAVKVAMRGTIQVYYSHFHKKNFRSLDTSAIRFICVCL

SEQ ID NO: 173891 - protein, 173 aa, Glycine max
  Coding DNA Sequence Number=SeqID_57113
MQFKGTLDSTQQGFKRAETQIGKLVDDMIKVMARREEEYAEIETHQESILQVNTIHHQLITKEETDEVSIIPEYPYIATTGYVVGKDKGQLELSVEDQKISFDLFEAMKHTDISDACFEEEEVEQEIELSASTMVLQFPLEKDPNYVIDCLVCDEELDDPKDNPIGHVVLEEL

SEQ ID NO: 173892 - protein, 111 aa, Glycine max
  Coding DNA Sequence Number=SeqID_57114
MVREKKFINRWIIVKFLYEVRDLIPHCRTVGICKLISVEGENGIARRQWNEGFNPFSFSLTFGNPNRATGGGAQESTSNITIDNGEHLSDYIKVRDEFIAIGVRMNMCRDP

SEQ ID NO: 173893 - protein, 285 aa, Glycine max
  Coding DNA Sequence Number=SeqID_57115
MVLEEGEFLPTYSRFCRLRTNPQEIEARLCIPRKGFVLNAKGQPWKLLINDLTTLAQTWSVFSYSNLAPTSHTSDLNMDRARLVYGLVTNMDINIGALISGQISSIAQSSSSRLGFPALITALCRARGVTSNSLTYESLSPTINLAYIKKKCWNVDDLTINFRGREEGKAPSTSATPTPAPPGSSTQDSQCFESMLQSLHQGQILLMHCLQVSWPGTLPSFVREGGGPSAQIPQQQPADPSTPVLEIPKDPATPVLGLTTTLPATPMLHLTDEEGTQDQETQQDD

SEQ ID NO: 173894 - protein, 141 aa, Glycine max
  Coding DNA Sequence Number=SeqID_57116
  Gene Ontology: Mol. function=transporter activity; Cellular component= integral to membrane; Biological process=transport
  Homolog annotation: Hit_ID=UPI00005FA16A; Match level="QueryCoverage =63%, HitCoverage=24%, E-value=7e-19, Identity=53%"; Hit description =COG0477: Permeases of the major facilitator superfamily
MGGELGVADNVDLQQIKHPRAAQNAREQMAAGEANQQRKHSGSRRKADHAIPAEMGQRQAAERRAGRHTDKHHGEHQRIEAAARFRRQAVDQRLMRHQRGLHAKVKADGAEDNQAKLGRHRQHRQQEHQANDTITSVAPYW

SEQ ID NO: 173895 - protein, 305 aa, Glycine max
  Coding DNA Sequence Number=SeqID_57117
  Gene Ontology: Mol. function=solute:hydrogen antiporter activity; Cellular component=integral to membrane; Biological process =regulation of pH
  Homolog annotation: Hit_ID=Q4ZU04; Match level="QueryCoverage=83%, HitCoverage=56%, E-value=7e-35, Identity=35%"; Hit description =Sodium/hydrogen exchanger family protein precursor
  Pfam annotation: Domain name=Na_H_Exchanger; Domain location=12-298; Score=-71.1; E_value=0.032; Accession=PF00999.11; Description =Sodiumhydrogen exchanger family
MNFLAWTALTGGLLLLMSLASGWIHRGPVTSFGLYLFAGILCGPWMLNLLQIDIIGHAELAAHITEITMAASLFITGLKLRLPMSAHAWRVGLRLAFPAMLLTVGGMACLIHWITGFGWPLSLAFGAIVAPTDPVLASLISVNDARDDDALRVALSSEAGMNDGSALPLLMLALLLMHPGAFSLELLGGWAARDVVWAIGGGLAIGYLLGRLIGQLATHLRSAHHDVAPNDFLALALIALSYAAAQSVDASGFLATFAAGVGLRRAELRVTKRFPLEDLPEEKRYLPAEVLVNPNQRLKQQGGSP

SEQ ID NO: 173896 - protein, 83 aa, Glycine max
  Coding DNA Sequence Number=SeqID_57118
MTESRFWGERKVPKGKNEKGNRIGGKDGGGGDGNNGILGKVGGGGGDGKNRILGKDAGIVGNIGQDGNCGQGGNVDQDVTVVC

SEQ ID NO: 173897 - protein, 74 aa, Glycine max
  Coding DNA Sequence Number=SeqID_57119
MNKERKNKTQIYFCTVRNKEKAESAEASFTHLTEWTTPKPTKSMIEKEKRRFQVLVTEAQPLEAKEGGMKAMRA

SEQ ID NO: 173898 - protein, 96 aa, Glycine max
  Coding DNA Sequence Number=SeqID_57120
  Gene Ontology: Mol. function=aldehyde dehydrogenase (NAD) activity; Biological process=metabolic process
  Homolog annotation: Hit_ID=Q0WSF1; Match level="QueryCoverage=92%, HitCoverage=15%, E-value=8e-35, Identity=76%"; Hit description =Aldehyde dehydrogenase 22A1 precursor
MAFWWPLLVLAFAYGICRFLLMLIPPKVPSIDVDTSDVLDDGNQAQENSFIYVPPRGTSQQSGKIVQCYEPATMKYLGYVPALTHEEVSELQPVLL

SEQ ID NO: 173899 - protein, 79 aa, Glycine max
  Coding DNA Sequence Number=SeqID_57121
MVDENCKKGWASRGRGKGRGRTQGRGLLAPPSQSSSTILCDAHTKPNTKGPKMPDGTRGFTMGRGKPISPSSQVTSPKE

SEQ ID NO: 173900 - protein, 404 aa, Glycine max
  Coding DNA Sequence Number=SeqID_57122
  Homolog annotation: Hit_ID=Q1ZY19; Match level="QueryCoverage=93%, HitCoverage=79%, E-value=4e-27, Identity=26%"; Hit description =Fgenesh protein 60
  Pfam annotation: Domain name=DUF247; Domain location=26-404; Score =278.9; E_value=9.7e-81; Accession=PF03140.6; Description=Plant protein of unknown function
MDHTPASAITQAKKDLVTSIKEKLEAVSSLKSIFRVPEKLLEANEKMYIPSTVSIGPLHHGKEGLKYMEDRKWHYLFTLLSRQPNQLESSLHEFVNALSDLEKPARNFYAEELNLTCNQFMEMMLVDGCFIIELFLKYSLEGIRRRGDPTFTTPGLLNRLRCDLILLENQIPFLILQRLFQIVLIPIKYDLTLTLSELAVRFFRKMLPGDKEIVNEKFSQEGYHLLDLIRHCFLPTYARVMSKRSVSQGDLETESATKLKKDGIKSKSSKAKSLLNIKFANGVLEVPSFTPHHHFTEMLFSNLIALEQHQNDSQPFTSYAFLMKALVCNENDVKLFRNRGIVIMDNYTEKEVCDLFKRLCGKVEYGEDKFYFAGLIEQIFEYKRTPRSWRKILKFSWLKTRTST

SEQ ID NO: 173901 - protein, 108 aa, Glycine max
  Coding DNA Sequence Number=SeqID_57123
MPPTVPVNHYSDPEGQHNRIRILTGGTTRPVKDRSASPAEGTSRPVHTGGGPIDPTQAGITAAAGTRLALQWILVKGFRLYSFQLPDSMSPAPSPESNPNSPSPVTTM

SEQ ID NO: 173902 - protein, 192 aa, Glycine max
  Coding DNA Sequence Number=SeqID_57124
  Homolog annotation: Hit_ID=Q9SWB6; Match level="QueryCoverage=93%, HitCoverage=95%, E-value=6e-86, Identity=75%"; Hit description=Seed maturation protein PM36
  Pfam annotation: Domain name=TENA_THI-4; Domain location=19-191; Score=88.9; E_value=1.6e-23; Accession=PF03070.6; Description =TENATHI-4 family
MEEKAKAEEKKIGMSETWLRKHRLIYDGATRHPLIISICDGTIIIASFKTWLDYLFVRAFVPFAASVLIKAWKESDCRGDMEVILGGVASLEDEISWFKAEANKWAFWAIEAVYQESFAHCIEEGSKIPPELKETCARWGNEAFGKYCQSLQNIANRRLQKASDEELKKAEFMLLSVLEHEVEFWNMSCGNV

SEQ ID NO: 173903 - protein, 120 aa, Glycine max
  Coding DNA Sequence Number=SeqID_57125
  Gene Ontology: Mol. function=zinc ion binding
  Homolog annotation: Hit_ID=Q1STZ5; Match level="QueryCoverage=52%, HitCoverage=51%, E-value=1e-09, Identity=41%"; Hit description=Zinc finger, SWIM-type
MADLQEKLDALKGLVGVLNNMDEGETHNNNATSSPNNSHSPAPMPGRNRSVGKYNNSGTQKIKVCDCGKFQELRMSCSHVVTACKHAHHEYKNYMHPVYKLESASNVYRGLFRELRYEAY

SEQ ID NO: 173904 - protein, 111 aa, Glycine max
  Coding DNA Sequence Number=SeqID_57126
MMLKTLNEIWEFLQQEYNENEKGLNKHYSGGISECTTSTRTKKAYETIRICRGSFPSQELQRCKQIKVHAKGKSFSLDLMKEEQEDNEDDNADKKQAEKKPHEKNLKSMFG

SEQ ID NO: 173905 - protein, 92 aa, Glycine max
  Coding DNA Sequence Number=SeqID_57127
  Gene Ontology: Cellular component=nucleus
  Homolog annotation: Hit_ID=Q8RXD8; Match level="QueryCoverage=68%, HitCoverage=17%, E-value=8e-10, Identity=49%"; Hit description=WD repeat protein-like
  Pfam annotation: Domain name=WD40; Domain location=16-54; Score=19.2; E_value=0.015; Accession=PF00400.22; Description=WD domain, G-beta repeat
MTASLTELDDDLVRSMAIGAVFSDFGGMIHSIDFHRKDDLLVTASEDDSVRLYDIANAKVVSLCMSPINDSFMSGSLDHSVRIWDLRVNACQ

SEQ ID NO: 173906 - protein, 107 aa, Glycine max
  Coding DNA Sequence Number=SeqID_57128
ARPYPSVGKEDPLKDKTILKDPGRDMRGKRKRDDTIIQTPSYRVQGKRRFKLSNLTLMCRRSLALRRLCQRCRSATTVWNEEGKKPFGCEAGLEIEKGVARFCRGRV

SEQ ID NO: 173907 - protein, 100 aa, Glycine max
  Coding DNA Sequence Number=SeqID_57129
  Homolog annotation: Hit_ID=Q8RXD8; Match level="QueryCoverage=72%, HitCoverage=22%, E-value=3e-11, Identity=45%"; Hit description=WD repeat protein-like
GPFDTFLVGGDTAEVCDIKFSNDGKSMLLTTTNNNIYVLDAYGGEKRCGFSLEPSPGTPIEATFTPDGKYMVAADMHKNCYPSNFSYYYYHEAVEVELSS

SEQ ID NO: 173908 - protein, 116 aa, Glycine max
  Coding DNA Sequence Number=SeqID_57130
  Gene Ontology: Mol. function=RNA polymerase II transcription factor activity; Cellular component=DNA-directed RNA polymerase II, core complex; Biological process=regulation of transcription, DNA -dependent
  Homolog annotation: Hit_ID=Q2HU21; Match level="QueryCoverage=69%, HitCoverage=71%, E-value=7e-31, Identity=72%"; Hit description=DNA -directed RNA polymerase, subunit C11/M/9
MWLHLFFGLNQREPGVRLRAFGALVIIFCFIQLRKYQEIADSNVVYRNKIHHSVQRRTRELENVAADPTLPRTKSVRCSQCNHGEAVFFKAPVKGEEGMALIFVCCNPTCGYRWRD

SEQ ID NO: 173909 - protein, 53 aa, Glycine max
  Coding DNA Sequence Number=SeqID_57131
MGTQERTMLKLNMWKKGLASYLESVIGKRERVEERTLCDSSGEFIELKKPTSW

SEQ ID NO: 173910 - protein, 62 aa, Glycine max
  Coding DNA Sequence Number=SeqID_57132
MEADRKRERMKEKIEMESKREERNLVIAVAASIENHCLFLAGRLSLLNQKNRLGSSYRKNYT

SEQ ID NO: 173911 - protein, 152 aa, Glycine max
  Coding DNA Sequence Number=SeqID_57133
MAEFLGQLLGQLLQSGVGEEPMEATHPRHSPNPGAVAHPRHSHKELPRASFNNTGTQNIRGLINNTGCTKGNGFVRGFANMIDGGDSNRSVATQPQSNPNNNMMNGTPFPPLQPPAAGLLNGDNQKLFGVTNNTNIKLKGDGNGAFTLGYFK

SEQ ID NO: 173912 - protein, 49 aa, Glycine max
  Coding DNA Sequence Number=SeqID_57134
MELVLVGVKRHANCKGVPRSHILLIKVEWCSLGLTIMVEWRPKNSSSHH

SEQ ID NO: 173913 - protein, 67 aa, Glycine max
  Coding DNA Sequence Number=SeqID_57135
MKVWMWTTWMGILHIEDKDLVQDQDAKDISDAPNRRIWMMEIDMSSTLVIPFPIIIQTIYLDTLKSN

SEQ ID NO: 173914 - protein, 434 aa, Glycine max
  Coding DNA Sequence Number=SeqID_57136
  Gene Ontology: Mol. function=protein binding; Cellular component =integral to membrane; Biological process=response to DNA damage stimulus
  Homolog annotation: Hit_ID=Q00UZ0; Match level="QueryCoverage=89%, HitCoverage=42%, E-value=3e-63, Identity=33%"; Hit description=[G] KOG2175 Protein predicted to be involved in carbohydrate metabolism
  Pfam annotation: Domain name=DUF625; Domain location=158-348; Score =380.6; E_value=2.4e-111; Accession=PF04802.5; Description=Protein of unknown function (DUF625)
MQRSEELGLFVYDEEDNENILLHRISSDDIYRKQEDTIISWRDPEYATELALSFQEPSGCSYIWDNICNVQRNMHFNTLNSEPFHSVNSEPRELPAVELSTLPLILKTVVDSGFADQLRLTELILSDPPALVMSNAAEMALFCLYILYMHPFSPVFILQQEFFRKLMEVFRMCEDLENIDGLHMIFKIVKGIVLLNSPAIFERIFSDDFIVDIIGAFEYDPEVPCVQHHRKFLKEHVVFKEAIPIKDPVVLSKIHQTYRVGFLKDVVLARVLDEGIGANLNSIIHSNNAHVVSLLKDDSTFIQELFARLKSPTTSQESKKNLVYFLHEFCSLSKSLQMVQQLRLFRELMNEGIFDVVTNVLQSQDKKLVLTGTDILILFLNQDPNLLRSYFVRLEGFALLGLLSVIVKLMYYFKNECKAWYSVAYGSEPKERKD

SEQ ID NO: 173915 - protein, 734 aa, Glycine max
  Coding DNA Sequence Number=SeqID_57137
  Gene Ontology: Mol. function=calcium ion binding; Cellular component =nucleus; Biological process=regulation of transcription, DNA -dependent
  Homolog annotation: Hit_ID=Q1T0C7; Match level="QueryCoverage=99%, HitCoverage=79%, E-value=0.0, Identity=79%"; Hit description=IQ calmodulin-binding region; CG-1
  Pfam annotation: Domain name=Ank; Domain location=418-450; Score =41.9; E_value=2.2e-09; Accession=PF00023.20; Description=Ankyrin repeat
  Pfam annotation: Domain name=IQ; Domain location=583-603; Score=20.3; E_value=0.0068; Accession=PF00612.17; Description=IQ calmodulin -binding motif
  Pfam annotation: Domain name=IQ; Domain location=606-626; Score=25.5; E_value=0.00019; Accession=PF00612.17; Description=IQ calmodulin -binding motif
  Pfam annotation: Domain name=IQ; Domain location=687-707; Score=18.8; E_value=0.019; Accession=PF00612.17; Description=IQ calmodulin -binding motif
  Pfam module annotation: Pfam domain module=Ank::IQ::IQ::IQ; Domain location=418-450::583-603::606-626::687-707
MSNNINVKSHELRLHEINTLEWDDLVDTNDHNASTVPNGGTVPYFDQQDQILLNDSFGNVANNLSAEIPSFGNLTQPIAGSNRVPYNFSESVTLQTMDNQANPHEQKNNTVSLSGVDSLDTLVNDRLQSQDSFGMWVNHIMSDSPCSVDDPALESPVSSIHEPYSSLVVDSQESSLPEQVFTITDVSPTCVSSTEKSKVLVTGFFLKDYMHLSKSNLLCVCGDVSVPAEIVQVGVYRCWVSPHSPGFVNLYLSIDGHKPISQVVNFEYRTPALHDPAVSMEESDNWDEFRQQMRLAYLLFAKQLNLDVISSKVSPNRLKEARQFALKTSFISNSWQYLIKSTEDNQIPFSQAKDALFGITLKNRLKEWLLERIVLGCKTTEYDAHGQSVIHLCAILGYNWAVSLFSWSGLSLDFRDRFGWTALHWAAYCGREKMVATLLSAGAKPNLVTDPTPQNPGGCTAADLAYMRGHDGLAAYLSEKSLVQHFNDMSLAGNISGSLETSTTDPVNPANLTEDQQNLKDTLTAYRTAAEAASRIHAAFREHSLKLRTKAVASSNPEAQARKIVAAMKIQHAFRNHETKKMMAAAARIQCTYRTWKIRKEFLNMRRQAVKIQAAFRCFQVRKHYRKILWSVGVVEKAVLRWRLKRRGFRGLQVKTVDAGTGDQDQQSDVEEEFFRTGRKQAEERVERSVVRVQAMFRSKKAQEEYRRMKLALNQAKLEREYEQLLSTEVDMQL

SEQ ID NO: 173916 - protein, 189 aa, Glycine max
  Coding DNA Sequence Number=SeqID_57138
  Gene Ontology: Mol. function=protein binding; Cellular component =clathrin vesicle coat; Biological process=ER to Golgi vesicle -mediated transport
  Homolog annotation: Hit_ID=Q93Y22; Match level="QueryCoverage=98%, HitCoverage=33%, E-value=7e-76, Identity=80%"; Hit description =Coatomer delta subunit
MVVLAASIVSKSGKEKLNLESLNVEFGVLVSRQFVDMSRIRIEGLLAAFPKLIGTGKQHTYVEMENVRYVYQPMEALYLLLVTNKHSNILEDLATLRLLSKLVPEYSYSLDEEDICQNAFELIFAFDEVISLGHTENVTVAQVKQYCEMESHEEKLHKLVMQSKINDTKDVMKRKASEIDKSKIEKNQR

SEQ ID NO: 173917 - protein, 77 aa, Glycine max
  Coding DNA Sequence Number=SeqID_57139
  Homolog annotation: Hit_ID=Q1T0C7; Match level="QueryCoverage=89%, HitCoverage=6%, E-value=8e-24, Identity=80%"; Hit description=IQ calmodulin-binding region; CG-1
MANNLAVQLVGSEMHGFHTLQGTYFTVDLDVGSIMEEARTRWLRPNEIHAMLCNYKYFTINVKPVNLPKSNYHLAAT

SEQ ID NO: 173918 - protein, 829 aa, Glycine max
  Coding DNA Sequence Number=SeqID_57140
  Gene Ontology: Mol. function=binding; Cellular component=ubiquitin ligase complex; Biological process=protein ubiquitination
  Homolog annotation: Hit_ID=Q8GSZ9; Match level="QueryCoverage=79%, HitCoverage=98%, E-value=1e-176, Identity=52%"; Hit description =Armadillo repeat-containing protein-like
  Pfam annotation: Domain name=Arm; Domain location=241-280; Score=1.1; E_value=8.8; Accession=PF00514.13; Description=Armadillobeta-catenin -like repeat
  Pfam annotation: Domain name=Arm; Domain location=323-363; Score =10.9; E_value=0.53; Accession=PF00514.13; Description=Armadillobeta -catenin-like repeat
  Pfam annotation: Domain name=Arm; Domain location=364-404; Score =28.0; E_value=3.4e-05; Accession=PF00514.13; Description =Armadillobeta-catenin-like repeat
  Pfam annotation: Domain name=Arm; Domain location=490-530; Score=6.7; E_value=1.8; Accession=PF00514.13; Description=Armadillobeta-catenin -like repeat
  Pfam annotation: Domain name=Arm; Domain location=623-665; Score =26.9; E_value=7.3e-05; Accession=PF00514.13; Description =Armadillobeta-catenin-like repeat
  Pfam annotation: Domain name=Arm; Domain location=697-737; Score =17.5; E_value=0.047; Accession=PF00514.13; Description=Armadillobeta- catenin-like repeat
  Pfam annotation: Domain name=Arm; Domain location=741-781; Score =12.7; E_value=0.32; Accession=PF00514.13; Description=Armadillobeta -catenin-like repeat
  Pfam annotation: Domain name=DUF634; Domain location=435-645; Score= -161.1; E_value=0.098; Accession=PF04826.4; Description=Protein of unknown function (DUF634)
  Pfam annotation: Domain name=DUF919; Domain location=61-121; Score= -10.5; E_value=0.072; Accession=PF06034.2; Description=Nucleopolyhedro virus protein of unknown function (DUF919)
  Pfam annotation: Domain name=HEAT; Domain location=374-406; Score =1.2; E_value=30; Accession=PF02985.12; Description=HEAT repeat
  Pfam annotation: Domain name=HEAT; Domain location=496-532; Score =9.8; E_value=2.7; Accession=PF02985.12; Description=HEAT repeat
  Pfam annotation: Domain name=HEAT; Domain location=631-667; Score =16.9; E_value=0.075; Accession=PF02985.12; Description=HEAT repeat
  Pfam annotation: Domain name=HEAT; Domain location=707-739; Score =11.3; E_value=1.8; Accession=PF02985.12; Description=HEAT repeat
  Pfam module annotation: Pfam domain module=Arm::Arm::Arm::Arm::Arm::Ar m::Arm::DUF634::DUF919::HEAT::HEAT::HEAT::HEAT; Domain location=241 -280::323-363::364-404::490-530::623-665::697-737::741-781::435 -645::61-121::...
  Pfam module annotation: Domain location=374-406::496-532::631 -667::707-739
MKEKRDFSEFVSELIVLADEVASFAKNPEIEIVEDAFTEFAMLVEKFAPIFNDLRDKSKIMDKSAIRKSLESLMNELTRAKALIRSSSLKERIKRIEDIAHDLGRSLGMLRVASLEVSIDFREKIGTLQKKLMNVRFGGNTSLTSSSISTFVNEEKVGGEIEEEINNVTGDDVLLHLKNGDAEEFAVALLRLKKFIRGGKLDSGLINVEAAVSILFNRLFSCKTGNRLTIIQLLRSVALQNDEMKEKMTKNELLSAVVKSLTRDTEERRESVGLLLELSDLPAVRRKIGRIQGCIVMLVSILNGVDPVASRDAAKLLDILSNNTQNALLMAEAGYFGPLVQYLNKGSDMTKILMATTLSRLVLTDHSKLTLGQDGAIEPLVRMFNSGKLESKLSALNALQNLSSLTENVERLVKTGIVGSELQLLFSVTSVLMTIRERASVILARIAESETVLVNKGVAQQMLSLLNLSSPVIQGHILEALNSIASHPCASKVRSKMKDKGALQLILPLLKETKMKIRSKALNLLYTLSEDLTDELTAHFDETHLFDIVNIVLSSTSDSEKAAAVGILSNLPVSDKKVTDVLKRANLLPVLVSIMDSGTRSNSPAKSILMESIAGVAIRFTSSSDKKLQLLSAQHGVIPLLVKLLSSGSAITKFKAATALAQLSQNSPSLRRSRKSRWLCVAPSVNAYCEVHDGYCFVSSTFCLIKAGAVSPLIQILEDKDWEAVEAALNALSTLLQDEIWEGGANYIAKLSGVEAIVNVLEAGDVKVQEKALWMLERIFRIEEHRMKYAEFAQMVLIDMAQRSDSRLKSTVAKVLAVLELLLVQSSYF

SEQ ID NO: 173919 - protein, 70 aa, Glycine max
  Coding DNA Sequence Number=SeqID_57141
MDEDQQNWKKMFNIMSKINKKAEEIFNIVHVMDQPYDEVSKLFFVRWNDELGHTWHLLHSSDNMHSVTYN

SEQ ID NO: 173920 - protein, 58 aa, Glycine max
  Coding DNA Sequence Number=SeqID_57142
MELDGMVQYQKPLPSYFDKEMISAEEQRKDMAKKKTDVATTKTQHTPIDLEKFGAIET

SEQ ID NO: 173921 - protein, 171 aa, Glycine max
  Coding DNA Sequence Number=SeqID_57143
  Homolog annotation: Hit_ID=Q0KIN0; Match level="QueryCoverage=26%, HitCoverage=2%, E-value=1e-11, Identity=71%"; Hit description =Integrase core domain containing protein
MPMVLMSFLGQVVIEGERRDGCSGQYDQICNARLPRALDPHSVPSEEFSTSLGVLALGYGNEILIGMHVLPRGGILAEIIFACSQVVVAITLYFASALDQATVFYFLLFKEIMLPPMYTQYPAVDLLSDVSSIGACRPRIFFINGFLCFLEDEWQRNGEGRGKGDATSRRR

SEQ ID NO: 173922 - protein, 80 aa, Glycine max
  Coding DNA Sequence Number=SeqID_57144
MDAMAFVVYNPPPSKAYVRLVEDILLWTYKALAQALEDKDYAKKEAKKWYLIGDFFYKKLTGWKPHKIPTLPSYPIPLSS

SEQ ID NO: 173923 - protein, 85 aa, Glycine max
  Coding DNA Sequence Number=SeqID_57145
MQKKELDKLNFTKLWMDGFPGIDPFHYPVWDTLPEEEEDSCRNYGGQELVLEEFPVRQSVAPKQNNMIFEHRPIERNLYPLGASV

SEQ ID NO: 173924 - protein, 100 aa, Glycine max
  Coding DNA Sequence Number=SeqID_57146
MTNANCPQESLHSVSNRNLRFDTAQTLVSRFLQVSSFFEDEGESPVESDETKVQSWSCVCVVYFELVNKGPLAAQIHFLKIIWSRFLIPYENYSSDFREI

SEQ ID NO: 173925 - protein, 82 aa, Glycine max
  Coding DNA Sequence Number=SeqID_57147
PTLSWVEENPTYTVATRVLKHSSLLKGQSFFREAPLTCVCCWVLLIKRMNHDFCRWIHRGLEIACNCFNILLSNRGGLTVVV

SEQ ID NO: 173926 - protein, 83 aa, Glycine max; identical to SEQ ID NO: 157982
  Coding DNA Sequence Number=SeqID_57148
  Gene Ontology: Mol. function=DNA binding; Cellular component=nucleus; Biological process=regulation of transcription, DNA-dependent
  Homolog annotation: Hit_ID=Q6R074; Match level="QueryCoverage=48%, HitCoverage=15%, E-value=3e-13, Identity=78%"; Hit description=MYB transcription factor
  Pfam annotation: Domain name=Myb_DNA-binding; Domain location=17-58; Score=20.2; E_value=0.0075; Accession=PF00249.21; Description=Myb -like DNA-binding domain

SEQ ID NO: 173927 - protein, 71 aa, Glycine max
  Coding DNA Sequence Number=SeqID_57149
MAAEKGLKMVLVTENMMVACWTSHIGVPSCLKWAPRRAMFAAASSVLTFWIPNNDSKLETQYGGTDAEAGP

SEQ ID NO: 173928 - protein, 97 aa, Glycine max
  Coding DNA Sequence Number=SeqID_57150
MTLQLADHSITRPYGVIEDVLVQDVEIPLILGRPFMSTASCVVDKGKKKLEMGIEDQKIRFDLFDEEKQLLDQNVCLKVKEYGEEILKEGTKFDPDP

SEQ ID NO: 173929 - protein, 135 aa, Glycine max
  Coding DNA Sequence Number=SeqID_57151
MDMDVGDLISRQISLIAQSNSSRLGFPAIITALCMDRGVTSDSLTFETLSLANNLAYIKKNCWNLDDPSVSFPGTCKARARGSEGPSSSAPQDSTDAILPRKGPVTRAMSKRLQEDWARVAKEGPRVLINLRVDF

SEQ ID NO: 173930 - protein, 61 aa, Glycine max
  Coding DNA Sequence Number=SeqID_57152
MVEGDIIYKLKVQVINFSSIWVQRINHFIRKESINLVTGPVVGPDPWHPPHQSDSAQACLL

SEQ ID NO: 173931 - protein, 115 aa, Glycine max
  Coding DNA Sequence Number=SeqID_57153
  Homolog annotation: Hit_ID=Q84T14; Match level="QueryCoverage=31%, HitCoverage=16%, E-value=2e-08, Identity=75%"; Hit description =Vacuolar ATPase subunit E
MAEFQSSDNSALDTYNFITMSYFHTDITGGIVLASEDGKIVLENTLDARLDVIFRQKLPEACKEAPVRLNNILQFEFSLYVSKWKSKDVATSFPLSLIKANAPPLLFFLFSKTKF

SEQ ID NO: 173932 - protein, 452 aa, Glycine max
  Coding DNA Sequence Number=SeqID_57154
  Gene Ontology: Mol. function=DNA binding; Cellular component =ribonucleoprotein complex; Biological process=snRNP protein import into nucleus
  Homolog annotation: Hit_ID=O65334; Match level="QueryCoverage=68%, HitCoverage=55%, E-value=1e-159, Identity=92%"; Hit description=SAR DNA-binding protein-1
  Pfam annotation: Domain name=NOSIC; Domain location=55-107; Score =125.0; E_value=2.1e-34; Accession=PF08060.3; Description=NOSIC (NUC001) domain
  Pfam annotation: Domain name=Nop; Domain location=147-295; Score =332.2; E_value=8.7e-97; Accession=PF01798.8; Description=Putative snoRNA binding domain
  Pfam module annotation: Pfam domain module=NOSIC::Nop; Domain location=55-107::147-295
MGIGTDGKTGQARWSDLSAHYQFGRAGWRTQPVNLLWLALPPQRANGGAGQVDTMIVQAIGLLDDLDKELNTYAMRVREWYGWHFPELTKIIQDNILYARAVKLMGDRVNAANLDFSEILPEEVEAELKEASVISMGTEIGELDLANIRELCDQVLSLSEYRAQLYDYLKSRMNTIAPNLTAMVGELVGARLIAHGGSLLNLAKQPGSTVQILGAEKALFRALKTKHATPKYGLIYHASLIGQAAPKFKGKISRSLAAKTALAIRCDALGDSQDNTMGLENRAKLEARLRNLEGKELGRFAGSAKGKPKIEAYDKDRKKGAGGLITPAKTYNPSADSVIGQMVNSAMDEDAQEPSVADKKKEKKEKKEKKKKEKNEGDETVQADGDVGEEPEPEVVKKEKKKKRKETESAELQNGNDDNAGEKKKKRKKHAEKEESPEMPSKKKGKKKKSGD

SEQ ID NO: 173933 - protein, 94 aa, Glycine max
  Coding DNA Sequence Number=SeqID_57155
  Gene Ontology: Mol. function=protein serine/threonine kinase activity; Cellular component=integral to membrane; Biological process=protein amino acid phosphorylation
  Homolog annotation: Hit_ID=Q8GSN9; Match level="QueryCoverage=88%, HitCoverage=12%, E-value=1e-26, Identity=57%"; Hit description=LRR receptor-like kinase
MDALLKLKDSMTGSVNCDQELRVVAINVSFVPLFGYLPPEIGQLDKLENLTSLKLLDISHNVFSGQIILPMTKLEVLDVYDNNFRQHTGDLLGV

SEQ ID NO: 173934 - protein, 88 aa, Glycine max
  Coding DNA Sequence Number=SeqID_57156
  Subcellular localization annotation: CTP_CleavageSite=53; ConfidenceScore=5.89e-01
MSFFFRKSFLPPFSKSFTSHFLFFVRRCLWFVGVATLSAAVKVKFLASSFAVVGGSKRGTQMVFVRRGRTDDFRIKLIRKFRIKLIHG

SEQ ID NO: 173935 - protein, 78 aa, Glycine max
  Coding DNA Sequence Number=SeqID_57157
ENKVDDQGDEREGGIGAGGSSEVPWRQWPATVVVEEDPFCFFDASAIGVLGRLGTIKEMGKNEGLHKERENKAYPVTD

SEQ ID NO: 173936 - protein, 800 aa, Glycine max
  Coding DNA Sequence Number=SeqID_57158
  Gene Ontology: Mol. function=calmodulin binding
  Homolog annotation: Hit_ID=Q1S042; Match level="QueryCoverage=99%, HitCoverage=99%, E-value=0.0, Identity=49%"; Hit description =Calmodulin-binding, plant
  Pfam annotation: Domain name=CaM_binding; Domain location=662-776; Score=162.8; E_value=8.9e-46; Accession=PF07839.2; Description=Plant calmodulin-binding domain
MVLSKLGIQADHVKSDKCLANLKPYSSQYQDGKTKGTDKVKKMMKSRSFQLSDFEPPQSPPSVRSLSQPRKPSPLHVPTTAASPQQQKAMVRRSPNYMKPTSSSDAKKELLPVSHRNTQSSSDGKSLPQKCMRNSKASYVSCKEPAKTLSRSSSVNSMRTLTKTPSFKPCKACSREFTSAVLFEDVNAPERATCSSTLKDCKFPEYLMLDPGGTESEGVSLMKVCPYTYCSLNGHGHGHSPLPPLKSFMSARRHLLETQKNIKAEVASPQRWKVPPCDTKKDSYSEQIVFHGKPACDEADTGNPTITPLAQEIGMDFFFEIYAKEREGDGKMGKFNSFKDLEEQEDINFANDENDIAAEEDGVKQVTPGVTRDLPKSQINFEEDFKNYFADTAAIEANSKGSFHLGQNAEDADENQPPSWFHEETCSGSCCNETSYDGEQMENIDLDESDSQYSDMDWEEEHFCEFNHEDDTDSSICSMEETDSKLESLSESSHDISEMRLHDIVSSQYADILVEEALQEVEEEKSTCFDAQPHCTNSVLEDTSESIEFVTQETDYPSNDTSSENDQSTSTEEVFQHLINAEDNSRENEKHVDYEVSCVSMVLDEVENSEGHKTSEICEIDESSEDRNASLENDDDNGISQENQIHSSEVPEESTIVVQEQKLSEENQVKGSKLPSTGGSEEQHTGNNRQWGTKRKRPMEEDEEMRKINPRKPNFLPLVIEPEPEKVELKHQMIDERKDAEEWMLDFALRQAVTRLAPAGKRKVSLLVEAFETVMSMPKCEARMKNDSPFAHARPIQACS

SEQ ID NO: 173937 - protein, 111 aa, Glycine max
  Coding DNA Sequence Number=SeqID_57159
  Homolog annotation: Hit_ID=Q1S040; Match level="QueryCoverage=88%, HitCoverage=22%, E-value=4e-33, Identity=72%"; Hit description=IMP dehydrogenase/GMP reductase
MGMKSLSPWSNETRGMYEKLKSHPNPKVSKKARQFMYSFQAMEMMKETTGSQFYLKNSDYQNYFDAFVENKSNYPKDGLVQESAMNQVLPYILFLVSPIFVVLLIAVRKGT

SEQ ID NO: 173938 - protein, 453 aa, Glycine max
  Coding DNA Sequence Number=SeqID_57160
  Gene Ontology: Mol. function=catalytic activity; Cellular component =nucleus; Biological process=metabolic process
  Homolog annotation: Hit_ID=Q9LSQ0; Match level="QueryCoverage=99%, HitCoverage=97%, E-value=0.0, Identity=57%"; Hit description=AMP -binding protein
  Pfam annotation: Domain name=AMP-binding; Domain location=6-391; Score=159.1; E_value=1.2e-44; Accession=PF00501.18; Description=AMP -binding enzyme
MVRVAEDIDQWSKNYTALTPLWFLERAAQVAVIAPNVPALYEAHFGIPMAGAVLNAVNIRLNASTIAFMLGHCSAAAVMVDQEFFYLAEEALKIWSEKAKTFSPPLLIVIGDENCDPKALIYASIALGYTSGTTASPKGVVLHHRGAYLMSLSGALIWGMTDGAVYLWTVPMFHCNGWCYTWALAARCGTNICLRKVTAKAVYEAIAKYKVTHFCAAPVVLNTILNAPPEDTILPLPHVVRVSTGGAPPPPSVLSGMSERGFGVTHVYGLSEVYGPAVYCSWKPEWESLPPETQARLHARQGVRYIGLEYLDVVNAKTMQPVPADGKTVGEVVMRGNAVMKGYLKNPKANEEAFANGWFHSGDLAVKHQDGYIEIKARADKKWGESPCAFVTLKPGVDKSNEQRMIEDVLKFSRAKMPAYWVPKSVVFGALPKTATGKIQKHLLRAKAKEMGP

SEQ ID NO: 173939 - protein, 67 aa, Glycine max
  Coding DNA Sequence Number=SeqID_57161
MGDQLEDMMIHDLGKSFQPDMGEVTKTSLHSLRFKHLSANGDDTKDLRWHVDGTNWDGMLFHLADSS

SEQ ID NO: 173940 - protein, 65 aa, Glycine max
  Coding DNA Sequence Number=SeqID_57162
MIQTAYGNTLQSMRTLDKREEKDWNEELQRGDDTDNSDNDRLGLQSYLKTGVVKHLQHRFSNNRC

SEQ ID NO: 173941 - protein, 435 aa, Glycine max
  Coding DNA Sequence Number=SeqID_57163
  Homolog annotation: Hit_ID=Q942M1; Match level="QueryCoverage=90%, HitCoverage=80%, E-value=2e-75, Identity=42%"; Hit description=STAM binding protein(Associated molecule with the SH3 domain of STAM)- like
MTIDLDSIARRVEVDNRIPIRYYYRIADNLLKQRSRAVLDELESLKPEFKRRVEKMNDSHVKAPFPEENGFNKALQSSVNSSLEWPAVSKQPTAGFSSHSSWNYDNMLSLDSRPIDKQFQKLSLSLPPPNKETLSRHSFLGPNGLRGQWLGPSAEIKRGENERIDIEYSKVDGLDMVQYPSSSDLTHAKDSSLNQAGLYDLGAIKDGDQGPVTSTMDSVLSLDDGSWLRPAVESCSPVVTESREDPLQLLNIKQPLPPPVLAQVYPEHAPIPPSKVADPRPGPAKSSHDSGLGSTTYQHLHIPVKMMEDFLRLASENTRKNLETCGVLAGSLGIPYHNTYNPKAGINFRLVISVVSFQIMLPEAIAIVMAPTDTTSPHGIFHLSDPGGVSVIRNCQQRGFHPHEEPEDGTPIYEHCSHVYMNANLKFDVVDLRER

SEQ ID NO: 173942 - protein, 348 aa, Glycine max
  Coding DNA Sequence Number=SeqID_57164
  Gene Ontology: Mol. function=DNA binding; Cellular component=nucleus; Biological process=regulation of transcription, DNA-dependent
  Homolog annotation: Hit_ID=Q0PJI6; Match level="QueryCoverage=84%, HitCoverage=91%, E-value=1e-116, Identity=71%"; Hit description=MYB transcription factor MYB133
MVSVNPSPAQGFYFFDPSNMALPGVNNLPPPPLPAPPSHAAVEDPSKKIRKPYTITKSRESWTEQEHDKFLEALQFHAQKYFLKVQKKGTSEHVPPPRPKRKAARPYPQKAPKTPTVSQVMGPLQSSSSFIEPAYIYIPDSSSALGTPVTNMPSSSWNYNNTPQPVNVPQVTRDDMGFTVAGQTAPLNCCCSSSNESNPPTWPSSKRINQGDQEPIKVMPDFAQVYSFIGSVFDPNSTNHLQKLRQMDPLNVETLDCLSTLYCAVLQILLLMRNLSINLMSPEFEDHALLDRRYAGVFGVYLSKMMIDLGMQDNESPVRSLLEAKLYSLLSAFVYYAVKLRISIEERC

SEQ ID NO: 173943 - protein, 41 aa, Glycine max
  Coding DNA Sequence Number=SeqID_57165
MADLIRPRPVSFDHALRGTAVTFNFSILYIQDQVYCEGSSL

SEQ ID NO: 173944 - protein, 145 aa, Glycine max
  Coding DNA Sequence Number=SeqID_57166
  Gene Ontology: Mol. function=nucleic acid binding; Cellular component= intracellular
  Homolog annotation: Hit_ID=Q39265; Match level="QueryCoverage=53%, HitCoverage=42%, E-value=2e-11, Identity=44%"; Hit description=Zinc finger protein 6
  Pfam annotation: Domain name=zf-C2H2; Domain location=31-53; Score =20.4; E_value=0.0063; Accession=PF00096.16; Description=Zinc finger, C2H2 type
MKLFGFPLKGSGSISISEDTPCVDDGGGKKFKCRYCRRQFANSQALGGHQNAHRRERAKLAQFKYLLRLQQHDQYHHHRFNQASNASPSVSDASATTSAAALFQFHSAAAAGSSHLGTLLLQVPAGGNDVDLNLRLACSSENLKN

SEQ ID NO: 173945 - protein, 337 aa, Glycine max
  Coding DNA Sequence Number=SeqID_57167
  Gene Ontology: Mol. function=DNA binding; Cellular component=nucleus; Biological process=regulation of transcription, DNA-dependent
  Homolog annotation: Hit_ID=Q9FJ07; Match level="QueryCoverage=69%, HitCoverage=62%, E-value=4e-63, Identity=55%"; Hit description =Similarity to myb-related transcription factor
  Pfam annotation: Domain name=Myb_DNA-binding; Domain location=14-61; Score=44.7; E_value=3.1e-10; Accession=PF00249.21; Description=Myb -like DNA-binding domain
  Pfam annotation: Domain name=Myb_DNA-binding; Domain location=67-112; Score=51.5; E_value=2.9e-12; Accession=PF00249.21; Description=Myb -like DNA-binding domain
  Pfam module annotation: Pfam domain module=Myb_DNA-binding::Myb_DNA -binding; Domain location=14-61::67-112
MGRAPCCEKVGLKKGRWTAEEDKILTDYIQENGEGSWSSLPKNAGLLRCGKSCRLRWINYLRSDVKRGNITPQEEEIIVKLHAVLGNRWSVIAGHLPGRTDNEIKNYWNSHLRRKIYCFMKSLNESLPPIDMAAVNVAAKSKRRTGGRGTKTQPATQEDKKVAHNTSEVPQVQPMLKRSATSQSFNDEESLTDYGLDAYCEMGDNTYDTTASCPSIDEVEALGPYQWLDDEIMKLTRMFENGVLVNPGGVLTNNEEWLIRNNFGLMGEGSSNAESGEWNTSCSSVNSVYDYHHYQWPDMQLEGSVQSYNPWDLCEENQNVANCFWGTGHNEGNGFYQ

SEQ ID NO: 173946 - protein, 336 aa, Glycine max
  Coding DNA Sequence Number=SeqID_57168
  Gene Ontology: Mol. function=nucleic acid binding; Cellular component= nuclear pore; Biological process=DNA integration
  Homolog annotation: Hit_ID=Q1T1E6; Match level="QueryCoverage=58%, HitCoverage=32%, E-value=1e-73, Identity=74%"; Hit description=Zinc finger, CCHC-type; Peptidase aspartic, catalytic
MNLYLAYSSSLKFVPSAKAKTCCIYSPDVDFKETFSPIIKPQTIKLVLCIAISNRWTLSQMDMNNAFLHGTLTEEVYISQPTGFVHPNFPQHVCKLVSNRLRVHAYGFFNSRSDPSLFIYKQGSFAAYFLVYVDDLLLTDVAFVVNKLPQFMKTPTATHIQALKRVLGYLKSTISHGLQLIPAKSLILNAFCYAGDTDDRKSTGAYIVYLGPNAISWSCKKQSTVARSSTEAEYHTIGSTATELLWLQQVLQELGITIQQPSTIFSDNIGPTYLCANPVFHSRMKHLAIDYHFVRDLVPRISSKFPMCPSVTNLQTCSPNLSLPHDTTFSHPRLEL

SEQ ID NO: 173947 - protein, 722 aa, Glycine max
  Coding DNA Sequence Number=SeqID_57169
  Homolog annotation: Hit_ID=Q10MM5; Match level="QueryCoverage=84%, HitCoverage=62%, E-value=2e-78, Identity=34%"; Hit description =Expressed protein
MDSLDIFNRDMRVDVSFTYVSYSFYGFKKMRVEKEGAKNEGRYVGGFFYLFDWTSKSRKKLFAAKSDLPESSKQRRKVDGNMAMMLPYLVDDDEIGVGKCIRESSDHICASSVIDDESCGTRAPGVIGRLMGLDSLPSSSFPDPCSTPYFDSQSLQDVQYWRTEFNHLHDHQILYSGKLIEKAEGSSWKFMEAKPQQTRSRPIEKFQTEVMPPKSAKSIPLTHHKLLSPIKSPGFVPANNATYIMEAAARIIEPGPQATTKDKTPLVASSTVSLRVRDLKEKLEASQKGPLIGSSSLTSRVRDLKEKRETSHRTSRLLEPSQRSAESNDAKYLKGQSFNISWNGSVDTQVRSSSQAEEDSSLKNKGKSISLAIQAKVNVQRREGLSLSRGKSLVEQKEQCDIKTPQQPLKANVKKKLHKKSSGQDASGVLRQNNLKQNCSTDKDKLPSKPLVSNSNSRKVVTGDSSCGHHRSSSSKSIAKSKVGPKKSSMNVTDSEKEVLYTRTNNFPRKKRSTDRDWNDRVVDNLFIDKTQKPVQSNLVSNKQHDGAEEVKSKDMDVVSFTFTTPLTRCNSGFETSGQTGLKTNSLSLDQHIRRVLLDNETDITRFPVGYNAIGGDSLAILLDQKLRELTYGVENSCDDSVKARSPSSTVPKSKDLVPTLNSVNLFQQLQQKKNQDMMCSDKSDKLFSSHECDISFTCLPEISSKHRLWACMEYGQYQDPS

SEQ ID NO: 173948 - protein, 541 aa, Glycine max
  Coding DNA Sequence Number=SeqID_57170
  Gene Ontology: Mol. function=protein transporter activity; Cellular component=nuclear pore; Biological process=intracellular protein transport
  Homolog annotation: Hit_ID=Q94KA9; Match level="QueryCoverage=99%, HitCoverage=98%, E-value=0.0, Identity=89%"; Hit description =Importin alpha 2
  Pfam annotation: Domain name=Arm; Domain location=116-157; Score =48.6; E_value=2.1e-11; Accession=PF00514.13; Description =Armadillobeta-catenin-like repeat
  Pfam annotation: Domain name=Arm; Domain location=159-199; Score =59.4; E_value=1.2e-14; Accession=PF00514.13; Description =Armadillobeta-catenin-like repeat
  Pfam annotation: Domain name=Arm; Domain location=201-242; Score =38.4; E_value=2.5e-08; Accession=PF00514.13; Description =Armadillobeta-catenin-like repeat
  Pfam annotation: Domain name=Arm; Domain location=244-283; Score =33.2; E_value=9.4e-07; Accession=PF00514.13; Description =Armadillobeta-catenin-like repeat
  Pfam annotation: Domain name=Arm; Domain location=285-325; Score =47.8; E_value=3.6e-11; Accession=PF00514.13; Description =Armadillobeta-catenin-like repeat
  Pfam annotation: Domain name=Arm; Domain location=327-368; Score =51.4; E_value=3e-12; Accession=PF00514.13; Description=Armadillobeta- catenin-like repeat
  Pfam annotation: Domain name=Arm; Domain location=370-410; Score =53.7; E_value=5.9e-13; Accession=PF00514.13; Description =Armadillobeta-catenin-like repeat
  Pfam annotation: Domain name=Arm; Domain location=413-453; Score =34.7; E_value=3.2e-07; Accession=PF00514.13; Description =Armadillobeta-catenin-like repeat
  Pfam annotation: Domain name=HEAT; Domain location=122-159; Score =3.0; E_value=19; Accession=PF02985.12; Description=HEAT repeat
  Pfam annotation: Domain name=HEAT; Domain location=165-201; Score =28.3; E_value=2.7e-05; Accession=PF02985.12; Description=HEAT repeat
  Pfam annotation: Domain name=HEAT; Domain location=250-285; Score =10.3; E_value=2.4; Accession=PF02985.12; Description=HEAT repeat
  Pfam annotation: Domain name=HEAT; Domain location=291-327; Score =11.6; E_value=1.7; Accession=PF02985.12; Description=HEAT repeat
  Pfam annotation: Domain name=HEAT; Domain location=332-370; Score =4.6; E_value=12; Accession=PF02985.12; Description=HEAT repeat
  Pfam annotation: Domain name=HEAT; Domain location=376-412; Score =5.2; E_value=10; Accession=PF02985.12; Description=HEAT repeat
  Pfam annotation: Domain name=HEAT; Domain location=419-455; Score =0.3; E_value=40; Accession=PF02985.12; Description=HEAT repeat
  Pfam module annotation: Pfam domain module=Arm::Arm::Arm::Arm::Arm::Ar m::Arm::Arm::HEAT::HEAT::HEAT::HEAT::HEAT::HEAT::HEAT; Domain location=116-157::159-199::201-242::244-283::285-325::327-368::370 -410::413-453::...
  Pfam module annotation: Domain location=122-159::165-201::250 -285::291-327::332-370::376-412::419-455
  Subcellular localization annotation: CTP_CleavageSite=33; ConfidenceScore=5.69e-01
MPEPRFAATVTRSPLTPTRAAGEERTTWSRSARASAKRVCSRSVAKASKLTNSFPLLFRTPLSTKMVRSHGLLGFWMLVPVMLESLPAMVAGVWSNDNSLQLEATTQFRKLLSIERSPPIEEVIQAGVVPRFVEFLVREDFPQLQFEAAWALTNIASGTSENTKVVIDHGAVPIFVKLLSSPSDDVREQAVWALGNVAGDSPRCRDLVLSHGALVPLLAQLNEHAKLSMLRNATWTLSNFCRGKPQPPFEQVRPALPALERLVFSNDEEVLTDACWALSYLSDGTNDKIQAVIEAGVCPRLMQLLMHPSPSVLIPALRTVGNIVTGDDMQTQCIINHGALPCLLNLLTNNHKKSIKKEACWTISNITAGNKEQIQTVIEAGLVAPLVNLLQSAEFDIKKEASWAISNATSGGTHDQIKYLVSQGCVKPLCDLLVCPDPRIVTVCLEGLENILKVGEAEKSLGNTGDVNVYAQMIDEAEGLEKIENLQSHDNNEIYEKVVKILETYWLEEEDETLPSGNGAQPGFNFGNNELPVPSGGFNFS

SEQ ID NO: 173949 - protein, 281 aa, Glycine max
  Coding DNA Sequence Number=SeqID_57171
  Gene Ontology: Mol. function=protein serine/threonine kinase activity; Cellular component=membrane; Biological process=protein amino acid phosphorylation
  Homolog annotation: Hit_ID=Q10SE3; Match level="QueryCoverage=82%, HitCoverage=48%, E-value=3e-87, Identity=63%"; Hit description =Protein kinase domain containing protein, expressed
  Pfam annotation: Domain name=Pkinase; Domain location=1-217; Score =3.6; E_value=8.9e-09; Accession=PF00069.15; Description=Protein kinase domain
  Pfam annotation: Domain name=Pkinase_Tyr; Domain location=4-217; Score=-39.7; E_value=4.9e-10; Accession=PF07714.7; Description =Protein tyrosine kinase
  Pfam module annotation: Pfam domain module=Pkinase::Pkinase_Tyr; Domain location=1-217::4-217
MAPRGQAEREFKVEVEAIGRVRHKNLVRLLGYCVEGAYRTVAAWGCWTLVFVYLFRLAYLHEGLEPKVVHRDVKSSNILIDRQWNPKVSDFGLAKLLSADHSYVTTRVMGTFGYVAPEYACTGMLTEKSDVYSFGILIMELITGRSPVDYSKPQGEVNLIEWLKSMVGNRKSEEVVDPKIAEKPSSKALKRALLVALRCVDPDAAKRPKIGHVIHMLEAEDLLFRDDRRTGGESSRSHRDYQLEHKDSKLDKRQIGGEITDQSEDDSTTSSRLHPQPHRSR

SEQ ID NO: 173950 - protein, 158 aa, Glycine max
  Coding DNA Sequence Number=SeqID_57172
  Gene Ontology: Mol. function=sequence-specific DNA binding; Cellular component=nucleus; Biological process=regulation of transcription, DNA-dependent
  Homolog annotation: Hit_ID=Q9FJ10; Match level="QueryCoverage=78%, HitCoverage=76%, E-value=5e-20, Identity=44%"; Hit description =Putative GATA transcription factor 23
  Pfam annotation: Domain name=GATA; Domain location=39-102; Score =38.6; E_value=2.1e-08; Accession=PF00320.17; Description=GATA zinc finger
MVDPTGKGSEIEVEDSNSNPNAPSSGNSPSSNNEQKKTCADCGTTKTPLWRGGPAGPKVSSPSISQIAPRGVKPTLDLTLCYPFFQSLCNACGIRSRKKKRAILGINKGSNEDGRKGKRTGGALGKEVLLHRSHWKKLGEEEKAAVLLMSLSYGSVYA

SEQ ID NO: 173951 - protein, 278 aa, Glycine max
  Coding DNA Sequence Number=SeqID_57173
  Gene Ontology: Mol. function=hydrolase activity, acting on acid anhydrides, catalyzing transmembrane movement of substances; Cellular component=integral to membrane; Biological process=copper ion transport
  Homolog annotation: Hit_ID=Q9SH30; Match level="QueryCoverage=81%, HitCoverage=26%, E-value=2e-67, Identity=47%"; Hit description =Putative copper-transporting ATPase 3
  Pfam annotation: Domain name=HMA; Domain location=173-237; Score=3.0; E_value=0.9; Accession=PF00403.16; Description=Heavy-metal-associated domain
  Pfam annotation: Domain name=HMA; Domain location=98-162; Score=53.7; E_value=6.2e-13; Accession=PF00403.16; Description=Heavy-metal -associated domain
  Pfam module annotation: Pfam domain module=HMA::HMA; Domain location =173-237::98-162
MMNDSISFHVGLSNGSIRVPQITLKINIHAPQITLKIKVKQASKTKKKITQKDAVQSNATNLDKPPEKEETIREVIEDAGFQATFIRDDNETSVQICRIRIQGMTCTSCSSTVESALQSIQGVVKAQVALATEEAEVHYTPNVVTYNQILEAVEDTGFQATLISTGEDMSRIDLQVEGIRTGRSMRLIENSLQALPGVQGVETHPEFNKVSLSYKPDLTGPRNFINVIEETGSRRFKAKIFPEEGGRRNSHRREEIRQYYRSFLWSLVFTIPVFLTSM

SEQ ID NO: 173952 - protein, 71 aa, Glycine max
  Coding DNA Sequence Number=SeqID_57174
MTQPPMLRTCYLNMRVFGSKTMVVIVTPLPGWKDETCLLPTNQYSNKVGSLGMIHALVVFALRLSSGVPCP

SEQ ID NO: 173953 - protein, 233 aa, Glycine max
  Coding DNA Sequence Number=SeqID_57175
  Gene Ontology: Mol. function=nucleoside-triphosphatase activity; Cellular component=chloroplast
  Homolog annotation: Hit_ID=Q2PMM5; Match level="QueryCoverage=100%, HitCoverage=10%, E-value=1e-135, Identity=100%"; Hit description =Protein ycf2
MVERKNPYLTRLLTIPMNSIGPKNDTLEESSESSNINRLIVPLLYLPKGKKISESYFLDPKESTRVLPITKKYIMPESNWGSRWWRNWIGKKSDSSCKISNETIAGIEISFKEKDIKYLEFLFVYYMDDPIRKDHDWEFFDRLSPRKRRNIINLNSGQLFEILVKDWIYYLMFAFREKIPKEVEGFFKQQGTGSIIQSNDIEHVSHLFLRNKRAISLQNCAQFHMWQFRQDLF

SEQ ID NO: 173954 - protein, 68 aa, Glycine max
  Coding DNA Sequence Number=SeqID_57176
MSRNFTDYETIPSSTSGMLRNFADCALTLPFNSRHVAELHGLPNDGCQVPQSGQARVASHKQMVPGRN

SEQ ID NO: 173955 - protein, 337 aa, Glycine max
  Coding DNA Sequence Number=SeqID_57177
MKRTRKVTCLRSLATRPVGAEKPLVHVDPATGKADSPHIKKLRTYLGIVARDKFKSDLTSKWALAADKDSVDDIVCEKDPSWEEVQKKAWAIQKQNITPHVLSREGYEFLEKNLMDERKKKQLQEATKFGSTDTMIDPPSPIRRHVKWKMVRTKKTDRMTFEATEKIADKIVRSQGSFVAHGRQDVLTVAIRRPEHLGRVRTIGAGVTIKQYFGPAPRTTRTSSSMTLEDLDQMQSQFQSHMQSQGLILTPELEVGPSVARVNTKESCVDPSGNDLDTGDSEKCGLYVEENPPCLVALGILYEGSTTVHNIPLCHDQDKLVLRKLEMQMLPFLYPLK

SEQ ID NO: 173956 - protein, 123 aa, Glycine max
  Coding DNA Sequence Number=SeqID_57178
MAEKYPRLYSVLLQQHQLIRSVGVYQGVGWEWNFAWRRALFDNEITSAANFLRDIAENKIQQQGEEARNNSEEECFEKLWRIKVPASKVQPIWWETMSWMQVKGAFPLSPKQHFLLHLGVQPA

SEQ ID NO: 173957 - protein, 76 aa, Glycine max
  Coding DNA Sequence Number=SeqID_57179
  Subcellular localization annotation: CTP_CleavageSite=36; ConfidenceScore=5.04e-01
MRDSLPNTSSRSSQDPNTTTYRESLSLSKIIGRPVRVTMFCENAPTIWNQHRLKGALKPGDPQGLHSEESVRASPS

SEQ ID NO: 173958 - protein, 94 aa, Glycine max
  Coding DNA Sequence Number=SeqID_57180
  Subcellular localization annotation: CTP_CleavageSite=55; ConfidenceScore=5.33e-01
MPPPPLEPHNHSQTHLKLSGRLPLQASFSTGGLVGACTLSATLDRLACISEFRLSAHLLAQRMDSSGALSGMSPRSANTHTTQPKEWCAQQMPR

SEQ ID NO: 173959 - protein, 423 aa, Glycine max
  Coding DNA Sequence Number=SeqID_57181
  Homolog annotation: Hit_ID=Q1SLB1; Match level="QueryCoverage=31%, HitCoverage=27%, E-value=1e-24, Identity=38%"; Hit description=RNA -directed DNA polymerase
DLGIDVQSFCKKVEARDNIEGFKGKTYTKRGCLTTQGSLEATKMSFEQDGHNEETEQSRKQGEGIKCDGYETVGNTQIQTFACEVQEDVREIMGLDPKLMGWGQVVQHDLSQPGAIALLMRQNSGASVVALNLVFKVERHKVVRSASLDFCDNMSDGCIMNCNNLLRIRDEMQQAGKVWDVGMKLKVSSKGHNVTIVIVYFPYDLEAKWRQGESVVDYGRGESLEFNNFINDLELDLLLLVETSLGLGLMEKLEAVWDCGSSKSPRLDSFNFKFIMKFWEVLKEDMLPFYMLRRLGFNETRVIWIKGCLASSSVSILINGRPTKEFMLQKGLRQGDPLAPFLFNIVGKGLSGLMRETTSKNLFSGFKLASRLKVIFLKSRFGAIGVDGEAIEKYARYLNCRILNLPFMYLGLPNGVNSRKVET

SEQ ID NO: 173960 - protein, 189 aa, Glycine max
  Coding DNA Sequence Number=SeqID_57182
  Gene Ontology: Mol. function=lipid binding; Cellular component =integral to membrane; Biological process=cell division
  Homolog annotation: Hit_ID=Q56Z59; Match level="QueryCoverage=81%, HitCoverage=31%, E-value=5e-38, Identity=48%"; Hit description =Patellin-3
  Pfam annotation: Domain name=CRAL_TRIO_N; Domain location=53-125; Score=40.1; E_value=7.7e-09; Accession=PF03765.5; Description =CRALTRIO, N-terminus
MAQNDSNPTPPQEPHVVVVVAVEPIIEDLVQDKEEENDKRVLVIEGGSNRVFDSEKNAIDELKKLLKEELEDEEVSIWGVPLLKDDRTDIILLKFLRARELKVKGALVMFQNTLRWRKDFNIDVLLDEDLGDDLEKVVFMHGHGREGHPVCYNVYGEFQNKDLYHKAFSSQDNRNKFLQWHIQLLERSI

SEQ ID NO: 173961 - protein, 283 aa, Glycine max
  Coding DNA Sequence Number=SeqID_57183
  Homolog annotation: Hit_ID=Q9FGP9; Match level="QueryCoverage=31%, HitCoverage=19%, E-value=8e-14, Identity=45%"; Hit description =Arabidopsis thaliana genomic DNA, chromosome 5, TAC clone:K8E10
MGYECQQGSFWPLGFFMKSCSMLHNRILADPAFLFKIGSEFSYVTRLSSIHVVLRLMKFKKRGKDFWVEFELYLADLLVGLVVNVALVGMLAPYARSLFIHILLDYRHKYRSLFIHPTPFPHTTCVKAFGLNHISAIGLVDHLIDHKDIRRRHTCATTCEECFSLGFVPPELPKPVVGINFARDGMQEKDSENNCTQNINLLDVITFSLKDDFGFPVSGPLYKLLLKKEKAHGMDINYVRWSPWHFGDIAAAKDLVHNGKLAEIILVPSLVGIRFPVWWYMLA

SEQ ID NO: 173962 - protein, 94 aa, Glycine max
  Coding DNA Sequence Number=SeqID_57184
MALHLIPLSYSFKLATLNFVLCHLYLHFEEREDTLNTIGQGTNDILGQPEDVHLEDYCIVLNCKMFHSVATNQLPPKHQRISLKRIAHQAGKVT

SEQ ID NO: 173963 - protein, 93 aa, Glycine max
  Coding DNA Sequence Number=SeqID_57185
  Homolog annotation: Hit_ID=Q8H6Q8; Match level="QueryCoverage=98%, HitCoverage=2%, E-value=2e-09, Identity=34%"; Hit description=CTV.20
MEPEYWDKNPFKATAKVFPPGFHYRPSTLNKTKKFYEFILIDTNSVSMKHFKDPKDPNLNTHSTIQILKVMQPRHYGSNLNQPKKFSAPFDLA

SEQ ID NO: 173964 - protein, 1098 aa, Glycine max
  Coding DNA Sequence Number=SeqID_57186
  Homolog annotation: Hit_ID=Q016V2; Match level="QueryCoverage=36%, HitCoverage=29%, E-value=1e-19, Identity=24%"; Hit description=[S] KOG4732 Uncharacterized conserved protein
  Pfam annotation: Domain name=RPAP1_C; Domain location=38-90; Score= -6.9; E_value=0.00023; Accession=PF08620.1; Description=RPAP1-like, C- terminal
MACLRALSRLCPLPPCIVPQITILFCFMSGLKFWYDNVNERDYLRTEGDPGASGYTIKEAVALTRSVIPGQRALALHLLSSVLDKALHYICKDRTGYMTKNENKVDKSVDWEAVWAFALGPEPELVLSLRICLDDNHNSVVLACTKVVQSVLSYDANENYCDMSEKIATCDMDICTAPVFRSRPDINDGFLQGGFWKYSAKPSNILPFSDDSMDNETEGKHTIQDDIVVAAQDFTVGLVRMGILPRLRYLLEKDPTTALEECIISILIAIARHSPTCANAVLKCERLVQTIVNRFTADNFELRSSMTKSVKLLKEVISTSAARESFLMFHLILEKVFARLDQKTCLEFIKKGYFQAMTWNLYQSPSSVDHWLRLGKEKCKLTSALIVEQMRFWRVCIQYGYCVSYFLEMFPALCFWLNPPSFEKLVENDVLDESTSISREAYLVLESLAGRLPNLFSKQCLNNQLPESAGDTEVWSWNYVGPMVDLAIKWIASRSDPEVSKFFEGQKEGRCDFPFRDLSATPLLWVYAAVTRMLFRVLERMTWGDTISSFETEGHVPWLPEFVPKIGLELIKYWFLGFSASFGAKFGRDSEGESFMKELVYLRQKDDIEMSLASTCCLNGMVKIITTIDNLILSAKAGICSLPRQEQSLSKEGKVLEDGIVNGCLVELRYMLDAFMFSVSSGWHHIQSIESFGRGGPVPGAGIGWGAPSGGFWSATFLLAQIDAKFLVSLLEIFENASKGVVTEETTFIIQRVNAGLGLCLTAGPREKVVVEKALDLLFHVSVLKNLDLCIHNFLFNRRGRTFGWQHEEEDYMHLRRMLSSHFRSRWLSVKVKSKSVDGSSSSGIKTSPKVGACLETIYEDSDMSSMTSPCCNSLMIEWAHQKLPLPVHFYLSPISTIFHSKRAGTKKVDDVLHDPSYLIEVAKCGLFFVLGVEAMSIFHGTDIPSPVEQVSLTWKLHSLSVNFLVGMEILEQDRSRVTFEALQDLYGELLDKARLNQSKEVISNDKKHLEFLRFQTEIHESYSTFLEELVEQFSAVSYGDVIFGRQVSLYLHRYVETSIRLAAWNTLSNARVLELLPPLEKCFSGAEGYLEPAEHLS

SEQ ID NO: 173965 - protein, 213 aa, Glycine max
  Coding DNA Sequence Number=SeqID_57187
  Homolog annotation: Hit_ID=Q1S7C5; Match level="QueryCoverage=27%, HitCoverage=4%, E-value=8e-11, Identity=50%"; Hit description =Integrase, catalytic region
MAANQNSTSATPTFHLISQKLDDSNFLLWRQQVEPVIKSHKLQRFVMNPQIPMRFLTEADYPILPREHLDVILEGRPEEYSPMISVIKSNFEPLPIGEVEMLLLVHEARMKKFQKRLVDSPLINVAQGYNSSSNSYSSSSNNFISQNRSNYSGNRGGGHRGGGRDRGGRYANFQCQVCYKFGHTAAMYHYRYDSEYLSRQFVEHLWFRTESGN

SEQ ID NO: 173966 - protein, 246 aa, Glycine max
  Coding DNA Sequence Number=SeqID_57188
  Gene Ontology: Mol. function=nucleic acid binding; Biological process= DNA integration
  Homolog annotation: Hit_ID=Q1S7C5; Match level="QueryCoverage=55%, HitCoverage=13%, E-value=2e-33, Identity=48%"; Hit description =Integrase, catalytic region
  Subcellular localization annotation: CTP_CleavageSite=22; ConfidenceScore=5.63e-01
ILLQATCLLSNSSVDSVVNPVSSSSNAQISDSIVNPVSHAMSDAKTAPSTSSQTIWHLRLGHPNANLVVLFQVPYPVLFNKSPDYTFLRNFGCSCYPFLRPYNKHKLEFRSHECLFLGYSTSHKGYKCLSPNGKLYVSKDVVFNELKYPYNDVFPSLSNSVTPSKSNFLPTAHIPIVSPSPNEPSLPSQTAETNPPSINADPPIPLNAESTNSQNVTLSSPFLNAEPTSVNDEHSNTVSDFKQRFK

SEQ ID NO: 173967 - protein, 403 aa, Glycine max
  Coding DNA Sequence Number=SeqID_57189
  Pfam annotation: Domain name=RPAP1_N; Domain location=244-292; Score =60.4; E_value=5.9e-15; Accession=PF08621.1; Description=RPAP1-like, N-terminal
MGNSMHRVIEGWVGMAFDGEGITSLVSWWQQFNEMQHWRPLSSKGNDDGEGDDNVEDEEDKNFQEFEKVSAFAMPVQRRRKKGLDFRKWKEITRDDSSSMGKETEEDVSSFSQTTGKKNKKGSKSTYKKTSSSDDNVISPMKVDTKPLLDNSDGGFINSTTTMEVDTSNKVNHQAKVKYTRIFDDKGQNESVPGLDQISSDRMADYNFGSLDLQRPGQTDLTSSMRSCPSSNSIRSEKESVSLESEIDAENRAQIQQMSAEEIAEAQAEIMEKMSPALLKALQKRGQDKLKKLKSEVGTGSDSVNGHVQSPQDAKHLHTEDGITQTVIAPPSKEKLDDEKISTKTSTTASSSAWNAWSNRVEAVRELRFSLAGDVVDSERVSVYGMCFYLLMFLFYLLVLISR

SEQ ID NO: 173968 - protein, 174 aa, Glycine max
  Coding DNA Sequence Number=SeqID_57190
MARNGERKNSGLGEKMEGDTLFHDGTNQVKGIVLVYLEGARVHHLLLGLLSSFALLILHCTTHWTNATQEEAKQNRKSQRGKKKSETLEGNILGMGCLPGDFLPAPAMFFIHPAIMVRTRGLRWGLGRALGREKHTELKLASHGRKVEKLGRSIPQIEGLVVDTSLSSFFTQGN

SEQ ID NO: 173969 - protein, 226 aa, Glycine max
  Coding DNA Sequence Number=SeqID_57191
MYPKCTLCILKLDTKDCTKYLGSSLQNKPMFPFQDIFQSSILFPGKHAQISQSGRVKLEEDSIYSSQLTAPITLDQESSSCALSLLSDQSQYLSHHAACNPLTSHRVFSGICIPNRDGQISETPLRISSADKHAPNESFPCNTTSKEVIKNRSAATFSNTGHALRVHHGDDICQPSELLDVKHHFSSEHAATVDLFQLSSHLQRVEQQRNSVLVKWENEDYCFPTV

SEQ ID NO: 173970 - protein, 94 aa, Glycine max
  Coding DNA Sequence Number=SeqID_57192
MQDFIEDIVDVKADDNCGYRVNMDKYMNIINMSDVITSKYNDILVSLSLQQSMTFFLLRSQPSRDSFVHCIICIGHVYDNHFVQVFLRDGCPMP

SEQ ID NO: 173971 - protein, 158 aa, Glycine max
  Coding DNA Sequence Number=SeqID_57193
  Homolog annotation: Hit_ID=Q1T344; Match level="QueryCoverage=50%, HitCoverage=28%, E-value=4e-07, Identity=33%"; Hit description=RNA polymerase, RBP11-like
MDEDKWIYESIMSKEINMNEDTRDKLVVVENIDCFDVFNTSQRTGKYRAYKKDLVPMVTSTRKYGCPFKLRAKPVPGGEWWMVKLICETHNHTLTKSLSGHPYVGRLTKDEKIILGDMTKSMGSLVDCPTKIEYDDCLTKFEIACSLWLMFVDYVKDT

SEQ ID NO: 173972 - protein, 278 aa, Glycine max
  Coding DNA Sequence Number=SeqID_57194
  Gene Ontology: Mol. function=metal ion binding; Cellular component =nucleus; Biological process=regulation of transcription, DNA -dependent
  Homolog annotation: Hit_ID=Q94JW8; Match level="QueryCoverage=65%, HitCoverage=42%, E-value=2e-48, Identity=54%"; Hit description =Squamosa promoter-binding-like protein 6
  Pfam annotation: Domain name=SBP; Domain location=180-258; Score =186.3; E_value=7.5e-53; Accession=PF03110.5; Description=SBP domain
MESWSYVPEEKGYLFSDEMEFSLDAFMRSRKALVEWDNKSNFVERDGFNSDREVVKSMEFVDLGFPDLLQKSFHGSLPLETSSYELDSNNSSKRGNSSTHVIALDSSMGEEESNSKHLSSLVESKTQDSSLIDLKLGRLADCKGASSDKVEKEGFTLTSIHPTTLSKRARTSSLPAQAPVCQVYGCNMDLSSSKDYHKRHKVCDAHSKTAKVIVNGIEQRFCQQCSRFHLLVEFDDGKRSCRRRLAGHNERRRKPQFDYMTGKQHKILQSYQGMKNAF

SEQ ID NO: 173973 - protein, 126 aa, Glycine max
  Coding DNA Sequence Number=SeqID_57195
MMAHQSDSNTQEETDTVPQVHEGRPKRGTTCPVHLKNYVTPESKKGITNSCSKVLTKLVFQDSMTSQLQFSPTKSSTQQSIQKYQGNVSSSGRTSIKSYLSICKITSSKSSKATDDVANKPRTSIS

SEQ ID NO: 173974 - protein, 48 aa, Glycine max
  Coding DNA Sequence Number=SeqID_57196
MLWLVLNEKIPEEERAITMNNEKLDRLQVAMVHYLPTLATFKAALRWK

SEQ ID NO: 173975 - protein, 76 aa, Glycine max
  Coding DNA Sequence Number=SeqID_57197
MDYLILNMNSHDDGFPFSIEDTVLIIHGAVLHVPYACTRSTLREFRRCFLKKRIIDVREESRVQEWDFKNFKVKRG

SEQ ID NO: 173976 - protein, 65 aa, Glycine max
  Coding DNA Sequence Number=SeqID_57198
MALCWCLGEGERKKYKNTSSNITTKSEKGEIKGSHNIKDAASQGHHKNEKARSNDEILYIHKSIA

SEQ ID NO: 173977 - protein, 203 aa, Glycine max
  Coding DNA Sequence Number=SeqID_57199
  Gene Ontology: Mol. function=DNA binding; Cellular component =mitochondrion
  Homolog annotation: Hit_ID=Q2QPI7; Match level="QueryCoverage=78%, HitCoverage=28%, E-value=2e-21, Identity=37%"; Hit description =Pentatricopeptide, putative, expressed
  Pfam annotation: Domain name=PPR; Domain location=159-193; Score =27.9; E_value=3.5e-05; Accession=PF01535.11; Description=PPR repeat
MAHCSLFLSLRRNSGLACLLNRTRFVSSGAVSSDLVEESVEGVDDDLRSRIFRLRLPKRSATNVLQKWVLQGNPVTLSQLRDISKELRRSQRYKHALETIATYAVPIAVTISEWMVSHEEYELSDSDYAARIDLTTKVFGIDAAERYFEGLPLATKTAETYTALLHSYAGAKLTKKAEELYQRIKDSNLSFDALTYNEMMTLY

SEQ ID NO: 173978 - protein, 74 aa, Glycine max
  Coding DNA Sequence Number=SeqID_57200
MMKNVEEKALKKKLEEVDSCLASKFRLSVQLAQRAAQAQRTVSLSVQPWLSVRRPTRKPKACLAYKYALSTKSA

SEQ ID NO: 173979 - protein, 150 aa, Glycine max
  Coding DNA Sequence Number=SeqID_57201
  Gene Ontology: Mol. function=peroxidase activity
  Homolog annotation: Hit_ID=Q01FV5; Match level="QueryCoverage=51%, HitCoverage=20%, E-value=3e-11, Identity=39%"; Hit description=[C] KOG2873 Ubiquinol cytochrome c reductase assembly protein CBP3
MLRRWSKAVTPISKFGSQQSHLNFVKDVTRQSYAGVAPAPTTIEDKPQPPVQEGNEGVEFGQYLYEIYNHDVELRVSKAGVNLLLTKWMKELEKIFYGNIVAYDTAILPEAKPGDFSNVIWRNIFSEDGSSTPDAAASQSVQTFGMGLFP

SEQ ID NO: 173980 - protein, 617 aa, Glycine max
  Coding DNA Sequence Number=SeqID_57202
  Gene Ontology: Mol. function=tRNA-pseudouridine synthase activity; Cellular component=ribonucleoprotein complex; Biological process =rRNA processing
  Homolog annotation: Hit_ID=Q9LD90; Match level="QueryCoverage=64%, HitCoverage=70%, E-value=0.0, Identity=87%"; Hit description=H/ACA ribonucleoprotein complex subunit 4
  Pfam annotation: Domain name=DKCLD; Domain location=74-132; Score =141.6; E_value=2.1e-39; Accession=PF08068.2; Description=DKCLD (NUC011) domain
  Pfam annotation: Domain name=PUA; Domain location=323-396; Score =95.8; E_value=1.3e-25; Accession=PF01472.10; Description=PUA domain
  Pfam annotation: Domain name=TruB_N; Domain location=136-273; Score =233.9; E_value=3.5e-67; Accession=PF01509.9; Description=TruB family pseudouridylate synthase (N terminal domain)
  Pfam module annotation: Pfam domain module=DKCLD::PUA::TruB_N; Domain location=74-132::323-396::136-273
MGVAGSDCREKEGKEVVSRKAPIASALKPKAAECCRGMSESDTKKKKQQQRSGGKHEGEEGLMIKPQSFTPPIDTSQWPILLKNYERLNVRTGHYTPIPSGYSPLKRPLSEYLKYGVLNLDKPANPSSHEVVAWIKRLLRVEKTGHSGTLDPKVTGNLIVCIDRATRLVKSQQGAGKEYVCIARLHSAVPDISKVSRALETLTGAVFQRPPLISAVKRQLRIRTIYESKLLEYDPDRHLVVFWISCEAGTYVRTMCVHLGLLLGVGSHMQELRRVRSGIMGEKDNMVSMHDVMDAQWVYDNYRDETYLRRVVMPLEILLTSYKRLVVKDSAVNAICYGAKFMIPGLLRFENDIDVGEEVVLMTTKGEAIALGIAEMTTAVMATCDHGVVAKIKRVVMDRDTYPRKWGLGPRASMKKRLISEGKLDKHGKPNEKTPQEWLRNLVLPTGGDSMIAGLAAAPEPEDDKLQKKEEGDGEGKKRKKHESTDSLVAVPAKKAKVVDEVEELEKLEKVKVKKVDEETVEVEVEKKEKKKKKKKDKENSEVASSDEEKTEKKKNKNKIEDGSPELDKSEKKKKKKKDKAAAAAAEISNGKVDDSNADKSEKKKNKKKKNKDAKEE

SEQ ID NO: 173981 - protein, 403 aa, Glycine max
  Coding DNA Sequence Number=SeqID_57203
  Gene Ontology: Mol. function=zinc ion binding; Cellular component =integral to membrane; Biological process=ubiquitin cycle
  Homolog annotation: Hit_ID=Q1SGA9; Match level="QueryCoverage=99%, HitCoverage=100%, E-value=8e-64, Identity=41%"; Hit description=Zinc finger, RING-type; RINGv
  Pfam annotation: Domain name=PHD; Domain location=180-225; Score=2.2; E_value=0.034; Accession=PF00628.19; Description=PHD-finger
  Pfam annotation: Domain name=zf-C3HC4; Domain location=181-222; Score= 40.2; E_value=7.2e-09; Accession=PF00097.15; Description=Zinc finger, C3HC4 type (RING finger)
  Pfam module annotation: Pfam domain module=PHD::zf-C3HC4; Domain location=180-225::181-222
MGLHHHHHRKLMPLPEKICGLICHVKKSEPCSSDCKVCLKICLTNPQYPSFYYSPPPPQVPPFQSYDDVVDGADQAYNHKISTYLFLALALLTAAFFVVSCRAIYTRFSSRRRVSSPSTSRRQTQTHHDDDDFVDDEEHHGRMVDHPIWYIRTLGLQQSIINAITVCKYKKGEGLIEGTDCAVCLSEFQEDENLRLLPKCQHAFHLPCIDTWLRSHTNCPMCRAPIVAEIESSSFVDSNSLENSHMEVLENSAPGGSELMNNNRVEEVGQLEEVVDDDGVRVCETETPVEDVAASIRPRRSFSLDSFSVANFNLALATAESYGNSKRVQGGVDDIDDPTASKGVIGNYLATSSKGSSSFRLTRYLQQGIPSSSVKRSQSFNGKYLLSRYGRSQKKPNAPLRSF

SEQ ID NO: 173982 - protein, 148 aa, Glycine max
  Coding DNA Sequence Number=SeqID_57204
MSLVKYIDMRPLHALVPPSNNDPHHQITNRNANTPPWHKHSVQTPPPSEEGYGDGGCELQCERGLPLLLNVGSSRGFTLQDEGLVEVDKFEGFFGKGIERLRFLSDRVLEGGKVGGEGGEEVGAFGENGFLRFEFIEELVDPVAIGEC

SEQ ID NO: 173983 - protein, 147 aa, Glycine max
  Coding DNA Sequence Number=SeqID_57205
  Homolog annotation: Hit_ID=Q5W7C9; Match level="QueryCoverage=90%, HitCoverage=61%, E-value=1e-48, Identity=78%"; Hit description =Unknow protein
MDKRLVGLHEGFVYNKEAISNATRISWRVRSCLRKNAGGMPYTCKSDGRWCFQWRTATLGVRHGPDSYGRQQWGIFRNGRKPDGAMPREGRRPTASANSVPAAAVRQRMQALSGMIGRKASVGGFLSSPSNPRAQPWTGGGNYQAGV

SEQ ID NO: 173984 - protein, 88 aa, Glycine max
  Coding DNA Sequence Number=SeqID_57206
MLHSAAAINEGGEAYLDGRSGGDVSTEAANARKMNQQVAEMSSNAHAQEEKKPIEVISIELCKPVKLTISSVQGRFTCIAVLEVNQTR

SEQ ID NO: 173985 - protein, 281 aa, Glycine max
  Coding DNA Sequence Number=SeqID_57207
  Gene Ontology: Mol. function=RNA-directed DNA polymerase activity; Cellular component=chromatin; Biological process=chromatin assembly or disassembly
MVDATRSKTNVDHWEDAFAKLSSSMTAKIDELLHCITQLETSHASSHIPSPFPRSSSAPTTNPANYLKLEVPRFDGSNPEGWIFKITQFFEYHATPYHDRLTIASFYMEGFALAWLSPIIRREVQVMQPHSLAQEVSFVKIHEKLLDSRHPSVRPPPTPTISFPSRSLPPPSTNPLEPPLLPASAKPHSTTIPFKRLSPTELAIRREKDLCFNCDEKYSQGHKCTSSLFLFVTKEDECLQDSDPLPRRQLLLLLLRTRHRRRSVSMHFQATGLWKLYVSPT

SEQ ID NO: 173986 - protein, 564 aa, Glycine max
  Coding DNA Sequence Number=SeqID_57208
  Gene Ontology: Mol. function=cysteine-type endopeptidase activity; Cellular component=endoplasmic reticulum; Biological process =proteolysis
  Homolog annotation: Hit_ID=Q1SPP4; Match level="QueryCoverage=94%, HitCoverage=95%, E-value=1e-107, Identity=55%"; Hit description =Peptidase C1A, papain
  Pfam annotation: Domain name=Inhibitor_I29; Domain location=274-331; Score=97.5; E_value=4e-26; Accession=PF08246.2; Description =Cathepsin propeptide inhibitor domain (
  Pfam annotation: Domain name=Peptidase_C1; Domain location=361-563; Score=341.1; E_value=1.9e-99; Accession=PF00112.13; Description =Papain family cysteine protease
  Pfam annotation: Domain name=Peptidase_C1; Domain location=78-242; Score=100.9; E_value=3.8e-27; Accession=PF00112.13; Description =Papain family cysteine protease
  Pfam module annotation: Pfam domain module=Inhibitor_I29::Peptidase _C1::Peptidase_C1; Domain location=274-331::361-563::78-242
MSCYEERRSEESSRIEMGRGMSRKQRRCGDKSFNLSTNQFADLHDEEFKALLTNGHKKEHSLWTTTETLFRYDNVTKIPASMDWRKREQELVDFVKGESEGCYGDYVEDAFKFITKKGRIESETHYPYKGVNNTCKVKKETHGVAQIKGYKKVPSKSENALLKAVANQLVSVSVEARDSAFQFYSSGIFTGKCGTDTDHRVALASYGESGDGTKYWLAKNSWGTEWDVVTLTRSSQEAANQINRKDTHWEVLFLVLTVWISRVMSRGLITSERHEKWMAQYGKVYKDAAEKEKRFQVFKNNVQFIESFNAAGDKPFNLSINQFADLHDEEFKALLNNVQKKASRVETATETSFRYENVTKIPSTMDWRKRGAVTPIKDQGYTCGSCWAFATVATVESLHQITTGDSEGCRGGYVENAFEFIANKGGITSEAYYPYKGKDRSCKVKKETHGVARIIGYESVPSNSEKALLKAVANQPVSVYIDAGAIAFKFYSSGIFEARNCGTHLDHAVAVVGYGKLRDGTKYWLVKNSWSTAWGEKGYMRIKRDIRAKKGLCGIASNASYPIA

SEQ ID NO: 173987 - protein, 250 aa, Glycine max
  Coding DNA Sequence Number=SeqID_57209
  Homolog annotation: Hit_ID=Q67UT0; Match level="QueryCoverage=17%, HitCoverage=10%, E-value=2e-08, Identity=60%"; Hit description =Putative serine/threonine protein kinase
MDKIASSLSLELLKEPDSDALSVSQRLNMSFSHIIPAPNLILQTLNLSLQAGLQNQHVSHPTTFLGVPKNNQRKRKTPYILVVVVVTQGSAESSKSDEKIPSWAKSDSDEPPPWAQDKPNNNKKKESHEDNTNGGFNPFSFSLMFKNPKRATGGGALESTKNATIDNGELLSDYIEIMNELFTIEYGVILNKLLTGNYPYVETKYGPTKIVMEVVEGKLRPKLPCDDVGQLGTREIEGALHPMGKILFDS

SEQ ID NO: 173988 - protein, 165 aa, Glycine max
  Coding DNA Sequence Number=SeqID_57210
  Gene Ontology: Mol. function=transmembrane receptor activity; Cellular component=membrane; Biological process=defense response
  Homolog annotation: Hit_ID=Q1SGR7; Match level="QueryCoverage=99%, HitCoverage=16%, E-value=2e-17, Identity=34%"; Hit description=TIR; Disease resistance protein; AAA ATPase
MKELTKIVDWVQETGPSVLPVFYDVTPSEVRKQSGQFGEAFTEHEERPQNEEIEKIVQEVINILGYNQISSFGDDLVDIHSGVKRMEDFLDLDANEVVLVVGICGIGGIGKMTLAHLLLLYLIKSLLDMMLVISLMMLAKLMEILEPIGAQKQLLRQTLTKEILR

SEQ ID NO: 173989 - protein, 84 aa, Glycine max
  Coding DNA Sequence Number=SeqID_57211
MRGTWLGSILGRIDSLLRENPSLVLEVMDLFRSWKGSTTMLIADAEEEEPTNLRSNPLQGGGNDVILPRKGPVTRAMSKRLQED

SEQ ID NO: 173990 - protein, 36 aa, Glycine max
  Coding DNA Sequence Number=SeqID_57212
MSTTSAPWTNCTFNYNVWAESTFSAAFCLLGEVIVL

SEQ ID NO: 173991 - protein, 132 aa, Glycine max
  Coding DNA Sequence Number=SeqID_57213
MKSPLPPIASDDDVEDKKMKKKANTVENDDDVEHMEGLVHFNDNLLFKVLKHMDVWTLAMSRCSMVSLDRSKDLVTMNGTIDVKKMAPALSEQSALSASTQTQVHSSNYKKGVKPKETDTPNLRTLSYIPKA

SEQ ID NO: 173992 - protein, 471 aa, Glycine max
  Coding DNA Sequence Number=SeqID_57214
  Gene Ontology: Mol. function=nucleoside-triphosphatase activity
  Homolog annotation: Hit_ID=Q7P847; Match level="QueryCoverage=58%, HitCoverage=38%, E-value=1e-15, Identity=25%"; Hit description =Nucleotidyltransferase
MHGSIDWYQNDDGYLWRVRDRDTYPIKNQMVLIYPQSTKYIATQKDPFSSQFDLFRKAISSPSYNVLIVCGYSFGDDHINQEISLSMSNPDNKTVLLAFCQEVGNKLPDILTTWLRGSDMMQFIPIEELKIGQIVEVSGTKVRVELSNKVEELTRSYEGKVYPIGQLGSIVKIHFGRNIIFGFVTLLRMRSDEIQTNSLPIPPEADQRIMEVELFSHGQWSQSTQKLSFSRGVKTYPLPQQGVYLLTQNESSGLFSAAEDIREDEYNPLVPFASYTSATSIPCRANIDKLFGLHCAILGSTGSGKSGAVATLLHSILDHSCIYGNEIAPRIIMIDPHDEYGSAFLDRGITYQAYSTIDKNDKIDIKLPYWLMSSDELRTLIIGKTEKEATSQNNIIYKALAHSRMVSVGLVSPAPTNYNWNIPDDNLPLHDPRPKAGRTFEEIMSFDSDKPIAFSLIEFENHIRYIQASRI

SEQ ID NO: 173993 - protein, 75 aa, Glycine max
  Coding DNA Sequence Number=SeqID_57215
MTYCKQIISHTYIYRGNHVGDMVVMTMITLVMEILVTTIIVMVAVDGGCDKSHDSCGKNDHDNYDSHSGDRFEIF

SEQ ID NO: 173994 - protein, 49 aa, Glycine max
  Coding DNA Sequence Number=SeqID_57216
MKALVEGHGVGVVQAEEAGDKGHGIKVGAAGGKEKGLNVEGCEGNVMVG

SEQ ID NO: 173995 - protein, 178 aa, Glycine max
  Coding DNA Sequence Number=SeqID_57217
  Gene Ontology: Mol. function=nucleic acid binding
  Homolog annotation: Hit_ID=Q9LRR6; Match level="QueryCoverage=88%, HitCoverage=56%, E-value=6e-76, Identity=70%"; Hit description =Similarity to RNA-binding protein
  Pfam annotation: Domain name=RRM_1; Domain location=92-161; Score =41.1; E_value=3.8e-09; Accession=PF00076.12; Description=RNA recognition motif. (a.k.a. RRM, R
MLWYSNISPLAEYLGFKFVIDCRICGDPHSVLRFAFVEFADEYGARTALNLGGTVLGYYPVRVLPSKTAILPVNPTFLPRSDDEREMCARTIYCTNIDKKVSQAEVKNFFESACGEVMRLRLLGDQVHSTRIAFVEFAMAESAIIALNCSGMLLGTQPIRVSPSKTPVRPRVPRPASH

SEQ ID NO: 173996 - protein, 172 aa, Glycine max
  Coding DNA Sequence Number=SeqID_57218
  Homolog annotation: Hit_ID=Q6ZGZ0; Match level="QueryCoverage=53%, HitCoverage=34%, E-value=1e-16, Identity=35%"; Hit description =Putative purine permease
  Pfam annotation: Domain name=TPT; Domain location=1-75; Score=-32.5; E_value=0.045; Accession=PF03151.7; Description=Triose-phosphate Transporter family
MQLYPTIIATCSNIVGLFVSGDWKTLEMEMKEFENGNLELTITPFLAFMVFHDKINGVKVIAFLLAIWGFLSYMYQYYLDGTKAKEDKSSYKEKLALASKEDNVQVEQHLGESDSGSNSDLVGISLSDLTLYAFDIENLVLNDNVEDHFSNEEEFEDNGDEDDDGGVILDMI

SEQ ID NO: 173997 - protein, 104 aa, Glycine max
  Coding DNA Sequence Number=SeqID_57219
MSLKWNVDDVGNALTSGCCVCSWGAECTNLVGWPIRGGQAWLKNLSIYEGMLRRFNWGCIDLVGRPLCGKLKWLKNPSISEGMLRSFNSSMVIVLDGAHVSYLI

SEQ ID NO: 173998 - protein, 90 aa, Glycine max
  Coding DNA Sequence Number=SeqID_57220
MEEKWIETDRQRDSHAKCVCPAGSSGRALCTGCVLSALACDSCLPMWLLVLSGWLGLNGYDSLSMTLLFIHLLSCLCYNSTLHKTQPKLL

SEQ ID NO: 173999 - protein, 58 aa, Glycine max
  Coding DNA Sequence Number=SeqID_57221
MEEQRRPIARAPDQNAVIIGEVLAIWLRTKALELKVGGGGAEREIEKKSVEHRCFFSS

SEQ ID NO: 174000 - protein, 150 aa, Glycine max
  Coding DNA Sequence Number=SeqID_57222
  Subcellular localization annotation: CTP_CleavageSite=64; ConfidenceScore=5.13e-01
MEKVRWNVPSKNKRLCGSACLTSDRDSRISKPVTSWMSKRRSMATLWLELTKTQRTREWLKAVKQRRRWSRKRRKKKRSGLNVQGVLLGKDMGCVEEKLQVSSMQRKRKRSVREVTAIATKERHLRNLTMSLPSSPPPSFMFLGSPYHLL

SEQ ID NO: 174001 - protein, 69 aa, Glycine max
  Coding DNA Sequence Number=SeqID_57223
MVFGHAVVVGRSDVRIGERVVRGGVVITVLLVMFLFFEFGPFLQDLKRCSCWWFFGGDGKRKCSVLGSG

SEQ ID NO: 174002 - protein, 89 aa, Glycine max
  Coding DNA Sequence Number=SeqID_57224
MPQPDQQGQISPFGVLLKSISPDGVVLKDIPAVGTFARKVHAWPKQTVSEIDEFVVDEGLATANGDTHMQGEGLATTNDDMHMQGEPPV

SEQ ID NO: 174003 - protein, 93 aa, Glycine max
  Coding DNA Sequence Number=SeqID_57225
METSLNGFLGFDGYIINIRHDLDDSGISVDLDGNVTVGIKVDLLVFGSGDAFKWWMVGFGLLVGMVCGVAYSVLLKKTIRKVVPSVMVALVVW

SEQ ID NO: 174004 - protein, 201 aa, Glycine max
  Coding DNA Sequence Number=SeqID_57226
  Gene Ontology: Cellular component=membrane
  Homolog annotation: Hit_ID=Q6ZGZ0; Match level="QueryCoverage=91%, HitCoverage=48%, E-value=2e-46, Identity=51%"; Hit description =Putative purine permease
  Pfam annotation: Domain name=TPT; Domain location=26-175; Score =128.2; E_value=2.2e-35; Accession=PF03151.7; Description=Triose -phosphate Transporter family
MSVILIALNPESEDTKHHPKEKQIIGILCAIVSSATFALHHSLVQRCFEKVIKTKTFATVLRMNFYPMLVASVFGSVGLFFSGDWRTMGMEMKEFESGSVSYVMTLVWTAVAWQIAGVSMLGLIFEVSSLFSVVISNLELTITPILAVIVFHDKIYGVKIIAFILAVWAFLSYIYQHYLDDRKAKEDKSDCIKVSMGNGEI

SEQ ID NO: 174005 - protein, 71 aa, Glycine max
  Coding DNA Sequence Number=SeqID_57227
LAKRAYHAKRVHPLRMNNHPLAELPMANRTLSRAFLGQARLVAASVELKELVPLSAAFKELSAYPCSKCSA

SEQ ID NO: 174006 - protein, 96 aa, Glycine max
  Coding DNA Sequence Number=SeqID_57228
MKNKYKIHYIAKGWVRHAVTHCPCRHSYWQDMLSRKDADLASPSCETRAHAAIGTGGTCQRGQSRHWLQRDTFTPCIGLKMPLLMMRLKHFFRDAG

SEQ ID NO: 174007 - protein, 52 aa, Glycine max
  Coding DNA Sequence Number=SeqID_57229
EADVELKCLNFYNPDDTIEGKFVTKKKNGVLAVQLSAMDLGGCTTKQPQGQP

SEQ ID NO: 174008 - protein, 80 aa, Glycine max
  Coding DNA Sequence Number=SeqID_57230
MGLRIRFVGGGCTNNARQSIRGAPDSMRLAINLWGSKLNGGGCMNENQFMRLRIRFVGGGCTNSARQSIRGAPDSMVEDA

SEQ ID NO: 174009 - protein, 123 aa, Glycine max
  Coding DNA Sequence Number=SeqID_57231
MLSNLDGIGVGVKAAQCVWVVDFVVLLLVYYTLVRVGLRFEGERELWVRCGLNRIKVLVSTFEVGVECLRMGGSLWWEEMRKEWREEWVRGEEGPKEGVDNMKRVGEEGGLEGKGEVAERETS

SEQ ID NO: 174010 - protein, 446 aa, Glycine max
  Coding DNA Sequence Number=SeqID_57232
  Gene Ontology: Cellular component=membrane
  Homolog annotation: Hit_ID=Q6ZGZ0; Match level="QueryCoverage=78%, HitCoverage=93%, E-value=3e-86, Identity=45%"; Hit description =Putative purine permease
  Pfam annotation: Domain name=TPT; Domain location=214-346; Score =139.4; E_value=9.7e-39; Accession=PF03151.7; Description=Triose -phosphate Transporter family
MEVVQEQQLQNTDGRKLHNSDRNSNVTQQLQHPRFRKYKWWLRVSLYIIFLLVGQSAATLLGRLYYDNGGNSKWMATFVQSAGFPVLLPLLFYFPRQTHAKFNNNPSNNDYSYKTKPKFSTLVFLYLAFGLILTGDNLMYSYGLLYLPLSTYSLLCATQLGFNAVFSFFLNSQKFTAFIINSVVLLTISASLLAINSDSDEDSTGLSREKHVIGFFCTIGASATFSLYLSLVQLSFQKVIKRETFSAVLDMQFYPSFIATCACVVGLFASGEWKSLNNEMKGYDKGSVSYVMTLLWIAVTWQISSIGTLALPIVPILAIVFFHDKINGVKFVALLLAVWGFLSYVYQHYLDDKKAKAEKSDGLGVSNSEGRVKTGEWVFLDFVLADFYLLVWELYICLSNWGTFARKVHAWPKQIANGTSEFAVGEGLATANGDTHMQGEGCKVKD

SEQ ID NO: 174011 - protein, 84 aa, Glycine max
  Coding DNA Sequence Number=SeqID_57233
  Homolog annotation: Hit_ID=Q1SGB8; Match level="QueryCoverage=98%, HitCoverage=60%, E-value=9e-28, Identity=71%"; Hit description =Vacuolar protein sorting 55
  Pfam annotation: Domain name=Vps55; Domain location=1-80; Score=44.2; E_value=4.5e-10; Accession=PF04133.4; Description=Vacuolar protein sorting 55
MPLLFLVGSGRSSLFSESDSSWVNATKFLTGASAVGSIAIPAILKHSGVIGWGAFAMELSSFFVFVFAILCYIRINDEDDYSSL

SEQ ID NO: 174012 - protein, 179 aa, Glycine max
  Coding DNA Sequence Number=SeqID_57234
MVEVISNIRLDSVRLKELIYIFVKGYHWCVDAEEALDKDEESEGGSKVGVCFDLGFMGLPYHCGLNGVHTNHALSSQQRHQHDLDLDLERKVQDNDGVGGGSGGCNDIGGGCGDKGDGSDSDNNDDVGNDNGGGSGASVMVVIVSFGGDNDVDGGSVVVAMTKMILVVVMMVAVVWWWQ

SEQ ID NO: 174013 - protein, 148 aa, Glycine max
  Coding DNA Sequence Number=SeqID_57235
  Gene Ontology: Mol. function=RNA-directed DNA polymerase activity; Cellular component=chromatin; Biological process=RNA-dependent DNA replication
MELLKDYDCTILYHPGKANVVVDTLSRKSMGSLAHSVEVMKPVVKEFQDLVANGVRFEVTSTKSLLAHVHAHSTLMDTIKVTQGEDPHLRKIVEEIQAGKVSDFVVDFEGIVDHRLGGLKLESLVGEEMTWEPKIIMREKYIHLLETQ

SEQ ID NO: 174014 - protein, 131 aa, Glycine max
  Coding DNA Sequence Number=SeqID_57236
MTETSMRVGNIDVYGFLEPQYIQRSSQSQFESENYIKNWMQNSKRDVYLGAYLNGAHWQMVVILPKENVVIWFCSLHKKSDNYLKGIINRSVLFFNTFALALVSALKGLDNTQQSKSKPPARWIVVKYCVD

SEQ ID NO: 174015 - protein, 696 aa, Glycine max
  Coding DNA Sequence Number=SeqID_57237
  Gene Ontology: Mol. function=solute:hydrogen antiporter activity; Cellular component=integral to membrane; Biological process =regulation of pH
  Homolog annotation: Hit_ID=Q2QLJ1; Match level="QueryCoverage=99%, HitCoverage=93%, E-value=1e-111, Identity=33%"; Hit description =Sodium/hydrogen exchanger family protein, expressed
  Pfam annotation: Domain name=Na_H_Exchanger; Domain location=1-331; Score=-29.3; E_value=0.0029; Accession=PF00999.11; Description =Sodiumhydrogen exchanger family
VGLVVGRIGFVRRLFAKFNLTFGFIIDFGMTCYMFALGIEMDPHALFARPNRYTKVAFTGVLCTLVVTGISTPIFRYFPSHHRLIDFTLCFATLAASTDSPVLTRLITQLKIGKSDIGKLVIGAGVHSDFVCCLILCIGYIVLPLPEFCHHLEDKMDIKKSLQMGCAVVVQVVFTAMVSPILMKWVGNENPEGLCVPREGRVSKWVITKINYLMTTIFFPIFFLWMGYETDFTMIDAPNAFTWIRLVVLFTVATAGKVAGTVISGAMLGFHWPESVAIGMLLVTKGHLQIYLAIKVIGCGATSMSTGIVMVIATFLTTLPAPTIVAKIIKRARKRAPTHRLALQLLDPLSELRILLCVQGPQNVPASINLVEITKGTADTSIVLYVTDMIELTDELSDTLERDEGVHTTTVKDKEVMDMRDQVTNLFQAYVVENDDGITLKRTMALSTITSMPQDICILAEDLMVALIILPFHRSQREDGKLDGGNSGFRYVNRKVLRNAPCSVGILVDRGLGSVEHITRCQVAVNVGVIFIGGKDDREALAYASRVAQHPQVKLTVIRFLEDSSVESSSLFRIILPEQEQEKQLDDECFTQFYERHVIGGGRISYMEKHLANASETFSTLRSFEGQYSLVIVGREGGMNSILTRGMNDWQQCPELGPIGDVLSGSDFSTTLSVLIIQQHRLKGEIDGLDEDFSMI

SEQ ID NO: 174016 - protein, 235 aa, Glycine max
  Coding DNA Sequence Number=SeqID_57238
  Gene Ontology: Mol. function=siderophore-iron transporter activity; Cellular component=outer membrane; Biological process=siderophore transport
  Homolog annotation: Hit_ID=Q2SM63; Match level="QueryCoverage=97%, HitCoverage=34%, E-value=3e-42, Identity=36%"; Hit description=Outer membrane receptor for ferric coprogen and ferric-rhodotorulic acid
  Pfam annotation: Domain name=TonB_dep_Rec; Domain location=24-235; Score=83.0; E_value=9.4e-22; Accession=PF00593.14; Description=TonB dependent receptor
MLSYDYAGTSYGAAQDSDATNKVTPYVGAVYALDPQHSAYASYTEIYNPQVQLDANFKILPPVQGSNREVGLKSEWFDRHLNTSVAYFDNKQDNFAQSTGALVGIVQIYEAIDVRTKGFELDMSGEIGDGWNMNAGLTRLMSVKDNEGASLNWQSKVYANIDMTSTGAGIVKYTQNSYALLNLLASYDINPHWQAAVNLNNVTNEKYLASMMWVNFGQGYYAPGTNGYATLTWKY

SEQ ID NO: 174017 - protein, 252 aa, Glycine max
  Coding DNA Sequence Number=SeqID_57239
  Gene Ontology: Mol. function=nucleoside-triphosphatase activity; Cellular component=membrane; Biological process=heme transport
  Homolog annotation: Hit_ID=Q0XKD3; Match level="QueryCoverage=95%, HitCoverage=86%, E-value=6e-79, Identity=61%"; Hit description =Heme/hemin ABC transporter, ATP-binding protein
  Pfam annotation: Domain name=ABC_tran; Domain location=35-221; Score =114.8; E_value=2.5e-31; Accession=PF00005.17; Description=ABC transporter
MTTLPAVSELLAFEQVTVSLGRQSFGPFTLSIRPGEQIAILGPSGAGKSTLLKLLARELMPASGHAHFDQRTFRDWSLADLSRRRAILPQSHEVAFGLPVELVIGLGRVARTYDPNLNSIVQQAAGQACATHLLGRRFDTLSGGEKARVHMARIFAQLWDAEQGLLLVDEPLAALDPGLQFELMDAINTFASRRGHAILAILHDINQALQGFERLILIKHGKLVGDYETSHVSISLLEALYGVSLACATTDD

SEQ ID NO: 174018 - protein, 216 aa, Glycine max
  Coding DNA Sequence Number=SeqID_57240
  Homolog annotation: Hit_ID=Q2QXX4; Match level="QueryCoverage=32%, HitCoverage=36%, E-value=4e-11, Identity=47%"; Hit description=Zinc finger, C3HC4 type family protein, expressed
  Pfam annotation: Domain name=zf-C3HC4; Domain location=170-207; Score= 45.2; E_value=2.3e-10; Accession=PF00097.15; Description=Zinc finger, C3HC4 type (RING finger)
MDEYYCCAYPHISASDFASETPFCPDDQRFSVEVAYTNMYVLNAREFETSEYTTHHSFSNISKDEIMQETTIVSWLSSMGVPSEAHRSVVAKVLQCARGMANDRIPTKVLSMRVDVTITQPGDDFEDYDEEYEDEDHDDDDEDHGLVQAAAKSQHVEGLETVEQEGCKRCAICLEDFNVGVRMPCLHMFHENCIGEWLQIGNSCPLCRFKMPPQMG

SEQ ID NO: 174019 - protein, 851 aa, Glycine max
  Coding DNA Sequence Number=SeqID_57241
  Gene Ontology: Mol. function=nucleic acid binding; Cellular component= proton-transporting two-sector ATPase complex; Biological process=DNA integration
  Homolog annotation: Hit_ID=Q1T2W1; Match level="QueryCoverage=65%, HitCoverage=95%, E-value=1e-131, Identity=40%"; Hit description =Integrase, catalytic region; Asp/Glu racemase
  Pfam annotation: Domain name=rve; Domain location=213-387; Score =41.9; E_value=2.1e-09; Accession=PF00665.16; Description=Integrase core domain
  Pfam annotation: Domain name=zf-CCHC; Domain location=236-253; Score =24.8; E_value=8e-05; Accession=PF00098.13; Description=Zinc knuckle
  Pfam module annotation: Pfam domain module=RVT_2::rve::zf-CCHC; Domain location=497-691::213-387::236-253
MATDSNFVQAAIPRFDGHYDHWSMLMENFLPSKEYWPIIESGIQEPEKGTKTSKDIWDSMKKKYQGSSRVKRAQLQALRRDFETLTMKDGESVSSYFARTIETSNRMRFHGKKMKDVTIVEKILRSLTPTFDYVVCAIEESKDIDAFSLDELQSSLLVHKQKMNRSSNLTGKEQALKASTNTHSIGRGMGKGRGRGRGQGRGRSNYRGNQQQQKEKERGSWSHQTTNYKLANKSNIECFKCHRLGHYKSECRTNLSKEQGEKSNFVEIEEEEENKSEVFSTFKSFKARVENEARKTIQTLRTDRGGEYCSKEFEAYCEHHGIQRELTAAYTPQQNGVSERKNRIILNMAWSRRQPSVDPFKNFGCIAYAHIPDEKRKKLVDKAEKDVIFDEDNTWDWNEQQPNSIIVDNEDVKELQLLVNIVLTSPNEAQIAPETEISTPTNAGTTDATTAAQSKCLRRRPAWMSDYKVTGIDQTEDPTTHFALFSDCDPTTFESAELIDLLRGHKTIGVKWVFKTKLKENGEVDKYKARLVAKGYKQEYGLDVKSAFLHGYLEEQVFVEQPPGYIKIGHEHKVYKLKKALYGLKQAPRAWYSHIEAYLMKVGFLKCPYEHTLFVKSENEGKMLIVCLYVDDLIFTGNCEIMFQEFKKSIMDEFEMSDLGDYNPTNTSTEFGLKLNKDHEGKKVDNTLYKQIVGSLMYLTAIRPDIMYSERWKTILFGFTDIDYAAGDQDDRKSTSGTEAEFVVATTCACQAIWLRRILEELKFKQSEATIVFCDNNSTIKLSKNPVLHGRSKHIDVRFYFLRDLTNEGVIDLKFCRSDEQLADTFTKSLKVSGFQNLRRLIEIYTLGDLV

SEQ ID NO: 174020 - protein, 163 aa, Glycine max
  Coding DNA Sequence Number=SeqID_57242
  Gene Ontology: Mol. function=oxidoreductase activity, acting on single donors with incorporation of molecular oxygen, incorporation of two atoms of oxygen; Cellular component=proton-transporting two -sector ATPase ...
  Gene Ontology: Cellular component=complex; Biological process=ATP synthesis coupled proton transport
  Homolog annotation: Hit_ID=Q9LHN8; Match level="QueryCoverage=82%, HitCoverage=43%, E-value=6e-39, Identity=49%"; Hit description =Leucoanthocyanidin dioxygenase-like protein
  Pfam annotation: Domain name=2OG-FeII_Oxy; Domain location=34-114; Score=71.8; E_value=2.1e-18; Accession=PF03171.10; Description=2OG -Fe(II) oxygenase superfamily
MKHAEVIIRKLLKVLLKKLNVKELDKPREKTLMGAMILGFNYYPACPDPEVVAGVGPHSDVSSITVLLQDDIGGLYVRGIDDDSWIFVPPVQGALSIEWLQKETRISIPIFVNPAPDAVIGPLSKVLEDGDEPKYKQVLYSDYFKYFFSKAHDGKKTIEFAMV

SEQ ID NO: 174021 - protein, 216 aa, Glycine max
  Coding DNA Sequence Number=SeqID_57243
  Gene Ontology: Mol. function=glutathione transferase activity; Cellular component=eukaryotic translation elongation factor 1 complex; Biological process=auxin mediated signaling pathway
  Homolog annotation: Hit_ID=Q06FE1; Match level="QueryCoverage=94%, HitCoverage=100%, E-value=2e-95, Identity=81%"; Hit description =Glutathione S-transferase
  Pfam annotation: Domain name=GST_C; Domain location=110-202; Score =64.8; E_value=2.8e-16; Accession=PF00043.15; Description=Glutathione S-transferase, C-terminal domain
  Pfam annotation: Domain name=GST_N; Domain location=1-75; Score=58.6; E_value=2e-14; Accession=PF02798.10; Description=Glutathione S -transferase, N-terminal domain
  Pfam module annotation: Pfam domain module=GST_C::GST_N; Domain location=110-202::1-75
MVVKVYGPDYANPKRVIVCLIEKEIEFETIHVDSFKEEHKQPEYLKLQPFGLMPVIQDGDYTLYESRAILRYYSEKYKNQGTDLLGKTIEERGLVEQWLEVEAHNYYPPIYNLVMHVLVHPYKGEPFDPKVIQESEEKLGKVLDIYEERLSKTKYLAGDFFSLADLSHLPFTHYLMNHMKKGYMVRERKHVSAWWDDISNRPSWKKVLQLYKDPNF

SEQ ID NO: 174022 - protein, 77 aa, Glycine max
  Coding DNA Sequence Number=SeqID_57244
MADGSVPWMSVKKTLTATSTVKVEFISCFEATSHGSGDGGCQKQYAEQLECILASKPEVARVFRDHGKGWRIKTKIF

SEQ ID NO: 174023 - protein, 68 aa, Glycine max
  Coding DNA Sequence Number=SeqID_57245
  Gene Ontology: Mol. function=glutathione transferase activity; Biological process=auxin mediated signaling pathway
  Homolog annotation: Hit_ID=Q9FQD6; Match level="QueryCoverage=85%, HitCoverage=28%, E-value=2e-28, Identity=100%"; Hit description =Glutathione S-transferase GST 22
  Pfam annotation: Domain name=GST_N; Domain location=1-66; Score=23.2; E_value=0.00094; Accession=PF02798.10; Description=Glutathione S -transferase, N-terminal domain
MVVKVYGPTYGSPKRVLVCLIEKEIEFETVHVDLFKGENKEPEFLKLQPFGSLPVIQDGDYTLYGKPF

SEQ ID NO: 174024 - protein, 132 aa, Glycine max
  Coding DNA Sequence Number=SeqID_57246
  Gene Ontology: Mol. function=transferase activity
  Homolog annotation: Hit_ID=Q9FQD6; Match level="QueryCoverage=49%, HitCoverage=30%, E-value=9e-33, Identity=100%"; Hit description =Glutathione S-transferase GST 22
VLDVYEERLSKSKYLAGDFFSLADLSHLPFGHYLVNQTGRGNLVRDRKHVSAWWDDISNRPAWQKPRKAESIKEVIWRPRRLSWMKCNSDGVAKGSVGIFIDIELNFVGAFASHIGINGNHLGNRKGARIVK

SEQ ID NO: 174025 - protein, 136 aa, Glycine max
  Coding DNA Sequence Number=SeqID_57247
  Pfam annotation: Domain name=Transposase_23; Domain location=45-115; Score=-3.8; E_value=0.003; Accession=PF03017.5; Description =TNP1ENSPM transposase
MQSQFQSQMQSQGLTVPPEPEVGPSAARVSTKESWVDPSGNDPDTGDSDKCGLYIEENPPRLVALGRLSEGSTTVHNIPLLHDQVKVGVEEVRDTDAPIPVPTKEVKLVGQTLFLLGRHILSSVYQNRELWDWGNL

SEQ ID NO: 174026 - protein, 44 aa, Glycine max
  Coding DNA Sequence Number=SeqID_57248
DSLKEQSSQGSFVAHGRQDVLTASIGRPEHPGHVCAAGAGVTIK

SEQ ID NO: 174027 - protein, 413 aa, Glycine max
  Coding DNA Sequence Number=SeqID_57249
  Homolog annotation: Hit_ID=Q6H4U9; Match level="QueryCoverage=47%, HitCoverage=67%, E-value=7e-21, Identity=32%"; Hit description =Dentin sialophosphoprotein-like
MKGASSGSSKLCNSLRCFDLVHMMVTVSVSDHHSPCTLASLGVALCISTTRLYSKAKFLKAGDTLARTPLEKAHPVGQPFNPSTPVKCCEEGGKRTDSLEQTPSSCISNVLSTQCDTLDSTEGIRTGSLHSLDKNDKNTASVSPWPSTTYTRRNKSIGFECDSDLSSCDSSDYGGRHMKKTDSLNNESTYKPSPNPTPMKLSDEMQTPGTAYPSAKDLPNGKPRVKSQFVYPIYNPGHHFSQKKFEESESVEPSQVTTSTSEKELKKMSCENECKVEESLSSWLKPAAVILEERNKRMQTSYNQVRKTPADRPIIGMVAAHWNKDGDSQAPPPKWWDGNGIPNSTNKYKEDQKVNWHATSFEERLEKALSEETVISQRKDTCGKSIPFDENEESDTALSQLQSSTHPQSVVSF

SEQ ID NO: 174028 - protein, 616 aa, Glycine max
  Coding DNA Sequence Number=SeqID_57250
  Gene Ontology: Mol. function=protein binding; Biological process =apoptosis
  Homolog annotation: Hit_ID=Q8LJ95; Match level="QueryCoverage=46%, HitCoverage=47%, E-value=1e-50, Identity=41%"; Hit description=NBS -LRR resistance protein RGH1-like
  Pfam annotation: Domain name=LRR_1; Domain location=392-414; Score =14.0; E_value=0.53; Accession=PF00560.23; Description=Leucine Rich Repeat
  Pfam annotation: Domain name=LRR_1; Domain location=416-438; Score =6.1; E_value=21; Accession=PF00560.23; Description=Leucine Rich Repeat
  Pfam annotation: Domain name=LRR_1; Domain location=548-568; Score =1.6; E_value=1.4e+02; Accession=PF00560.23; Description=Leucine Rich Repeat
  Pfam module annotation: Pfam domain module=LRR_1::LRR_1::LRR_1; Domain location=392-414::416-438::548-568
MSIRTNRFKAVDRVLKDLERVEKEGKLNDLKSELNKIKEVFLKVKENEEELLDTLAVVDGYIRNKNIAKLREEEGHFCQKIWNSTLKLLPAAHHAQAAASSGQSSHHAQAAASSGQSSHHAQAAASSGQSSHHAQAAASSGQSSHHAQAALPSGQSSHHVTPLPSSTTPQLHQEEDLQIIKDYYNSLGRFDKRCFSSLLQFPENAVFKRREISFWFSPFDQVVDPLLEGKVIVPHGNGKSPIASKFKINPLVRHKSLSPLFQNEEVPICGYYSQIKTSSSSRASDIGYERLVLDQRKIKLSDGFGFKSNRCYYIYNVGASYLNFGPGWMAKMKDLLVLQLGRWTKDSPKHHIEVDSEEFLKELSGHEYLFCLSLRGISRIFELPPSIVKIESLETLDLKACHNLETLPSDISSLRWLRYLNLSECYLLDRMPKGIQNLTWLEVLKGFVLGSSSKTPCRISDIAARLKRLERLSIRIGSGAVIQEGEFESLEKLRRLERLKISWGVFDTRYIDIQISVPSSLKKLHLEGFPGQNIPEWLKPSKLPQELELRELHITGGKLKSLDHGENNDWGVEMVYLKYLKYLDVDLEHLRKLFPSLRYVEIKQILNQPYLEWSIN

SEQ ID NO: 174029 - protein, 475 aa, Glycine max
  Coding DNA Sequence Number=SeqID_57251
  Gene Ontology: Mol. function=transferase activity; Biological process= flavonoid biosynthetic process
  Homolog annotation: Hit_ID=Q9MAP9; Match level="QueryCoverage=94%, HitCoverage=93%, E-value=1e-109, Identity=48%"; Hit description =Highly similar to YUP8H12R.39
  Pfam annotation: Domain name=Transferase; Domain location=8-464; Score=318.7; E_value=1e-92; Accession=PF02458.6; Description =Transferase family
MGAENGGFSVNVTNEEVVAAVVPMQEHWLPLSNLDLLLPPIDVGVFFCYKNPMLTSTTLGDTCTNKITFESMLGSLKKALAQALISYYAFAGEVVPNNVGEPEVLCNNRGVDFVEAVADVELKCLNFYNPDDTIEGKFVPKKKNGVLTVQATSLKCGGIVLACIFDHRIADAYSANMFLISWAEIAQPTKPTTTTTTPCFRRSLLSPRRPSSIPRSLYDMYLPISKITPPQATTAPLLSRIYYVTAEQLEKMQSLVVMTNENNTKRTKFECFSAFLWKIVAQAASRGNKKGKKVIAKMGIVVDGRKRLCDGDKEKEALMGCYFGNVLSIPFGGKEVEELMEKPLGLVAEAVHEFLAVATKEHFLGLIDWVEAHRPEPGVAKIYCGGGSGDEGPSFVVSSGQRLMEGKMDFGWGEVVFGSFHFPWGGQAGYVMPMPSPLGNGDWVVYMHLAKEQLEVLESEASDVFRPISWDYLNQ

SEQ ID NO: 174030 - protein, 137 aa, Glycine max
  Coding DNA Sequence Number=SeqID_57252
MSVRASLLQSEQSSGNSISKNKKAANSGIVTVGLCLPEGEEGTVAVGAVAEEESRALKQAKKHPMVVVGEQDRETNLNVEASSSSSSSSGQSVSWKRLGAGGEWDEAVRVMNVCFLHSCVKQECSYGWIFVIKNGIS

SEQ ID NO: 174031 - protein, 84 aa, Glycine max
  Coding DNA Sequence Number=SeqID_57253
  Gene Ontology: Mol. function=transcriptional repressor activity; Biological process=regulation of nitrogen utilization
  Homolog annotation: Hit_ID=Q9SDZ1; Match level="QueryCoverage=99%, HitCoverage=27%, E-value=2e-30, Identity=80%"; Hit description =Isoflavone reductase homolog 1
MAAKSKILVLGGTSYIGKFIVMASVEAGHSTFALVRESTLSHPQKSKLIQSFKSFGVTLLYGDVNNHESLVKAIKQVDVLIFTL

SEQ ID NO: 174032 - protein, 634 aa, Glycine max
  Coding DNA Sequence Number=SeqID_57254
  Gene Ontology: Mol. function=microtubule motor activity; Cellular component=microtubule associated complex; Biological process =microtubule-based movement
  Homolog annotation: Hit_ID=Q9ZQ52; Match level="QueryCoverage=96%, HitCoverage=61%, E-value=0.0, Identity=60%"; Hit description =Putative kinesin heavy chain
  Pfam annotation: Domain name=Kinesin; Domain location=398-634; Score =214.4; E_value=2.6e-61; Accession=PF00225.13; Description=Kinesin motor domain
MDPTQSNDVQQYPQTLISEPKDSSMHDANESLFDSMVCDSSSRLVPTGLTRSGNAEEECFMFVNAGGDAFSEAAGGITFLGDTYFDGGNVMRTNEQIVEGGDYPFIYQSARLGSFCYRFANLPPGDYVVDLHFVEIININGPKGMRVFNVLSELDIYAVVGANKPLQMVDSRVSVKDDGVILIRFESISGSPVVSGICIRRATKASVPQVTSDYIKCSSCAAQIEIPSSQMKVMQAKSTAKYKSKIKELTMQCDLKAKECYEAWMSLTAKNEQLEAVQMELDKVTFKLLTTDQTVEKQAESLRNISNRYELDKKKWAEAINSLQEKIKLMKSDYSKLSFEAHECVDSIPELNKMVFAVQELVKQCEDLKVKYSEEMAKRKKLFNEVQEAKGNIRVFCRCRPLNKAEISAGSNTVVDFDAAKEGCLGILTSGSTKKSFRFDRVYTPKDDQVDVFADASSMVISVLDGYNVCIFAYGQTGTGKTFTMEGTQQNRGVNYRTLEHLFKVSKERSETFSYDISVSVIEVYNEQIRDLLATGQTSKRLEIKQASEGFHHVPGVVEARIDNINEVWNAKNLLSGESTKSKLWLVDLAGSERLAKTDVQGERLKEAQNINRSLSALGDVISALAAKSSHIPY

SEQ ID NO: 174033 - protein, 356 aa, Glycine max
  Coding DNA Sequence Number=SeqID_57255
  Gene Ontology: Mol. function=binding; Cellular component =extracellular region; Biological process=proteolysis
  Homolog annotation: Hit_ID=Q8XUM5; Match level="QueryCoverage=98%, HitCoverage=36%, E-value=1e-27, Identity=28%"; Hit description =Probable hemagglutinin-related autotransporter protein
  Pfam annotation: Domain name=Autotransporter; Domain location=149 -355; Score=45.9; E_value=1.3e-10; Accession=PF03797.9; Description =Autotransporter beta-domain
  Subcellular localization annotation: CTP_CleavageSite=94; ConfidenceScore=5.54e-01
PKLASGVTVANGKFYVLANTFQIDSLNVTSGANTLPTIQASNSLLSWVASVNSNNALVLQSQVHNANMISGVSGNAANALNTLVNANNPLFSTIANMGSDSQVAQASQSLVPEVNGASVNAAQKALGSSMQIISNRNSAAQTNFITGLSGQSGVATGDAPNNTGTKTDVKQTDGYQVNAYGMALGVDRIVNTDNNLRVGGAFTYTNSSIDAKGSNKGDSVGLDSYLGSLYASVNMGDWYLNGSLVAGQHKYDSKRVVVGNVAKGSYDANQFGVNAEAGMPIKTAVGTLIPLVSAAYNYLDIDGYSERGTGGLKISGESVDSFRTGLGARIWFHEFADNRFDTTGRYTTGGSSFKTA

SEQ ID NO: 174034 - protein, 131 aa, Glycine max
  Coding DNA Sequence Number=SeqID_57256
  Subcellular localization annotation: CTP_CleavageSite=32; ConfidenceScore=5.33e-01
MASFTMTASIFGCPAVTKRSAVAAQRRLLVVSAAKAEGEKVSYDNNDSNGRRNLMFAVAAAAVFSVAGMAVADEPKPGTSEAKKKYAPEFMKGLTTLEEVEDCELMAIMDSGLIATDEVKCEKRILAGEND

SEQ ID NO: 174035 - protein, 206 aa, Glycine max
  Coding DNA Sequence Number=SeqID_57257
  Gene Ontology: Mol. function=oxidoreductase activity; Cellular component=phragmoplast; Biological process=metabolic process
  Homolog annotation: Hit_ID=Q13ZK1; Match level="QueryCoverage=53%, HitCoverage=32%, E-value=8e-27, Identity=52%"; Hit description =Dihydrouridine synthase TIM-barrel, yjbN
MREEGRRVGGDCERGMEKGNSNALGVSPQAHTVQLKQAKGILVGDIIEEFVLIRVGVAMYLTLLCACAILIFFQSGFVVFFAWIFSVAPMMDWTDHHYRTLARLISKHAWLYTEMLAAETIVYQKGNLDRFLAYSPDQHPIVLQIGGSNLDNLAKATELANAYCYDEINFNCGCPSPRVAGRGCFGVRLMLDPKVRKSSILDAQTD

SEQ ID NO: 174036 - protein, 54 aa, Glycine max
  Coding DNA Sequence Number=SeqID_57258
  Gene Ontology: Mol. function=oxidoreductase activity; Cellular component=phragmoplast; Biological process=metabolic process
  Homolog annotation: Hit_ID=Q22A31; Match level="QueryCoverage=72%, HitCoverage=8%, E-value=5e-08, Identity=62%"; Hit description=TIM -barrel protein, yjbN family
MDLDRGGDFIYKVSSLSPAKHFVIHSRKALLKGLSPAENRSIPPLKYVPDCWKI

SEQ ID NO: 174037 - protein, 215 aa, Glycine max
  Coding DNA Sequence Number=SeqID_57259
NHLGNGKIGLESGKPVKDSCFWKCILVRQRQIEGVMKDLVLSRCISGMRTVLINPSLKMHYDIGSCRTDVECEREIKTRISSLVLQIKTLNSSSLSLFALFLPILPRPPPFLYSPNSNNRTTNLTPMTSPPHVPLPDSDDQIPTTSTLTFASTSWCNSSNATAHRSKEVDASCTAKRKSKSTQAWGRKMAHDALIIDSPSSTFVCCQDLLTLCTI

SEQ ID NO: 174038 - protein, 164 aa, Glycine max
  Coding DNA Sequence Number=SeqID_57260
  Subcellular localization annotation: CTP_CleavageSite=35; ConfidenceScore=5.20e-01
MASSTCFQQIPSQITTTMHKPSKLPIISPKTQYPRKSSEKEVYPNLKFRSPTRRDALHDSENAFLSRFGAEMATKGWSFVGASMVEEEEEDGNPFKMHRLQKFRVEISRMSQFGKVCCLHPVPKKPTWEFHYLSNPLHFLKHTRTTLPLCLDALQQETLSLLAF

SEQ ID NO: 174039 - protein, 153 aa, Glycine max
  Coding DNA Sequence Number=SeqID_57261
  Homolog annotation: Hit_ID=Q06A77; Match level="QueryCoverage=35%, HitCoverage=21%, E-value=3e-24, Identity=98%"; Hit description=PHD3
  Pfam annotation: Domain name=2OG-FeII_Oxy; Domain location=85-152; Score=24.1; E_value=0.00051; Accession=PF03171.10; Description=2OG -Fe(II) oxygenase superfamily
MQEKDWLSLVVVHSDTWLLALAFYFGARFGFDKTHRNRLFSMINELPTIFEVVTSAAKKQVKEKSSVSNNSGSKSKSRSNLYDFISWKHQFRIYPDLELTLGLPMHTDFNVLIIVLQSQVSGLQVIKDGKCIAVPVIPNAFVINLGDQIQRKG

SEQ ID NO: 174040 - protein, 455 aa, Glycine max
  Coding DNA Sequence Number=SeqID_57262
MGAWLDTKFMKDADPYKVIEEFCCRMTGTLKEWYHNLGAVRQNQFHELRSAVAVLELSIKNTDSSDEESSASPIPISSIQEEQSIRLAIPQPCVEIQVLAKKFEKPINVIAFIDTGAQRTMMNPDILSQEYWKNEVAYLVAANGKFFRRLSNTWLFSLAEAPLEVGEFKQKISSGCADSHEDFNHPYLLWKNKEYFVDLPIRLNEDINPTKATHQDDTFRSTSSHTRMPRSTKPRTDDNSQGTQEDAQNPPALKIPGTGLITHTPAQILEYAKSHYFPFLHETMRFKYTPTQIFDPEIPFGAWWRMKLKQILDIVRQRGISEDLIGELVSIVIIHQPYLMEQGQLWSRNEAQIWGTFEAYSLEESYRNQPARHLCENTNDAQIRTEIYVSELEFQKVEDLVDGHSALEQDSEDYNAQLMEELLHKKRYPYHHLVYGSLTRSEVQHYNLSLSTRSD

SEQ ID NO: 174041 - protein, 260 aa, Glycine max
  Coding DNA Sequence Number=SeqID_57263
  Gene Ontology: Mol. function=protein binding
  Homolog annotation: Hit_ID=Q1T2F4; Match level="QueryCoverage=72%, HitCoverage=38%, E-value=1e-53, Identity=62%"; Hit description =Actin/actin-like
MVETWKTSSSPDMFDIAPVIEGAVNHIASRRFEFGGIDLTNFLAQELGKSNPLVNISISDVENIKQQYSCCVEDELAYQKTQGSCPVETHTLPDGQRWWKGHEPFTRVGMLNCSDGGFEWLNNDSGGFELNQGGRGFKQLNVAVVITIGRERYTVGEALFQPCLLGLEAHGIVEQLVHAISTVSSENHRQLLENTVCSPGTSQRASAQPAGLGVGAAECGGMLGSNCNPLGQELTSDLGRAGNKLDHKSSELGTVGELKI

SEQ ID NO: 174042 - protein, 372 aa, Glycine max
  Coding DNA Sequence Number=SeqID_57264
  Gene Ontology: Mol. function=fructose-bisphosphate aldolase activity; Cellular component=chloroplast; Biological process=metabolic process
  Homolog annotation: Hit_ID=Q94JJ0; Match level="QueryCoverage=89%, HitCoverage=90%, E-value=1e-172, Identity=87%"; Hit description =Putative plastidic aldolase
  Pfam annotation: Domain name=Glycolytic; Domain location=44-372; Score=773.3; E_value=1.5e-229; Accession=PF00274.9; Description =Fructose-bisphosphate aldolase class-I
  Subcellular localization annotation: CTP_CleavageSite=37; ConfidenceScore=5.68e-01
MAMASAKLNTLSSQWIAHNSFSPRRGSSSRRVSLPIRASSYQHELVQTAKSIASPSRGILAIDESNATCGKRLASIGLDNTEVNRQAYRQLLLTTPGLGEYISGAILFEETLYQSTTDGNKFVDCLRDQNIVPDIKVDKGLVPLPGSAEYYKQGARFAKWRTVVSIPCGPSALAVKEAAWGLARYAAISQDNGLVPIVEPEILLDGDHPIERTLEVAEKVWSEVFFYLAENNVLFEGILLKPSMVTPGAEHTEKASPETIAKYTLTMLRRRVPPALPGIMFLSGGQSEVEATLNLNAMNQSPNPWHVSFSYARALQNTVLKTWQGHPENVEAAQKSLLVRAKANSLAQLGRYSAEGESEEAKKGMFVKGYTY

SEQ ID NO: 174043 - protein, 78 aa, Glycine max
  Coding DNA Sequence Number=SeqID_57265
  Gene Ontology: Mol. function=protein binding; Cellular component =cytoskeleton; Biological process=regulation of transcription from RNA polymerase II promoter
  Homolog annotation: Hit_ID=Q1T2F4; Match level="QueryCoverage=91%, HitCoverage=19%, E-value=2e-32, Identity=91%"; Hit description =Actin/actin-like
MRLSHSFEERFQKESSLSSSAIRPTLVKPPEYMPENLTMNSAWVGGAILAKVVFPQNQHVTKADYDETGPSIVHRKCF

SEQ ID NO: 174044 - protein, 74 aa, Glycine max
  Coding DNA Sequence Number=SeqID_57266
MVDIELSNEGFQNLITNGREVGLDDGGELLGVEVGKDAKCEVYHLEVFWVPLRMVESRIPLEEERMVRYFSSTM

SEQ ID NO: 174045 - protein, 72 aa, Glycine max
  Coding DNA Sequence Number=SeqID_57267
MWFCKTINTRCNRVFALATAAVSNEPKILTWLKTTTNKVKVERLTYGQRRAEFVGVIVMVLVMLLAWSEGIG

SEQ ID NO: 174046 - protein, 381 aa, Glycine max
  Coding DNA Sequence Number=SeqID_57268
MILSSNCNEHILTEWTMFQEPVIKPIWNTFASSLSGIWKGVGAVFSPITAEMEPMEIGSKNEHLYDCYTLSRIEAVPSVSGERTSQIQRKVNWVTLNPYGEIPQHIEGSNVAKDKQHKSSDNVINHVLPIFESFDFKRSDVMEEDVMGCEPGLVYFEDGSYSRGPIDIPVGEYNDTKYYISPTFKFEQCLVKGCHKRIRIVHTIEFINGGSDIQILRVALYEEEWVSPASIDDQSDTEFDAKPFSQRKRTKPSELTGSWKVFEVSATPVYDEESTEEGNAAPYVYLCMENLKKRSLPENTNYFGEEERLDMQDVTMLWLPGGVTCYVDINKDGILCIGVGWYSDEGINLVMERDYGLDGKLKEVRWKSEVKRRWSNPPPIE

SEQ ID NO: 174047 - protein, 110 aa, Glycine max
  Coding DNA Sequence Number=SeqID_57269
MSLCLLLMINHTYTIWIVHGGSLQQKKKRALFIVIRGRFSVEALPSLAPHLSAAKRRTSPQQRAAPHCSSSVAGNASGPPETAAFGTTETGSSFETFCALLCLKVLEPLC

SEQ ID NO: 174048 - protein, 214 aa, Glycine max
  Coding DNA Sequence Number=SeqID_57270
  Gene Ontology: Mol. function=tyrosine decarboxylase activity; Cellular component=cytoplasm; Biological process=antibiotic biosynthetic process
  Homolog annotation: Hit_ID=Q8RUN2; Match level="QueryCoverage=94%, HitCoverage=91%, E-value=1e-70, Identity=65%"; Hit description =Expressed protein
  Pfam annotation: Domain name=Lysine_decarbox; Domain location=62-204; Score=201.5; E_value=1.9e-57; Accession=PF03641.4; Description=Lysine decarboxylase family
MEGEGKVSAENENQNRFKRICVFCGSRVGYKSAFSDAALELGKLMVERRIDLVYGGGRLGLMGLISQTVLNGGCHVLGVIPEALLPREISGETFGEVKTVADMHERKSTMFEHADAFIALPETLLKLHCSGGYGTMEELLEVIAWSQLGIHDKPVGLFNVDGYFNSLLSLFDKGVEEGFIENSARHVMVIADTAIELIKKMEEYVPVLGMVAPK

SEQ ID NO: 174049 - protein, 486 aa, Glycine max
  Coding DNA Sequence Number=SeqID_57271
  Homolog annotation: Hit_ID=Q1S0F5; Match level="QueryCoverage=34%, HitCoverage=34%, E-value=3e-10, Identity=30%"; Hit description=IMP dehydrogenase/GMP reductase
MVVSFFLTHLLLEVASPIIFLLLYSTAIEILEAKDSIDEEDPRPTSSTWSYITTLLQRQAFHKTYGKIWDLAMVEVSVEVIASLYSVLRSAPEVPHIRGFPASTTVEEFEEILGCPLGERKPYLFSGFYPSMARVEKVVKISVQELDRVKQNRNGVVGIPRKHLEGKAKALANQGEWVLFIDTFALLIFGVVLFPNVEGLVDLAAIDAFLAYHHSKESPTITILANLYDTSACPLQGHRLCIEKGKANWDQLLASMEGASINWFPRWKEGRTGLGYPMRGAPSEESVTPFITRGFSDPNARLLQGVRKAWEAAQRKDKELRGSSNGVIDVYHKCLRVRTQGLDWLPKLKAAREEEAKALEESEEVQALKAELEKARAIKEKFKSTVIKVRKEYNELKDINMAAAKALERETKRARKEEHGRNNFRGALWGRNNELKLQRDEMDQSRVKGMIMKDELKACLRSKRGLSQQLSKIEGNMWAIIDEYKV

SEQ ID NO: 174050 - protein, 436 aa, Glycine max
  Coding DNA Sequence Number=SeqID_57272
  Gene Ontology: Mol. function=polygalacturonase activity; Cellular component=amyloplast; Biological process=carbohydrate metabolic process
  Homolog annotation: Hit_ID=Q1T2F3; Match level="QueryCoverage=99%, HitCoverage=99%, E-value=1e-174, Identity=67%"; Hit description =Virulence factor, pectin lyase fold
  Pfam annotation: Domain name=Glyco_hydro_28; Domain location=93-435; Score=502.1; E_value=6.4e-148; Accession=PF00295.8; Description =Glycosyl hydrolases family 28
MSPQSVALSLFITMFVSFGVCFGSFLEDTYHLTNYQRYSMKPNNEHFGIMTRAYGSTPSTRSQRRINVDDYGAKTIDGRDDTEAFEKAWDEVCSTGGIVVVPEEKIFHLKPITFSGPCQPNIAFRVYGTIKAWPKMSAYQNDRLHWIKFENVTNLRVDGGGTINGNGRKWWENSCKRNKNLPCKPAPTAVTFYQCNNLKVTNLRFKNAQQMHIRFQKCNNVAASNLVVRAPGNSPNTDGIHVTETKNILISNSIIGTGDDCISIVSGSQNVRAIDIKCGPGHGISIGSLGAGDSKAQVSNVLVNRATLTRTTNGVRIKTWQGGSGYAENIIFVNIAMRNVTNPIIVDQNYCDQEKPCHEKDSAVKLSNIMYQNIRGTSASEVAIKFNCSKTVPCKGIYLQDVILTPEGHGGCSSTIATCENVRYVNQGKVFPPCST

SEQ ID NO: 174051 - protein, 90 aa, Glycine max
  Coding DNA Sequence Number=SeqID_57273
MDKDTLGYNGRRGSKSPRDSKLRLSSIWCTHLARVTHRLHFATPDRLQGYVFSVGNLGIGWALTGEKCISSALRILRVFEGLTPTTNNFK

SEQ ID NO: 174052 - protein, 172 aa, Glycine max
  Coding DNA Sequence Number=SeqID_57274
  Gene Ontology: Mol. function=RNA binding
  Homolog annotation: Hit_ID=Q84ZX0; Match level="QueryCoverage=49%, HitCoverage=9%, E-value=6e-19, Identity=58%"; Hit description=HEN4
  Pfam annotation: Domain name=KH_1; Domain location=100-162; Score =43.3; E_value=8.6e-10; Accession=PF00013.19; Description=KH domain
MESQFLMVLQMRMWWCRDNLSPNEVVAEARPKSNWKVNKDPIKGKPFARGKSAFPSGRFLPRNAGVHAETILQNGELHTDLSENLERGRGNMFATVTNTTVEIIVSEHVFGSVYGEDGGNLDRIRQISGAIVTVYDPSVGTSGGKVVISGTPDQTFAAQSLLQAFIQTGQAS

SEQ ID NO: 174053 - protein, 101 aa, Glycine max
  Coding DNA Sequence Number=SeqID_57275
METWSMTNMRRNGKEWRGTIQAFIMIHDHFEKVNDVRELRMDKLINSMNIESMKTMNNLRGANYSLGSYNVGPIGKKIDNISFNYVVQLSSLSFVGSWNQI

SEQ ID NO: 174054 - protein, 91 aa, Glycine max
  Coding DNA Sequence Number=SeqID_57276
MAIEGLQLGVKERIGIKTKKIEEEERAQAWSAENNVVNENPCISANKECVDAVKGGIQVDNRTTSSDKHTPEAAEDTIGILAGNGENVGSF

SEQ ID NO: 174055 - protein, 415 aa, Glycine max
  Coding DNA Sequence Number=SeqID_57277
  Gene Ontology: Mol. function=calcium ion binding; Cellular component =Golgi stack; Biological process=protein amino acid phosphorylation
  Homolog annotation: Hit_ID=Q654Y7; Match level="QueryCoverage=97%, HitCoverage=80%, E-value=4e-80, Identity=28%"; Hit description =Putative fertility restorer
  Pfam annotation: Domain name=BioW; Domain location=37-278; Score= -96.7; E_value=0.02; Accession=PF03744.4; Description=6 -carboxyhexanoate--CoA ligase
  Pfam annotation: Domain name=PPR; Domain location=121-155; Score =17.3; E_value=0.054; Accession=PF01535.11; Description=PPR repeat
  Pfam annotation: Domain name=PPR; Domain location=156-190; Score =40.9; E_value=4.3e-09; Accession=PF01535.11; Description=PPR repeat
  Pfam annotation: Domain name=PPR; Domain location=191-225; Score =23.3; E_value=0.00086; Accession=PF01535.11; Description=PPR repeat
  Pfam annotation: Domain name=PPR; Domain location=290-324; Score =36.1; E_value=1.2e-07; Accession=PF01535.11; Description=PPR repeat
  Pfam annotation: Domain name=PPR; Domain location=325-359; Score =25.9; E_value=0.00014; Accession=PF01535.11; Description=PPR repeat
  Pfam annotation: Domain name=PPR; Domain location=360-394; Score =14.5; E_value=0.14; Accession=PF01535.11; Description=PPR repeat
  Pfam annotation: Domain name=PPR; Domain location=51-85; Score=47.4; E_value=4.7e-11; Accession=PF01535.11; Description=PPR repeat
  Pfam annotation: Domain name=PPR; Domain location=86-120; Score=36.4; E_value=9.7e-08; Accession=PF01535.11; Description=PPR repeat
  Pfam module annotation: Pfam domain module=BioW::PPR::PPR::PPR::PPR::P PR::PPR::PPR::PPR; Domain location=37-278::121-155::156-190::191 -225::290-324::325-359::360-394::51-85::86-120
MVERGCEPNVYTYSVLIGYFCKEAMRINGQSRRSWSDLESLKEKHFKANELVYTALIDGYCKAGEIEDAVSMFKRMLTEECLPNLITFNVLIDGLRKEGKVQDAMLLVEDMAKFDVKPTLHTYTILVEEVLKEYDFDRANEILNQIISSGYQPNVVTYTAFIKAYCSQGRLEEAEEMVVKIKNEGILLDSFIYNLLINAYGCMRLLDSAFGILKCMFDTSCEPSYQTYSILMKHLVIEKYKKEGSNPVGLNVSLTNISVDNADIWNKIDFEVTTVLFEKMAECGCVPNLNTYSKLIKGLCKVGLLDVAFSLYHHMRETGISPSEIIHNSLLSSCCKLGMFGEAVTLLDSMMECSHLAHLESYKLLICGMFEQMNKEKAEAVFCSLLRCGYNYDEVAWKVHIDGLAKSMLINAQNF

SEQ ID NO: 174056 - protein, 385 aa, Glycine max
  Coding DNA Sequence Number=SeqID_57278
  Gene Ontology: Mol. function=RNA binding
  Homolog annotation: Hit_ID=Q9ZQ53; Match level="QueryCoverage=90%, HitCoverage=52%, E-value=2e-44, Identity=34%"; Hit description =Putative RNA-binding protein
  Pfam annotation: Domain name=KH_1; Domain location=144-196; Score =34.3; E_value=4.2e-07; Accession=PF00013.19; Description=KH domain
  Pfam annotation: Domain name=KH_1; Domain location=302-356; Score =37.5; E_value=4.5e-08; Accession=PF00013.19; Description=KH domain
  Pfam annotation: Domain name=KH_1; Domain location=42-101; Score =32.7; E_value=1.2e-06; Accession=PF00013.19; Description=KH domain
  Pfam annotation: Domain name=KH_2; Domain location=144-193; Score =8.6; E_value=0.011; Accession=PF07650.7; Description=KH domain
  Pfam module annotation: Pfam domain module=KH_1::KH_1::KH_1::KH_2; Domain location=144-196::302-356::42-101::144-193
  Subcellular localization annotation: CTP_CleavageSite=48; ConfidenceScore=5.71e-01
MQDPATSDTDHQTTPSPKRSNTTTTNRSSKRPVFKVLPGQIAFRLVCHASTVGGLIGSSGSIVSQLRRETGCKIHCEDSLSSAEDRVILVIGSLSPRKGLLLGDGGEVEVSSAQEAVVRVFERVWDLEAEKGVNSNRAVNGEVFSKLLAHTSQIGAVVGKGGKNITAIRNNTGAKIRVFPPPQCATKDEELVQAFLPIFFTGGVKLPTKGYRITGGILAVKKALISVSHCLQDCPPLCKVPVTSSTPTVSSSDRLSSDPNAELFPHLNSLLTSMEGLSIYERTTNSNETSNRDSKGAEHEVVFRLLCSNNVAGSVIGKRGAIVRALESKTGASIIFAAPLSEHAERIVTISAVESLESCNSPAQDAVILVFARIIDDHIGQGFLQ

SEQ ID NO: 174057 - protein, 64 aa, Glycine max
  Coding DNA Sequence Number=SeqID_57279
MPHHPPPSEFENEFVIVASLNSLHNNSAINDLTHPPSNECTLTMKMQNSTHMGSAISTSISAIK

SEQ ID NO: 174058 - protein, 81 aa, Glycine max
  Coding DNA Sequence Number=SeqID_57280
MGGVDPDPVLISTVTGEGPHMRNPCEVGAVLSKSEHDVSNSHGINRSHTHLASPSPPLLLDSDGLDWMDVMAEWGHYSCFQ

SEQ ID NO: 174059 - protein, 285 aa, Glycine max
  Coding DNA Sequence Number=SeqID_57281
  Gene Ontology: Mol. function=DNA binding; Cellular component=nucleus; Biological process=regulation of transcription
  Homolog annotation: Hit_ID=Q40880; Match level="QueryCoverage=99%, HitCoverage=80%, E-value=3e-78, Identity=57%"; Hit description=NAM protein
  Pfam annotation: Domain name=NAM; Domain location=1-78; Score=132.0; E_value=1.7e-36; Accession=PF02365.6; Description=No apical meristem (NAM) protein
MGEKEWYFFSLRDRKYPTGLRTNRATEAGYWKATGKDREIYSSKTCSLVGMKKTLVFYRGRAPKGEKSNWVMHEYRLEGKFAYHYLSRNSEDEWVISRVFRKSNTTPITNGGSTMSASTNSKKTRINNTTSLIHEPGSPSSVFLPPLLDSSPYTNTTTNTFTDHHNSSYDSATKKEHVSCFSTIAAATAVVSPNNNFNNASFDLPPSQPLATDPFARFQRNVGLSAFPSLRSLQDNLQLPFFFSTAAAPPFSGGGSGDFLSWPVPEDGVSNMPLGVSELDCMWGY

SEQ ID NO: 174060 - protein, 481 aa, Glycine max
  Coding DNA Sequence Number=SeqID_57282
  Gene Ontology: Mol. function=transferase activity, transferring glycosyl groups; Cellular component=cytoplasm; Biological process =metabolic process
  Homolog annotation: Hit_ID=Q8S998; Match level="QueryCoverage=95%, HitCoverage=100%, E-value=0.0, Identity=74%"; Hit description =Glucosyltransferase-11
  Pfam annotation: Domain name=UDPGT; Domain location=4-480; Score= -53.5; E_value=6.3e-08; Accession=PF00201.9; Description=UDP -glucoronosyl and UDP-glucosyl transferase
MAKAHVLIFPLPLPGHLGSMLKLAELLALDNIHVTFVDTENIHIRLTRFGDIQELSECYPTLHFKTIPDCYDEEGEHPGFGDRVGDFITSTAQHAKPFLRDILVSQHSPGIPKVSCIIQDGIFGALSSDFAAELRIPLIHFRTVSSCCFWAYFCVPKLLDCKELPIKGEEDMDRIIRNMPGMENLLRCRDLPSFCRPNTEGNFLEWAVFRTRQSLAADALMLNTFEDLEGSVLSQMGQHFPKLYTIGPIHHHLKIRKAESNKAKDIPTFKNSLFQVDRSCMAWLEAQPQGSVIYVSFGSSTIVKREDLMEIWHGLVNSKKRFLWVMRPDIVAAKDNDDRIPAEVEEGTRERGLIVGWAPQEDVLAHKAVGGFFTHNGWNSTLDSVVAGVPMICWPYFADQQINSRFVSEVWKLGLDMKDVCDRHVVEKMVNDLMVHRKEEFLKSAQEMAMLAHKSVTPGGSSYSSFDDLIQYIKSASKEKN

SEQ ID NO: 174061 - protein, 120 aa, Glycine max
  Coding DNA Sequence Number=SeqID_57283
  Gene Ontology: Biological process=lipid metabolic process
  Homolog annotation: Hit_ID=O80959; Match level="QueryCoverage=80%, HitCoverage=21%, E-value=7e-12, Identity=41%"; Hit description =Similar to latex allergen from Hevea brasiliensis
MAEPHLAPSATLGLFTPFHFSSINEKTSCAVVDGGLVINNLVAAAIMHVLHNKRDFLSVNSVEDLLVLSIENEAQAKRMNNIGECSTSTVVDIALEGVFKTVDQMLENAFCWNHTIYVKI

SEQ ID NO: 174062 - protein, 320 aa, Glycine max
  Coding DNA Sequence Number=SeqID_57284
  Gene Ontology: Mol. function=transferase activity, transferring glycosyl groups; Biological process=metabolic process
  Homolog annotation: Hit_ID=Q8S997; Match level="QueryCoverage=89%, HitCoverage=74%, E-value=1e-110, Identity=61%"; Hit description =Glucosyltransferase-12
MTEGEGAHALIFPCPLQGHVGSMLKLSENPTLRSIIHFRTSNACCFWPYFWIPKLFECKELPIRYEDMYRIICNMPGMGNLLRCRDLPSFCRPGTEGNLSMDWVWFQTKQSLAADAVILNTFEDLFSPDTSSLSQTLHHHLNPQGSVIYVSFGSSTVLTREELVEFWHGLVNRKNRFLWVMRPDLVVGKENGDWIPAELEEGTKERGFMVGWAPQEEVLAHMAVGEFLTHSGWNSTLESLVNSRFVSEVWKLGLDMKDVCDRKVVEKMINDLMVHRKEEFLKSAQEMAMLAHKSISPGGSSYSSLDDLIQYIKSACLENS

SEQ ID NO: 174063 - protein, 94 aa, Glycine max
  Coding DNA Sequence Number=SeqID_57285
  Gene Ontology: Cellular component=membrane
  Homolog annotation: Hit_ID=Q0TH27; Match level="QueryCoverage=80%, HitCoverage=39%, E-value=3e-24, Identity=76%"; Hit description=Outer membrane lipoprotein, Slp family
  Pfam annotation: Domain name=Slp; Domain location=12-94; Score=9.8; E_ value=3e-07; Accession=PF03843.4; Description=Outer membrane lipoprotein Slp family
MSGALLACALLLSGCVSVPDAIKGSSQLPQQDLLRVMNAPQLYVGQESRFGGKVVKVTNLNGLTRLEIATQPLDDSARPRLGAASIGRIYAFFH

SEQ ID NO: 174064 - protein, 233 aa, Glycine max
  Coding DNA Sequence Number=SeqID_57286
  Gene Ontology: Mol. function=O-sialoglycoprotein endopeptidase activity; Cellular component=integral to membrane; Biological process=proteolysis
  Homolog annotation: Hit_ID=Q533R4; Match level="QueryCoverage=98%, HitCoverage=99%, E-value=2e-74, Identity=63%"; Hit description =Resuscitation-promoting factor
  Pfam annotation: Domain name=Peptidase_M22; Domain location=24-230; Score=184.0; E_value=3.7e-52; Accession=PF00814.15; Description =Glycoprotease family
MSARILALDTATEACSAALLNQQQIDARFEIAPRDHTQRILPLVQEVLQAQSLALSALDALAFGRGPGSFTGVRIGIGIAQGLALGANLPMIGVSSLATMAQGAWRLTGATRVLAAIDARMGEVYWAEYQRDEQGEWQGAESEAVLKPEAAQARIAQLSGEWATVGTGWQAYPQLLAGASGAQLLTTTVTLPAAEDMLPLALSAWQRGDSVAVENAEPVYLRNEVAWKKLPGR

SEQ ID NO: 174065 - protein, 71 aa, Glycine max
  Coding DNA Sequence Number=SeqID_57287
MPMVMENLVFFLLLAFTLVNRHPYWTALSPNQNGGIKGSKLTFDSIWILLFEKGLKGAPWDTHKYQCVMKS

SEQ ID NO: 174066 - protein, 61 aa, Glycine max
  Coding DNA Sequence Number=SeqID_57288
MLQLGKSLKIEDFLLSECPGFFELFCPLLDWISLHGHFTHGHHILLVLLCFYEAICCPVFK

SEQ ID NO: 174067 - protein, 61 aa, Glycine max
  Coding DNA Sequence Number=SeqID_57289
MRSRRIGSGGGREGFRGGVVIFCVGGPLGVQTKLNQIHDEVVGFLPASGNHGHYQLADEPS

SEQ ID NO: 174068 - protein, 458 aa, Glycine max
  Coding DNA Sequence Number=SeqID_57290
  Gene Ontology: Mol. function=receptor activity
  Homolog annotation: Hit_ID=Q1T2F5; Match level="QueryCoverage=80%, HitCoverage=97%, E-value=3e-41, Identity=32%"; Hit description =Cyclin-like F-box
  Pfam annotation: Domain name=DUF295; Domain location=285-340; Score =47.9; E_value=3.5e-11; Accession=PF03478.8; Description=Protein of unknown function (DUF295)
  Pfam annotation: Domain name=F-box; Domain location=2-51; Score=18.1; E_value=0.032; Accession=PF00646.23; Description=F-box domain
  Pfam module annotation: Pfam domain module=DUF295::F-box; Domain location=285-340::2-51
  Subcellular localization annotation: CTP_CleavageSite=89; ConfidenceScore=5.32e-01
MADWSELPKDLLHKISQLLLESPLYLLRFRSVCSSWRSSTPPSPFNPSISLTNTFSLSHRTLLLLNPNSNPNPNPRPRPWLVKLSLDPHASTARLFHPLSRFPMKLPRFALDLFTLPALDLGREFLLTNTRHTRDSLYIEKLVFLPLTHRKDRFALLTIHVSGKLALFRSGEDGWTVIPDMPTPYDDVCVFKGNLYGADSNGRTVRVRPDDGGLTLAAEPVFGGDKKFLVESEGALLLVDMYLSYYSCTQGLFHEDFDEEDVAGMGWERTVKFDVFRLDEEGKKWVELTDLGERVLFLGDDCAFSASAKDLNLGRGNCVAFRDDGLGFNRVLNGMGVFRLDDGHRLLLVLLLVYKAICFCPVFFKLRLSSVSMVNCAYQCHQWKNMAEGQNSAISTCYYTLWCHHGHQVIGTSSIGLNLLKQGGGFELCRWKKRGWEGSPIKGGQPDFLAKISHQQSW

SEQ ID NO: 174069 - protein, 59 aa, Glycine max
  Coding DNA Sequence Number=SeqID_57291
MKTDTEALKEQMATMMEAMMSIKEIMEVNAAAIAGTSTIAEVDLTPLYGLNQLIIQAQI

SEQ ID NO: 174070 - protein, 137 aa, Glycine max
  Coding DNA Sequence Number=SeqID_57292
  Homolog annotation: Hit_ID=Q5XM22; Match level="QueryCoverage=59%, HitCoverage=57%, E-value=3e-12, Identity=41%"; Hit description =Resistance-like protein HAAS-2
MWHHLLHPPITSAFHTFDAIDVDEAMDLLVELLEVNTQEAKDETDQCKGAYVLLAWLRDIYCNKCDASKSVTHISVVFLDAYRDLSQSGVYSWGAAALVHMYDNLNVASKHTTKHLAGYITLLQCWIYENPTIASII

SEQ ID NO: 174071 - protein, 55 aa, Glycine max
  Coding DNA Sequence Number=SeqID_57293
MEVVHRIAITLTTSRRARDSLGLKPNTRGGKQHFFGHCHWKFVVPHLNANIVGGG

SEQ ID NO: 174072 - protein, 116 aa, Glycine max
  Coding DNA Sequence Number=SeqID_57294
MWRLQSSSFLLHSAAIDLQEAKDSIDEEDPRPTSSTWNYITLDDNGILKVAQLSLDEPENSPQYNQGKTKMWDIAEDEFGPLDDNGTLEVAQLSLDEPELEVVFFNDGEQEQKEMA

SEQ ID NO: 174073 - protein, 169 aa, Glycine max
  Coding DNA Sequence Number=SeqID_57295
  Gene Ontology: Mol. function=protein dimerization activity
  Homolog annotation: Hit_ID=Q2R1C3; Match level="QueryCoverage=57%, HitCoverage=13%, E-value=4e-24, Identity=51%"; Hit description=HAT family dimerisation domain containing protein
MVISDRWSSYKEDDVNKVLFVKETLLSGIWWDKVDYILAFTTPIYDVLRKTDTDATSLHLVYEMWDSMIEKVRKAIYQHERKTKNEEPIFYEVVHSILLDHWTKSSSTPLHCLAHSLNPRTLQEMNLVHFDAILPPRALDRGVQEDWAREAREGPRVFMSLRVDFGPLD

SEQ ID NO: 174074 - protein, 106 aa, Glycine max
  Coding DNA Sequence Number=SeqID_57296
MEIKRTNEEWLKKCFVGWLNKEASLFNLQKAFLGLGWWKRLNLGGKEVVVGKGIMSSLMMNQSKKNGEVRCTWAKPTFAKALTRFCLAKLTFVSQSGPQQDDDKIS

SEQ ID NO: 174075 - protein, 97 aa, Glycine max
  Coding DNA Sequence Number=SeqID_57297
MMMQSSARLLTMRFSRNNIGEVVLSDDNIGEWRLVRVQTTLDNVMQRGKPKTRSRRDLRRPMKCLRAMAKLCPHGSCPCQKHVGHLNTPLHSRVRAS

SEQ ID NO: 174076 - protein, 178 aa, Glycine max
  Coding DNA Sequence Number=SeqID_57298
  Gene Ontology: Mol. function=sequence-specific DNA binding; Cellular component=nucleus; Biological process=regulation of transcription, DNA-dependent
  Homolog annotation: Hit_ID=Q1SEL3; Match level="QueryCoverage=87%, HitCoverage=69%, E-value=2e-38, Identity=50%"; Hit description =Transcription factor, MADS-box
  Pfam annotation: Domain name=SRF-TF; Domain location=25-75; Score =76.8; E_value=7e-20; Accession=PF00319.9; Description=SRF-type transcription factor (DNA-binding and dimerisation domain)
MESNNMPDLNGVAKKTKGRQKIEMKKMRNESNLQVTFSKRCTGVFKKASELATLCGVDVAVIMFSPDNQVFSFGSPSVDSVVQRYKTQGPPPLLTLDLNKVHSTVDEVELHTHLHCLSNQIAIEKKRTKDLNHLAKAAEDQFWWARPIESMTDSQLDKYKKMLEDFKRQLKEKRGNLN

SEQ ID NO: 174077 - protein, 136 aa, Glycine max
  Coding DNA Sequence Number=SeqID_57299
  Homolog annotation: Hit_ID=Q1T493; Match level="QueryCoverage=99%, HitCoverage=25%, E-value=7e-20, Identity=37%"; Hit description =Nucleic acid-binding, OB-fold, subgroup
  Pfam annotation: Domain name=DUF223; Domain location=40-135; Score= -1.4; E_value=0.0039; Accession=PF02721.5; Description=Domain of unknown function DUF223
MARIHDKIWSIDGSKETLKLVVRITDLWFVGTPNKSEQAEMVFVDYEGDQIHAICKSDHLKSWKADLKENCTYVMHNFKVVKNDGQFRVCEHEYKLFFIGVTVVREADLHELPFKEFRFVEFANVVAGNFVSGLLV

SEQ ID NO: 174078 - protein, 100 aa, Glycine max
  Coding DNA Sequence Number=SeqID_57300
MKGSGREGWEVFLDWLMITPSIRTGRVESSEGDVESKTSIKRMVVVAAVPMVLVVVATSGCGGSDNGIGCSGDGDNGGGVGSCANSGDGVGGSGKDHCQM

SEQ ID NO: 174079 - protein, 366 aa, Glycine max
  Coding DNA Sequence Number=SeqID_57301
  Gene Ontology: Mol. function=RNA-directed DNA polymerase activity; Cellular component=chromatin; Biological process=chromatin assembly or disassembly
MKMIIESGTIHKDIIQENHREFTQKWLQQSIHRGLKGRRCIAQAKRHYAIFVMALMGAKGGLRSSFENHEAWPRSSNNSSMVGMGKRSLIVTEFRARTLTQANQTGLEESNNLPFDFGLLAIGITIRTDVNRWGRRLKVDTMDNLAGRRVGEGSGSKAKWNRAEVERVWISRLTCGADMGVSPKDTSAFNVTGPNPFNQAIPNTTSAPLMRNLVAVEDGTVADQDAQWRGLGDRQVQELGDAWLDEIVGSSGVGSEEGERGGLGSVVTKALLATKNHLLWRTGGSCGDGQSTCPPGVSPRRRPGPDDAVSKTLEVRKAISRGNKAIAVHPLVPAQGWTIHVKRGHGDAVLKTPATVAEEARSIDSS

SEQ ID NO: 174080 - protein, 68 aa, Glycine max
  Coding DNA Sequence Number=SeqID_57302
  Gene Ontology: Mol. function=protein serine/threonine kinase activity; Biological process=protein amino acid phosphorylation
  Homolog annotation: Hit_ID=Q1SMH9; Match level="QueryCoverage=73%, HitCoverage=8%, E-value=1e-17, Identity=80%"; Hit description =Protein kinase
MEQYEILEHIGRGSFASALLIKHRHENKRYILKKIRLARQTDRTSRSAHQECFWFMLHKWELFWTGKV

SEQ ID NO: 174081 - protein, 67 aa, Glycine max
  Coding DNA Sequence Number=SeqID_57303
METKEMNKMTPQSHFDNRHLDGNQNGSTQKPKRSLLILTDKQGLIFTQPHQNGSTQKAIPRYDNKSS

SEQ ID NO: 174082 - protein, 136 aa, Glycine max
  Coding DNA Sequence Number=SeqID_57304
  Homolog annotation: Hit_ID=Q9LTU4; Match level="QueryCoverage=65%, HitCoverage=6%, E-value=2e-10, Identity=35%"; Hit description =Helicase-like protein
SGSNFMNPFEDCQSPTNQPVINTKGYSDLGDQLIQYRYCNAQMWYDERISKNKNCQNPRFSLYSGDGKVELPLLQNPPQYLQQLIFHDDTIDSKNYQHNLRAYNIMFAFTSAGIKLDKTINNSRGPTTIKIRATMP

SEQ ID NO: 174083 - protein, 682 aa, Glycine max
  Coding DNA Sequence Number=SeqID_57305
  Gene Ontology: Mol. function=RNA-directed DNA polymerase activity; Cellular component=chromatin; Biological process=chromatin assembly or disassembly
  Pfam annotation: Domain name=Chromo; Domain location=593-644; Score =28.0; E_value=3.2e-05; Accession=PF00385.14; Description='chromo' (CHRromatin Organisation MOdifier
  Pfam annotation: Domain name=rve; Domain location=308-460; Score =61.9; E_value=2.1e-15; Accession=PF00665.16; Description=Integrase core domain
  Pfam module annotation: Pfam domain module=Chromo::rve; Domain location=593-644::308-460
MLTWPVPSSQKELCSFLGLTGFYRHFIKGYVSIASALTPLLCKDKFLWSPAAQAAFDRLKQAMTCAPMLAPPDFAIPFVLETYASNSAMGAVLMQQGHPITFFSKQFSPRMQRASMYVRELHVMTTAIRKWRHYLLGHPFTILTDHRSLKDLMSQVIQTPEQQYYLTKLLGYDYKIAYKPGATNVVADALSRIESGRDSTLFILTYPYFDFMTQLRQSLHSSPDFQAMRDSILRDPIAYPDYRIQDDLIFCKGSIWLDSKNPFIQTLLLEFHSSPLGGHLGVAKTLHRLQANFHLTHRLAGLLQPLSVPLGIWEDLSLDFITHLPKSHGYTVILVVVDHFTKGVHLGALPAQFTASKVATLFFDIVCKLHGIHRSLVSDRDQVFVSAFWRKLFKLSGTLLRLSTAYHPQTEVMNCVVEQYLCSFTHSRPSEWHQFLSLVEWSYNTSLHSSTGMTPYEATFGKPPSSIPDYVVGTSRNEVVDSLLTNRQIIHASLTQCLLKAQAAMKKYVDAKHRDKEFTGSVTKTTNQKLAKRYFGPFEILERIGSVAYRLKLPTDSRIHPIFHYSLLCPHYGPISPHPSALPPHVVDNQPVLEPLSIISSKMDLTTSPLTPMVLVQWVGLPPEEATWEPWNTIRDTYHLEDKNPTEDIPVPQGSSKPNEVETHRERPKRSTKRPTYLDQYT

SEQ ID NO: 174084 - protein, 94 aa, Glycine max
  Coding DNA Sequence Number=SeqID_57306
MEANTFLPPATKSQAKYSDDKSKTGRQIPSGSLYLARKHLLERKLVHFFGGVNATDAASSFAGASIVSSSATAALIVLENLRGFEREKERCGRN

SEQ ID NO: 174085 - protein, 154 aa, Glycine max
  Coding DNA Sequence Number=SeqID_57307
  Homolog annotation: Hit_ID=Q1SAV4; Match level="QueryCoverage=40%, HitCoverage=24%, E-value=1e-08, Identity=50%"; Hit description =Integrase, catalytic region
MEREPCRLILADVFSHSCAAAEGDDLGLGGGRRKIQSFNSLVEMLEIKRGAFGASFGPLPMGLDFIGLAASLWHRYVFSWVLGIASNTPCRENHLVLKVVSIADGIPRLPRVLGLVDYRRREGAEHWGGEKWDHSEDKVRSSGKWGESLNQLAV

SEQ ID NO: 174086 - protein, 57 aa, Glycine max
  Coding DNA Sequence Number=SeqID_57308
  Homolog annotation: Hit_ID=O82667; Match level="QueryCoverage=55%, HitCoverage=5%, E-value=9e-09, Identity=84%"; Hit description=MAP3K alpha 1 protein kinase
MTNYQKSASNNLIRRSICSVSFHRDIKGANILVDPNGEIKLTDFGMAKHVSLFAFRE

SEQ ID NO: 174087 - protein, 160 aa, Glycine max
  Coding DNA Sequence Number=SeqID_57309
  Gene Ontology: Mol. function=transferase activity, transferring glycosyl groups; Biological process=metabolic process
  Homolog annotation: Hit_ID=Q8S997; Match level="QueryCoverage=67%, HitCoverage=25%, E-value=4e-22, Identity=47%"; Hit description =Glucosyltransferase-12
MNDGYSNLVCYVYGEGSEDSIGYEAIDLGLSGVLGEKNVSDVRFCVQIYVLKEVHCALSGTRVVVREAIGEGLELERGIAETVEAVVDEVCVEEGDVEAMESEKLCKLQHGADMALRWTGEDGHETPLQGGRRVERRRHFKERMSQEKAHHHRKPWIRAW

SEQ ID NO: 174088 - protein, 505 aa, Glycine max
  Coding DNA Sequence Number=SeqID_57310
  Gene Ontology: Mol. function=transferase activity, transferring glycosyl groups; Cellular component=cytoplasm; Biological process =metabolic process
  Homolog annotation: Hit_ID=Q8S9A7; Match level="QueryCoverage=95%, HitCoverage=99%, E-value=1e-159, Identity=59%"; Hit description =Glucosyltransferase-2
  Pfam annotation: Domain name=UDPGT; Domain location=31-501; Score= -60.8; E_value=1.5e-07; Accession=PF00201.9; Description=UDP -glucoronosyl and UDP-glucosyl transferase
MIPIIYEAYMSKAQKENATRAKMKAEETTDTHVAIFPCPAQGHVSTMLKLAQLLALHGFHITFLNTDFIHHRLHRFGDLEALLQTYPSLQFKTFPDGLPHHHPRSGQSAVDLFQYINLHAKPHIRHILLSQDPGKPKINCFIADGVFGALTIDVAHQVGIPIIHFRTISASCFWTYFCVPNLFQSNQLPITGDEDMDRVITCIPGMENMFRCRDLPSFSRGTGSEIVYALNSLALETRESLQARALILNTFEDLEGSVLSQMRLQFPRVFTIGPLHAHLNTRKESNTETTPSTSCVGEVDRRCMTWLDSQPLKSVIYVSFGSIATMTREKLIEIWYGLVNSKKRFLWVVRPDMVGPKENGDRVPAELEEGTKERGFIVGWAPQEEVLAHKAIGGFLTHSGWNSTLESLAAGVPMICCPSFGDQHVNSRFVSEVCKVGLDMKDVACDRNLVENMVNDLMDHRNEVFLNSAREVALLANRSVSSGGSSYSNLDGLIQYIRSISQEII

SEQ ID NO: 174089 - protein, 228 aa, Glycine max
  Coding DNA Sequence Number=SeqID_57311
MAIQDILPNKVKHAITRLCFFFNAICSKVIDPLKSYELENKTAIILCQLEMCIVEEAIEFYSEYIEKTKFVGLFESWHDKRVGDPCDERWSVVLHGKTIGINVKMMMIQLLILVHMATPPNSLHPPPKSAAPSSFTSKKTRKATRLRSLDTRQVGVERPVVHVDPTTRKSMTEFDIHEPSDLRIKKKILHTVGERWRQFKSNLTSKWALTDDKEGKDDKDVSKKAHAI

SEQ ID NO: 174090 - protein, 67 aa, Glycine max
  Coding DNA Sequence Number=SeqID_57312
MANPGCKLHFGLGCSAGNKSGVGYRKQGRSLGPESCLLFLLKAVIMNFDYSFLVLDMRGTKRNLSSN

SEQ ID NO: 174091 - protein, 119 aa, Glycine max
  Coding DNA Sequence Number=SeqID_57313
MGKVDGVQERIKADIEALKEQMAIMMEAMMSMKKMMEANIAAVAEGGKELGSAGAPHFVQVQNKHPFPPYGLPPNYTPPNVVHTPYENVNNSIPILIESQQPQSDHAHVSQPMREAHEG

SEQ ID NO: 174092 - protein, 131 aa, Glycine max
  Coding DNA Sequence Number=SeqID_57314
SQLIDIESSTKGVDDYVGLCVSSDWIVLACIGLTKRRLMSSRLIDIESLTKGADHHATMLVSTCQWARLPLVDEGKTKLVLVVIIARTLSPMKDKDEDFESYEGEDFLSSIGEDFESYEGEDFESSKGEDL

SEQ ID NO: 174093 - protein, 48 aa, Glycine max
  Coding DNA Sequence Number=SeqID_57315
MEAKYDPIGIKGILSMKYYYLLRNLAKIQNVGVAHLEYSRFDVEYYNF

SEQ ID NO: 174094 - protein, 145 aa, Glycine max
  Coding DNA Sequence Number=SeqID_57316
MVARFHCSDTIKIPHHPKTSESDSMRRPSCLSIFIDIKAPRLLLMHLTSFMLFLLTGNEQKTQNEGEKINLGGVLQHWAHLGPSGSFNRKQPARLGKLGGNLLLHFFYKWTWRAEGKGSAPLVFIFHIKLVRTKRKEKIKAEALP

SEQ ID NO: 174095 - protein, 84 aa, Glycine max
  Coding DNA Sequence Number=SeqID_57317
MLQKKNLMVTTQDLDDSSSVDDNKEEVNLCLMPDASTNKVEPILDTGLDDEDPRSNDIVNPDGEELYVELVGLGSSSSMESFAS

SEQ ID NO: 174096 - protein, 185 aa, Glycine max
  Coding DNA Sequence Number=SeqID_57318
  Gene Ontology: Mol. function=protein serine/threonine kinase activity; Cellular component=cytoplasm; Biological process=protein amino acid phosphorylation
  Homolog annotation: Hit_ID=Q9LSM2; Match level="QueryCoverage=94%, HitCoverage=41%, E-value=4e-65, Identity=66%"; Hit description =Similarity to lectin-like protein kinase
GNNWRCNKLQISDFGLAKWLPSKWTNHVVFPIEGTFGYLAPEYFMHGVVDEKTDVFAFGVLLLELITGHRAVDSNSRQSLVIWAKPLLDTNNVKDLADPRLGEEYDLTEMKRTMLTASMCVHHASSKRPYMNQVVLLLKGEETIIEPKKNLVAQKSLMLEACDLEDYTCSSYLKDLNRHRQLIME

SEQ ID NO: 174097 - protein, 154 aa, Glycine max
  Coding DNA Sequence Number=SeqID_57319
  Gene Ontology: Mol. function=monooxygenase activity; Cellular component=membrane; Biological process=electron transport
  Homolog annotation: Hit_ID=Q1S220; Match level="QueryCoverage=75%, HitCoverage=31%, E-value=3e-24, Identity=40%"; Hit description=E -class P450, group I
  Subcellular localization annotation: CTP_CleavageSite=37; ConfidenceScore=5.18e-01
AFGASFGPLPMGLDFTGLAASLWHRHSFIVNSNMNLLLAAVTLLVFYMVNFFYSNLWIPWRTEHYFKEQGIWGPDYRLILGNSLEIRRLYDEAKSEPTPSFDHHHVIMGRVEYVKVPFNPQSKMLFGQGLVGLEGDQWAFYRSIINLAFNFGTC

SEQ ID NO: 174098 - protein, 123 aa, Glycine max
  Coding DNA Sequence Number=SeqID_57320
  Gene Ontology: Mol. function=protein serine/threonine kinase activity; Cellular component=integral to membrane; Biological process=protein amino acid phosphorylation
  Homolog annotation: Hit_ID=Q1T003; Match level="QueryCoverage=97%, HitCoverage=17%, E-value=2e-43, Identity=74%"; Hit description =Protein kinase; Concanavalin A-like lectin/glucanase
MGATEKTDVFSYGVMVLEVASGRRPIEKDAPAVGNGKVGISINLVEWVWSLHQEGKLLTPADPRLEGKFEEGEMRKELLVGLACSHPDSMARPTMRGVVQMLLGEAKVPIVLRAKSSTSYSTS

SEQ ID NO: 174099 - protein, 39 aa, Glycine max
  Coding DNA Sequence Number=SeqID_57321
MSGRLSFTIANWPYCGSSLIIATPASSACSLCTEYVGVC

SEQ ID NO: 174100 - protein, 103 aa, Glycine max
  Coding DNA Sequence Number=SeqID_57322
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q1SP46; Match level="QueryCoverage=84%, HitCoverage=22%, E-value=9e-33, Identity=71%"; Hit description =Protein phosphatase 2C
MSKDHMPLCIKERKRIKSLGGYIDDGYLNDQLGLNYALGNWNLQGMKEINGKGGPLSVEHKLKLITLTKEDEFFIIGSDGIWDVFTAKMPYTLLEGVFKSTMM

SEQ ID NO: 174101 - protein, 133 aa, Glycine max
  Coding DNA Sequence Number=SeqID_57323
  Homolog annotation: Hit_ID=Q1T254; Match level="QueryCoverage=74%, HitCoverage=28%, E-value=1e-07, Identity=31%"; Hit description =Peptidase aspartic, catalytic
  Subcellular localization annotation: CTP_CleavageSite=65; ConfidenceScore=5.07e-01
MPLRGRIASMQVVFQNQGQGWRSHPGNQFNKDQGGPSNRPQNQRPSLYERTTKLEETLAQFMQISMSNPKSTESTIKSLEIQVGQLAKQIDENSSRSFGANSEKNPKEECKAVMTRSKRETMVEDENKTSDEK

SEQ ID NO: 174102 - protein, 187 aa, Glycine max
  Coding DNA Sequence Number=SeqID_57324
  Homolog annotation: Hit_ID=Q1KL58; Match level="QueryCoverage=59%, HitCoverage=7%, E-value=3e-14, Identity=41%"; Hit description=Dicer -like 2 spliceform 1
  Pfam annotation: Domain name=dsrm; Domain location=45-110; Score =22.3; E_value=0.0017; Accession=PF00035.15; Description=Double -stranded RNA binding motif
VLGDIVESLAGAILVDSGYNKEVVWQSIRPLLEPLVTPETLKLHPIRELNELCQKRSYKIILEDVSRKDGLTYYRMEVEADGIIHKYEYKGDALRDTAKKIVCKEILNSLKDGGAHKDTAKKIVCEEKLNSLKEGESNEKPGDYQEAEKLTAVKGCLEEKAMSFLAKIAKFESDFESKMAKSDEFVH

SEQ ID NO: 174103 - protein, 218 aa, Glycine max
  Coding DNA Sequence Number=SeqID_57325
  Gene Ontology: Mol. function=nucleoside-triphosphatase activity; Cellular component=chloroplast
  Homolog annotation: Hit_ID=Q2PMM5; Match level="QueryCoverage=92%, HitCoverage=10%, E-value=9e-98, Identity=81%"; Hit description =Protein ycf2
MESIPNIYTMVPYLDREFFYSILFLLLVAGYLVRTHLLFVSRVYSELQTEFEKNLFLVALEQLGDSLEEIRSFAFGGNMLWGGGPTYGVKSIRSKKKYLNLIDLISIIPNPINRIAFSRNTRHLSHPSKTIYSLIRKIKNVNGDWIDDKIESWVLNSNSIDDKEREFLVQFSTLTTEKRIDQILLSLTHSHHLSKNNSGYQMIEQPGAIYLRYLVDLP

SEQ ID NO: 174104 - protein, 134 aa, Glycine max
  Coding DNA Sequence Number=SeqID_57326
MILKEAFNLEVPIQLPQKKPPRTGSNTTKYYRYHHGIGHNTKDYWTLKDKIEELIQVRDFKGINLVNQDDPMVVSIIIANFMVSRVLIDQGASLISCIGKPSKDSRSHPTLSTLTLVHSWVSQVREARPEATWT

SEQ ID NO: 174105 - protein, 89 aa, Glycine max
  Coding DNA Sequence Number=SeqID_57327
  Gene Ontology: Mol. function=RNA-directed DNA polymerase activity; Biological process=RNA-dependent DNA replication
MGEERRTAVKEKVNNLLHANFITEVRLVDGTPGFQVLSFPDTYSRYNQIRMHPPDEEKMTFIIEHDNFCYKVMPFDLKNASTTYQQPMD

SEQ ID NO: 174106 - protein, 1097 aa, Glycine max
  Coding DNA Sequence Number=SeqID_57328
  Gene Ontology: Mol. function=double-stranded RNA binding; Cellular component=intracellular; Biological process=RNA processing
  Homolog annotation: Hit_ID=Q1KL58; Match level="QueryCoverage=98%, HitCoverage=76%, E-value=0.0, Identity=50%"; Hit description=Dicer -like 2 spliceform 1
  Pfam annotation: Domain name=DUF283; Domain location=343-425; Score =47.9; E_value=3.4e-11; Accession=PF03368.5; Description=Domain of unknown function
  Pfam annotation: Domain name=Helicase_C; Domain location=194-275; Score=55.1; E_value=2.3e-13; Accession=PF00271.21; Description =Helicase conserved C-terminal domain
  Pfam annotation: Domain name=PAZ; Domain location=593-733; Score =10.6; E_value=0.00017; Accession=PF02170.12; Description=PAZ domain
  Pfam annotation: Domain name=Ribonuclease_3; Domain location=772-912; Score=103.9; E_value=4.7e-28; Accession=PF00636.16; Description =RNase3 domain
  Pfam annotation: Domain name=Ribonuclease_3; Domain location=984 -1052; Score=64.9; E_value=2.7e-16; Accession=PF00636.16; Description= RNase3 domain
  Pfam module annotation: Pfam domain module=DUF283::Helicase _C::PAZ::Ribonuclease_3::Ribonuclease_3; Domain location=343-425::194- 275::593-733::772-912::984-1052
MKVYTCVSEAVLTEFIPTSTPKFKFYQGNEVQSVLFEDLAFKLKMLKEQHESNLKSSDFTKSAAEFARRRTKKIFSALIFCLDELGVWLALKAAESLSSNDIQLFSWGHSGDTVVKNFISAGVQTLKTYLPCGPQWSIGDNIKYDVEMELLSSKVCCLIDSILEYRGLTDMRCIIFVERVITAVVLRDLLNTLLPKYNSWKTKFIAGQNFGLQNQSRKKQNEIVEEFRMGLVNIIVATSILEEGLDVESCNLVIRFDPCHTVCSFIQSRGRARMQNSDYILMVKSGDSVTCSRLAKYLASGDIMRKESLRHSSLPCDPLEEDRFDKETYRVASTEAFANLSSSISLIHLYCSRLPADGYFKPTLRWDKETGTLYLPKSCPLQPIRVEGDKKILKNIACLEACKQLHKIGALSDNLVPDIVMEEAEVEELGNEPYDENQPTFVPFGLVNSVSNNSQTVYHCYFMEFNNKFSYDVSVQDIFLLMRIELDPEIGCMQFDMGFDRGSLSVNFRYKGTINLSPDQVLLCKKFQVTILRILIDHDMNKLTAGLDRCYLEDDLEIDYLLLPAMGKGKYTAINWLAVNSVNPSEVSCKYHEPHIRTKSGLVCSCKLQNALVCTSHPIGKISFYIATGTMELDGNSPMELRGGGVTTYKKYYEQHHGIQLQFEHQRLLKARHIFQVKNHCHGRKQGKEGEVSKAFVELPPELCSIVMMPISDSLIYSYSFIPSIMHRFESLLGAFNLKKMHLDHCARNEIQTIKVLEAITTKRCKEAFHYESLETLGDSFLKYAASQQLFKTYHNHHEGLLSLKREKIISNAALCKLGCSSGLPEETSMECRQKIVECVQIARLWAGGFIRNEPFDPNTWIIPGDKPRSFKLKELVAKGKTIYVSGKRKLRQKIVADVVEALIGAFLSTGGEKAALLFMDWVGIKVSFNKIPYDRHFDIQPEKLVNVSFLESQLNYSFHDRSLLVEAVTHGSYMLPEVPRCYQRLEFLGDSVLDYLITWHLYNKYPGMTPGQLTDMRSASVNNDCYAWSAIKHGLHKHVLHASQELHMHVSATLNKFDKLSSLSTFGYEAETSLPKIEEVSRLPLMLRTNLEKYYN

SEQ ID NO: 174107 - protein, 124 aa, Glycine max
  Coding DNA Sequence Number=SeqID_57329
  Gene Ontology: Mol. function=binding; Cellular component=membrane; Biological process=photosynthesis
  Homolog annotation: Hit_ID=O65310; Match level="QueryCoverage=97%, HitCoverage=27%, E-value=7e-36, Identity=61%"; Hit description =Pollenless3
  Subcellular localization annotation: CTP_CleavageSite=43; ConfidenceScore=5.29e-01
MLFERGSPARCYMTPPPQRTSPWKPPHSRSSSVPFSERKMSPNSVNKSDIFHIIHKVPAGDSPYVKAKQVQLVDKDPGRAVSLFWAAINAGDRVESALKDMALVMKQLNRSDEAIEAIRSFRHL

SEQ ID NO: 174108 - protein, 55 aa, Glycine max
  Coding DNA Sequence Number=SeqID_57330
MVEDVAAKGDKGLEIRKELEVEDVDWKSGDVRSVCSMVGTQLDNEGGEGFGSKTI

SEQ ID NO: 174109 - protein, 91 aa, Glycine max
  Coding DNA Sequence Number=SeqID_57331
MGIDGHLRKCPWRVLFFFKEGKLNLGFGISHTCLTCSSPGNGFGFSPHLLIPTNQSVSFFTFNFDRAKLFTNQNPPQVVIFETSTIYFDRL

SEQ ID NO: 174110 - protein, 194 aa, Glycine max
  Coding DNA Sequence Number=SeqID_57332
MKTLMRKRELECLMCSTKGHMTSQCRRWKTLTSELKEKEMKENELRENEMRQKELREKENEMKEQEIQQKAIREREIIKKELEKERAKDKEKYDCSYFYSNPLFDCHDHLVKEFEELFQKEESKASNEYQLEFSKTLDVATKGHCPFQVVEKMSDTSYNLQFHDDELDLRMNFFEEGWNDMIQQGSNVFKYILQ

SEQ ID NO: 174111 - protein, 125 aa, Glycine max
  Coding DNA Sequence Number=SeqID_57333
MNEIEDEVSMEECRTLILSSKNDELNSYCNYVCASNYEMSFVLMPKEELFINNQWARQFGKEMDAHENQANHWDKKILNHIISRPNVLIDMKGPVTRAMSKRLQEDWARTAEEGPRVLMNLRVDF

SEQ ID NO: 174112 - protein, 51 aa, Glycine max
  Coding DNA Sequence Number=SeqID_57334
MEGCCPLRQTAPVSLASLARKRARCDTDPFRALAQAIGNSKKGEAIGVAGY

SEQ ID NO: 174113 - protein, 94 aa, Glycine max
  Coding DNA Sequence Number=SeqID_57335
MPCDALKRLLTSTVDIKTGGVISKKWEITKKKSEMAQPSISLSAYLVLSETGDIGAKRDVKHESQNSRLARNRKQNPLSERSPLSARSNRSTKR

SEQ ID NO: 174114 - protein, 476 aa, Glycine max
  Coding DNA Sequence Number=SeqID_57336
  Gene Ontology: Mol. function=ubiquitin-protein ligase activity; Cellular component=ubiquitin ligase complex; Biological process =protein amino acid phosphorylation
  Homolog annotation: Hit_ID=Q9FGD7; Match level="QueryCoverage=98%, HitCoverage=54%, E-value=5e-88, Identity=41%"; Hit description =Similarity to receptor-like kinase
MDAIQTEKIYVAVGNDVQDGYKTLNWALKKWNSHPISIVILHLTHNSTKDYVHTPFGKLPARSVSEEKLQILRKDEQDKINKLLSKYIAFCGKVPAEILEVEKFDEPMQKRVIDLIFGLGITKLVMGFSFMKPSMKSKGAINGLFHVHEQKPSFCELFVICGGKQVFLRGKNDEKIMEDDQGVMVARMRDKITFKDWLDKWFKDKTNDSQDRIASLSSSNLESPVNRNQWEFYLQEIENYYQELLSSKPEEGSCVQENDDSQIGPIEPHVTEQNNYNMSTAEKIEILKNKLNEGQKTIQLKRKEAKDNIERHTKAEWAICLCNSRAEELESRIREEVSAREELKKESDAEKEQTEEMRTEVEERKRRLSSLTEVQSELSNRLQIWTLAKIRAETQLEKAVGERREMGREIEELRRQRDVLNRRIEFCKQKDAIGMAARLAETTFCAFREYTEEELRLATDNFSERLRLKSGGDWTN

SEQ ID NO: 174115 - protein, 502 aa, Glycine max
  Coding DNA Sequence Number=SeqID_57337
  Gene Ontology: Mol. function=transporter activity; Cellular component= integral to membrane; Biological process=transport
  Homolog annotation: Hit_ID=Q6SZ87; Match level="QueryCoverage=98%, HitCoverage=72%, E-value=0.0, Identity=68%"; Hit description =Nucleobase-ascorbate transporter 11
  Pfam annotation: Domain name=Xan_ur_permease; Domain location=1-398; Score=163.8; E_value=4.3e-46; Accession=PF00860.11; Description =Permease family
HYLSLAGSLVLIPLVMIPVMGGTDKDTATVISTMLFLSGITTILHSYLGTRLPLVQGSSFVYLAPALVIINAQEYRNLTEHKFRHIMRELQGAIIVGSVFQCILGFSGLMSILLRLINPIVVAPTVAAVGLAFFSYGFPQAGTCPEITIPQIALVLIFTLVPLSLTIIWIYASFLTAGGAYNYKGCNPDIPSSNILLDACRKHAYTMKHCRTDVSNALSTAAWVRMPYPLQWGIPIFHFRTSIIMVIVSLVASVDSVGTYRATSLQVNSRPPTPGVVSRGIALEGFCSILAGLWGSGTGATTLTENMHTIDVTKVASRKVVVVGAAFLIMFSFIGKVGALLASIPLALAASVLCFMWALTAALGLSNLQYSQSASFRNITIVGVSLFLGMSIPAYFQQYQAESSLVLPSYLVPYAAAASSGPFRSGIKQLDFAINALMSLNMVVTLLVAFLLDNTVPGSQEERGVYQWSRAEDIATDPSQQSEYSLPKKVARCCCRFKCLGV

SEQ ID NO: 174116 - protein, 162 aa, Glycine max
  Coding DNA Sequence Number=SeqID_57338
  Gene Ontology: Mol. function=N-acetyltransferase activity; Cellular component=cytoplasm; Biological process=metabolic process
  Homolog annotation: Hit_ID=Q9FKI4; Match level="QueryCoverage=95%, HitCoverage=92%, E-value=1e-65, Identity=71%"; Hit description =Similarity to N-acetyltransferase
MVCIRKATVKDLLAMQACNLFCLPENYQMKYYLYHILSWPQLLYVAEDYNGRIVGYVLAKMEEETTDCHGHITSLAVFGAEYVSLHVRKSNRAAFNLYTETLGYKIHDVEAKYYADGEDAYDMRKQLKGKQHHHHHHHHHHRHEHGGGCCSGEPKGNVAKAT

SEQ ID NO: 174117 - protein, 66 aa, Glycine max
  Coding DNA Sequence Number=SeqID_57339
MVLERNLLLSPPLEPHHTTPYHCEKEAKASISRSRTKCEISALSATGAFSQAKRETGAKPNLTYLR

SEQ ID NO: 174118 - protein, 199 aa, Glycine max
  Coding DNA Sequence Number=SeqID_57340
  Gene Ontology: Mol. function=transporter activity; Cellular component= integral to membrane; Biological process=transport
  Homolog annotation: Hit_ID=Q6SZ87; Match level="QueryCoverage=81%, HitCoverage=20%, E-value=6e-12, Identity=31%"; Hit description =Nucleobase-ascorbate transporter 11
METGSKSESLNRNVAMSVRGGTGKKKQQGGVAGKVDSFVPRSEHNPRELRSWAKRTGFVSDYSGEAGTSGSAKFEALERRREGSSPKIEIDPVVGRARQNEIVPESHGGATRGENGAVLDGRGRKEKENEGGERKVGFNGNGNGHGVSAVAPVNEEKEGEEGNGDVKVNVFPEGEEVGDGGWQGPLGLKCGLKENPGIG

SEQ ID NO: 174119 - protein, 100 aa, Glycine max
  Coding DNA Sequence Number=SeqID_57341
  Homolog annotation: Hit_ID=Q2LC23; Match level="QueryCoverage=98%, HitCoverage=63%, E-value=7e-28, Identity=57%"; Hit description=SGT1 protein-like
DSDESDIAELDEDTEDGEEIFMRSYSDAMNEELKTTTLQKSFVRANEQIPKKDQGTSNASEHIVDEDFSPVDVDQGLPGPASNLLGLMGVQLPQDGKKGK

SEQ ID NO: 174120 - protein, 171 aa, Glycine max
  Coding DNA Sequence Number=SeqID_57342
  Homolog annotation: Hit_ID=Q9LSM6; Match level="QueryCoverage=90%, HitCoverage=88%, E-value=5e-07, Identity=30%"; Hit description =Arabidopsis thaliana genomic DNA, chromosome 5, TAC clone:K19O4
MAVSLTRLSWWLWGRSNKEKEPVVSGGSTLNSSSEWSFKERESVKFPSVKGTKIAPSHRKVKRKWQSREERRHDREYDVVLVPSDGDGCLSSSESDDSDFSIGWLEPHGSDFLQSDDDLDNSFAVLVPCYRKEVESSNKELLSAIKNLPNEFSSDANALLSNYKCNGNWGL

SEQ ID NO: 174121 - protein, 965 aa, Glycine max
  Coding DNA Sequence Number=SeqID_57343
  Gene Ontology: Mol. function=kinase activity; Cellular component =proton-transporting two-sector ATPase complex; Biological process =ATP synthesis coupled proton transport
  Homolog annotation: Hit_ID=Q94CG5; Match level="QueryCoverage=99%, HitCoverage=96%, E-value=1e-179, Identity=39%"; Hit description =Kinase interacting protein 1
  Pfam annotation: Domain name=KIP1; Domain location=1-52; Score=80.5; E_value=5.3e-21; Accession=PF07765.3; Description=KIP1-like protein
MEEKVQTVLKLLEEEGDSFAKRAEMYYKRRPELISFVEESFKAYRALAERYDHISTELQNANNTIASVFPDRVPFMDEEDDDGSPRPSRKKAEGFKTNIPKPPIKDLKNVITTAAATRKFHSKKPAATAASAAPKVPKSGLSRKEALEEVDKLQKQILALQTVKEFVKNSYDNSIARYWETDEQIKELQERVSTLQDELGEGVDIEDDEARRLMAEAALKSCQEALTQLQEKQEKSLDETRIESKRVKDVKAKLGSLMDEFHYEQSNSEEPRVQRDLKEIAETKDLEENAGLAPKKQELQLLKENIKEHFETSSNSSLSVAEMAEKIDELVNKVISLETAVSSQTVMVTRLRTDTDELQEQIRTLENDKESLIKDRNKLNEQLRKMEEKMHGVQDLNQIVEDKNNNLQTQFNEAHSNLDQLSEKVQNVQQPGEEAKTTDLSHTQKDSSSQAELKSKSEGQVPLNEDNILLNDIKSEKELTNDLVEDDAKDKELKVAGTVEDDVTSDNKLEATGSPFANEPNVTRSLENDAKSVDKVKVTSSLEMEEATPMEKKSPKELEEQEKTVNPGNDEKTTVAVSTTTENQEVSQLPASNKADSSSESSEKQPENDAKQSSCEIDNALKVDPKGQATAQEDEPDWQQLFTNGMQDREQVLLSEYTNTLRNYKDMKKRLAEIEKKNQDSNSDSSLQLKELKTANAMKDEEIRHLRQKLGLLQRSMEGNEDFTEELLQIEPPESTSPIEEKFRSNMDEVLEENLTFWLKFSAYYSEIQKFETTIKDLLTDLSKLEEKGKSSEGSSSIKHSIKSDSRPIYRHLTEIQNEITVWMERGALLKEELQSRFSSLCDIQEQITSALKTSAEDDDFRFTSYQAAKFQGEILNMKQENNKVADELQAGLDGVTSLQLEIEKALVKLNDEFGFSASKRQQNGQLRQSETRAKVPLRSFIFGAKPKKQSIFSCMTPGMHRRIP

SEQ ID NO: 174122 - protein, 175 aa, Glycine max
  Coding DNA Sequence Number=SeqID_57344
  Homolog annotation: Hit_ID=Q1SC51; Match level="QueryCoverage=31%, HitCoverage=11%, E-value=2e-17, Identity=78%"; Hit description =Thioredoxin, putative
MHNSNREVEGKRKEMQNSVREVQKTEREREREREREVQKREGKRCNRDRALTKALGDSLTVRHFPALSCEFASVDVSDVLGTNRLNITKTVRKFSIDSNLRPTGAEFHSGTVANAVKHDDEVDEESVEDTMNELCRSSNKAIDEEKYGLVDPALNGRPERLSQTLSWMGGVYSLS

SEQ ID NO: 174123 - protein, 152 aa, Glycine max
  Coding DNA Sequence Number=SeqID_57345
  Subcellular localization annotation: CTP_CleavageSite=49; ConfidenceScore=5.16e-01
MPTPHFHTARPHHVFNTSSSLPPPGGTTPTGSCHIQPPKLQPQPLEGLPAKILREIAIHRPFSVHQAMVLHVLLRPKSVTTKGRLLQLLCLVGDFSTKWFLFLHWAQSKKIWVACENKQTNVEETSPSSFSKLSPNNSEKATGATPEILWPF

SEQ ID NO: 174124 - protein, 39 aa, Glycine max
  Coding DNA Sequence Number=SeqID_57346
MGVVASTTRVSFSEEVVGIEPTLFMIRYHAATRTQTEML

SEQ ID NO: 174125 - protein, 675 aa, Glycine max
  Coding DNA Sequence Number=SeqID_57347
  Gene Ontology: Mol. function=structural constituent of ribosome; Cellular component=intracellular; Biological process=translation
  Homolog annotation: Hit_ID=Q949K0; Match level="QueryCoverage=95%, HitCoverage=90%, E-value=1e-37, Identity=24%"; Hit description =Putative centromere protein
  Pfam annotation: Domain name=Pox_A_type_inc; Domain location=215-236; Score=0.3; E_value=73; Accession=PF04508.3; Description=Viral A-type inclusion protein repeat
  Pfam annotation: Domain name=Pox_A_type_inc; Domain location=246-268; Score=2.4; E_value=36; Accession=PF04508.3; Description=Viral A-type inclusion protein repeat
  Pfam annotation: Domain name=Pox_A_type_inc; Domain location=5-27; Score=14.1; E_value=0.52; Accession=PF04508.3; Description=Viral A -type inclusion protein repeat
  Pfam annotation: Domain name=Pox_A_type_inc; Domain location=574-596; Score=2.2; E_value=39; Accession=PF04508.3; Description=Viral A-type inclusion protein repeat
  Pfam annotation: Domain name=Pox_A_type_inc; Domain location=616-638; Score=4.5; E_value=18; Accession=PF04508.3; Description=Viral A-type inclusion protein repeat
  Pfam module annotation: Pfam domain module=Pox_A_type_inc::Pox_A_type_ inc::Pox_A_type_inc::Pox_A_type_inc::Pox_A_type_inc; Domain location =215-236::246-268::5-27::574-596::616-638
MDVYEEMEEAKAEIEKLKVKLGDKTNTLQNIKKYYDAQVNKIQEAIFKVEKLNQEMLQKADDINDDLKESLNNKESIAKHLNAANDELGANCDDKFRKWHDEERGYVLALEEANEKLDNQEKQMHLSRQEIESMEGCFSISYNKCLEIEKNLEASSKLGEANDMFQKLEEENMKVEEQLEWKEEHFKHLGEVHEKLIDQFKASKEWELEKPTLLDEISSLKSMLDYHKRISHDLQHQLQMCNQALAHEESLRKRLEDEVSNLNKEKEEKCFQLKQMELKDAALISSKKDISEEREQAACFMRQVESYGLANELLHLPHNEFDWHKDLHMEDGFKEQLNEVYDALDRANIELDERICEKSEMEFELRIWKSFVERLRNALEENLVMRKELENSLLAQVDFSESLAQEKDSLVYKLEEKENKIECLQQHVLLFEQEPKVKETEASVPASGEIAESSENVEVRYLQIIEEKDKILEEFQKEVLSLEQESLRRELESAMIAKSNMERTNEFEKENPIQIIKGKNVRTDELMQQVTSLEQKFTNSLTSISSQLAEKQAEIIHVKEACDKITAAEVLAALEVEEKKLMLVELEYDIHDMEQKLKLKDENWRQSEQLALDIEEEMDAKQLQIKELIDQMENKLRGSDVFLQKLKIENRSLLEKCYKIVIRKGKLVGFCSGIG

SEQ ID NO: 174126 - protein, 570 aa, Glycine max
  Coding DNA Sequence Number=SeqID_57348
  Gene Ontology: Mol. function=nucleotide binding
  Homolog annotation: Hit_ID=Q9FKP3; Match level="QueryCoverage=81%, HitCoverage=93%, E-value=0.0, Identity=74%"; Hit description =Similarity to auxin-independent growth promoter
  Pfam annotation: Domain name=DUF246; Domain location=158-534; Score =741.7; E_value=4.7e-220; Accession=PF03138.5; Description=Plant protein family
  Subcellular localization annotation: CTP_CleavageSite=39; ConfidenceScore=5.40e-01
MELGYLNQGQPSRGTTPLVTLPLLLSTLVFFSTFTHAFSSSVFPELKFDNKFGGGGVKKFLCLRFDVSILRRKKKKKIEVAVVEISYFGERFGTLKEILVELNPIKPRHSRLLRSAVQRETPTSQLSELWSPLESQGWKPYVESNKPTLPEKSEGYIQVFLDGGLNQQKMGICDAVAVAKILNATLVIPYLELNPVWRDSSSFMDIFDVDHFIDVLKDDISIVKELPKEFAWSTREYYGLAIRETRIKAAPVHASAYWYLENVLPVLQSYGIAAISPFSHRLSFDNLPVDIQHLRCKVNFQALTFVSHIRTLGDALISRLRYPQGSAEEMGFNYLQEVTGAGARKNAGKFVVLHLRFDKDMAAHSACDFGGGKAEKLALAKYRQVIWQGRVLNSQFTDEELRSQGRCPMTPEEVGLLLAAMGFDNSTRLYLASHKVYGGEARISTLRELFPRMEDKKSLASSEERSEIKGKASLLAALDYYVGLHSDIFISASPGNMHNALVGHRTYLNLKTIRPNMALMGQLFLNKTIEWSEFQDAVVEGHQNRQGEPRLRKPKQSIYTYPAPDCMCQA

SEQ ID NO: 174127 - protein, 377 aa, Glycine max
  Coding DNA Sequence Number=SeqID_57349
  Gene Ontology: Mol. function=electron carrier activity; Cellular component=mitochondrion; Biological process=electron transport
  Homolog annotation: Hit_ID=Q9C6I6; Match level="QueryCoverage=89%, HitCoverage=87%, E-value=1e-110, Identity=63%"; Hit description =Electron transport flavoprotein, putative
  Pfam annotation: Domain name=ETF; Domain location=30-236; Score=32.9; E_value=6.8e-07; Accession=PF01012.11; Description=Electron transfer flavoprotein domain
  Pfam annotation: Domain name=ETF_alpha; Domain location=251-341; Score=177.0; E_value=4.8e-50; Accession=PF00766.10; Description =Electron transfer flavoprotein alpha subunit
  Pfam module annotation: Pfam domain module=ETF::ETF_alpha; Domain location=30-236::251-341
MATRALLGAIKKRAVSFPAFPGHSGYRHGSTLVVAEHEGGFIKPPSLSALAAATCLPDPYSSVSVLLAGSGPSLHQAASHAASCHPSISKVLVADSDKFKNPLAEPWAKLVHLLQQSSGYSHIIAAANSFGKNVMPRAAALLDVSPITDVTGISDSNTFVSDLSSNCLSLKNLEQMSLHVANICWKCTLNHRYTGANPCILTIRSTSFPVPQKSVDSKSNEASISQVDLSTFDEDLDKSRYISQTSQDDERPDLGNARIVVTGGQALKSCENFKLIEDLAKKLVAAGFTIAVGATRAAVDAGYVPNDLQVGQTGKIVAPELYMAFGVSGAIQHLAGMRDSKVIVAVNNDADAPIFQVADYGLFEVIPELLEKLPEKK

SEQ ID NO: 174128 - protein, 143 aa, Glycine max
  Coding DNA Sequence Number=SeqID_57350
  Gene Ontology: Mol. function=hydrolase activity, hydrolyzing O -glycosyl compounds; Biological process=carbohydrate metabolic process
  Homolog annotation: Hit_ID=Q1M320; Match level="QueryCoverage=99%, HitCoverage=35%, E-value=4e-40, Identity=84%"; Hit description =Putative beta-glycosidase
MRSYGLFDIAAVSLANSLTLFPYIDEISEKLDYIGINYYGQTISDNWEWAEGYGPKFGLVAVDRTNNLARIPRPSYHLFLRFELPSIFIVNTGKVTHEDRERAWDELQRAAKEKKTRPFYWAVDKHRLMYVVVDLTNLNNDLI

SEQ ID NO: 174129 - protein, 81 aa, Glycine max
  Coding DNA Sequence Number=SeqID_57351
MTGGSSWRRQHNIDSSDNTNNEENDNGGCDMMTMVVVTEIVTMTSIMITTMMKMVGVVTTAIVVIIMTVMTIEVVMTMVRV

SEQ ID NO: 174130 - protein, 157 aa, Glycine max
  Coding DNA Sequence Number=SeqID_57352
  Gene Ontology: Mol. function=sequence-specific DNA binding; Cellular component=nucleus; Biological process=regulation of transcription, DNA-dependent
  Homolog annotation: Hit_ID=Q52ZJ0; Match level="QueryCoverage=83%, HitCoverage=61%, E-value=1e-50, Identity=74%"; Hit description=SHORT VEGETATIVE PHASE
  Pfam annotation: Domain name=K-box; Domain location=19-112; Score =36.2; E_value=1.1e-07; Accession=PF01486.8; Description=K-box region
MKEILERHHLHSKNLARMEQPSLELQLVENSNCSRLSKEVAEKSHQLRQLRGEDLQGLNIEELQQLEMSLETGLGRIIEKKGEKIMSEIADLQRKGMLLMEENERLKRHVAGIINGQRHGGAESENFVMDEGYHTPADEKVCEEIKLTQAKVHKIMV

SEQ ID NO: 174131 - protein, 77 aa, Glycine max
  Coding DNA Sequence Number=SeqID_57353
  Gene Ontology: Mol. function=sequence-specific DNA binding; Cellular component=nucleus; Biological process=regulation of transcription, DNA-dependent
  Homolog annotation: Hit_ID=Q9FUY6; Match level="QueryCoverage=79%, HitCoverage=23%, E-value=1e-25, Identity=96%"; Hit description=MADS -box protein JOINTLESS
  Pfam annotation: Domain name=SRF-TF; Domain location=9-59; Score =110.9; E_value=3.7e-30; Accession=PF00319.9; Description=SRF-type transcription factor (DNA-binding and dimerisation domain)
MAREKIQIKKIDNATARQVTFSKRRRGLFKKAEELSVLCDADVALIIFSSTGKLFEYSSSSMVVYAQVGSVGTDSEL

SEQ ID NO: 174132 - protein, 325 aa, Glycine max
  Coding DNA Sequence Number=SeqID_57354
  Gene Ontology: Mol. function=microtubule motor activity; Cellular component=microtubule associated complex; Biological process =microtubule-based movement
  Homolog annotation: Hit_ID=Q9FKP4; Match level="QueryCoverage=85%, HitCoverage=22%, E-value=1e-111, Identity=70%"; Hit description =Similarity to kinesin heavy chain
  Pfam annotation: Domain name=Kinesin; Domain location=39-320; Score =92.1; E_value=1.6e-24; Accession=PF00225.13; Description=Kinesin motor domain
MPDQVALETEARMSSVINEKKKLFNDLLTSKGNIKVFCRTRPLFEDEGPSIVEFPDDYTIRVNTGDESLSNSKKEFEFDRVYGPHVGQADLFSDVQPMVQSALDGYNISLFAYGQTHSGKTHTMEGSSYDRGLYARCFEELFDLSNSDTTATSQCTFCITVFELYNEQIRDLLLESGKSLPKLCFGSPEYFIELMQEKVDNPLDFSRVLKAAFQSRGNNPLKINVSHLVVTIHIFYNNLVTGENSYSKLSLVDLAGSECLITEDDSGERVTDMLHVMKTLSAFFAKRHRPQWCVYMAELWPSAIFRHPSLRTMDPKKQMTEPKTP

SEQ ID NO: 174133 - protein, 214 aa, Glycine max
  Coding DNA Sequence Number=SeqID_57355
MLHYHHGVQIRALHGHEGQIGASRNRRGQIKGTHDSDNLYLIYNYLIIFFMLWCGLWGQIGRAHGAMRRENTELGWRKRERENKGRRELGWRGREVRGRGKKRKKEKIGGGETPIDVSESGSPTPLARPMGQKEVKRKVKVKGTSSSTPCVDLSVIAKEMKEINVVQKQIIKAMESNNIVKMYNILMEDTFNRIEDQHKKHEITCNYIFKKFSS

SEQ ID NO: 174134 - protein, 227 aa, Glycine max
  Coding DNA Sequence Number=SeqID_57356
  Gene Ontology: Mol. function=microtubule motor activity; Cellular component=microtubule associated complex; Biological process =microtubule-based movement
  Homolog annotation: Hit_ID=Q9FKP4; Match level="QueryCoverage=96%, HitCoverage=16%, E-value=2e-61, Identity=59%"; Hit description =Similarity to kinesin heavy chain
  Subcellular localization annotation: CTP_CleavageSite=34; ConfidenceScore=5.19e-01
MTRENCGSSKTLMIVNVCPNSSNLSETLLSLNFSARARNSVLSLGNRDTIKKWRDVANDARKELYEKEKEIQYLKQDGLRLKQALKDANDQCALLFNEVQKAWKVSSALQTDLKSEHILLADNYKVEKEQNAQLRNQVAHMLQLEQEQNLLIQQRDSTIQSLQAKIGSLEIQLNEALKSSNTGSNVGPETLSGTLSNPRTTGDGTDSSAVTKKLEEELKKRDALIEV

SEQ ID NO: 174135 - protein, 114 aa, Glycine max
  Coding DNA Sequence Number=SeqID_57357
  Homolog annotation: Hit_ID=Q9FKP4; Match level="QueryCoverage=66%, HitCoverage=6%, E-value=6e-07, Identity=43%"; Hit description =Similarity to kinesin heavy chain
MAEQGNRWSWDVAGFEPWKSPSPEQNDQKPTVPLARRNSTSSLVPPHSLASKVEGLREKVKLKAVSVVLGNNKEYTEGNVQAWLLCALCLQNLHWISNSQEVKISSQSAADPDI

SEQ ID NO: 174136 - protein, 148 aa, Glycine max
  Coding DNA Sequence Number=SeqID_57358
MKMLLIPHDVAPCGACRPWIFFIIGVLYFLKINGSGMENPLIQDHVQDSPLSVLRCHDASHGPKIYPKAPENPRTFSCISGPIFLESPSHGSSDGSPPWEDCIITVAFGTENLIWTATNRWIFILWFCRQNGVGLKSADKSAVNNSAM

SEQ ID NO: 174137 - protein, 119 aa, Glycine max
  Coding DNA Sequence Number=SeqID_57359
MSNVPNRFMDDWGTSLGHGSVYGFLEPRPIHNTKDRRQECHHYIEAWVKDSQRQVYLGAYLNYAMKTITSSLDGMSDQPTPRWIEAKWFSDGPTLDIEAITTLRKKWAAYLLACKNMGC

SEQ ID NO: 174138 - protein, 363 aa, Glycine max
  Coding DNA Sequence Number=SeqID_57360
GKFDIPEGSTAKKKVMSTVATKWRQFKSSLTTKYVYANNEGQDKHDPSAKYVEDGSNKAIWVDDIYSVMQSYPVKALDRRLQEDWARDAGEDLRILMSLRVHVAGTGVTISQYFGQALRGSNTSSASITPKELEEIIGNLKERWRREVEEENKCSLEIMKKELKEAIKIELSQMASQHSPPFETSDTRVLATRVTTKGSCAEAITNPLVEDPSTIDFNTMGLYIVGEQRTRLVALGKVFDSATTIHNVPYADDVVWVSVVTVYDADAPIPFLTSKIQYVRRSLTHSLDGQHILSNMYLMCNIVAGEDPLGELMKIFEARLTGALSKGGKMRGVATNVYLWKTSGKPKETGQNENSKFGSCIYV

SEQ ID NO: 174139 - protein, 42 aa, Glycine max
  Coding DNA Sequence Number=SeqID_57361
MYRGPRGSYGVEGRSKVGPCDHTSTNAPDPIRTPQLSVLGRE

SEQ ID NO: 174140 - protein, 86 aa, Glycine max
  Coding DNA Sequence Number=SeqID_57362
MGAKYLEVVERGSHPNNGWSPDEIRTLNDHNLSLHFVGHNRTWVARHRMTIICLCVPLDTIASGWRKGARNDHNLSPPTSRLIVPE

SEQ ID NO: 174141 - protein, 79 aa, Glycine max
  Coding DNA Sequence Number=SeqID_57363
MEVEDELWHLLEDHEGLKWHMHINPKEEDFKCFGGKIDAKIGQKGLVEKLKELDSSLSAQSRPSAHSRLAGKFKLSMHA

SEQ ID NO: 174142 - protein, 139 aa, Glycine max
  Coding DNA Sequence Number=SeqID_57364
MSEAQMIDHVTQLHDAQTKKKVDEEEALTTTTTKEKVASVQDEAYAKVMDDTIVCGVIIDLTNTATMKETPKVSNAAIADEVVHHIQEPVSKLSMPNAIMTQFSNLGVFLLQNLQQAQMSMLGIVVTPTPMPVPIPPNT

SEQ ID NO: 174143 - protein, 214 aa, Glycine max
  Coding DNA Sequence Number=SeqID_57365
MGDRGGRSCVEETGCFLRGMIGVPSIDSLSKEDELASSLFLVKETIHSLSPNLGSKGRFSIKWKSMSLWRSDSDVFELALHLVALVIELLDNTILVPRTLDTMRYYDLLVEKLNIPPKGLDEFRVVLHKLLSYPNFVWELLLDGTQPLIDRFETLPPEGGCFWKKQPGSPRRAELAWASWGFSLLGTSYSLEIAEENCFREENPSRGTSVTFSW

SEQ ID NO: 174144 - protein, 250 aa, Glycine max
  Coding DNA Sequence Number=SeqID_57366
  Gene Ontology: Mol. function=DNA binding
  Homolog annotation: Hit_ID=Q1RUD8; Match level="QueryCoverage=65%, HitCoverage=32%, E-value=3e-15, Identity=33%"; Hit description=IMP dehydrogenase/GMP reductase
MKNVEERSKTFAKFLTENVTETFRKRLGLDFLHGNNFSKQIRKREKCLRSLTPFFFTSSPIYSKIGEVLAAQLAQASQVAILADLFDTFDRRCEKNSARIVCCLPALCVWLISHLFQQDTRHPCPLQSYRSCAEKGRVDWDQHLAGIGGSAINWFPRWKEGKEGVIFSCGDYPNVPLIGTRGCINYNLALAIRQLGYPMRGAPTEESLSPFLVRNLGAQSLKAIQRVHKAWRSPLKKDKELRGIRNGVIG

SEQ ID NO: 174145 - protein, 94 aa, Glycine max
  Coding DNA Sequence Number=SeqID_57367
  Subcellular localization annotation: CTP_CleavageSite=26; ConfidenceScore=5.12e-01
MCSPLKAWMCSPLKVRTCSPLKVRMCSSLKARACSPLKGRGLKLKLKNKGGRIWRIKVVIIKKGEIVEASFMMMNQVDSSSFDDDKDDGTKPKE

SEQ ID NO: 174146 - protein, 100 aa, Glycine max
  Coding DNA Sequence Number=SeqID_57368
RCCVASFGYRKEHDGFWVKKGAQPIDEEGHLHGGEDSSLLQKILDRFDGLQTFVGERFDTLELLVDIRFNEMESRITKVKEDVSYIRTSFDLPPPPPPSS

SEQ ID NO: 174147 - protein, 136 aa, Glycine max
  Coding DNA Sequence Number=SeqID_57369
MGTTSIVQAYRDIIIPAGTTATTLSFDWKADGESSYDYLRVWLVPASFMPVAGAQITAGGGRIQVGALAVNGVTATGAVLSWTGPTPAPANGYAYYLTTTNTPPVAGTPPTGTSTTTSVNLTTLTPNTTYYWWVKS

SEQ ID NO: 174148 - protein, 245 aa, Glycine max
  Coding DNA Sequence Number=SeqID_57370
  Gene Ontology: Mol. function=chitin binding; Cellular component =extracellular region; Biological process=chitin metabolic process
  Homolog annotation: Hit_ID=UPI000044A8F0; Match level="QueryCoverage =92%, HitCoverage=99%, E-value=1e-39, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
VLTFRGLHVLTFRGPHVLTFRGLHALTFTGLHTLTFIGLHVLAFRGLQVLAFRGLYGFLTFKGPYVLAFRGLQALTFRGLHVLAFRGLHVLTFRGLHALPFKGLHVLAFRGLHVLTFRAPHVLAFRGLHAFTFRGLHVLSFRGLQVLAFRGLHVLTFRGPHVVTFRGLHVLAFRGLHVLAFRGLDVLTFRGLHVLAFRGLHALAFIGLHVLAFRGLHVIAFRGLHVLAFRGLHICAFRELKVFRP

SEQ ID NO: 174149 - protein, 63 aa, Glycine max
  Coding DNA Sequence Number=SeqID_57371
MSWSFTDCLTMGVKYLEAVKRRLNATKPMMASRKRKAPASASQARYDNRDSHPKRPGIAILTL

SEQ ID NO: 174150 - protein, 84 aa, Glycine max
  Coding DNA Sequence Number=SeqID_57372
MVCVDNADRTGHLLADLLPNAPDERTPSPPPRDPSSSLLNDVLSELLDLRAFVRDWFNSLDSHITRLKDDISFICHCFDPPTDP

SEQ ID NO: 174151 - protein, 266 aa, Glycine max
  Coding DNA Sequence Number=SeqID_57373
  Gene Ontology: Mol. function=DNA binding; Biological process =regulation of transcription, DNA-dependent
  Homolog annotation: Hit_ID=Q9FLV7; Match level="QueryCoverage=41%, HitCoverage=32%, E-value=9e-14, Identity=35%"; Hit description =Arabidopsis thaliana genomic DNA, chromosome 5, P1 clone:MZF18
  Pfam annotation: Domain name=DUF313; Domain location=127-239; Score =35.2; E_value=8.6e-08; Accession=PF03754.4; Description=Domain of unknown function (DUF313)
MRDLKTLKELVASVTDWKSLEKMSCKPFKPSILHLAISQDAPHLYSEEQLIQLKKLSKLLSSAESKPNTNKTDKRVTKKRQIEERPKEERVMPATIKKPRKIILEQNGPSPDLPPRRIILEHSGPSPDLPMQFKNRVAELSGHDLKYLMHKRLFWSDVKPNNNRLSMPINEIMCEFLTQAEIEKLDERNGSNGKGRLVGLELTVLDPCLREFTLPLKKWSMQRTDTYNLVTDWNSIVSTNEFEEGQELQIWSFRIDNKLYLLLNKL

SEQ ID NO: 174152 - protein, 87 aa, Glycine max
  Coding DNA Sequence Number=SeqID_57374
MEDKGTHETLRKHIKHNKHTLKEKEKEKLSLERRSVDKFTLMEHFFIGENVNKQRSKAYSCIFTFICNPNLHLQKTLQPYTANTVHG

SEQ ID NO: 174153 - protein, 53 aa, Glycine max
  Coding DNA Sequence Number=SeqID_57375
MVKLGSLRLIMSEMVGVHVGVAKKSLNLVLEVIVVANAEKAYRMDAWVNPKIG

SEQ ID NO: 174154 - protein, 80 aa, Glycine max; identical to SEQ ID NO: 143763
  Coding DNA Sequence Number=SeqID_57376

SEQ ID NO: 174155 - protein, 39 aa, Glycine max
  Coding DNA Sequence Number=SeqID_57377
MNQSLSSQPFQLPNPISLNMVQGVLTIGGPCFSDFPQGF

SEQ ID NO: 174156 - protein, 169 aa, Glycine max
  Coding DNA Sequence Number=SeqID_57378
  Gene Ontology: Biological process=cell wall catabolic process
  Homolog annotation: Hit_ID=Q7VY72; Match level="QueryCoverage=67%, HitCoverage=21%, E-value=2e-26, Identity=53%"; Hit description =Putative membrane protein
MCRPANADAPFRLVLTRSPRTASARPFDDKNGIPAYDPAFAPSEACPPFEGPPVGDRAGDRRERLQPGVGHAGRAFAGGLGPGRALASAGGIAGTHTRRNRFAAGVGGRRGCVAARGPEAARAAGQPGGEGRGWDGSDPQEPAGAVDSGAVRRLGRPAAGHQLQLGPAA

SEQ ID NO: 174157 - protein, 70 aa, Glycine max
  Coding DNA Sequence Number=SeqID_57379
MEVDEPWLGLWLPLNYQVDMGASQPRTLELGWVLWCDLGMAFVDNCVVGKEMGCYWLSNDIVGLVGNLAI

SEQ ID NO: 174158 - protein, 67 aa, Glycine max
  Coding DNA Sequence Number=SeqID_57380
MFGLHVWFRVGGTSAVLFCVMARSPDKIKSIDGSKETLKLSVRISDLWFIGTPNKYEQAEMVFVDSD

SEQ ID NO: 174159 - protein, 184 aa, Glycine max
  Coding DNA Sequence Number=SeqID_57381
  Pfam annotation: Domain name=Extensin_2; Domain location=5-184; Score= -139.1; E_value=0.072; Accession=PF04554.4; Description=Extensin-like region
LLCLCLTLLLFLASVAMAEEDSDHNKHSLKATSHAQIQCTMCSSCNNPCNQVPSPPPPSPPPPSPSTNNCPPPPSPPSSGGGGGGAPYYYSPPPPSQYTYSSPPPPASTGGGGGGGIYYYPPPSNGNYPRPPPPNPIVPYFPFYYYSPPPPGFADLEIPREMRVESESEVIEVLVNFPICPEHV

SEQ ID NO: 174160 - protein, 360 aa, Glycine max
  Coding DNA Sequence Number=SeqID_57382
  Gene Ontology: Mol. function=protein serine/threonine kinase activity; Cellular component=nucleus; Biological process=protein amino acid phosphorylation
  Homolog annotation: Hit_ID=Q40353; Match level="QueryCoverage=82%, HitCoverage=99%, E-value=1e-108, Identity=91%"; Hit description =Mitogen-activated protein kinase homolog MMK2
  Pfam annotation: Domain name=Pkinase; Domain location=96-312; Score =119.2; E_value=1.2e-32; Accession=PF00069.15; Description=Protein kinase domain
  Pfam annotation: Domain name=Pkinase_Tyr; Domain location=96-312; Score=-94.6; E_value=1.1e-06; Accession=PF07714.7; Description =Protein tyrosine kinase
  Pfam module annotation: Pfam domain module=Pkinase::Pkinase_Tyr; Domain location=96-312::96-312
MEVENHRQHTNVDAKEVKRKVNKFTGSHMRVRLKSLMSFKLKCKKLRREEVIDTTQDMSVVESGEHNNIRGVPTHGGRYVQYNIYGNLFEVSRKYVPPIRPVGRGAYGIVCAAVNAETGEEVAIKKIGNAFDNRIDAKRTLREIKLLRHMDHANPSNLLLNANCDLKIADFGLARTTSETDFMTEYVVTRWYRAPELLLNCSEYTAAIDIWSVGCILGEIITRQPLFPGKDYVHQLRLITELIGSPNDASLGFLRSDNARRYVKQLPQYPKQNFSARFPDMSPGAVDLLEKMLIFDPNRRITVDEALSHPYMAPLHDINEEPVCTRPFSFDFEQPSFTEEDIKELIWRESVKFNPVPPVY

SEQ ID NO: 174161 - protein, 686 aa, Glycine max
  Coding DNA Sequence Number=SeqID_57383
  Gene Ontology: Mol. function=GPI anchor binding; Cellular component =membrane; Biological process=root hair cell differentiation
  Homolog annotation: Hit_ID=Q8GZ17; Match level="QueryCoverage=86%, HitCoverage=90%, E-value=0.0, Identity=69%"; Hit description=COBRA -like protein 7 precursor
  Pfam annotation: Domain name=Phytochel_synth; Domain location=264 -444; Score=404.4; E_value=1.6e-118; Accession=PF04833.5; Description= Phytochelatin synthetase-like conserv
MENVKCLRSRDEQSETQTCPQLKPLSEEYSILPLSCSNFEIRKMLLRSHCCYYLTIITALAVFLATTSFADAQSCNGILVSYAHTGGVRLPPNVSDPAKQPYRFESTVTVLNNGLDELKSWKVFVGFDHDELLVSASNAVLADGTTLPAAVGNGTVFAGFPMTDLKTAVETAGDLTQMQAQIELVGTVFGVAPPSVPMPKSINLANDGFLCRRSTAQGKNASSVCCTRDPKFKTNITTDEEFLPRQSGDLTIMYDVIRTYDSNYWAEVTIANHNPLGRLDNWRLSWDWMNDEFIYSMKGAYPSVVDASDCLFGKQGTFYRDLDFAHVLNCERRPTIIDLPPTKFNDSDLGKIPFCCRNGTILPPSMDPSMSASRFQMQVFKMPPALNRSQLLPPQNWNISGTLNPDYKCGPPVRVSPTENPDPSGLPSNKTVMASWQIVCNITTAKRTSSKCCVSFSSYYNDSVIPCKTCACGCPKNAERTCSTTAPAMWLPPEALLVPFENRTAKAVAWASLKHLRVPNPMPCSDNCGVSINWHLYTDYTKGWSARVTLFNWGETNFADWFAAVQMDKAAAGFEKMYSFNATLLDGVNNTIIMQGLPGLNYLVAETDAADPLRDPRVPGKQQSVISFTKKTTPGINVAHGDGFPTKVFFNGEECSLPSVYPSSSGFRDGFSLATPLLLTLLMILL

SEQ ID NO: 174162 - protein, 656 aa, Glycine max
  Coding DNA Sequence Number=SeqID_57384
  Gene Ontology: Mol. function=two-component response regulator activity; Cellular component=nucleus; Biological process=two -component signal transduction system (phosphorelay)
  Homolog annotation: Hit_ID=Q71BZ1; Match level="QueryCoverage=100%, HitCoverage=97%, E-value=0.0, Identity=60%"; Hit description=Type-B response regulator
  Pfam annotation: Domain name=Myb_DNA-binding; Domain location=215 -265; Score=51.9; E_value=2.1e-12; Accession=PF00249.21; Description =Myb-like DNA-binding domain
  Pfam annotation: Domain name=Response_reg; Domain location=33-146; Score=92.1; E_value=1.7e-24; Accession=PF00072.14; Description =Response regulator receiver domain
  Pfam module annotation: Pfam domain module=Myb_DNA-binding::Response _reg; Domain location=215-265::33-146
MNLSNGKGSMSTLTASVVMKSGDAVSDQFPAGLRVLVVDDDPTCLMILEKMLRTCLYEVTKCNRAETALSLLRENKNGFDIVISDVHMPDMDGFKLLEHIGLEMDLPVIMMSADDGKSVVMKGVTHGACDYLIKPVRIEALKNIWQHVVRKRKNEWKDAEQSGSAEEGDRQPKASDEADYSSSANEGSWRNSKKRRDEEEEAEDRDDTSTLKKPRVVWSVELHQQFVAAVDQLGIDKAVPKKILELMNVPGLTRENVASHLQKYRLYLRRLSGVSQHQNNMNNSFLSPQEATFGTISSINGIDLQTLAVAGQLPAQSLATLQAAGLGRPTGKAGVPMPLMDQRNLFSFENPRLRFGEGQQQHLSTSKPMNLLHGIPTNMEPKQLANLHQSTQSIGSLNMRVNASATQGSPLLMQMAQSQPRGQMLSENIGPRVPRLPSSLGQPTVSNGISNGLLGRNGIAGNNRGPAYNPVPPSSSLLSFPMNQTSEMSVNNSFPLGSTPGISSITTKGSFQEEVTSGIKGSGGFPSYDIFNELHHQKPHDWEITNPNLTYNASQHANPLQGNIDVTPSVLVHQGFSSTQQTGQSRDAALIGKAMFSMGEGLEQNNFQNASQNLNSLLLDNSIRVKAERILDASSQTNLFPEHYGQEDLMSALLKQ

SEQ ID NO: 174163 - protein, 181 aa, Glycine max
  Coding DNA Sequence Number=SeqID_57385
MVEKEAIEEAQSKLQSEFLQILRSRRPAQVPLTVQLAKPVANPLFQDSPPSIKECVRKGIGCEVARVFMSQISGRSKRNRTRGIGREGAGRTMIKVACEAHKNSKCWWHKDAGWRWWQARWSLVRKRGIVQGQTGKRREKQKRKTSTIDLKIKKSNSPKWLFPRGRHKVASHLSLRLDGKK

SEQ ID NO: 174164 - protein, 389 aa, Glycine max
  Coding DNA Sequence Number=SeqID_57386
  Gene Ontology: Mol. function=acyltransferase activity; Biological process=aromatic compound metabolic process
  Homolog annotation: Hit_ID=Q3DWZ5; Match level="QueryCoverage=64%, HitCoverage=60%, E-value=2e-09, Identity=25%"; Hit description =Alpha/beta hydrolase fold:Biotin/lipoyl attachment:E3 binding
  Pfam annotation: Domain name=Peptidase_S15; Domain location=111-327; Score=-105.7; E_value=0.022; Accession=PF02129.9; Description=X-Pro dipeptidyl-peptidase (S15 family)
  Pfam annotation: Domain name=Peptidase_S9; Domain location=144-373; Score=-36.5; E_value=5.4e-05; Accession=PF00326.11; Description =Prolyl oligopeptidase family
  Pfam module annotation: Pfam domain module=Peptidase_S15::Peptidase _S9; Domain location=111-327::144-373
MAEKEAVEEAQSKFRSEFLQVLRSRRPAQVPLTVELAKPVANPLHQDSPPSIEGVSYQHFFFQFLLNLLVQSHENLLQIEIMESCPKADIENLEDLLEEENLYLNTEEGEQGRLPLLVLKLKESDKQRKRPAVVFLHSTNKYKEAVRPLLKAYASRGYIAISVDSRYHGERATSATAYRDVWDLIKLADYLTHREDVDPSRIGITGISLGGMHAWFAAVADTRYAVVAPLIGVQGFRWAMDNDKWQARVDSIKPLFEVARDDLGKGAIDKEVVEKVWDRIAPGLASQFDSPYSVPTIAPRPLLIVNGAEDPRCPIAGLEIPRAKASWAYGEFDCLDNFKIITEPGVGHQLTRLQVLETLARALICVLQALCGCCSSSLPHFCCLRMIVS

SEQ ID NO: 174165 - protein, 161 aa, Glycine max
  Coding DNA Sequence Number=SeqID_57387
  Gene Ontology: Mol. function=small conjugating protein ligase activity; Cellular component=cytosol; Biological process=protein modification process
  Homolog annotation: Hit_ID=Q8LGF7; Match level="QueryCoverage=54%, HitCoverage=56%, E-value=1e-41, Identity=91%"; Hit description=E2, ubiquitin-conjugating enzyme, putative
  Pfam annotation: Domain name=UQ_con; Domain location=7-140; Score =51.9; E_value=2.1e-12; Accession=PF00179.16; Description=Ubiquitin -conjugating enzyme
MQASRARLFKEYKEVQREKAVDLDIQLVCDDSNIFKWTALIKGPSETPYEGGVFQLAFSVPEQYPLQPPQVRFLTKIFHPNVHFKVGWIPMIMSSSGGSGDGGQRDGGSNGEGVAAVVAMEVTTMVIGDDSGCGNAVAKIGGRSCDGGGGNDSGGSRRHSY

SEQ ID NO: 174166 - protein, 110 aa, Glycine max
  Coding DNA Sequence Number=SeqID_57388
  Subcellular localization annotation: CTP_CleavageSite=31; ConfidenceScore=5.07e-01
MVEPSKKRKGSSSRSQRHSEAQDTPIPSSISSSSLFSSEKKSFYSNLEIQESTLISEVYGIKMVIDQSLLYDLTQLSSDGVPFEGALDDDWNLIFLCMMPAGWFAPTKRI

SEQ ID NO: 174167 - protein, 78 aa, Glycine max
  Coding DNA Sequence Number=SeqID_57389
MVQDSSSSTPLAGQVVLAREEELSRDFTAGNHEETLASLLYYLRLATEHETTLRSLRVGTTISQRCMHLGEGLCATPR

SEQ ID NO: 174168 - protein, 168 aa, Glycine max
  Coding DNA Sequence Number=SeqID_57390
  Gene Ontology: Mol. function=lipoyltransferase activity; Biological process=lipoate biosynthetic process
  Homolog annotation: Hit_ID=Q8ZDG9; Match level="QueryCoverage=55%, HitCoverage=40%, E-value=5e-44, Identity=89%"; Hit description =Lipoyltransferase
  Pfam annotation: Domain name=BPL_LipA_LipB; Domain location=109-166; Score=3.1; E_value=0.069; Accession=PF03099.9; Description =Biotinlipoate AB protein ligase family
  Pfam annotation: Domain name=DUF493; Domain location=1-68; Score =102.0; E_value=1.7e-27; Accession=PF04359.5; Description=Protein of unknown function (DUF493)
  Pfam module annotation: Pfam domain module=BPL_LipA_LipB::DUF493; Domain location=109-166::1-68
MGLAQPELVDQVVEVVQRHAPGDYNPQVKPSSKGNYHSVSITINATHIEQVETLYEELGNIEIVRMAGRRPERPPYAPVSQAMHNFTDSRTETTPDELWLVQHHPVFTQGQAGKAEHVLMPGDIPVIQSDRGGQVTYHGPGQQVMYVMVDLKRNKVGVRQLVTAIEDT

SEQ ID NO: 174169 - protein, 212 aa, Glycine max
  Coding DNA Sequence Number=SeqID_57391
  Gene Ontology: Mol. function=transition metal ion binding; Biological process=DNA integration
  Subcellular localization annotation: CTP_CleavageSite=42; ConfidenceScore=5.30e-01
MKDSPTSPESSTYTLSGTSTLILSTPPIAKCPSYHLYSTRTSGASISSTKTIPVVVSIIIVNFMRLEVSPDIVHPYASPLLCFIGERVETRGYVDLMTTFGQGKLSRSFTIRYLLVDATTSYFALIGRKTLKELGAISSMPHLTTKFPTLTWEIVIVKADQKDLSAHEYRCLADMLCKNIDLFASQPSEMSRIHLDIIFHQLAIWPQAKQVS

SEQ ID NO: 174170 - protein, 48 aa, Glycine max
  Coding DNA Sequence Number=SeqID_57392
MCPPPSSAEPLRKKKERRESSSTNRGKGKDGRNQCLIFAFLLSPIKGK

SEQ ID NO: 174171 - protein, 86 aa, Glycine max
  Coding DNA Sequence Number=SeqID_57393
  Subcellular localization annotation: CTP_CleavageSite=30; ConfidenceScore=5.07e-01
MGKMLLNSNVIHIHVRLVMLVRMIRTRLFVAARVKSCPGMHSRCVIVSLSGCTRTVGCPPISRGGPGTDKGNYWPLNRERKSRLSI

SEQ ID NO: 174172 - protein, 128 aa, Glycine max
  Coding DNA Sequence Number=SeqID_57394
  Gene Ontology: Mol. function=structural constituent of ribosome; Cellular component=ribonucleoprotein complex; Biological process =translation
  Homolog annotation: Hit_ID=Q9BBS6; Match level="QueryCoverage=97%, HitCoverage=60%, E-value=2e-54, Identity=74%"; Hit description =Chloroplast 30S ribosomal protein S2
  Pfam annotation: Domain name=Ribosomal_S2; Domain location=13-128; Score=85.3; E_value=1.9e-22; Accession=PF00318.10; Description =Ribosomal protein S2
MTKRYWNIILEEMMEAGVHFGHGTRKWNPKMSPYISAKRKGIHITNLIRTARFLSEACDLVFDAATDSVARAAIRARCHYVNKKWLGGMLTNWYTTETRLQKFRDLRMQQRRETHSFPKRDAAILRDI

SEQ ID NO: 174173 - protein, 165 aa, Glycine max
  Coding DNA Sequence Number=SeqID_57395
KKVIWTFRLPVTKDKTNIQRVCDDMMLMRKKHNMGMYPVVISLLMVSRGIIPFDKHIAAVGTTSNNMLSKRKTLDEGSVLSSKSKTRHEHRFTSTPYVPLDPGIGPLFNSTPNSLKTVPSGVANCRNLPFGGRATRGLTGASSMGGKCAESPPTFIRGKCQKNRK

SEQ ID NO: 174174 - protein, 64 aa, Glycine max
  Coding DNA Sequence Number=SeqID_57396
ITPARHPVDSKKSNRVLGFPALITSLCQFYGEPIAPNKVIRPPINQALIKKYCASRQVQGKSSQ

SEQ ID NO: 174175 - protein, 525 aa, Glycine max
  Coding DNA Sequence Number=SeqID_57397
  Gene Ontology: Mol. function=nucleic acid binding; Cellular component= intracellular; Biological process=chromatin modification
MAGAALLDIVQSKPSCFPISSQELFSILDDASENTCLCGTAESMQRYVFDGEAGKIGLEPKNLVACTSFLLEQKLVIVFLMVKAWLADKDAEALRCQKQLVEEEEAAQKRQAEILERKRQKKLRQKEQKAREQRHQAEAEIKGDIDSTVKALSPAEASLDTYNFEAHNPSTFSDNAASPVPFQCPDTSEEINGDIHSESETITDQDIVRQSAHGHKHKRQAVARQQGLPKLQWAVANGLHTKQNSPVSKLEINQKYGTHCDQKASSIVNGSKVWTRKSKTEIDKVVLKTIKEKEPDQVKNQEVLIGSISVNLSNCSQSEGNMVASQKDFIVENMGKQNISRDKPMKTDLAMGDNNRSTVKFWRPVSRLETKDPLPVQSGGTKVDAVHENGQNLSGPSSLRVCTAAGGDIGFAKYFSHTEDKADPGSFWFDIQAAKAFLAQRWKEAISSEHVTLVICPDSEPPGCEEIQDLKTAACQSSDMDGCDIVANADKRLPATSKVAKSKPRLKKSEKGTKIKYIPKQKTNT

SEQ ID NO: 174176 - protein, 85 aa, Glycine max
  Coding DNA Sequence Number=SeqID_57398
CVQVTIGCLRMPPDSWVTVAKVRGEKVASAQDFGWQSKGEDHFRRGWAFSPWVKVYGELGFWLKACRMAGHDICQSVGLASSSGI

SEQ ID NO: 174177 - protein, 151 aa, Glycine max
  Coding DNA Sequence Number=SeqID_57399
  Gene Ontology: Mol. function=nucleic acid binding; Cellular component= intracellular; Biological process=chromatin modification
  Pfam annotation: Domain name=zf-C2H2; Domain location=80-102; Score =24.0; E_value=0.00054; Accession=PF00096.16; Description=Zinc finger, C2H2 type
MPIAKLKASGTPDVMKTEDRIDTLIRQAIGKEPFIPFPRASESPVQWIQLLHALDPQGVSNTFSEFPGWPLFSPLKVQLQKCDKCSREFCSPVNYRRHIRVHHRLKKLDKDFTKTKDLLGAYWDKLSVEEAKEVVSFENVLLEAVNWKRVE

SEQ ID NO: 174178 - protein, 111 aa, Glycine max
  Coding DNA Sequence Number=SeqID_57400
MADFHGGFSKKRHRIAVAWRVWDGSAMAAAITMAVVAVMAPHAHPAASLPHPTRAPSRDTRSRTRTQPRRPPAATHQHKRRRQAPAATHLSQTAACSKKFSRRRRSCRKGF

SEQ ID NO: 174179 - protein, 138 aa, Glycine max
  Coding DNA Sequence Number=SeqID_57401
MDHVPNRNEKRERAPRITRIGEAAAKGNTECLAGRKIGEKRRESDQQRRFRERGKETEYMKFMKHEIVGMKAFGRWSLQRARNERIWDDKLWRIQDLNFIVYFVRRQVNLIAHGLTTVVRDYASPHILVALQVVLPRS

SEQ ID NO: 174180 - protein, 183 aa, Glycine max
  Coding DNA Sequence Number=SeqID_57402
MLKTSVQIRLNSMFQDTMHNIRSDDHVGRTSDIGNFHPCPLKPCSKFLIGFVCCAVQCSAADKCHMYHPPLPPPPPHIDPPPELMPLLSQPSLSIIIHRRRQNMVEGQNFTIAPYSRPPFTNCLWQSAKNSPRHSTMVTPWPLFNNTEHHCCCCCFYKLCSRAIHRHGCSSRNHGGSHAIFTI

SEQ ID NO: 174181 - protein, 121 aa, Glycine max
  Coding DNA Sequence Number=SeqID_57403
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Biological process=protein metabolic process
  Homolog annotation: Hit_ID=Q9LSI6; Match level="QueryCoverage=70%, HitCoverage=25%, E-value=9e-09, Identity=37%"; Hit description =Prolyl 4-hydroxylase alpha subunit-like protein
MASISLLLALFVFFLIATSLTESRKELRNKQETALQMLERSIHFSNRINPSRVVQISWQPRVFLYKGFLSDKECDYLVSLAYAVKEKSSGNGGLSEGVETSLDMESFTNGEMLFMCGFLEL

SEQ ID NO: 174182 - protein, 729 aa, Glycine max
  Coding DNA Sequence Number=SeqID_57404
  Gene Ontology: Mol. function=sequence-specific DNA binding; Cellular component=microtubule associated complex; Biological process =microtubule-based movement
  Homolog annotation: Hit_ID=Q9FF89; Match level="QueryCoverage=98%, HitCoverage=98%, E-value=2e-74, Identity=30%"; Hit description =Arabidopsis thaliana genomic DNA, chromosome 5, P1 clone:MRO11
  Pfam annotation: Domain name=HHH; Domain location=663-692; Score =17.7; E_value=0.016; Accession=PF00633.13; Description=Helix-hairpin- helix motif
  Pfam annotation: Domain name=Kinesin; Domain location=18-330; Score =127.3; E_value=4.2e-35; Accession=PF00225.13; Description=Kinesin motor domain
  Pfam module annotation: Pfam domain module=HHH::Kinesin; Domain location=663-692::18-330
MDSKRFDRASRKVRVVTRIRGFAGPEANSEPAASRTVEWVSVNRENLEDVTISFGDQSSSRYSVDYCYKEDEDNELIYSREVKPLVSAAFDGHNSTVIAHGARGSGKTHAIQGSAERPGLAVLAIAEFLSVAEKNGKNIAVSFYEVDHQERAMDLLNPEKPPILVFEDHGRIQFKGLTQVLVKSIAEFQNLYSSACFALKGAPKKGGCEHVHRSHMGLIVHVFSQNGSLVSKVNFVDLAGYEDARKKSGDGSYLAEINKINKSIYALLNVCHALSTNESRVAYRESKITRMLQDSLRGTSKILLVSCLNPSFCQDTIYMVSLASRSCHWIHRAFLDSTKRNASSAKQMVNSHKNQIPKSVSGTAKKLHVSSKLLDKKVVVAKKSAIKGRKLFDEASHSVTKAEKEIAVAQVTQASKSLLEAQCINWSLMQDNSLLETGSDVVLNSGMEKKTGNHVVLNSGMEKKTRNHVVLNSGMEKKTRNHVVLNSGVEKDDSFSKARENVKLDLMVQNDDSSFNANIEVELNPLADQGISVDEEDHQKEHTPYASNYSEVLAKIVQEDHSINKENNNSRAIRDDSLAINSPPISSQLQDLSNSLKMLYSSTPSCMQIPKTEPIPLDIVEPKTPTIEQNMSINRWDAMNAKSPWETFSMRGSGMKSSLVQEYLRFLNTANKEELKKLKGIGEKRATFILELREESPEPFKSLDDLKDIGLSAKQVKGIMKKEVGELFS

SEQ ID NO: 174183 - protein, 238 aa, Glycine max
  Coding DNA Sequence Number=SeqID_57405
  Gene Ontology: Mol. function=triacylglycerol lipase activity; Biological process=lipid metabolic process
  Homolog annotation: Hit_ID=Q1RN82; Match level="QueryCoverage=99%, HitCoverage=52%, E-value=1e-119, Identity=81%"; Hit description =Calmodulin binding heat shock protein
  Pfam annotation: Domain name=Lipase3_N; Domain location=9-76; Score =100.0; E_value=7.2e-27; Accession=PF03893.7; Description=Lipase 3 N -terminal region
  Pfam annotation: Domain name=Lipase_3; Domain location=109-238; Score= 101.6; E_value=2.3e-27; Accession=PF01764.16; Description=Lipase (class 3)
  Pfam module annotation: Pfam domain module=Lipase3_N::Lipase_3; Domain location=9-76::109-238
MSILCGLPLVECVYCLACARWAWKRCLHTAGHDSENWGFATAEEFEPIPRLCRYILAVYEDDLRHPLWAPPGGYGISPDLLLLKKTYEDTRGRAPPYILYLDHEHEDIVFAIRGLNLAKESDYAVLLDNKLGKKKYDGGYVHNGLLKAAGWVLDSECEVLRELVAKHPNYTLTFVGHSLGAGVAAMLTMVVVQNRDRLGNIDRKRVRCYAIAPARCMSLNLAVRYADVINSVVLQASY

SEQ ID NO: 174184 - protein, 532 aa, Glycine max
  Coding DNA Sequence Number=SeqID_57406
  Gene Ontology: Cellular component=chloroplast thylakoid membrane
  Homolog annotation: Hit_ID=Q9FF91; Match level="QueryCoverage=97%, HitCoverage=52%, E-value=1e-145, Identity=54%"; Hit description =Arabidopsis thaliana genomic DNA, chromosome 5, P1 clone:MRO11
  Pfam annotation: Domain name=SLH; Domain location=49-105; Score=17.1; E_value=0.0064; Accession=PF00395.10; Description=S-layer homology domain
VIEPDVQPSDLCTRREYARWLVSASSALSSTVSKVYPAMYIDNATELAFDDVTPEDPDFSSIQGLAEAGLIESRLSRRDIQLFGDGDDSPFYFSPESPLSRQDLVSWKMALQKRQLPEADSKVLYQLSGFIDTDKIHPNACPALVADLSAGEQGIIALAFVISSLILVFGFHLCLYFWGCAWGWDIQGYTRLFQPDKPVTKAQAAMALATGDASEIVSEELARIEAESIAENAVAAHSALVAQVEKDINASFEQELFIEREKISAVERMAEEARLELERLRAEREEDNLALTKERAAIESEMEVFSKLRHEVEDQLQSLMSDKVEIAHEKERISKLREKAEVENNEIGRLQYELEVERKALSMARAWAEDEAKRVREQAIALEEARDRWERHGIKVVVDDDLRKEASAGVTWLNASEQVSVQGTVDRAESLLDKLKQMAADIRGKSRDTLHKIIHVVSQFISKLREWACKTGKQAEEFGEAAISKVGKSVSELQQNALEVGIGIKEGAKRVAGDCREGVEKITQKFTQKFKT

SEQ ID NO: 174185 - protein, 238 aa, Glycine max
  Coding DNA Sequence Number=SeqID_57407
  Gene Ontology: Mol. function=triacylglycerol lipase activity; Biological process=lipid metabolic process
  Homolog annotation: Hit_ID=Q9SMU2; Match level="QueryCoverage=99%, HitCoverage=43%, E-value=2e-47, Identity=43%"; Hit description =Calmodulin-binding heat-shock-like protein
MRDTCIPEEKMLRDPRRLYAPGRLYHIVERKPFRMGRFPPVVRTAVPVDGRFEHIVLSCNATSDHAIIWIEKEAQRALDMFIPRRKGMLLLGHPHWFTLQMSSPRHEEGCNFETSGTHAWISTQKYIEKSMLLALFDLMLEKDQPMEPPAKQKMERQETLTRHNDEYKAALQRAKTLDVPHAYTPPSEYGTFDDEGDENSTRSQGESSNKSSVDESWDALIERHFDKDEHGHTVLKKE

SEQ ID NO: 174186 - protein, 505 aa, Glycine max
  Coding DNA Sequence Number=SeqID_57408
  Gene Ontology: Cellular component=chloroplast thylakoid membrane
  Homolog annotation: Hit_ID=Q9FF91; Match level="QueryCoverage=93%, HitCoverage=45%, E-value=5e-13, Identity=24%"; Hit description =Arabidopsis thaliana genomic DNA, chromosome 5, P1 clone:MRO11
  Subcellular localization annotation: CTP_CleavageSite=42; ConfidenceScore=5.34e-01
MASLTCSPTSLQLRLALAAPKFPHTPQLRMRNFKLNRVRPLRAAQDGGPGPGPKLDGFSGWSDTDAEQRPNNAPKKESYGVVGVETLKLGLVVATNSTLLNNTFEGSLLSGVVGVGVAGVLLLSGLTFAALSLGKQTGSRPEQHMKPLTSQQEELLSSDDHNNEITEQGNVDNTVEQGNGKMEGQIHISGDYSSAESSNFYSDNSIVDDSDIGSQLIYDSKNPSDGVDDATKHISVQEDLQDVSAFDNKLVFASESPVPLESENTVDSFNAYGFRDFDSNPNVDTVESTPNLKENLFNVDPGDVPNYDDAKPLHLNTEQHDEITSSSGSVSFGFPETYSSSGADNETGIVSVVVISELNNMISDPKFFNEAGQENILSALKNENLDLNKIPQVSAEGNEPSFEERSIPGNDLFEKSSISTSANTLVDEQVRNDNYEVDEVKSESSNSGSFFSVPGIPAPLVVSTAVKVLPGKILVPAAVDQAQGQALAALQVLKVVICSYSHVSR

SEQ ID NO: 174187 - protein, 1046 aa, Glycine max
  Coding DNA Sequence Number=SeqID_57409
  Gene Ontology: Mol. function=DNA binding; Biological process =regulation of transcription
  Homolog annotation: Hit_ID=Q5NB82; Match level="QueryCoverage=91%, HitCoverage=97%, E-value=0.0, Identity=45%"; Hit description=Nodule inception protein-like
  Pfam annotation: Domain name=PB1; Domain location=896-978; Score =95.5; E_value=1.6e-25; Accession=PF00564.15; Description=PB1 domain
  Pfam annotation: Domain name=RWP-RK; Domain location=583-634; Score =99.5; E_value=9.8e-27; Accession=PF02042.6; Description=RWP-RK domain
  Pfam module annotation: Pfam domain module=PB1::RWP-RK; Domain location=896-978::583-634
MSESKEENPDLLLKSKAQEEHGFVMDFGIGLESLWPLDHISLVSNPMPPFLFSTISEQPFSPVWAFSDAEDERQIRIAASGNTNTTTENPIENDDNKKTVPPLVAMTASENPDGYCLIKERMTQALRHFKELTEQNVLAQVWAPVRNGNRYALTTSGQPFVLDPHSNGLHQYRTASLMYMFSVDGENDEILGLPGRVFQHKIPEWTPNVQFYSSKEYQRLNHAQHYNVRGTLALPVFELAGQSCVAVVELIMTSQKINYAPEVDKICKALEIDLDKGNCHEIIGLGLNVSDCKHFFYIPELPAYALAEILEILTAVCETHSLPLAQTWVPCKHRSVLAHGGGLKKICSSFNGCCMGQVCMSITEVAFYVIDAHKWGFHEACAEHHLQQGQGVAGRAFLSHNMCFCGNNTQFCKTEYPLVHYALMFHLNSCFAVCLQSSHTGNDDYVLEFFLPPGITDFNEQKRLLGSILATMKPHFQSLKIASGVELEGNASIEIIDARNERVHLRFESIPITQSSKSPPRHTSPNMGEGLPLEPSEPKIMAYFDGINDGGSLGDNAGGHIDQNTSLEIKTKKKPSDRKRGKAEISISLNVLQHYFTGSLKDAAKSLGVCPTTMKRICRQHGISRWPSRKIKKVNHSLSKLKCVIESVHGAEGAFGLNSLSTGSLPIAAGSFSDPFTSNKFHRQTTLTIRPSEPKINENDFDAFGASETKRQVAMEDQFLGLEARTRSPEKVINDKGVSIQEIGTKGTNKFRTGSGSSGSGNPTHASCHGSPPNEISPPKDTFVTGNSEQCLVLRGSLGSTTLHSTSTPNRATAYPMLHIVETTEPQEPFGGQLLEVAGSSKDLRNLCPSADAVLEDQVPEAYKMNPQCSDLPQMQHMDTLNKTMTPFAVRKEVNSVTIKATYKEDIIRFKVSMDCGIVELKEEIAKRLKLEVGTFHNKYLDDDHEWVLIACDADLQECMDISRSSGGNIIRLVVHDILPILGSSCESSRDWKGSSLCEGMGEGCCTQPYPCICKETVSGFEPITNKSPRHNFTAAPGLALHNLSR

SEQ ID NO: 174188 - protein, 357 aa, Glycine max
  Coding DNA Sequence Number=SeqID_57410
  Gene Ontology: Mol. function=transferase activity; Cellular component= integral to membrane; Biological process=phosphoenolpyruvate -dependent sugar phosphotransferase system
  Homolog annotation: Hit_ID=UPI00005F9A30; Match level="QueryCoverage =66%, HitCoverage=81%, E-value=1e-126, Identity=95%"; Hit description= COG3716: Phosphotransferase system, mannose/fructose/N-acetylgalactosa mine-specific component IID
  Pfam annotation: Domain name=EIIA-man; Domain location=237-352; Score= 151.9; E_value=1.7e-42; Accession=PF03610.6; Description=PTS system fructose IIA component
  Pfam annotation: Domain name=EIID-AGA; Domain location=1-240; Score =409.0; E_value=6.7e-120; Accession=PF03613.5; Description=PTS system mannosefructosesorbose family IID component
  Pfam module annotation: Pfam domain module=EIIA-man::EIID-AGA; Domain location=237-352::1-240
MLLQASFNYERMQASGWLYGLLPALKKIHTNPRDLARAMKGHMGFFNTHPFLVTFVIGIILAMERSKQDVNSIQNTKIAVGAPLGGIGDAMFWLTLLPICGGIGASLALQGSILGAVVFIVLFNVVHLGLRFGLAHYAYRMGVAAIPLIKANTKKVGHAASIVGMTVIGALVATYVRLSTTLEITAGDAVVKLQTDVIDKLMPAFLPLVYTLVMFWLVRRGWSPLRLIGITVALGIVGIILTGHGGFASGMEKAMKQILGEQSQFIAIDFPESSTTALLTAQLEQAVNELDGEEDIVFLTDLLGGTPFRVASTLAMQKRGREVITGTNLQLLLEMVLEREGLTSEAFRLQALECGHR

SEQ ID NO: 174189 - protein, 183 aa, Glycine max
  Coding DNA Sequence Number=SeqID_57411
ALKIRKENAKLRDVNVATTKALERETKRACREEHGRNKFRGALWGSNSKLKLRREERDQSRVDSLILKDELKACSRSKRSLSQWLCETETNMLAIITKYQEELNLATAHEHRVADEVIDSLHQEATMWMDQFALTLNGSQELPRLLAKAKEMANTYSAPEEIHGLLGYCQHIIDLMAHIIRNR

SEQ ID NO: 174190 - protein, 49 aa, Glycine max
  Coding DNA Sequence Number=SeqID_57412
MVSLDIFCYRRRKTHHKIHELLTPLNVVLSFDTVHALIRAAALALVPKM

SEQ ID NO: 174191 - protein, 221 aa, Glycine max
  Coding DNA Sequence Number=SeqID_57413
MNSIITVLYFNGRVYEDNDGVIFEGSKKAIQIKRGISFNALKKKIGDKVKLQNNEIISAISCRFLVSGKYIALQICDDEDVETMLESFKQQQEMSVLELYIEKDVAGGSMFHSANSLTSCGNYVSNDDTQPPTNMSNLNLDEDDDDDDDYLVSNSYVEESLDEDDSVDGISDTDDEVTDIPQPVRIVHPAEGAQRIENPFWNDALHYNNINWSYPDEEDIC

SEQ ID NO: 174192 - protein, 345 aa, Glycine max
  Coding DNA Sequence Number=SeqID_57414
  Gene Ontology: Mol. function=monooxygenase activity; Cellular component=membrane; Biological process=electron transport
  Homolog annotation: Hit_ID=Q1S498; Match level="QueryCoverage=99%, HitCoverage=66%, E-value=1e-146, Identity=72%"; Hit description =Cytochrome P450
  Pfam annotation: Domain name=p450; Domain location=1-342; Score=13.0; E_value=1.4e-11; Accession=PF00067.12; Description=Cytochrome P450
MASMMTESTNQMIDRWIAQINSGNPEIDVEREVVETAGEIIAKTSFGMKGKNAKEVSEKLRALQMTLFKTTRYVGVPFGKCFNVKKTLEAKKLGKEIDKLLLSVITSRMKSIKRQTQEDLLGLLLQGNNHQGDGKLGKTFTTRDLLDECKTFFFAGHETTALAISWTLLLLAINEDWQIQLRDEIREVVGDKELDINVLAGLRKMKWVMNEVLRLYPTAPNVQRQAREDIKVDNLTVPNGTNMWIDVVAMHHDPALWGKDVNDFRPERFMNDVNGGCNHKMGYLPFGFGGRMCVGRNLSFMEYKIVLTLLLSRFSFKVSPGYNHAPSIMLSLRPTYGLHLIVQPL

SEQ ID NO: 174193 - protein, 71 aa, Glycine max
  Coding DNA Sequence Number=SeqID_57415
MVSPREVLGINIVGEGLVAISRGVATAQSMIDALKLEGEDLEYPSICSLQVTTSFNAYIMIMIMFFTVSNE

SEQ ID NO: 174194 - protein, 186 aa, Glycine max
  Coding DNA Sequence Number=SeqID_57416
  Gene Ontology: Mol. function=nucleic acid binding; Biological process= DNA integration
  Pfam annotation: Domain name=zf-CCHC; Domain location=65-82; Score =19.2; E_value=0.00067; Accession=PF00098.13; Description=Zinc knuckle
MKTEEANRLKDKYVLHSVNSVNANVVEFADQHRSKGKEKRFQKKGQKKTHTNINKGDNKIQKRKGECYVCGKTGHKAYGCKLRKGQQSNNSKPAAPYAPQAHLAENEEVIVAVVVEANMVDNKVDWILDTGASKHLCANKELFHQIEDADDGECVFMGNSATAGVLGKGKILLKLTSGKTLSLSDV

SEQ ID NO: 174195 - protein, 343 aa, Glycine max
  Coding DNA Sequence Number=SeqID_57417
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=86%, HitCoverage=19%, E-value=7e-31, Identity=50%"; Hit description=Chromo
MADNTRMKELTGDVKRILKMMENRNKEYAARFETLETTLEMTLKDKTRDPGSISLAMNNHPFKVVPWYQMMTRENSFKTWIAFTRALETEFGPSPCECPRSQLFKLTQIGSVQSYYVQFTALANRVQGITQEALLDCFVGGLKPNIRMDVIAQSPTSLLRTVSLAKLYEEKYTPKLKPFSSSFSSKTQTSNTNSNLNTNQNSPQSLKSTSLPPLLPTPYTKPINVKKMTSAEMQLRRERGLSFTCDDKFSPSHRCPNKQHFVLQWEEEDDPALQPDPLDEVETVGDPSLQNHHLSYNALKGSSGLGIMKFQGSINGLGVQILVDSGSSDNFLQPRLAQCLKLP

SEQ ID NO: 174196 - protein, 109 aa, Glycine max
  Coding DNA Sequence Number=SeqID_57418
  Gene Ontology: Mol. function=DNA binding; Biological process=DNA integration
  Homolog annotation: Hit_ID=Q1SIT1; Match level="QueryCoverage=87%, HitCoverage=32%, E-value=5e-15, Identity=46%"; Hit description =Integrase, catalytic region
MDQAREERKLQLSELDEIRLVAYENSKFYKEKTKKFHDSLRAKKDFVVGKKVLLYNSRLELISVEIKSESTDTSFKVNGHRLKPFLTNPSLVDVVVEETSLLIPTSFSP

SEQ ID NO: 174197 - protein, 91 aa, Glycine max
  Coding DNA Sequence Number=SeqID_57419
MNCVFVHASSTHEFGAMRSDCLEKFSILNPFSEPHELRFRSCVFVHASSTHEFGAMRSDCLVQFSILNPFSEPHELRFHSCVLHPRVWSHA

SEQ ID NO: 174198 - protein, 272 aa, Glycine max
  Coding DNA Sequence Number=SeqID_57420
  Gene Ontology: Mol. function=DNA binding
  Homolog annotation: Hit_ID=Q1SDS1; Match level="QueryCoverage=79%, HitCoverage=40%, E-value=9e-28, Identity=36%"; Hit description=IMP dehydrogenase/GMP reductase
MGLVHRHKESPIVALLIFGGVLFSNVDGLVDLVAIDAFLAYHNHKESPVVAMLADLYDTFDQRCEKSSTRIVCCTPTLYVWLVLHLFRQEVRHACPLESHRSCTEKGGANWDQLLANKEGVSVNWFPRWKEGGTGVLISCGGFPNVPLMGTRGCISYNPILAIRQLGYPMRGAPLEEELTPVISRGFNKTNMETLQKVHKAWEVVRKNDKELRGSNNGPIGGYRKWLRAHVQGLDWLPSLRTAKRKEVEALEEDEEVQALRAELEQAQTVKE

SEQ ID NO: 174199 - protein, 96 aa, Glycine max
  Coding DNA Sequence Number=SeqID_57421
MPISPCGSISWSVPFRHRYDRAHKTPSGPGEVQQGPGVSNSGYGPLSVLQGARSPQQGIVPARHPADPKKSNRVLGFPALITSLCQFYGVPVTPSK

SEQ ID NO: 174200 - protein, 86 aa, Glycine max
  Coding DNA Sequence Number=SeqID_57422
MYSFYTKAQDDKSTMQNSGVTLRAEAQHFTTLVLATSNKSEIYKEEAQNTAQKHKPKRVESVNADAEAFGDHWKVQIGLCILKLKH

SEQ ID NO: 174201 - protein, 87 aa, Glycine max
  Coding DNA Sequence Number=SeqID_57423
MKTITSSFEGMSNQGAPQWVEPKTNVQSGGFECGYYVMHWMWCIVTAGLKNDWHKWFSDGSSLNVEAITSVRQKWATYFLSFRKSSC

SEQ ID NO: 174202 - protein, 83 aa, Glycine max
  Coding DNA Sequence Number=SeqID_57424
  Subcellular localization annotation: CTP_CleavageSite=41; ConfidenceScore=5.50e-01
MAEPSKKRKGSSSTATAAAHRRHGPSGAPTAPIPPSLSSPRSSTLFSSDDQRLRQGAPFEGTIVDDWKFDYSSHDARRMVCND

SEQ ID NO: 174203 - protein, 60 aa, Glycine max
  Coding DNA Sequence Number=SeqID_57425
MEEREWKIFRPDKFSARLPFSTGDIPPHMNKEEKTETPSFLSKNTSLEKILLVRDRTFDL

SEQ ID NO: 174204 - protein, 207 aa, Glycine max
  Coding DNA Sequence Number=SeqID_57426
  Gene Ontology: Cellular component=integral to membrane
  Homolog annotation: Hit_ID=Q7MZI5; Match level="QueryCoverage=99%, HitCoverage=92%, E-value=8e-73, Identity=70%"; Hit description =Similar to putative membrane protein
  Pfam annotation: Domain name=DUF969; Domain location=1-189; Score =308.9; E_value=9.4e-90; Accession=PF06149.2; Description=Protein of unknown function (DUF969)
MDNVVNLWPLLGIAAIVLGFVLRFNPVLVVIVAGFVTGLAAHMPLGDILEKLGSGFLNTRNLPLILLLPLAVIGLLERHGLKERAQTWIARIKTATAGRLLIVYLFVRELTAALGLTSLGGHPQMVRPLLAPMAEGATENRYGSVSPEIRQRLRAMSAATDNVGLFFGVGGHQHRAVAHRAVGHSDRAVCVPDSCCATGAARPSAVA

SEQ ID NO: 174205 - protein, 207 aa, Glycine max
  Coding DNA Sequence Number=SeqID_57427
  Gene Ontology: Mol. function=protein binding
  Homolog annotation: Hit_ID=P75746; Match level="QueryCoverage=94%, HitCoverage=80%, E-value=4e-45, Identity=52%"; Hit description =UPF0271 protein ybgL
  Pfam annotation: Domain name=LamB_YcsF; Domain location=1-200; Score =231.9; E_value=1.3e-66; Accession=PF03746.7; Description=LamBYcsF family
MLQSVRWASANGRGDWVRIRAFPTGKILAGTAMQLPPETVYAQVIYQIGALKSLAESEGAKLVHVKPHGMLYNQAAADAALADAIARAVKAVDPALILVGLAGSASIAAAAHHGLRTREEVFADRGYLASGALVPRSQPGALIEEAEQALAQTLTMVQQRQVRSVSGEWVAVNAQTVCLHGDGAHALEFARTLRAAFATNQIAVTSA

SEQ ID NO: 174206 - protein, 323 aa, Glycine max
  Coding DNA Sequence Number=SeqID_57428
  Gene Ontology: Mol. function=hydrolase activity
  Homolog annotation: Hit_ID=Q6D7H4; Match level="QueryCoverage=66%, HitCoverage=99%, E-value=2e-75, Identity=63%"; Hit description =Putative allophanate hydrolase subunit 1
  Pfam annotation: Domain name=AHS1; Domain location=10-208; Score =407.7; E_value=1.6e-119; Accession=PF02682.7; Description =Allophanate hydrolase subunit 1
MTGRWVLQRARCYLLGERAVVLELEPPVSLVSQQRIWGLCQRLQQNEQIAEVIPGMNNLTLLLRDPQLKALDAIERLQRWWEESEVLLAEPRQVEIPVVYGGAGGPDLAEVARAADLTSQQVVELHSSADYVVYFIGFQPGFPYLGGLDERLHTPRRAEPRLVVPGGSVGIGGSQTGIYPLAAPGGWQLIGHTPLNLFDPQQQPPTLLRPGDSVRFVPQREGDRGRHGWRQYGISLSGALDEPSMRTANMLVGNAENSAVLEIVLAGVDRLASAGEKRPGAESVHAHARYAQLSGGERRFRHRCDAGLTQHRSQSGLWRLAGA

SEQ ID NO: 174207 - protein, 139 aa, Glycine max
  Coding DNA Sequence Number=SeqID_57429
  Gene Ontology: Mol. function=DNA-directed RNA polymerase activity; Cellular component=chloroplast; Biological process=transcription, DNA-dependent
  Homolog annotation: Hit_ID=Q8HVY3; Match level="QueryCoverage=99%, HitCoverage=12%, E-value=1e-42, Identity=59%"; Hit description=DNA -directed RNA polymerase beta'' chain
SCYGARKGFVDTAVRTSDAGYLTRRLVEVVQHIVVRRTDCGTIQGISVNTQNGMMPERIWIQTLIGRVLADDIYRGSRCIAEHLDLSIVLWPKSYSWSLGGIRRSCRYYCGQSIGEPGTQLTLRTFHTGGVFTGGTAEQ

SEQ ID NO: 174208 - protein, 34 aa, Glycine max
  Coding DNA Sequence Number=SeqID_57430
MPQPSCAYIASRLGKGTDCTKVKGFNLTSDADGG

SEQ ID NO: 174209 - protein, 222 aa, Glycine max
  Coding DNA Sequence Number=SeqID_57431
  Gene Ontology: Mol. function=oxidoreductase activity; Biological process=electron transport
  Homolog annotation: Hit_ID=Q7WFA5; Match level="QueryCoverage=86%, HitCoverage=16%, E-value=5e-92, Identity=86%"; Hit description =Putative pyruvate ferredoxin/flavodoxin oxidoreductase
GEGFVFVDRGRVHDGHLPADQRGLAGVRDGGGDGGVVVAHHHQHAAMARGAGGVAVVQGIAGAIHAGALAVPHGEDAIDVAVGAHAGLLCAHDGGGGHVFVDAGQERDLVGVERLLRLPHRHVDAAQGRAAVAGDEAGGVQPALAIDAALGQHDAHQGLGAGQEDAAGLAGEVVGELVVEVQRGLGGGGAVHHECSCSRHHDRFARHRVYCVFGSCYPYNSQ

SEQ ID NO: 174210 - protein, 158 aa, Glycine max
  Coding DNA Sequence Number=SeqID_57432
  Gene Ontology: Mol. function=RNA-directed DNA polymerase activity; Cellular component=intracellular; Biological process=RNA-dependent DNA replication
MKPEISLKIKEEVKKQFDGSFLAVARYPEWVANIVLVPKKDGKVQMCMDNRDLNRASPNDNFPLPHIDVLVDNTTNFALFSFMDGFLGYNLIKMASEDMEKTMFVTLWGTFCYKVMSFGLKNTEATYQRAMVALFHDMMHKEIEVYVDDMIAKSRTEE

SEQ ID NO: 174211 - protein, 132 aa, Glycine max
  Coding DNA Sequence Number=SeqID_57433
  Homolog annotation: Hit_ID=Q53E54; Match level="QueryCoverage=99%, HitCoverage=22%, E-value=4e-46, Identity=66%"; Hit description=Male sterility protein 2-1 mutant
VPADMVVNATLAAMARHGMNQKPDINVYQIASSVVNPLVFQDLARLLYEHYSSSPCIDSMGRPIQVPLMKFFSSTEEFSGHLWRDAIQKRGITAMASSKAKMSQKLENMCRKSVEQAKYLANIYEPYTFYGG

SEQ ID NO: 174212 - protein, 90 aa, Glycine max
  Coding DNA Sequence Number=SeqID_57434
APDQVRIWFQAHPEFLKVANPETSLFLNQKSQLAAFLSSSKSKEILAQNLKEVLQLLQQEEDKGSSSKKEDNNSSKEDDDPFYQNENDCF

SEQ ID NO: 174213 - protein, 125 aa, Glycine max
  Coding DNA Sequence Number=SeqID_57435
  Gene Ontology: Mol. function=nucleic acid binding; Biological process= RNA-dependent DNA replication
MGILQKRHIPSYYEMQLMDKLQRLRQGIMSVKEYRQQMELLLLSVGLKEEERISIAWFLSGLSMEVRDKVEILPYRDLDDLVQLCIRVEQQLKRKPTSKSCGSHSWKRTHYFSMPHQENHDYEVM

SEQ ID NO: 174214 - protein, 208 aa, Glycine max
  Coding DNA Sequence Number=SeqID_57436
  Subcellular localization annotation: CTP_CleavageSite=41; ConfidenceScore=5.03e-01
MRLPKKSQNQKSSSSHHRTIAATSHHFGIEDSLVSSVLSPLSASVVGIEDVSTDLYSFCRRGRVLGRGDNLDSDDVPQHQRLTASARRQREVIAVAEDALHVDDTAEEVFQHDEEVIDDAEGFPGGPLDTLVLTTYADHVVVIIWNAELSSHGRKVQKFRRSATEIEGLVVVTGLSSLIACSLDTGDRELISAFIERWHKETSSFYLQ

SEQ ID NO: 174215 - protein, 118 aa, Glycine max
  Coding DNA Sequence Number=SeqID_57437
  Gene Ontology: Mol. function=nucleic acid binding
MDLLLTIWFFKGHPQEGFLEEDDKDAMEKPPLEEQCMFNRCPRVKIMESEFEEWCAPWKGSLVVHVLGKSVGFKMLEYKLQRSWPKVGKFRIVDMPVGYYLVQFTSEEGYKNAMFNGS

SEQ ID NO: 174216 - protein, 212 aa, Glycine max
  Coding DNA Sequence Number=SeqID_57438
  Homolog annotation: Hit_ID=Q84VH5; Match level="QueryCoverage=86%, HitCoverage=31%, E-value=5e-80, Identity=74%"; Hit description =Envelope-like protein
APAVINKYLGRPTEGVVDIAVSEHQIAKEITAKQVQHWPEKGKLSAGKLSVKYAILHRIGTANWVPTNHTSTVATESFAVKLPIAFPTVLCGIMLSQHPNILNNTDSVKKRESPLSLHYKLFEGTHVPDIVSTSGKAAASGAVSKDDLIAELKDTCKVLEATIKANTEKKMELERLIKRLSDNGVDDGEAAEEEEDAAEDTESDDDDSDATP

SEQ ID NO: 174217 - protein, 106 aa, Glycine max
  Coding DNA Sequence Number=SeqID_57439
  Gene Ontology: Mol. function=DNA binding; Biological process=DNA integration
  Homolog annotation: Hit_ID=Q1SIT1; Match level="QueryCoverage=80%, HitCoverage=29%, E-value=4e-16, Identity=45%"; Hit description =Integrase, catalytic region
MDQAGEERKLQLSELDEIRLEAYENAKFYKEKTQKFHDSMIIKKDFMVGQNVLLYNSRLGLMSVEIKSHSINKSFKVNGHRLKSFLQGDDTSRDHQEKYDHLGNYH

SEQ ID NO: 174218 - protein, 99 aa, Glycine max
  Coding DNA Sequence Number=SeqID_57440
MAKKRNQPQVVQAALDFRSNPSSTSSEDAYKNEDIGGYFARRVLSIQVKLTVETISQAISFGRQRTKSMNSWGDELEDHIGHSLSRPAGLRPQGDMDYY

SEQ ID NO: 174219 - protein, 420 aa, Glycine max
  Coding DNA Sequence Number=SeqID_57441
MKKRTKLIVDMDGEVQYAAPPSPTYLDRFRHQGPLAVDPNLFAEDIEVTCPPTTHLDSQAASTSIELDPPTRIKVLPPPKWKRLHPRYPSLHLSWISTKMSIRFLLGLTEKSYPPGIHIKCTTTIKFMLNHIAPRLPPLDIRKKKGKILCPAKIYRFNNWHMCFPRQEEDNVFYQCLIHDAPPLQSRFVFDLHKYFEAAMKRAFVTAWVRFPALKEHPLSLDQNPWVLGQGMATELQRKQDKLSCQLMEMQKKADVVESLLIQVTSQPQTIVEDALATINTASTPHEITPLTTFAPTTNLEETMEKRLLVEHMETNLLIKNTLESSLKSFNKFVPFNMNMLMQQRLHSPSQPAPPPSTTVVPPQPLLLEPMVLASKATITVDPVLAPPSPSLPSSPKPPSSIPQITTTFATILHKKIFVG

SEQ ID NO: 174220 - protein, 96 aa, Glycine max
  Coding DNA Sequence Number=SeqID_57442
MGIDAAVLMCLRDIRHNKFEDSLIETVETSLGQGLVYFNYYPNKMNQELSKVFKQKFKNQVSRFKNQESSFKNQESRSRFKTQDSRIKRRLNQDKY

SEQ ID NO: 174221 - protein, 129 aa, Glycine max
  Coding DNA Sequence Number=SeqID_57443
MAKNQSRFIPTGSLVHSENRPGHTGSYQVDNKFNPIVCSNRSNPVMWDYAHLTDSTMKVPQDAVEAEIKGAARSMTEKNQGNSRNCNLHNKSSNGWGERLILPVADPGEPVRKVMPFAQSMLPLLFNSF

SEQ ID NO: 174222 - protein, 293 aa, Glycine max
  Coding DNA Sequence Number=SeqID_57444
  Gene Ontology: Mol. function=sequence-specific DNA binding; Cellular component=nucleus; Biological process=regulation of transcription, DNA-dependent
MNSAKLLYVTLSGPGKALIYENEEHADIVGYADLDWASSVSERKYTEVLVRFAGFGPEEDEWINIRKHVRPRSLPCESSECVVVIPGDLILCFQEGKEQALYFDAHVLDAQRRRHDVRGCRCRFLVRYDHDQSERHNCTVKGQSVDAHYVDSTSMCSCQEIVPLRKICRRPETDYRLQQLHAVNEAAPVDQQKTGMDPAANVNAVRATTTETVPKQLIAANIHMETTPVPVVQTNVPQQPPQSMDMDVDQKKAETIADVQAGNSIITPGSVVTNIITTSSVPEVFSQTQNMVE

SEQ ID NO: 174223 - protein, 76 aa, Glycine max
  Coding DNA Sequence Number=SeqID_57445
  Subcellular localization annotation: CTP_CleavageSite=69; ConfidenceScore=5.17e-01
MYVGFSSSQDNVGSVGFERRQYGFSGSVGGGSVGSTDDNVGVEGAVSGGRRKRRAISGRRMTKKRGRARLSSARGL

SEQ ID NO: 174224 - protein, 464 aa, Glycine max
  Coding DNA Sequence Number=SeqID_57446
  Gene Ontology: Mol. function=microtubule motor activity; Cellular component=microtubule associated complex; Biological process =microtubule-based movement
  Homolog annotation: Hit_ID=Q9FKP4; Match level="QueryCoverage=99%, HitCoverage=36%, E-value=0.0, Identity=74%"; Hit description =Similarity to kinesin heavy chain
VLAAVIKAGASREHEILAEIRDAVFSFIRKMEPRRVMDTMLVSRVRILHIRSLLARSTELQSIKVLSVECFLEKANAGPSRSSSRASSPGRSSMQYVDEQIQGFKVSLKPEKKSKFSSVVLKIRGIDEETWRQQVTGGKLREISEEAKNFAIGNKALAALFVHTPAGELQRQIRSWLAEKFDFLSVMGNDAPGGTTGQLELISTAIMDGWMAGLGSALPPQTDALGQLLFEYSKRVYTSQLQHLKDIVGTLATEEAEDAAQVAKLRSALESVDHKRRKILQQMRSDVALLTLENGSSPVQNPSTAAEDARLASLVSLDRILKQVKDITRLSTVNTIQKSKKGTVLGSLDKLTEQMPSLLEIDHPCAQRYIADARRKVESIPEEDDRIQNLSHSRKPSTDTGSGSGTDVAQWNVLQFNTGNTSPFIIKCGANSNSELIIKAEARVKEPKGGEIVRVAPRPSILQI

SEQ ID NO: 174225 - protein, 263 aa, Glycine max
  Coding DNA Sequence Number=SeqID_57447
  Gene Ontology: Mol. function=CP2 mannose-ethanolamine phosphotransfera se activity; Cellular component=integral to membrane; Biological process=metabolic process
  Homolog annotation: Hit_ID=Q6K821; Match level="QueryCoverage=89%, HitCoverage=30%, E-value=2e-83, Identity=64%"; Hit description =Phosphatidylinositolglycan-like
  Subcellular localization annotation: CTP_CleavageSite=51; ConfidenceScore=5.11e-01
MSSISCTKLTLFSLAAVAIQFIGLSIFVFGFFPVKPLLSGYSGCESFRRPTCDNDGAANQSYASLSPDRRRFLYQEGSEIPPLYDRLVLMVIDGLPAEFVLGKKGQPPSKAFMEAMPYTQSLLASGMAVGYHAIAAAPTVTMPRLKAMVSGAIGGFLDVAFNFNTLAYLDDNLVAQFFKIGWKMVMHGDDTWLRLFPGLFARHDGVSSFFVKDTVQVDQNVSRHLGDELSRDDWNFLVAVKLCLGDLLVMGSNPETASLHMQG

SEQ ID NO: 174226 - protein, 616 aa, Glycine max
  Coding DNA Sequence Number=SeqID_57448
  Gene Ontology: Biological process=metabolic process
  Homolog annotation: Hit_ID=Q6K821; Match level="QueryCoverage=60%, HitCoverage=56%, E-value=5e-40, Identity=32%"; Hit description =Phosphatidylinositolglycan-like
MKHVNCEYFTFLGMFLSNLYPTWECDIPKSTFPGILLDTLKQSLPSNILIQINSQHLELLLYILPLPCNKWFFFSGRSLKSSSIVVVSDHGMTENGNHGGSSYEETDSIALFIGPKTHASGHSSSNHDTIFQVRSLFVYACLLIKRMKQIDDQKLRALQLNSWQLFRLLQAQLPGLSCRNFPCDAFVTNSGPTISECKGSKEKLFCCLYLNAATLHDAWKAKVVTRSNSTEGYNSIVAAYNEFLSSASEWLSHKATDKPINLLVLGVAALVVSCLILLGVVFVIHKEVPAWETQDHDNYVKPWKIDEVFILFGILILVISMGSSSMIEEEHYIWHFLTSTINLLFFRKAIQSLEFNKAHDFLNSIKEQKNTSVSQISSLFLILFSGRILRGWHQGGVNWTNLPDISKWLEQAGNQYINLIQIASCAMVIIMGISVLFLMQSKTKVLTGIGLSLLMSGLFVLQHFMKHPDMSASYNKDANLSVQILFAVLGITTIAVVLVLPWIMPMQTPDICSRKNFYMSASVPVEIQNSTPILVLKDSLYIVGCLYITSWCLLQLLLQQSINAVPVLLLFIQFLASMLTFSSNGSCHKQWVEHIGFGSKSVVLTLKVIALESNQG

SEQ ID NO: 174227 - protein, 165 aa, Glycine max
  Coding DNA Sequence Number=SeqID_57449
MVLYVSVKATIYPLVIKKGNSGEILKTLLGFPCLVPLTINSVLMTVYTIILLLMRNHLFIWSVFSPKYLYVCAATACVYVGICIVVVTVIHTYIVLFWLRKSFSISGKAKEYSLRPRRKNVAYAYSNDTESDSNSHDQDYSRFRPRKPTKRRNAICRMKYKEPPF

SEQ ID NO: 174228 - protein, 219 aa, Glycine max
  Coding DNA Sequence Number=SeqID_57450
  Gene Ontology: Mol. function=transcription regulator activity; Cellular component=nucleus; Biological process=regulation of transcription
  Homolog annotation: Hit_ID=Q7XHI6; Match level="QueryCoverage=93%, HitCoverage=78%, E-value=4e-35, Identity=40%"; Hit description =Putative bHLH131 transcription factor
  Pfam annotation: Domain name=HLH; Domain location=55-104; Score=34.3; E_value=4.4e-07; Accession=PF00010.16; Description=Helix-loop-helix DNA-binding domain
MAFIRQLVQGMQHVRNYYNSDAQMIRGGFHQTFISRTYKTSFLKPRSKVEIKLLAAKKHSEAEKRRRMRINGQYETLRNILPNIIKKDKASVLAETIKQVKELKKKVSKLEQDSSSNPSKDVVKFPNGTDKLNLERCNNDEGIVKATLSCEDRLGLMSSISGALEQVKAKVVKAEIVSVGGRARSVLWVQGLGNDGTGTLKSKLRVAMQKPPKMQRFTQ

SEQ ID NO: 174229 - protein, 61 aa, Glycine max
  Coding DNA Sequence Number=SeqID_57451
MAPKLFEMDEVVKMIHINTLRNLENDQRKTLLSMKKVISSMYYFVRAEIHYIEENEKGKNK

SEQ ID NO: 174230 - protein, 277 aa, Glycine max
  Coding DNA Sequence Number=SeqID_57452
  Gene Ontology: Mol. function=heat shock protein binding; Cellular component=integral to membrane; Biological process=protein folding
  Homolog annotation: Hit_ID=Q9ZU99; Match level="QueryCoverage=51%, HitCoverage=49%, E-value=6e-17, Identity=33%"; Hit description =Expressed protein
  Pfam annotation: Domain name=DnaJ; Domain location=55-119; Score =33.0; E_value=1.1e-06; Accession=PF00226.21; Description=DnaJ domain
MDPLRGSEPENPIATCLSMLSLRRFSACRDFARRLPPSDSVPRVLAVADVLSAADFYSVLQLRPSDGGNRDLARRQYAKLALLLDPTNPDKLPFSDEALARVQNAWHVLSHPERRALHDREQNANLNPNPMTASFWTACPYCWGLFEYEKRYEDRALLCHVCGKAFQGVPVKPPTKTGDAVMEGEELRQYYSCEASVPLMCYEVMGNNVLGGQNAAQYVYISDDNDNNDGGFVRNEGLQGSGEKRRMRVKTVANKEDGELEFTEGDDDVFVGVKFDK

SEQ ID NO: 174231 - protein, 435 aa, Glycine max
  Coding DNA Sequence Number=SeqID_57453
  Homolog annotation: Hit_ID=Q9FKP5; Match level="QueryCoverage=29%, HitCoverage=17%, E-value=2e-47, Identity=75%"; Hit description =Similarity to ubiquitin carboxyl-terminal hydrolase
MELKDENLSSRASVSKTESGLHEINGTHAGISSSNDSYSSLDPLVAARKSFDDNHRSRFAKPVCNDTTDDTSVASPHNKQTVNMKCSENIEVKDSSASKRSKSNHSNATDETRFKSKFPKTQSDTSHDEAANLGSHERRRKAAIVEKLAKDTSKCKTVPYLSGSSKYVVIDDVEEESHLPKYREARRSSSSSRERLSSATKGDFPSQSKCMETDNCHTLPAKVSAVPNLPQNVCSGLKISMQKVVQQFRSSKESRSNSISAENEAKEGISPLSPIGILSKIHKIGSHLGRGKEEDAHEFLRCAVDTMQSVCLKEVGVSSPLAEETTLVGYTFGGYLRSKIKCLRCLGKSERYERMMDLTVEIDGDIGTLEEALGQFTAPEILDKDNKYNCSRLSAEPDVFSQFAICTAKGQCQVVAAVQGGGGVVADGTRSEKFE

SEQ ID NO: 174232 - protein, 40 aa, Glycine max
  Coding DNA Sequence Number=SeqID_57454
MATFIGIHGDLVAVPTNLGPGVGRRSILLRVGFGFRQKPS

SEQ ID NO: 174233 - protein, 63 aa, Glycine max
  Coding DNA Sequence Number=SeqID_57455
  Gene Ontology: Mol. function=DNA binding; Cellular component=nucleus; Biological process=regulation of transcription, DNA-dependent
  Homolog annotation: Hit_ID=Q1SGV7; Match level="QueryCoverage=67%, HitCoverage=3%, E-value=2e-13, Identity=81%"; Hit description =Transcriptional factor B3; Auxin response factor; Aux/IAA_ARF _dimerisation
MLKLILMQSLCCLVRGVRKTLNSELWHACAGPLVSLPQVGSLVFYFPQGHSEHVNESLVLFPK

SEQ ID NO: 174234 - protein, 117 aa, Glycine max
  Coding DNA Sequence Number=SeqID_57456
  Homolog annotation: Hit_ID=Q1T098; Match level="QueryCoverage=38%, HitCoverage=7%, E-value=3e-15, Identity=84%"; Hit description =Forkhead-associated
MVEIQKNRREESLQKKRCEGLQSQQILSSLHSTVIEKKINSYHLSVIYLTQLLLSQSAQNPNVLICTPNFTIGSSRSCNFVLKDQTISANLCKIKHTQVLSRCGVECEGLETLCIKD

SEQ ID NO: 174235 - protein, 204 aa, Glycine max
  Coding DNA Sequence Number=SeqID_57457
  Homolog annotation: Hit_ID=Q8LAY6; Match level="QueryCoverage=30%, HitCoverage=19%, E-value=5e-15, Identity=66%"; Hit description=Major intrinsic protein, putative
MALLLEGRGRSLLLKAQVGFVVLTLTSLWSYLEDRSEEGKVENSYGKMTNVTSTDGSELVATTPTWIQKNVDLEANSHVFAPGDTGNERENVDLEANSGVLEGDTNDERESLIKKESGKSKRAADSIRSLTMVSSEAMDHGGGQIFHAGPSVEASRITTSSRYEPSMSNASFMETEWTELDEPGVHLAIRQLADGTRELRRIRF

SEQ ID NO: 174236 - protein, 76 aa, Glycine max
  Coding DNA Sequence Number=SeqID_57458
  Homolog annotation: Hit_ID=Q17TI5; Match level="QueryCoverage=91%, HitCoverage=18%, E-value=2e-14, Identity=66%"; Hit description =Brevis radix
MRNASDMETEWTEHDEPGVYLTNRQLADGTRDLLRVRISLSTLSATGRDLGREGQRNGGKRTEKEYKFNIFEVLWP

SEQ ID NO: 174237 - protein, 168 aa, Glycine max
  Coding DNA Sequence Number=SeqID_57459
MTDPLDESISCFLIKVDPWVLVPITFRGPYVLAIRGLHALAFRGLRVLIFSVLHIHTLEEYKQHSAQRPQCQSPPADVSVGIAPTRRPMDPKMSNKALGFPVLVTGLCQSYRVPVPPARSCHRDIGIAPTKTPSGPGEVQQGPRVSSSGYGPLLSYRVPVPPDKVTSS

SEQ ID NO: 174238 - protein, 58 aa, Glycine max
  Coding DNA Sequence Number=SeqID_57460
MEVGFVYLCELNRSCVSADTGIRCRPGKMTIPGLKQNNHRMTSIEHFLIDIVQISSGD

SEQ ID NO: 174239 - protein, 128 aa, Glycine max
  Coding DNA Sequence Number=SeqID_57461
MPCTKKSSQMTSEAAKDCLTGKLVTYGHQDVLIAAIGRLEHPGHIRADLPHIFVHGSRRPGVVDAKNQGPGLALPTEPEVGLFTTRVRTKESCIDPSGNDLDTVKVGDEEVRDVDVCIPVPTQEVQLV

SEQ ID NO: 174240 - protein, 97 aa, Glycine max
  Coding DNA Sequence Number=SeqID_57462
  Homolog annotation: Hit_ID=Q1RSK5; Match level="QueryCoverage=97%, HitCoverage=13%, E-value=3e-10, Identity=33%"; Hit description =Ovarian tumour, otubain
MVKLMCGSHNHELAKSLVEHPYTCRLTKDEKTIIANMTKSMVKPRNILLTLKEHNANSCRTIKQIYNARSAYSSSIKGSDTEMQHLMKLLERDQYIH

SEQ ID NO: 174241 - protein, 160 aa, Glycine max
  Coding DNA Sequence Number=SeqID_57463
MTTLTWLWMTLLFSNILPSLYNANLPLQMDQLGSRPQDTQWTRRSPTGPWGFQLWLRASVSPIGCPFPPARSCHRDIGIAPTKTSSGPGEVQQGPGGSRPQDTQWTRRSPTGSWSCQALITDLSQFYGVPVAPSKVIRPPTNRAFIKKYCVPRQAQGETP

SEQ ID NO: 174242 - protein, 131 aa, Glycine max
  Coding DNA Sequence Number=SeqID_57464
MIKDDCADSGIPLLNVTRKILTKEENFNTIVVVVVAMELIAATMTLTKKLSNCDGYNISRRSAYNDIFATPIKLCAPSFSFSSTITTRFFAPSLEPRFRSSNLYSSMIEETKMTFGAPSSISRMPLTGSKI

SEQ ID NO: 174243 - protein, 109 aa, Glycine max
  Coding DNA Sequence Number=SeqID_57465
  Homolog annotation: Hit_ID=Q1SEX1; Match level="QueryCoverage=69%, HitCoverage=10%, E-value=4e-07, Identity=42%"; Hit description=Exo70 exocyst complex subunit
MFLYGAEDKVLQLQTELRMMRSYLQVADRKQDALTSLWFFWEDRCELGKVENRFRKMMNLASIGAFALMALSLLRQLQIGFDVGVTNFLVGCFLVTLMKMNLKLAPLAA

SEQ ID NO: 174244 - protein, 385 aa, Glycine max
  Coding DNA Sequence Number=SeqID_57466
  Gene Ontology: Mol. function=chitin binding; Cellular component =extracellular region; Biological process=chitin metabolic process
  Homolog annotation: Hit_ID=UPI00006A17C9; Match level="QueryCoverage =93%, HitCoverage=100%, E-value=9e-46, Identity=31%"; Hit description= UPI00006A17C9 related cluster
MISPLNESISCFLIRVDPWVLEPIAVRGLHILAFRGLHALTIKGLHVLAIRGLHALTIRGLHILTIRGLHALTFRGLHVLTFRGLCILTFRGLHTLTFRGLHVLAFRGLHVLTLGTRTLTFKGLHALTFKGLRVLTFRGLHALAFRELHVLTFRGLHVLAFRGLHVLAIRGLHALTFRGQHVLTFRGLHILAFRGLNVLAFRGLHAFAFVRLHALTFSGLHVLVFRGLHVLAIRGLQVLAIKGLHVLSFRGLHVLTFRVPHALNFRGLHVLAIRGLHVLSFRGLHVLTFRGPHALTFRGPHVFAFRRLHVLAFRGLHALAFVGLHALTFRGLHVLAFRGLHALAFRGRHVLNFRGLHALAFRGLRILTFSGLHIHTLREFKVYCP

SEQ ID NO: 174245 - protein, 52 aa, Glycine max
  Coding DNA Sequence Number=SeqID_57467
MDEASSSNLEANLDVLIEHEANSNVPGRDRDESSSSEPEVLKDGKSITLPQS

SEQ ID NO: 174246 - protein, 107 aa, Glycine max
  Coding DNA Sequence Number=SeqID_57468
YANFLHLEANSDIFADDKDGERLPDLQGHETNSDVSERDTNEVDIQETSNVLACGTDELSSQDPDQTNSGVLEHEKDVVPLQHGEAERFSSSENDIQNTEKSIKKML

SEQ ID NO: 174247 - protein, 367 aa, Glycine max
  Coding DNA Sequence Number=SeqID_57469
  Gene Ontology: Mol. function=sequence-specific DNA binding; Cellular component=nucleus; Biological process=regulation of transcription
  Homolog annotation: Hit_ID=Q1SVZ6; Match level="QueryCoverage=53%, HitCoverage=64%, E-value=1e-28, Identity=36%"; Hit description=DNA -binding WRKY
NFDKKNVPEFLLVYGQEETFEAFSKLTVSPHGENLPFRKRGYPLFGKLLILLNPPPNFFSFMVKKRPSRHFPSFVSSIVGFSCYALSPSFHNMFGHWNALKIFVYTVVSSLLSIFMFFIKRCSWGHGRSFLLKAQVGFVVLTLTSLWSVFEDRSEEGKVENAHGKMMNLTSSGAFALMAMSLSRQLQLGFEVGVFNFLVGCFLVTVMKMSFKLAPVAALFCYLLVNIRSISDFILEMHARGATQEADGSNTGTVYIRRRSSEDGFDYYGYDTEEIEDRMTDAMFESLNYDTDYYDVEKLFVLVEGYDFVKNAYCVSEWAATRPARYGGKDYDFVVAMVVYKRCHFIFISLLTLNKFQDGKVFSGYDL

SEQ ID NO: 174248 - protein, 64 aa, Glycine max
  Coding DNA Sequence Number=SeqID_57470
MLIVFLMQPAIVLGAGARHSRVDLCISEGAPSVLSGLVTKYVVLGLCHMLLYSCTKAVLGGGCC

SEQ ID NO: 174249 - protein, 307 aa, Glycine max
  Coding DNA Sequence Number=SeqID_57471
  Gene Ontology: Mol. function=nucleic acid binding; Cellular component= intracellular; Biological process=regulation of transcription
  Homolog annotation: Hit_ID=Q1SGQ8; Match level="QueryCoverage=97%, HitCoverage=66%, E-value=1e-114, Identity=71%"; Hit description=Zinc finger, C2H2-type
MEKVKKVGRSEDNNMPTVWFSLKRSLHCKSEPSDVHDPKTRKQLATILTKKGGSSRSGCSRSIANLKDVIHGSKRHLEKPPSCSPRSIGSSEFLNPITHEVILSNSRCELKITGYGGFQEGGVGSDGGGGANNRSATSGDLSTFVGTLRPGTPGPGGHPTMHYFNPSFRTTSTPPRKSPFHSSDKEGSGLHGVGVLGLHSSTRVPLETDSNVSSTVTCHKCGDQFNKWEAAEAHHLSKHAVTELVEGDSSRKIVEIICRTSWLKSEKQCGRIERVLKVHNMQKTLARFEEYRELVKIKASKLPKKHP

SEQ ID NO: 174250 - protein, 204 aa, Glycine max
  Coding DNA Sequence Number=SeqID_57472
  Gene Ontology: Mol. function=structural constituent of ribosome; Cellular component=ribonucleoprotein complex; Biological process =translation
  Homolog annotation: Hit_ID=P11893; Match level="QueryCoverage=78%, HitCoverage=72%, E-value=6e-61, Identity=71%"; Hit description=50S ribosomal protein L24, chloroplast precursor
  Pfam annotation: Domain name=KOW; Domain location=62-95; Score=42.4; E_value=1.6e-09; Accession=PF00467.19; Description=KOW motif
AIDKEASCRQVFFPFAIVHVCSGTSCQGKSTEKQCPIVMRLKRWERKECKPNSLPILHKMHVKLGDTVQVISGRERGKVGEITKIFKHNSTVIVKDLNLKTKHVKSREEGEPGQIIKNGVIRLTRWLKEEGRGEGCIEGPIHSSNVMLYSKDQKVASRVGHKVLDNGKKVRYLIKTGEIIDSSENWKKLKEATKKSEEAAAAAA

SEQ ID NO: 174251 - protein, 70 aa, Glycine max
  Coding DNA Sequence Number=SeqID_57473
  Homolog annotation: Hit_ID=Q1SGQ8; Match level="QueryCoverage=57%, HitCoverage=9%, E-value=9e-12, Identity=85%"; Hit description=Zinc finger, C2H2-type
MAGQTGFDSLAGKVGLYSNIEELYLLNSRGLLPCFVVKSESLCDFSLNRLMDIDRPINCDSPASTLSKYC

SEQ ID NO: 174252 - protein, 337 aa, Glycine max
  Coding DNA Sequence Number=SeqID_57474
  Gene Ontology: Mol. function=metal ion binding; Cellular component =nucleus; Biological process=regulation of transcription, DNA -dependent
  Homolog annotation: Hit_ID=Q6F2W0; Match level="QueryCoverage=17%, HitCoverage=16%, E-value=4e-31, Identity=93%"; Hit description =Putative Dof zinc finger protein
  Pfam annotation: Domain name=zf-Dof; Domain location=33-95; Score =141.3; E_value=2.6e-39; Accession=PF02701.6; Description=Dof domain, zinc finger
  Subcellular localization annotation: CTP_CleavageSite=42; ConfidenceScore=5.06e-01
MSPDDTPPPKPATAKDQETQSSGGGRKSSSTRPQEQGLKCPRCDSPNTKFCYYNNYSLTQPRHFCKTCRRYWTKGGALRNVPIGGGCRKNKKVKSSRLSCDSKDSGSSSSELGGLKFLHSLSPSMDFHLGGLPFPRLHHHHPPTPYNHFSSFGDTSSASSCFNLDPSPGTTPSSSFAALNNYPFSYNGAIQGMSSLNVHSGLASSIESLSSINQDLHWKLQQQRLAMLFGGDNNNQKDHSGVNQIENLAQKPQPIMFQNLEISKPGTFPVGNSRKEQGSSGDTHTPSTEWFFGNSYASVTPTPTTSSGGPGNDNASNWSSGGVHAWGDVPQQYSALP

SEQ ID NO: 174253 - protein, 66 aa, Glycine max
  Coding DNA Sequence Number=SeqID_57475
FTKRNSQWLSARKNLEEDELSCSLSALLQICAKCTSTNKATYLSLKSDLQGEFGTFLEKLCMHEGS

SEQ ID NO: 174254 - protein, 388 aa, Glycine max
  Coding DNA Sequence Number=SeqID_57476
  Gene Ontology: Mol. function=microtubule motor activity; Cellular component=microtubule associated complex; Biological process =microtubule-based movement
  Homolog annotation: Hit_ID=UPI000034ED67; Match level="QueryCoverage =99%, HitCoverage=35%, E-value=1e-67, Identity=42%"; Hit description =ATP binding / microtubule motor
NSKLTHLLQDSLGGDSKTLMFVQISPSDQDVGETLSSLNFATRVRGVELGPVKKQIDTSEVQKMKAMLEKARSECRIKDESMRKLEENLQSLESKAKGKDQIYKNLQEKIQELEGQIELKRAMQNDSEKKISQLSAKLRGKEETCGTLQQKVKELEKKMKEQLQSESASFQQKVWDLEKKLEDQMQGSESESAILKDKIKELERKLKEQEQSSMSLLRQQMKELEDRYREREQQWQQTHSFVDAVKAATPDVCKSCMREECPSEIETGILRCSDSVNRQISQGSSLFKGNDSTHKISQGSLFKENDSTHKIRSKRSNDENNFVMPSSLLHDRRVARKSDPPKIVRGVRPTPRPVTANPAPVSHKRGSTSRDQVQGIKERDTKTKIRSR

SEQ ID NO: 174255 - protein, 231 aa, Glycine max
  Coding DNA Sequence Number=SeqID_57477
  Gene Ontology: Mol. function=RNA-directed DNA polymerase activity; Biological process=RNA-dependent DNA replication
MVLSIPLLADLQGAPHIKKSLPPITFTDEEFTGVDLEQDEPMVIAIGIASLRQFHTRGVIELETTFRVGKLSKRSSNMSLVMQTHPTTYLLDYLPNALGGNVSIPHLVMKFPNSEAPIKGQFLVDFIVELPPSEGHNEGWRTLYVDGASNRQGSGAGALNNQAEYKTLIASLKLPREVGVKKLKCKSNSKCITNDAILPRKGPLTRAMNKRLQEDQARAVEEGLRVLMNLR

SEQ ID NO: 174256 - protein, 42 aa, Glycine max
  Coding DNA Sequence Number=SeqID_57478
MSNVGGGDARLIFEANSSVLSVKDAPCRLSSPTHVVFQGDLT

SEQ ID NO: 174257 - protein, 55 aa, Glycine max
  Coding DNA Sequence Number=SeqID_57479
MKEGSSSQFLTVTISLKHKCLVTNMQIESEGLFLACNEAGLQTIHGFSRMQKLKF

SEQ ID NO: 174258 - protein, 134 aa, Glycine max
  Coding DNA Sequence Number=SeqID_57480
MWLQSRKRRPVCDKDELMQKEKEEERPRSLKANHNGLPKSIPTLSGTLSFPTFLRAAKDVPQSISGRDELHKDELHNVVVVMEAQTSLRQRRTQAEGERRRTIGFKHAGLCNFRFLVYNDNNIDFSKITDVNIN

SEQ ID NO: 174259 - protein, 69 aa, Glycine max
  Coding DNA Sequence Number=SeqID_57481
  Gene Ontology: Mol. function=transition metal ion binding; Cellular component=chloroplast; Biological process=iron ion homeostasis
  Homolog annotation: Hit_ID=Q94IC4; Match level="QueryCoverage=64%, HitCoverage=17%, E-value=2e-11, Identity=82%"; Hit description =Ferritin-2, chloroplast precursor
MTPASGAGAFEAAHTLEFLLPPTPLERPKKKKKKMNFFGTSPPPTTSEREKLKLWSKKGPFGKNNEMER

SEQ ID NO: 174260 - protein, 81 aa, Glycine max
  Coding DNA Sequence Number=SeqID_57482
MTINSWGSGLDGGGRTNSARQSIRRAPDSMAINSWRSELDGGGCMNDNQFMGLRIRFVGGGCTNSARQSIRGAPDSMVEDA

SEQ ID NO: 174261 - protein, 61 aa, Glycine max
  Coding DNA Sequence Number=SeqID_57483
MKEEEEEERRGNEAEALPNRDCDQCLHCSLSGVLRATVGVPLVIMCTFIFSIYHRRSHFSL

SEQ ID NO: 174262 - protein, 578 aa, Glycine max
  Coding DNA Sequence Number=SeqID_57484
MHAPINHIDDTYATWHLHLHTEFVPSNDTQKEETPEMVAEEAISADDKDTETLAQEKTEVSAAPPALQEKNGHGSSSSRSPSPPPSKGNSQATTGETFKTPVSGTRDKAQPNLNHQNAPNTSEKVKPKENTIPVSECMTNENKGGLHPSFREIRKSLARELIILQERLDSIIAKKRQQQMPDADVQEHVEITLMNMQSEEHVQKQQEEKVAVPEDSAEGTRDDVKGPCANDGGSESQSPVDPPSNEGAESVALPNGSDNEDTSQVVASDALNSSSDLSESDKMAVESEAKSEAKDNPIAEDIPIEVDKLDKTVWEELPVGVIDEDINDVSIEREEHDDVRSGSLPAMVNDSAQEGSDSENYAMMELPLGLHEEHERDNEMNISNGETRSENEIFIEELPVGLHDEDTAISKDKRDDQAKPKTYKEVLLAQEGECNADEETSSSTDDTANETQLEQQQKLKEQEKVHSSRVKIEYPEEGELNGDAPMDIRVECKSGEEAGTDTKLLPLTTQVSDNEPENEDVFSEANYVNNKLTEPMEFVPSNDTQKEETPEMVAEGAISADDKYFRCFWYSPLIRIGV

SEQ ID NO: 174263 - protein, 102 aa, Glycine max
  Coding DNA Sequence Number=SeqID_57485
MEKSDKRTFKEKKAYITWKDNDMDSSSDSENEIINLGLMAKEYESEEEVMSSNYDLSISFDELQDAFNDLHKESIKLAKLVPYSKKPISSLEKEILKLKFGI

SEQ ID NO: 174264 - protein, 87 aa, Glycine max
  Coding DNA Sequence Number=SeqID_57486
MDTSEPYTGAMKGTMHEPQANLGAGLQVFTFRELHVLTFRELHVLALRGLHILAFRGLHVLDFRGLHFLALRGFHALAFKGLHALCH

SEQ ID NO: 174265 - protein, 118 aa, Glycine max
  Coding DNA Sequence Number=SeqID_57487
MEVSIGLCRSDIGIVPTRHPVDPEKSNRVLGFPTLVTGLCQSYRVPVPPSKGSHPVDPKKSNRVLGFPALITSLCQFYEVPVIPGKVIRPPTNRAFIKKYCAPRQAQGKTPQQHWDGR

SEQ ID NO: 174266 - protein, 183 aa, Glycine max
  Coding DNA Sequence Number=SeqID_57488
MDGDSIIHTVAYANDFVRDAEIIPHKVDADGDKPANVDADDPMRGLIKYNFDIYDKPVEFKFDGSKFGIVDAPSSIFLTYSDVSEIIAGDKSLNISIQQLWLMYMHEWSETLGQGSSYAFLEQRSLVVSKDTCGECQQYLERWLKESDREVYVGPYFHHVMTKLKTGLSPESKAAAPKWIEVK

SEQ ID NO: 174267 - protein, 118 aa, Glycine max
  Coding DNA Sequence Number=SeqID_57489
  Gene Ontology: Mol. function=nucleic acid binding; Cellular component= endoplasmic reticulum membrane; Biological process=DNA integration
  Homolog annotation: Hit_ID=Q1T010; Match level="QueryCoverage=97%, HitCoverage=11%, E-value=1e-36, Identity=53%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MSEPRKSHLMAAKRMLRYIKGIPKYDRKNTLGYIFKFLKAPISWCFKKQPIVALSTCKAEYISYQAIWLDSVLKELKSKGKKPIQFFVDNKSAINLANNPDSHGRSKHIETKFHFLTI

SEQ ID NO: 174268 - protein, 130 aa, Glycine max
  Coding DNA Sequence Number=SeqID_57490
  Gene Ontology: Mol. function=nucleic acid binding
  Homolog annotation: Hit_ID=Q1SHC9; Match level="QueryCoverage=77%, HitCoverage=23%, E-value=8e-16, Identity=36%"; Hit description=Zinc knuckle, putative
MEELERIADYFSGMLSLTNAMKGCNEPITDQMIIDKIMRTFTQNFDQIVVVIEESKDVEIMKIEELEQDQSGRSSFAGTGHKDWLIDLDTRRSSKVKLANRKNWNAEGVGNILIRRKDGKTILIESVLFM

SEQ ID NO: 174269 - protein, 53 aa, Glycine max
  Coding DNA Sequence Number=SeqID_57491
MKVSKKAEGSGHSLEVGPHGLLHEAVSDGHVLVVVVDCGNGGGERKHVFEGSV

SEQ ID NO: 174270 - protein, 200 aa, Glycine max
  Coding DNA Sequence Number=SeqID_57492
  Gene Ontology: Mol. function=transposase activity; Cellular component= integral to membrane; Biological process=transposition, DNA-mediated
  Homolog annotation: Hit_ID=Q8GXE9; Match level="QueryCoverage=88%, HitCoverage=63%, E-value=7e-54, Identity=54%"; Hit description=HVA22- like protein j
  Pfam annotation: Domain name=TB2_DP1_HVA22; Domain location=2-96; Score=19.6; E_value=4.7e-07; Accession=PF03134.9; Description=TB2DP1, HVA22 family
MLGDFINRILILILGYAYPGFECYKTVEKNRVDIEELRFWCKYWIIVALFTVLEKFADIFVGWLPMYGEMKLVLFVYLWYPKTKAILYTPFLFEGEKHDYMSTGTGYVYQTLLRPYISKHENDIDRTLMEWKARGWDYVIFYWQYCAKFGQTAFVQALQHLASQSSRFSANPTTQLNVINKVSCWQLKLRKVKMTLEFYI

SEQ ID NO: 174271 - protein, 160 aa, Glycine max
  Coding DNA Sequence Number=SeqID_57493
  Homolog annotation: Hit_ID=O04892; Match level="QueryCoverage=39%, HitCoverage=11%, E-value=9e-19, Identity=73%"; Hit description =Cytochrome P450 like_TBP
LPTLETAQPEVGSSGWKSTARRVVSGAPPAALENPEDRVPPTPGKGSRQNGSVTSGKGLALRAGHGGPSPEPVGCRWTARAASAARAGRRVPVGGRIGNGPFGASSPGVEQSTQNCDAHEWINEIPTVPVYYPAKPQPRERAWRNQRGRDPVELDSSPTL

SEQ ID NO: 174272 - protein, 113 aa, Glycine max
  Coding DNA Sequence Number=SeqID_57494
  Gene Ontology: Mol. function=unspecific monooxygenase activity
  Homolog annotation: Hit_ID=O04892; Match level="QueryCoverage=57%, HitCoverage=12%, E-value=1e-19, Identity=72%"; Hit description =Cytochrome P450 like_TBP
  Subcellular localization annotation: CTP_CleavageSite=45; ConfidenceScore=5.08e-01
MEQCRQGKSAKWIRNLGKRIGSEGWARGSQSRTRRLSVDCSRCFRGESGSSRTGRGTDWERALRGLLAGRLQITNKPCPPQKTNQSGIPFFFYYVWPKEATVRRLSLVLPAWC

SEQ ID NO: 174273 - protein, 33 aa, Glycine max
  Coding DNA Sequence Number=SeqID_57495
MAYVGFHWWSVLPSFIRKDLFRNRCGLPFYSFR

SEQ ID NO: 174274 - protein, 98 aa, Glycine max
  Coding DNA Sequence Number=SeqID_57496
MVVRWWFRQVDLVKGRLVVGGIGVSVVVWTNKYGEWEVGGGPGVVLESRSGEEEASGAAVVVWASKSDEQEASGGVVVGGGTMVVLVSGSNEGRIVRV

SEQ ID NO: 174275 - protein, 50 aa, Glycine max
  Coding DNA Sequence Number=SeqID_57497
MDVGVELKDTTLSKLITTGREEVGCSTFLCRVVIALVVVGKEEKIVEEKE

SEQ ID NO: 174276 - protein, 56 aa, Glycine max
  Coding DNA Sequence Number=SeqID_57498
MFSRLDLNQEGEALTNSSKSRPWGRLTWFFTDKMVRWMAMENLVLEDARTQCSDRM

SEQ ID NO: 174277 - protein, 634 aa, Glycine max
  Coding DNA Sequence Number=SeqID_57499
  Gene Ontology: Mol. function=nucleoside-triphosphatase activity; Cellular component=intracellular; Biological process=small GTPase mediated signal transduction
  Homolog annotation: Hit_ID=Q1H0V5; Match level="QueryCoverage=62%, HitCoverage=79%, E-value=0.0, Identity=82%"; Hit description=Small GTP-binding protein domain
  Pfam annotation: Domain name=AIG1; Domain location=416-605; Score= -90.0; E_value=0.0054; Accession=PF04548.7; Description=AIG1 family
  Pfam annotation: Domain name=ATP_bind_1; Domain location=420-587; Score=-50.9; E_value=0.0021; Accession=PF03029.7; Description =Conserved hypothetical ATP binding prot
  Pfam annotation: Domain name=Dynamin_N; Domain location=418-537; Score=-24.9; E_value=0.0017; Accession=PF00350.13; Description =Dynamin family
  Pfam annotation: Domain name=GTP_EFTU; Domain location=413-596; Score= -22.0; E_value=1.2e-05; Accession=PF00009.17; Description=Elongation factor Tu GTP binding domain
  Pfam annotation: Domain name=MMR_HSR1; Domain location=240-359; Score= 157.1; E_value=4.4e-44; Accession=PF01926.13; Description=GTPase of unknown function
  Pfam annotation: Domain name=MMR_HSR1; Domain location=416-537; Score= 161.9; E_value=1.7e-45; Accession=PF01926.13; Description=GTPase of unknown function
  Pfam annotation: Domain name=Miro; Domain location=241-359; Score =1.3; E_value=0.0041; Accession=PF08477.3; Description=Miro-like protein
  Pfam annotation: Domain name=Miro; Domain location=417-537; Score =20.4; E_value=5.6e-05; Accession=PF08477.3; Description=Miro-like protein
  Pfam annotation: Domain name=PQQ; Domain location=1-29; Score=2.7; E _value=6.8; Accession=PF01011.11; Description=PQQ enzyme repeat
  Pfam annotation: Domain name=PQQ; Domain location=128-165; Score=5.1; E_value=3.1; Accession=PF01011.11; Description=PQQ enzyme repeat
  Pfam annotation: Domain name=PQQ; Domain location=166-203; Score=9.1; E_value=0.89; Accession=PF01011.11; Description=PQQ enzyme repeat
  Pfam annotation: Domain name=PQQ; Domain location=32-69; Score=23.5; E_value=0.00075; Accession=PF01011.11; Description=PQQ enzyme repeat
  Pfam annotation: Domain name=PQQ; Domain location=77-114; Score=20.7; E_value=0.0051; Accession=PF01011.11; Description=PQQ enzyme repeat
  Pfam annotation: Domain name=Ras; Domain location=417-586; Score= -96.4; E_value=0.048; Accession=PF00071.12; Description=Ras family
  Pfam annotation: Domain name=cobW; Domain location=416-559; Score= -69.3; E_value=0.024; Accession=PF02492.9; Description=Cobalamin synthesis proteinP47K
  Pfam module annotation: Pfam domain module=AIG1::ATP_bind_1::Dynamin _N::GTP_EFTU::MMR_HSR1::MMR_HSR1::Miro::Miro::PQQ::PQQ::PQQ::PQQ::PQQ: :Ras::cobW; Domain location=416-605::420-587::418-537::413-596::240 -359::416-537::...
  Pfam module annotation: Domain location=241-359::417-537::1-29::128 -165::166-203::32-69::77-114::417-586::416-559
KGHLYALNVNGKKLWSAILSSEVQGQPRYYDGTVIVRTSDHHIYGIDAADGRRKWSYERATPSLSLKTQAGIVVDGGAVYAGFPGGKLIAIRADNGKLVWETTVAQPKGVTEIERIADITSLPFVDGPLVYVVAYQGKVAAVDRQRGQIVWNRDISSYVGLTAENNKVYLSHTIGSVYSLDASNGKTFWRQGNLGYRNLTVPLPLSNVVAVGDLEGYIHLLSQDDGSFVGRTHHIQIMLPTIVLVGRPNVGKSTLFNRLTKTRDALVADLPGLTRDRHYGRGLGASQPYLVIDTGGFEPTADTGILKEMAKQTLLAIDEADVIIFLVDARAGLTPQEFTIAQTLRKAQRPVLLAVNKTEGMRKAIVSADFHELGMGEPLSISSAHGEGVRDLIELALETISDKEIENSEPVNPDNPRIAIVGRPNVGKSTLVNALLGEDRVIAFDQPGTTRDSIEIALEKNGKQYTIIDTAGVRKRGKVFEAVEKFSVIKTMQAIEDANVAILVVDAKEGITEQDAHVAAYIVDAGRALVVAINKWDGLQDDEREWIKREIDRKLQFLDFAKFHYISALRKKGLNELLSSVDVAFKAAMAKLATPQLTRVLGEATTQHQPPISKGIRPKLRYAHQGGTNPPIVV

SEQ ID NO: 174278 - protein, 102 aa, Glycine max
  Coding DNA Sequence Number=SeqID_57500
  Gene Ontology: Mol. function=RNA-directed DNA polymerase activity; Biological process=RNA-dependent DNA replication
  Pfam annotation: Domain name=rve; Domain location=1-101; Score=-9.7; E_value=0.039; Accession=PF00665.16; Description=Integrase core domain
MEHASRESRVALPPKGRLRHSDGGANFCNAQLQKVLSQYHVTHKVTSPYHPQSNGQAEVSNRELKKILEKTVASTRKDWSTKLEDALWAYRTAYKTSIGLSL

SEQ ID NO: 174279 - protein, 92 aa, Glycine max
  Coding DNA Sequence Number=SeqID_57501
MLNGMPRGFSMTSTRCVRVVSSKKWRLRKPSRVYGYHCIIEWTWEQVNIGHRNLGEFYRFFFSLQNSFLGGCFWIVLKVMFVIGSAVDILCG

SEQ ID NO: 174280 - protein, 213 aa, Glycine max
  Coding DNA Sequence Number=SeqID_57502
  Homolog annotation: Hit_ID=Q8S6H8; Match level="QueryCoverage=29%, HitCoverage=11%, E-value=2e-07, Identity=50%"; Hit description =Putative retroelement
MQRSGTSCICPIKSCNEILPNQEVPIFSKSFVVETDASNNGIEVVLSQEGMTIAFFSLAQGLSERVQNNSVYEMEFMALVYAMQNGGITGAADALSRKMNFSAITTVNVKGLVYWRKEVHSDANLQKIIKDLVLNPNYRDRLRGFIIEKIIKTQKKPRKSTIIPAYIEQRVASTPPEIQGKEMQNTTQTAPMSIAYIVRIKIYAVRSRTTPVA

SEQ ID NO: 174281 - protein, 237 aa, Glycine max
  Coding DNA Sequence Number=SeqID_57503
  Gene Ontology: Mol. function=nucleic acid binding
  Homolog annotation: Hit_ID=Q5JJM4; Match level="QueryCoverage=62%, HitCoverage=21%, E-value=2e-13, Identity=41%"; Hit description =Peptidylprolyl cis-trans isomerase-like protein
MDINSAYSCLLGQPWIHSVGVVPSTLHQKLKFVVEGHLVIVSGKEDNLGHVHLGFWRDLPRRDLGFVEPFEMRDSPRVYLGFDEPLAERDSSRVDLQFDKPLEKRDSPRADPGFDKSLEKRDSPIADLGFDEPLEKRDLPRADLRFNEPLLKRDSPRADLGFDEPLAKQDSPRENLKFNESLMKRDSPTTNLRFDEPLEKRDSPRANLGFWRSETHQGWTLGLRAFGDAILSRKGIG

SEQ ID NO: 174282 - protein, 1251 aa, Glycine max
  Coding DNA Sequence Number=SeqID_57504
  Gene Ontology: Mol. function=catalytic activity; Biological process =metabolic process
  Homolog annotation: Hit_ID=Q5W6W7; Match level="QueryCoverage=54%, HitCoverage=98%, E-value=0.0, Identity=65%"; Hit description =Putative long chain acyl-CoA synthetase
  Pfam annotation: Domain name=AMP-binding; Domain location=104-584; Score=318.1; E_value=1.6e-92; Accession=PF00501.18; Description=AMP -binding enzyme
MDDPKGSSSWLKSLNISDIFGWKGHGEYGALAAIVISILVPVLFSALFFGKKKGKIRGVPVEVGGEECFAVRNARKTELVEEFVTSSDGRKFEKLHLGDYEWETYGEVFARVSNFASGLLKLGHNGDSRVAIFSDTRAEWLIALQGCFRQNVTVVTIYASLGEDALIHSLNETEVSTLICDSKQSKKLDAIRSRLTSLQNVIYFEDDNEEDAFSGSSSGWTIASFSEVEKLGKESPVEPSLPSKNAIAVIMYTSGSTGLPKGVMITHGNIVATTAAVMTVIPNLGSKDVYLAYLPLAHVFEMAAESVMLAAGCAIGYGSPLTLTDTSNKVKKGTKGDATVLKPTLLTAVPAILDRIRDGVVKKVEQKGGLVKNLFHFAYKRRLGAVKGSWLGAWGLEKLMWDTIVFKQIRTALGGQLRFMLCGGAPLSGDSQHFINICMGAPIGQGYGLTETFAGAAFSEWDDYSVGRVGPPLPCCHIKLVSWEEGGYLTSDKPMPRGEIVVGGFSVTAGYFKNQEKTKEVFKVDEKGMRWFYTGDIGQFHPDGCLEIIDRKKDIVKLQHGEYISLGKIEAALSSCDHVDNIMVYADPFHNYCVALVVASHQSLEKWAQQAGIDYQDFPDLCNKPETVTEVLQSISKVAKSAKLEKTEIPAKIKLLPDPWTPESGLVTAALKIKREQLKAKFKDELQKLVVALTSGRVASSLSPNHGQVLSDVESSNLDKCESYRSVKLVKPSSLDKCCSGWFCQVVQGGGGHEVIPIGGSSKEETRHEASDSKSSSLERLRSHVVLVEEPLASIGWHNLLLLLWTGNLFQSSGKNIRASPRVHHSHNIGPPSYFLLVVGYEWMKLTRKIGWVSLNIVSKKLFEFDLNVFRFFKDRFFKSLATDVVVDRLPLMFNRDRESHFPYYWQLDLTRVDKAILEQQSTLLDAQTILSSPSANDPLVALDETYSVVPPSVDRSVGEGGQPPARVSPNDEVVEVSLNVSSSILIKSKHDDDAGVLGHKKLRGPFSLRAMRQAARFGLPLWFAGSTFSSDGYLGYCSFYYYCSCSSNSFLCACLGGFYFSCYCDYDVGFFGCHCLYTIVECWFDDHKCSRDVASFFVSFAGSPSTVLASASPSSSSHLSVSLNHIYTSRDINSLWGLPSKKSGDSGGERHHEALSKVESTTVDKDELAKVIVDLLARLRESKLEESELRVSKEREANKELEEELLAVMQAGFFAKDLYLGLFDPFRDVKDGVLLDEEEIATEEEDASEE

SEQ ID NO: 174283 - protein, 79 aa, Glycine max
  Coding DNA Sequence Number=SeqID_57505
MSRNFTYCATKGAKYLEAESIRKKPYFPVTEGSALDNEGHMNNARQSIHRAPNKMVEDTRTALSNQFVGLRTQWWRMHG

SEQ ID NO: 174284 - protein, 120 aa, Glycine max
  Coding DNA Sequence Number=SeqID_57506
MEDEGPTAQEPRQVHDASSGTTIPEPFTFQQDAGEEQVRLETATIPERSLEGTSEPPTSVVDLSSPQPTADPSTHVLDIPEDQTTPILALNTSPPATPVLNLTDEEDVQTQDTQDMSLEF

SEQ ID NO: 174285 - protein, 301 aa, Glycine max
  Coding DNA Sequence Number=SeqID_57507
ARVMGEIEKVQERIKADMEAMKEQMATMIEAMMSMKKILEVNAIAVDADPTPPSSLNQINHPTSNMVGQGGKELRSTGGPHFVQVQNKHVFPPHGLPPNYTPPIVVHTPDENVNNSTPILVESQQPQADHAHVSQPMREAHEIPHHNLANFKPCLGYATKGQAVGGIPLPNTLEGPQFHPQPQPLHFVVGESLLLWAIEGGGDCAFADMHESFKEYAQQWRDLASQVVLPMTEKEMITMIVDTLPVFYYEKMVGYTPSSFADLVFTDERIKVGLKRGKFDHPALTNKKPGANREDEKEEGT

SEQ ID NO: 174286 - protein, 88 aa, Glycine max
  Coding DNA Sequence Number=SeqID_57508
MKSADKREYHIVIRTFHQPRANESGDAQRLISSSAPSVILTHEVRFTLVVRRYSSTTTHEILLCWAGTIKFDSAWKRRGYPILSLSRH

SEQ ID NO: 174287 - protein, 171 aa, Glycine max
  Coding DNA Sequence Number=SeqID_57509
  Gene Ontology: Mol. function=nucleotide binding; Biological process =small GTPase mediated signal transduction
  Homolog annotation: Hit_ID=UPI00006BCA7D; Match level="QueryCoverage =98%, HitCoverage=89%, E-value=1e-20, Identity=31%"; Hit description =Conserved hypothetical ATP binding protein
  Pfam annotation: Domain name=ATP_bind_1; Domain location=2-160; Score= 23.5; E_value=4.7e-09; Accession=PF03029.7; Description=Conserved hypothetical ATP binding prot
  Pfam annotation: Domain name=MMR_HSR1; Domain location=2-116; Score= -18.1; E_value=0.046; Accession=PF01926.13; Description=GTPase of unknown function
  Pfam module annotation: Pfam domain module=ATP_bind_1::MMR_HSR1; Domain location=2-160::2-116
MGSGKSTLVRSIAAGAVIDTDVANSDRLGADKASTTVALDYADIDLPNGERLRLYGTPGQQRFDFLWPILLQGARGAVLLLDARRAGLAGELEDYLQVLQPFAASLALVVAVTHLDQAPHAALDDWAARASLDDQPLPLLAVDVRDREQGLLLMDVLMSEMEAHALVAAHG

SEQ ID NO: 174288 - protein, 400 aa, Glycine max
  Coding DNA Sequence Number=SeqID_57510
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q5GUR6; Match level="QueryCoverage=74%, HitCoverage=47%, E-value=1e-148, Identity=89%"; Hit description =Transcription termination factor Rho
TSQACDRVEQDHHVLRVLDQALGALDDHLGHLHVARGRLVEGRADDLAAHGALHFGHFFRALVDQQHDQVHVRVVGGDGSGHQLHHHRLAGLRLGNDERALALALRCHQVEDTAGDVFRRTVATLQGEAAAREQRGQVLEQHLVLRRFDRLAVDGVDDVQREVALAVLREADAAGDVVTGAQVEAADLAGRDVGVVRAGQVAGFGRAQEAEAVRQDFQHAIGGDAVTVAGQHLQQGEDHILLAGARHAFGDLQLLGDFQQLLRRHALEVAQRIDREALGHVGVRARHERLLLAAIVGQAVVAEAVVAVTVAAVAEAVAAVALALPLALLAVLVVRVLALVLAAHQAYRYRRPRGGARYQLLFPLVRVNFELGVIMVIAVSCVKLLSAHNSTQHTSRKHKV

SEQ ID NO: 174289 - protein, 456 aa, Glycine max
  Coding DNA Sequence Number=SeqID_57511
  Gene Ontology: Mol. function=transcription regulator activity; Cellular component=nucleus; Biological process=regulation of transcription
  Homolog annotation: Hit_ID=Q9LHQ8; Match level="QueryCoverage=99%, HitCoverage=91%, E-value=1e-75, Identity=41%"; Hit description =Arabidopsis thaliana genomic DNA, chromosome 3, BAC clone: F3H11
  Pfam annotation: Domain name=HLH; Domain location=348-386; Score=7.3; E_value=0.024; Accession=PF00010.16; Description=Helix-loop-helix DNA- binding domain
  Subcellular localization annotation: CTP_CleavageSite=21; ConfidenceScore=5.16e-01
MADDDQFQASGNWWETSRSVRYESGASQSSSSAITNTGNNFGWQGSDMADMKPRSSMDSSSVVFHDTQNNKLQQPDSATSSDPNLHMMGLGLSSQAMDWNRASLLRGEKGTENSFRSMLQENLSSSRTNFQHETGNMELSQQVQWRSEKIFSSESSTNEFKQVNRGGGFSLDQSQFSPQYSSGDSTVTSQGLPSSNFQIDSSALYGTSSILQGLLGPDHNNQTQQQPMSFPYHTTSYGLNSNELVPSWSKVPQFLRASPPKPPPNNQLHFTNPATFWNASEAANIKDVRPSFFPSLQPPFSTPNFEVQSKNISEVRESGTVVKKSGNEPAPKRTRNETPSPLPAFKVRKEKMGDRITALQQLVSPFGKTDTASVLSEAIEYIKFLHEQVTALSTPYMKSGAPIQIQQNSGKSKEAEGPKQDLRSRGLCLVPVSSTFPVTHETTVDFWTPTFGGTPR

SEQ ID NO: 174290 - protein, 175 aa, Glycine max
  Coding DNA Sequence Number=SeqID_57512
  Gene Ontology: Mol. function=RNA-directed DNA polymerase activity; Biological process=RNA-dependent DNA replication
MTIGMFGKSLNTKLSQDFFQVCLVLGYSLRLDDHVVAINLNVSSDMLLENSVHQSLRVCIFGARHVQISIIDAYSPFGVGLFYHDDVGELGKIFDFSDEVGIEEFVHFFSDSFAVVATYPLVRGRRGDHGCVFQERKMGGVATNVYSRKTSEKLERCGLRTLIVKGSGVVFMHGE

SEQ ID NO: 174291 - protein, 154 aa, Glycine max
  Coding DNA Sequence Number=SeqID_57513
GGTTISWEKVFLDKDGEGAMSRLDRAMVSLERLQMWPNATQYIFDRSISDQGLRPFKVFNYWIEKLEFVKKAYGSCDIQGWGAYVKFKHLKKDIKRNNCIKGLKVGNEWCDEPRKVKQEIKEYFQKRFFEEGSMEVVLEGVGFKSLSEDDNVLL

SEQ ID NO: 174292 - protein, 86 aa, Glycine max
  Coding DNA Sequence Number=SeqID_57514
MSQPTLQQEGDVRLMGASSKEGKYAESPPTFGFWHTLISSGDYCLMACNLWLTASRYLAPFDAQYVKFRDMPEIKRKHCYAIREIP

SEQ ID NO: 174293 - protein, 50 aa, Glycine max
  Coding DNA Sequence Number=SeqID_57515
MFVPRWRRLRMRQLWWLGLRGWPKSSLKHWMRKGLRKNSSHPTRSARHPR

SEQ ID NO: 174294 - protein, 98 aa, Glycine max
  Coding DNA Sequence Number=SeqID_57516
MLSIHDLAQHRPIMSMEAFMAQVARPGVQPSSSGGATPMEATDEDGAVETNVDTDYVVGVTMVQGTWDPWPTLAQDPPMPAQDAPTSPHDDPTPTQEE

SEQ ID NO: 174295 - protein, 131 aa, Glycine max
  Coding DNA Sequence Number=SeqID_57517
MASRKRRASTSRPQEPYDISRFVSEVAWEHYEKNVHTRNILPERNVELSITQWNRALTRQPDNHIDVAPVKEFYANLFDPEDKSPRKSRVRGKLIKFDAATLNEFLETPVVLEPGERYSAYSRFYHTHPDP

SEQ ID NO: 174296 - protein, 128 aa, Glycine max
  Coding DNA Sequence Number=SeqID_57518
  Gene Ontology: Mol. function=DNA binding; Biological process=DNA integration
  Homolog annotation: Hit_ID=Q1SJ98; Match level="QueryCoverage=96%, HitCoverage=23%, E-value=7e-16, Identity=42%"; Hit description =Integrase, catalytic region
MVLTEKTTRILAVGTPKKVARTPTVAQTMAPVLVADVETTNNSGSLGLGCSGLYGLALLLHILPTTIGPNPLSVLDHHSLVFLDQSLSKQLTMQMHPAQLILKQLFILSALLNLIRHGLSDRDDTNAM

SEQ ID NO: 174297 - protein, 53 aa, Glycine max
  Coding DNA Sequence Number=SeqID_57519
  Homolog annotation: Hit_ID=Q6T7D3; Match level="QueryCoverage=62%, HitCoverage=18%, E-value=1e-07, Identity=67%"; Hit description=Fiber protein Fb34
MVDGNIEKRKRKDEEEVIIYQQIMKRTSSKVLEPPGFRGFPQQKQRLATIMRS

SEQ ID NO: 174298 - protein, 240 aa, Glycine max
  Coding DNA Sequence Number=SeqID_57520
  Gene Ontology: Mol. function=transferase activity; Cellular component= membrane; Biological process=DNA integration
  Homolog annotation: Hit_ID=Q1SX87; Match level="QueryCoverage=94%, HitCoverage=22%, E-value=2e-63, Identity=76%"; Hit description =Polynucleotidyl transferase, Ribonuclease H fold
MKVHIRFSQSKSDNSLFIYKKGLEMAYILLYVDDIILTASSVALRKSIMLLLNSKFAMKDLGPLSYFLGIAITQHVGSLLLSQKKRILHYAQGTLHFGLHLYPASTTSLISYTNADWGGCPNTRKSTSGYCVFLGDNLLSWSSKRQPILSCSSAEVEYRGVANVVSESCWLRNLLLELHCPVHTVTLVYYDNVSVIYLFENPFQHHRTKHIEMDIHFVREKVSRGQGQSQHTTTSCFNCQ

SEQ ID NO: 174299 - protein, 120 aa, Glycine max
  Coding DNA Sequence Number=SeqID_57521
MVEALAKSTSRVKDFRRGATMAMKDDTMEDDGGDAKGKGLGKVEAKGKRKGKCFWSGSGRGHYLVKVVRSRIRKGEISGCRDLDLRSKLTKEVKERGSGEREAGCVVAIKEGVCQRRKNV

SEQ ID NO: 174300 - protein, 57 aa, Glycine max
  Coding DNA Sequence Number=SeqID_57522
MEKYVEQPREWEMKRLEKKTPGTICGATKGVGNEKWLQLKIVVMVAVIIIMVMVVTV

SEQ ID NO: 174301 - protein, 67 aa, Glycine max
  Coding DNA Sequence Number=SeqID_57523
MKRSAWGNPRRGSVLDVRAQRAVSSLNESFVLSRVMRILKLAKCRLKAQVEKDKAPKWRRMKAQRQR

SEQ ID NO: 174302 - protein, 74 aa, Glycine max
  Coding DNA Sequence Number=SeqID_57524
MNSDNSFGGQLMKGVRKNKHDYTTREQLVVSNDIGTFCLPTAHHIQLLFVNAIRDNIINPIKEEVLGPLNSSEK

SEQ ID NO: 174303 - protein, 105 aa, Glycine max
  Coding DNA Sequence Number=SeqID_57525
  Pfam annotation: Domain name=Transposase_23; Domain location=8-63; Score=-15.7; E_value=0.06; Accession=PF03017.5; Description =TNP1ENSPM transposase
MGEPHCERMDDSKLLIYEGLTTIHNVPLCSDQVKVGVEEVRDADACVPIPTKEVQLVGQTLNTFLAWPAHLLQPFSEQGLEGPLKPVDRSDLDVDPLYLMTLTIA

SEQ ID NO: 174304 - protein, 33 aa, Glycine max
  Coding DNA Sequence Number=SeqID_57526
MTDDNATSSTTIDKMSDLSDKLMIKFLWGCNCV

SEQ ID NO: 174305 - protein, 335 aa, Glycine max
  Coding DNA Sequence Number=SeqID_57527
  Gene Ontology: Mol. function=microtubule motor activity; Cellular component=microtubule associated complex; Biological process =microtubule-based movement
  Homolog annotation: Hit_ID=Q1SGR1; Match level="QueryCoverage=95%, HitCoverage=39%, E-value=1e-126, Identity=75%"; Hit description =Kinesin, motor region; Prefoldin
  Pfam annotation: Domain name=Kinesin; Domain location=191-335; Score=- 64.6; E_value=3.7e-10; Accession=PF00225.13; Description=Kinesin motor domain
MILRYICPKDLIRILVKKDQRTESANILPSLVDCRVSSQEEAIKQKDVLATEVSSLRGELQQVRDERDRQLSQVQTLSYELEKVKESRKHSSTELDSLTLKANDMEEKCSFKDNQIKALEEQLATAEKKLQVSNISAYETRTEYKGQQKFVNELQRRLADAEYKLIEEERLRKKLHNTILELKGNIRVFCRVRPLLADESCSTEGKIFSYPTSMETSGRAIDLAQNGQKHSFTFDKVFTPEASQEEVFVEISQLVQSALDGYKVCIFAYGQTWSGKTYTMMGRPGHPEEKGLIPRSLEQIFQTKQSQQPQGWKYEIIADKVFLAKFTGVNVGNIQ

SEQ ID NO: 174306 - protein, 101 aa, Glycine max
  Coding DNA Sequence Number=SeqID_57528
  Subcellular localization annotation: CTP_CleavageSite=22; ConfidenceScore=5.16e-01
MVVGDHGTSNGLGWPTSLSDTSTALRGRIQRRRILDRSYGTPAERTITKMVGTVELVFNQTCDEDEEMEIWGFESQNLHSIISRKSLRKTPIYSSSNIKGT

SEQ ID NO: 174307 - protein, 159 aa, Glycine max
  Coding DNA Sequence Number=SeqID_57529
  Gene Ontology: Mol. function=RNA-directed DNA polymerase activity; Cellular component=chromatin; Biological process=chromatin assembly or disassembly
  Pfam annotation: Domain name=rve; Domain location=1-147; Score=51.1; E_value=3.8e-12; Accession=PF00665.16; Description=Integrase core domain
MDFITSLPKSQGYEVILVVADRLSKYAHILSLRHPFTARNMTKKFIQDVAKLHGFPKLIISDRDPIFLSKFWGGLFRLQGTTLRISTFYHPQTDGQTKVVNRCLETFLFCIKSEQPTKWHLWLSWEELWYNTSSHSAIGKTHVDFVATVLIDRDEALRP

SEQ ID NO: 174308 - protein, 72 aa, Glycine max
  Coding DNA Sequence Number=SeqID_57530
MDMRRNFVLATWRPPICYSTTPTVEAKLTRNACEEKAMDLDTTLSHKINDLEALTVGSSLGWGLVRDLILAS

SEQ ID NO: 174309 - protein, 235 aa, Glycine max
  Coding DNA Sequence Number=SeqID_57531
  Gene Ontology: Mol. function=RNA-directed DNA polymerase activity; Cellular component=chromatin; Biological process=chromatin assembly or disassembly
  Homolog annotation: Hit_ID=Q94HV4; Match level="QueryCoverage=93%, HitCoverage=18%, E-value=1e-30, Identity=36%"; Hit description =Putative retroelement
MACLALDYRALDPCELARSKTIKLEGTLVGYPILLLVDSGTSHNFIAREMVVIAYPKGFAKLYQSELASTLLREKPIFTKIDLKSSFLQIQVQEEDIYKTTFWTHDDHYEYLVMPFGLVNASSTFQVTMNSIFHLLLRRLSSIDYLEHVISENGVELDPSKVQAIPDWLVLLIEKDVHGFFGLIGYYLVSFGIMARLPSLSARSPRRMVSIRDQNRSKPLCISRSVCLPSRFLLF

SEQ ID NO: 174310 - protein, 561 aa, Glycine max
  Coding DNA Sequence Number=SeqID_57532
  Gene Ontology: Mol. function=serine-type peptidase activity; Biological process=proteolysis
  Homolog annotation: Hit_ID=Q67ZA2; Match level="QueryCoverage=95%, HitCoverage=95%, E-value=2e-74, Identity=49%"; Hit description =Prolyl carboxypeptidase like protein
  Pfam annotation: Domain name=Peptidase_S28; Domain location=56-529; Score=-43.9; E_value=1.5e-11; Accession=PF05577.2; Description =Serine carboxypeptidase S28
MREQEDWRITTALLTLLLVFVSSFPALSYGVVPPRTLLNKLSQGSYLTTQEQWFNQTLDHFSPYDHHQFRQRYFEFLDYFRIPDGPIFLVIGGEGPCNGITNDYIGDSLNAKLNRTKTENPWFVFGGSYAGALSAWFRLKFPHLTCGSLASSAVVLAVYNFTEYDQQIGESAGAECKAVLQETTQLIEHKLATNGKELKASFNADDLEKDGDFMYLIADAAAVAFQYGNPDKVCKPMVEAKNAGEDLVATKWNVTEVIERISSFVTSCVAANSRSDILVDNSGSIHGTHDIRWEALDVGQVALNCDASVMDHGAKASCGGVICDNFGTFIYGFSAKLGSCTILMAALWAIFHGLKLAWERGFCSFNYQDAYAKYVKEYYIGTFGVNVQTYDQEYLKKTAINEDSSTRLWWFQVCTEVAFFQVAPSNDSIRSSEIDAKQVPHPHYNNILGRASPGAAVKLCLGDLLVMGSNPETASLHMQGCLNVSCMMLGLAQMGSVPSYTITCSNCAHCTDFRGCPQSPLVLEGNEKNCSSPDAVHKVRQQITEHMDLWLSECQEGSSYI

SEQ ID NO: 174311 - protein, 116 aa, Glycine max
  Coding DNA Sequence Number=SeqID_57533
MSLFVLHRTRRPLFLHVEKKEKKRRTSDVFCSTELQCPHVFSVSLPWFLPVARSNIELSCSAPVTTQDERSFDVSVKNMKIPKREGKKVILSLFLNPSSPRLAFGSPGPPKDLGVK

SEQ ID NO: 174312 - protein, 80 aa, Glycine max
  Coding DNA Sequence Number=SeqID_57534
  Homolog annotation: Hit_ID=Q10NZ2; Match level="QueryCoverage=50%, HitCoverage=15%, E-value=6e-10, Identity=68%"; Hit description =Expressed protein
MVRMRIGFPITCHGQESRNRAACQRIPHRVWTDEEGVEHVELARAGIIREIRHLPLNKKKGTENQRGGGGTLSSWKHLDS

SEQ ID NO: 174313 - protein, 304 aa, Glycine max
  Coding DNA Sequence Number=SeqID_57535
MPIDIKEIEAALCIPGRGFVLNAEGHPGKILRKYLDLTTLAQVWSVLSYSNLSLTSHTSDLISDRARLIFGLVSQLDMNVGSLISGQITSMAHSNSSRLGFPALITSLCRSRGVASDSLVFERLSPFINLAYIRKNCWNLADLTVTIRGARRARARPAKAPSTSTAPPPARTLAAPSTPSSVDFQRLEAMLQSIHQGKIVLLQSLQLVAPPDSIPSVEQFNEWVAWPGTQPPLHREDEGLTAQVPQQREDESSETSTLEPLIKRKRVVETREAATTSEKSLEATSEPSEPVAGFNSAGNRPLHS

SEQ ID NO: 174314 - protein, 316 aa, Glycine max
  Coding DNA Sequence Number=SeqID_57536
  Gene Ontology: Mol. function=DNA binding; Cellular component =chromatin; Biological process=DNA integration
  Pfam annotation: Domain name=zf-H2C2; Domain location=230-271; Score =6.5; E_value=0.05; Accession=PF09337.1; Description=His(2)-Cys(2) zinc finger
MSRKRYGSGSAWIFPTETIFLTNFERILNTTRAEHFYFALFPLIIGEKREVVAAQLAQASWVASIKRHCLLLELPRRPKWAWFRHAQLCKVWNQAMLDWPVPTTPKSLCGFLGLTGFYHYFVKNYGQLAFPLTQLLCKDQFSWSPDAQMTFDTLKRAMTQTQVLSLPDFNIPFILKMNASEEFTSLLNFVRNEPQNHPEFKIRDDLLLYKRHIWLNKGNSFVLLLQEEYHKSPLGGHMGLAKTLSRLQQNFLWIGMKQDIWQYITQCSYFQQTKYIPQGRHAPTNSSSIKPLGGHGPRFYHRASQLPGHHHHPDSC

SEQ ID NO: 174315 - protein, 124 aa, Glycine max
  Coding DNA Sequence Number=SeqID_57537
  Gene Ontology: Mol. function=chromatin binding; Cellular component =chromatin; Biological process=chromatin assembly or disassembly
  Homolog annotation: Hit_ID=Q1SAV4; Match level="QueryCoverage=54%, HitCoverage=17%, E-value=8e-13, Identity=53%"; Hit description =Integrase, catalytic region
  Pfam annotation: Domain name=Chromo; Domain location=18-65; Score =9.1; E_value=0.082; Accession=PF00385.14; Description='chromo' (CHRromatin Organisation MOdifier
MASDQSLPPTALDNQPIIEPLIILYHKWDNSDPPQLHVLVQWLGLLPEDLAWESWTELQANYHLEDKVILEEVGNDSNPESEANCRPKRITKRPQGWEEFIHYMLSDHHQNFVSSGSISISGIC

SEQ ID NO: 174316 - protein, 110 aa, Glycine max
  Coding DNA Sequence Number=SeqID_57538
MEKVSWPGTRPSLEREGGGPSAQVPQQVQDASFEATIPSHSFLKQLVDPPTPVHVMPADLSTPLLDLPEDPSTPLLGLTTTPLATPVLHLIDEEDTQDEDTQSQDLSQEF

SEQ ID NO: 174317 - protein, 100 aa, Glycine max
  Coding DNA Sequence Number=SeqID_57539
SLVRCERLGAVKVTVRCGDRRRQTRYAEGGCFVANMDEDEWMYEILSERADMDYENAEACGANEPHVDCSDAFNTSQVFEYREDVLRWARSVAHENGFVA

SEQ ID NO: 174318 - protein, 126 aa, Glycine max
  Coding DNA Sequence Number=SeqID_57540
SGCEWRHDGGVGVGDNNDGGSSSDGMMMTCFNTWIKPIVKSMIHRLRSGHVQGKKHVGSWGGNNDDNDDGCSRIMTMMVTKQWWDEIVSDDKNNDEGDEMMTTTMIMVMVVITILGGGGDYGGIVV

SEQ ID NO: 174319 - protein, 213 aa, Glycine max
  Coding DNA Sequence Number=SeqID_57541
  Gene Ontology: Mol. function=microtubule motor activity; Cellular component=microtubule associated complex; Biological process =microtubule-based movement
  Homolog annotation: Hit_ID=Q1S0D4; Match level="QueryCoverage=100%, HitCoverage=18%, E-value=1e-103, Identity=87%"; Hit description =Kinesin motor domain, putative
  Pfam annotation: Domain name=Kinesin; Domain location=16-213; Score =55.2; E_value=1.6e-17; Accession=PF00225.13; Description=Kinesin motor domain
MPNLVGSEERILVSVRVRPLNEKELIRNDLSEWECINDTTIMYRSNLSATERSLYPTAYTFDRVFRTDSPTKQVYEEAAKEVALSVLSGINSSIFAYGQTSSGKTYTMSGITDFAIADIFNYIEKHTEREFVLKFSALEIYNESVRDLLSVDSTPLRLLDDPEKGTVVERLTEETLRDWSHFQELISFCEAQRQIGETALNEVSSRSHQILRL

SEQ ID NO: 174320 - protein, 679 aa, Glycine max
  Coding DNA Sequence Number=SeqID_57542
  Gene Ontology: Mol. function=microtubule motor activity; Cellular component=microtubule associated complex; Biological process =microtubule-based movement
  Homolog annotation: Hit_ID=Q1S0D4; Match level="QueryCoverage=95%, HitCoverage=74%, E-value=1e-128, Identity=64%"; Hit description =Kinesin motor domain, putative
  Subcellular localization annotation: CTP_CleavageSite=55; ConfidenceScore=5.16e-01
MKSKGRNGHIPFRDSKLTRILQSSLAGNAKTAIICTMSPARSHVEQTRNTLLFASCAKEVTTNAKVNVVVSDKLLVKQLQKELARLESELKNSGPTRLKFDSAALLKEKDLQIERLKKEVMDVSMQRDLAQSQIKDMLQVVGDDASSTELDSLGHQYPKLRVRSSFDFENQTAERPNLSNFDCIESVRSFDASQYSDGHSISSDDNYFQLPDLQKNLPVRISSPAISIVSGDAAKNDLDQKNVEDSLGDRCREVRCIESDDLTTNTHTHSTASSPAVSGLTEVDNRDKENLDLCSSGLKDNKEINGLQERFVLPSPEKISPCPTQSSASSSKTMKLTRSRSCKASLMRDPFSDWFDQEEMIQNTPPIGRPGGLQRKTYTLNYNPNAERLSWAGYENSLGRASDAQNMKSSTYNGSYKDNSLAPVRKEKNDLESSNMQANLEVQETGMESDVTTKKFKDVGLDPLQSEEEKQLEWPSEFKRLQKEIIELWHACNVSLVHRTYFFLLFKGDPSDSIYMEVELRRLFYLKQTFDQGNQTVEDGLTPESSKRYLRGERQMLSKQMQKKLSKSERENLYNNWGIRLSSKNRRLHLAHRLWSESDDLEHIRESATIVAKLVGSVEPDQAFKEMFGLNFAPRRTRKKSFGWTASLSRMCNPKVTDFFCTMCLTKNNCTYCAQKNAQ

SEQ ID NO: 174321 - protein, 156 aa, Glycine max
  Coding DNA Sequence Number=SeqID_57543
MKVSGLGSDLRHKVQTHADLGHGGGGGGGGDDDRYGGRGREAREETFPRMVYGTLLPTLSPLKGRRVPRWMLLPLLRAGKGAGCFGMSAGCGGGVGMGGGVSMGDRVGLSGGGSIGVCVRNVFTEEEDGAGWKLAWLWLLQCVPFWFWVELLQPWW

SEQ ID NO: 174322 - protein, 206 aa, Glycine max
  Coding DNA Sequence Number=SeqID_57544
  Gene Ontology: Mol. function=voltage-gated potassium channel activity; Cellular component=integral to membrane; Biological process=potassium ion transport
  Homolog annotation: Hit_ID=Q9FS92; Match level="QueryCoverage=70%, HitCoverage=16%, E-value=1e-31, Identity=53%"; Hit description =Outwardly rectifying potassium channel
MVILEDYHCQGPNQPNNFTHGKEYLQDKQLESDITFHVGKQEAELALTVNNAAFNRDLYQLKGLIRARADPNKTDYDGRSPLHLEASRGYEDITLFLMSQHLEDKVFLDGHRNVMNQPKVEQFSTEQSNTKEEIAVNKVETGTNLKIKMKICRPHYLKDFVTNAILNAELVASHWVKEIPLSARISSPLPFFYFLSCSLGHGEEIE

SEQ ID NO: 174323 - protein, 536 aa, Glycine max
  Coding DNA Sequence Number=SeqID_57545
  Gene Ontology: Mol. function=transporter activity; Cellular component= outer membrane-bounded periplasmic space; Biological process=transport
  Homolog annotation: Hit_ID=Q6D3R7; Match level="QueryCoverage=66%, HitCoverage=96%, E-value=1e-162, Identity=75%"; Hit description =Putrescine-binding periplasmic protein
  Pfam annotation: Domain name=SBP_bac_1; Domain location=165-458; Score=42.5; E_value=1.5e-09; Accession=PF01547.15; Description =Bacterial extracellular solute-binding protein
MDSLVVPDIDMLRRWLDQQNITWFECDACQALHLPHMQNFDGVFDAKIDLVDNVILFSALAEVKPTALIPLVGELSQINASSLTVKAFIDIQDDNLPKLIVCQSISVSAGITLGQFTHFMKQSEEGISMVIMEAFANHLLMMGEDEERIRGAILAGLSDTCNYGAAIGVLMAAAVGAQAEDKTLHVYNWSDYISADTVPNFEKQTGIKVVYDVFDSNEVLEGKLMAGSTGYDVVVPSSSFLARQLQSGVFQELDKSKLPNYKNLDPDLMAKVAQHDPGNKYAIPYLWGTTGIGYNIDKVKAALGADAPVNSWDLVLKPENLEKLKSCGVSFLDAPEEIFATVLNYLGKDPNSSDAKDYTGAATDLLLKLRPNIRYFHSSQYINDLANGNICVAIGWSGDILQAKDRAVKANNGVHLGYSVPKEGALAFFDMMAIPKDAKNLDAAYQWLNYIMDPKVIADVSNKMNYANGNKASLPLINADVRNNPGIFPTPEAMAKLFVLKVQDPKLDRARTRAWTKVKSAAGCAALSRLAPETCE

SEQ ID NO: 174324 - protein, 87 aa, Glycine max
  Coding DNA Sequence Number=SeqID_57546
  Gene Ontology: Mol. function=RNA-directed DNA polymerase activity; Biological process=RNA-dependent DNA replication
MGNQNKGKVVGAIEYQGLDRFQRNNLPTFNGRYNPDGAQNWIREIGKIFRVKDVRNKKEMEFLELKQGNMIVAEYAAKFKMVKVQNM

SEQ ID NO: 174325 - protein, 60 aa, Glycine max
  Coding DNA Sequence Number=SeqID_57547
MEEAEREILETFKKVEWAKRASTAKRSFSALSATEEPGRASIPRLHAKRNSCLQPGPAHD

SEQ ID NO: 174326 - protein, 69 aa, Glycine max
  Coding DNA Sequence Number=SeqID_57548
MATMVEAMISMKKIMEVNAAAVAAISIVAKVDLTHPSGLNQVENKHSFPQYGLPPNDMPPNVAHTPDED

SEQ ID NO: 174327 - protein, 187 aa, Glycine max
  Coding DNA Sequence Number=SeqID_57549
MSLVVDMDLVVDLGMRSDLCDSGGGNGHVGDNDGGHVFDHDSGCSDDLNVNGDVIAVAVVVVVEVARQISQFGAVLQTFSRNRVVCKLFPRGCCFCTYPTCKSQLGVATSCMVDTWRALEGRANLVGNFSLEAPVLLAPQWKRQYCWRFQPRAGSFSAARASFQQLCRWGSATPFGDLGEVRKRHSL

SEQ ID NO: 174328 - protein, 82 aa, Glycine max
  Coding DNA Sequence Number=SeqID_57550
  Gene Ontology: Mol. function=nucleoside transporter activity; Cellular component=membrane; Biological process=transport
  Homolog annotation: Hit_ID=Q69S29; Match level="QueryCoverage=61%, HitCoverage=12%, E-value=3e-13, Identity=58%"; Hit description =Putative equilibrative nucleoside transporter ENT8 splice variant
MGCITHFVSTLKKYHPARELTLVELATSGKGGLGPYIGICVLVACFGIADAQVKGGMLGDLCFMCPKFIQFCLPYNIFNILQ

SEQ ID NO: 174329 - protein, 64 aa, Glycine max
  Coding DNA Sequence Number=SeqID_57551
MASSSSCSSSIQTRSGPIDGDVLWMQPKHVLEHVWNEEPDRKLHIRRAVPTYQDGIPKDKCDLN

SEQ ID NO: 174330 - protein, 248 aa, Glycine max
  Coding DNA Sequence Number=SeqID_57552
  Pfam annotation: Domain name=GRP; Domain location=73-150; Score= -21.8; E_value=0.013; Accession=PF07172.2; Description=Glycine rich protein family
  Subcellular localization annotation: CTP_CleavageSite=70; ConfidenceScore=5.01e-01
DGGGDKGGISGTGGTSSGGSNVDSNGGGIDVGGVVVVAMLVVECGGGGGSDVGSSSVVVVEVATLVVIVMVMMKVVLLVVVVTMLVVVALMVIMVVAMSMCGGCDDIDGGCGGGGGDNDNDNGGGNDIDDGGGGGSNVNGDGGCGRGRGSDNDNSYSGDNDGGVDGVVVNSNGARAGAGISILDPIPKLGFLSREKPKAKPDLHGDNKGGIDGGGSDNDDDSSDGDSSGGGNKKKCHYQIEKCMFFLN

SEQ ID NO: 174331 - protein, 1133 aa, Glycine max
  Coding DNA Sequence Number=SeqID_57553
  Gene Ontology: Mol. function=protein serine/threonine kinase activity; Cellular component=integral to membrane; Biological process=protein amino acid phosphorylation
  Homolog annotation: Hit_ID=O65510; Match level="QueryCoverage=99%, HitCoverage=99%, E-value=0.0, Identity=62%"; Hit description =Putative receptor protein kinase
  Pfam annotation: Domain name=LRRNT_2; Domain location=22-63; Score =45.7; E_value=1.5e-10; Accession=PF08263.3; Description=Leucine rich repeat N-terminal domain
  Pfam annotation: Domain name=LRR_1; Domain location=114-136; Score =11.7; E_value=1.8; Accession=PF00560.23; Description=Leucine Rich Repeat
  Pfam annotation: Domain name=LRR_1; Domain location=138-157; Score =9.0; E_value=5.8; Accession=PF00560.23; Description=Leucine Rich Repeat
  Pfam annotation: Domain name=LRR_1; Domain location=160-182; Score =12.1; E_value=1.5; Accession=PF00560.23; Description=Leucine Rich Repeat
  Pfam annotation: Domain name=LRR_1; Domain location=184-206; Score =10.7; E_value=2.8; Accession=PF00560.23; Description=Leucine Rich Repeat
  Pfam annotation: Domain name=LRR_1; Domain location=208-230; Score =13.7; E_value=0.66; Accession=PF00560.23; Description=Leucine Rich Repeat
  Pfam annotation: Domain name=LRR_1; Domain location=232-254; Score =8.7; E_value=6.8; Accession=PF00560.23; Description=Leucine Rich Repeat
  Pfam annotation: Domain name=LRR_1; Domain location=256-279; Score =16.0; E_value=0.14; Accession=PF00560.23; Description=Leucine Rich Repeat
  Pfam annotation: Domain name=LRR_1; Domain location=285-305; Score =2.2; E_value=1.1e+02; Accession=PF00560.23; Description=Leucine Rich Repeat
  Pfam annotation: Domain name=LRR_1; Domain location=311-333; Score =2.3; E_value=1e+02; Accession=PF00560.23; Description=Leucine Rich Repeat
  Pfam annotation: Domain name=LRR_1; Domain location=335-357; Score =15.7; E_value=0.17; Accession=PF00560.23; Description=Leucine Rich Repeat
  Pfam annotation: Domain name=LRR_1; Domain location=359-381; Score =14.9; E_value=0.3; Accession=PF00560.23; Description=Leucine Rich Repeat
  Pfam annotation: Domain name=LRR_1; Domain location=383-405; Score =8.5; E_value=7.4; Accession=PF00560.23; Description=Leucine Rich Repeat
  Pfam annotation: Domain name=LRR_1; Domain location=407-429; Score =10.9; E_value=2.7; Accession=PF00560.23; Description=Leucine Rich Repeat
  Pfam annotation: Domain name=LRR_1; Domain location=431-451; Score =11.1; E_value=2.4; Accession=PF00560.23; Description=Leucine Rich Repeat
  Pfam annotation: Domain name=LRR_1; Domain location=455-477; Score =16.2; E_value=0.12; Accession=PF00560.23; Description=Leucine Rich Repeat
  Pfam annotation: Domain name=LRR_1; Domain location=479-501; Score =13.4; E_value=0.84; Accession=PF00560.23; Description=Leucine Rich Repeat
  Pfam annotation: Domain name=LRR_1; Domain location=503-525; Score =11.2; E_value=2.3; Accession=PF00560.23; Description=Leucine Rich Repeat
  Pfam annotation: Domain name=LRR_1; Domain location=527-549; Score =11.3; E_value=2.2; Accession=PF00560.23; Description=Leucine Rich Repeat
  Pfam annotation: Domain name=LRR_1; Domain location=551-573; Score =11.6; E_value=1.9; Accession=PF00560.23; Description=Leucine Rich Repeat
  Pfam annotation: Domain name=LRR_1; Domain location=575-597; Score =18.5; E_value=0.024; Accession=PF00560.23; Description=Leucine Rich Repeat
  Pfam annotation: Domain name=LRR_1; Domain location=599-621; Score =13.7; E_value=0.69; Accession=PF00560.23; Description=Leucine Rich Repeat
  Pfam annotation: Domain name=LRR_1; Domain location=623-645; Score =14.3; E_value=0.45; Accession=PF00560.23; Description=Leucine Rich Repeat
  Pfam annotation: Domain name=LRR_1; Domain location=647-669; Score =5.0; E_value=33; Accession=PF00560.23; Description=Leucine Rich Repeat
  Pfam annotation: Domain name=LRR_1; Domain location=66-88; Score=3.6; E_value=62; Accession=PF00560.23; Description=Leucine Rich Repeat
  Pfam annotation: Domain name=LRR_1; Domain location=671-690; Score =14.3; E_value=0.43; Accession=PF00560.23; Description=Leucine Rich Repeat
  Pfam annotation: Domain name=LRR_1; Domain location=695-714; Score =8.4; E_value=7.6; Accession=PF00560.23; Description=Leucine Rich Repeat
  Pfam annotation: Domain name=LRR_1; Domain location=90-112; Score =12.4; E_value=1.3; Accession=PF00560.23; Description=Leucine Rich Repeat
  Pfam annotation: Domain name=Pkinase; Domain location=833-1111; Score= 71.4; E_value=2.9e-18; Accession=PF00069.15; Description=Protein kinase domain
  Pfam annotation: Domain name=Pkinase_Tyr; Domain location=833-1111; Score=35.8; E_value=1.1e-14; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR _1::Pkinase::Pkinase_Tyr; Domain location=22-63::114-136::138 -157::160-182::184-206::208-230::232-254::256-279::285-305::311 -333::335-357::359-381::383-405::...
  Pfam module annotation: Domain location=407-429::431-451::455 -477::479-501::503-525::527-549::551-573::575-597::599-621::623 -645::647-669::66-88::671-690::695-714::90-112::833-1111::833-1111
MPTFLILVLLCARFLSCAQCGSVTEIQALTSLKLNLHDPLGALNGWDPSTPLAPCDWRGVSCKNDRVTELRLPRLQLSGQLGDRISDLRMLRRLSLRSNSFNGTIPHSLSKCTLLRALFLQYNSLSGQLPPEIGNLAGLQILNVAGNNLSGEISGELPLRLKYIDISANSFSGEIPSTVAALSELQLINFSYNKFSGQIPARIGELQNLQYLWLDHNVLGGTLPSSLANCSSLVHLSVEGNALAGVLPAAIAALPNLQVLSLAQNNFTGAIPASVFCNVSLKTPSLRIVQLEFNGFTDFAWPQAATTCFSVLEVFNIQRNRVGGKFPLWLTNVTTLSVLDVSGNALSGEIPPEIGRLEKLEELKIANNSFSGEIPPEIVKCRSLRAVVFEGNRFSGEVPSFFGSLTRLKVLSLGVNNFSGSVPVSIGELASLETLSLRGNRLNGTMPEEVMWLKNLTILDLSGNKFSGHVSGKIGNLSKLMVLNLSGNGFHGEIPSTLGNLFRLATLDLSKQNLSGELPFEISGLPSLQVIALQENKLSGVIPEGFSSLTSLKHVNLSSNDFSGHVPKNYGFLRSLVVLSLSHNRITGMIPPEIGNCSDIEILELGSNYLEGPIPKDLSSLAHLKMLDLGKNNLTGALPEDISKCSWLTVLLADHNQLSGAIPESLAELSYLTILDLSANNLSGEIPSNLNTIPGLVNFNVSGNNLEGEIPAMLGSKFNNPSVFANNQNLCGKPLDKKCEETDSGERNRLIVLIIIIAVGGCLLALCCCFYIFSLLRWRRRIKAAVSGEKKKSPRTSSGTSQSRSSTDTNGPKLVMFNTKITLAETIEATRQFDEENVLSRTRHGLVFKACYNDGMVFSIRKLQDGSLDENMFRKEAESLGKIRHRNLTVLRGYYAGSPDVRLLVYDYMPNGNLATLLQEASHLDGHVLNWPMRHLIALGIARGIAFLHQSSLIHGDIKPQNVLFDADFEAHLSDFGLDKLTVTNNNNNNAVEASTSSTASVGTLGYVSPEATLTGEATKECDVYSFGIVLLELLTGKRPVMFTQDEDIVKWVKKQLQKGQITELLEPGLFELDPESSEWEEFLLGVKVGLLCTAPDPLDRPTMSDIVFMLEGCRVGPDIASSADPTTQPSPV

SEQ ID NO: 174332 - protein, 173 aa, Glycine max
  Coding DNA Sequence Number=SeqID_57554
  Pfam annotation: Domain name=DUF784; Domain location=1-94; Score= -28.3; E_value=0.0034; Accession=PF05617.2; Description=Arabidopsis thaliana protein of unknown function (DUF784)
MAIGTTVASITAPEKEESLLECAKYVGSYCGNEVLDTLSNKKSNVSTDCCYKIIQTGYSCHTKLTLFVLQNDSEFKHANVTNVLEKNDRIFDMCDKATEPERTECGEEVFDNLKHNKNNVTDCCCGRLVETGLPCHINMAKALIRTPEMRNVDAIEFLNKGKKLFDECLEDQE

SEQ ID NO: 174333 - protein, 114 aa, Glycine max
  Coding DNA Sequence Number=SeqID_57555
NNDDRDSGVDDIGSSGDDVNVDSGCWQIGNGVCRGYVDNILAVLVVMMVLIVTIWEGSDLGSGVGNPLDLVAFYVLSPGVVVRLPDQWGRVAVLQQWQSGRWGCAMGRKEVVTH

SEQ ID NO: 174334 - protein, 63 aa, Glycine max
  Coding DNA Sequence Number=SeqID_57556
  Subcellular localization annotation: CTP_CleavageSite=47; ConfidenceScore=5.18e-01
MASSGSGGVNSSSPSVATDVGCFSLGSWAAKAPPSPEGEGWAPCQTTCASKSSMLIMDGKPKP

SEQ ID NO: 174335 - protein, 348 aa, Glycine max
  Coding DNA Sequence Number=SeqID_57557
  Gene Ontology: Mol. function=nucleic acid binding; Cellular component= intracellular; Biological process=DNA integration
  Homolog annotation: Hit_ID=Q1RXN8; Match level="QueryCoverage=98%, HitCoverage=30%, E-value=1e-124, Identity=56%"; Hit description =Peptidase S8 and S53, subtilisin, kexin, sedolisin; Integrase, catalytic region; Zinc finger, CCHC-type
MTFLHGDLEETIYMRQPEGGYLYLMLYVDDILVASCNKCMINDLKSRLHSEFEMKDLGEARRILGVDIKRDQLKGTLLLSQQAYMQKVVERFRMHQSKPMSTPLWQHMKLSKSQGPISDDDRKKMDVVPYTSGVGSIMYGMVCTRPNLAHVVSVVSRFMVEPGQAHWEALKWILRYINGTLDSGLLYQKNSQDGTVIEGFVDADFAGCLDTRKSLSGYMFTLFGTAVSWKSNLQSVVALSTTEAEYNALAEGVKEGIWLKGMLHELGIEQETIQIHCDSQSAIHLANHHMYHTRTKHIDIKLYFIHEVVESGVIKIVKIASKDNPANMLTKSLPRDKFEKCLGLVGFG

SEQ ID NO: 174336 - protein, 109 aa, Glycine max
  Coding DNA Sequence Number=SeqID_57558
  Gene Ontology: Mol. function=nucleic acid binding; Biological process= DNA integration
  Homolog annotation: Hit_ID=Q1SHW0; Match level="QueryCoverage=80%, HitCoverage=11%, E-value=2e-26, Identity=65%"; Hit description =Integrase core domain, putative
MEVWSGSPANYSNLRVFGALAYENVKKDKLDARAVKCLFLGYAEGVKGYRLWRLDPKPSKLIISRDVTFDGNENTQINPTTDLDSTVEETGHSASNLRRSDHAINDYQL

SEQ ID NO: 174337 - protein, 65 aa, Glycine max
  Coding DNA Sequence Number=SeqID_57559
MYANNSNVLLVLGFMMKLCVERLRYIVLVLDVNINIDLVKISSNRQKHTGAVLQRRFQTLSVICV

SEQ ID NO: 174338 - protein, 53 aa, Glycine max
  Coding DNA Sequence Number=SeqID_57560
  Homolog annotation: Hit_ID=Q9LHM0; Match level="QueryCoverage=98%, HitCoverage=11%, E-value=5e-08, Identity=38%"; Hit description =Arabidopsis thaliana genomic DNA, chromosome 3, P1 clone: MEC18
VFSWKVGPFDTLIDPTTDSISEGPIIAIRPESESILGFFWTDSQQCDIVLVKT

SEQ ID NO: 174339 - protein, 69 aa, Glycine max
  Coding DNA Sequence Number=SeqID_57561
MNPIKEMDDKYWIWVSLVTKAMAGEGSLQTKIEKQVREQNGKENDKMKMANKSSYIHIKGYVMVVAKAT

SEQ ID NO: 174340 - protein, 388 aa, Glycine max
  Coding DNA Sequence Number=SeqID_57562
  Gene Ontology: Mol. function=DNA binding; Cellular component=nucleus; Biological process=regulation of transcription
  Homolog annotation: Hit_ID=Q1S0C7; Match level="QueryCoverage=99%, HitCoverage=99%, E-value=1e-112, Identity=62%"; Hit description=No apical meristem (NAM) protein
  Pfam annotation: Domain name=NAM; Domain location=5-134; Score=303.9; E_value=3e-88; Accession=PF02365.6; Description=No apical meristem (NAM) protein
MESCIPPGFRFHPTDEELVGYYLRKKVASQKIDLDVIKEIDLYRIEPWDLQETYRIGYEEQNEWYFFSHKDKKYPTGTRTNRATMAGFWKATGRDKSVYERTKLIGMRKTLVFYKGRAPNGQKTDWIMHEYRLETVENGPPQVYVTSNIQYGQYFLRGRKLYRAKILSPEEGWVVCRAFKKRTTNGQTKTIEGWHRNCLYDEQQQACGSVSSTVVDPNIDLMLRQQPQRFSGAQNFMYKQEEIIEADNNNLSFMHAEQQLVQLPHLESPSLPLAKKQSSVVSPISDNINNNEDDDNPQKGLSNTTKKVTTDWRALDKFVASQLSQEERHEIEGVSSFATHHTTTSSDMALLLLQNNSRENERNNKFNPFFNTSSTISDCDIGICVFEK

SEQ ID NO: 174341 - protein, 113 aa, Glycine max
  Coding DNA Sequence Number=SeqID_57563
MEKELRVWMEAESRLDGSGDGGAMGARRVPREGLWEIGKVVKCLEAICQRDVSFLPEVYNLLSQCYHLVEAIPLQKHVLHKGIELTASVGYEYEAAAGTRLLIDGRTCLLQVK

SEQ ID NO: 174342 - protein, 165 aa, Glycine max
  Coding DNA Sequence Number=SeqID_57564
MHARARMMSEVEEVQEQMKADMEAIKDQMAAMMEAMLSMKKIMESNTVVVSTTSTVTEVDPTHPSGINQISCPIPDVGNQGPLTSAFPHLFIAKQGIWDKGSSPRRAGYFIMKQPCSPRKKGVDDHDGLRMPSDLIASGWKRKRMTIICFCVPTDLHISGRQMRL

SEQ ID NO: 174343 - protein, 110 aa, Glycine max
  Coding DNA Sequence Number=SeqID_57565
MRTCFSKETKLPTDQSNICFLDEKQCVYRGRRGLTFSPWVKVYGKLGFWLKACRTAGHDICQGLASGLGIKELYTGAMRGTMHKPQANLGADENFSPNRLKTRKGGLSKN

SEQ ID NO: 174344 - protein, 67 aa, Glycine max
  Coding DNA Sequence Number=SeqID_57566
MAGPVISLGGRGAYIEKGDVLYRQQNSKERRREKGKDEREGMRGYLQTLPPSLTAVPNETCPDRIRV

SEQ ID NO: 174345 - protein, 60 aa, Glycine max
  Coding DNA Sequence Number=SeqID_57567
  Subcellular localization annotation: CTP_CleavageSite=49; ConfidenceScore=5.07e-01
MFAGMKILMTNTSTPYHKGGMMNASGHTLPWCPMHATKKVMQTFQLLMTKMMKTNARHEQ

SEQ ID NO: 174346 - protein, 70 aa, Glycine max
  Coding DNA Sequence Number=SeqID_57568
MGQLHQVLDSVLDDDDFVTVVVELALWCVAVDKDDHPDVRELVEELKWVASTHGTTRRRPTCLVNGHISI

SEQ ID NO: 174347 - protein, 112 aa, Glycine max
  Coding DNA Sequence Number=SeqID_57569
MCGVSLLVFLLLLSLCVEASVHDYKGEKFAAKFVAHGGIKGIYAFVPNLSDAYPLPNLDSYIRMAVVTKIRRSKEANKEELFEEAENVYLAGGGGLVSVGGGVVVGGTVVTK

SEQ ID NO: 174348 - protein, 236 aa, Glycine max
  Coding DNA Sequence Number=SeqID_57570
  Gene Ontology: Mol. function=nucleic acid binding
  Homolog annotation: Hit_ID=Q1S0C5; Match level="QueryCoverage=94%, HitCoverage=30%, E-value=1e-64, Identity=47%"; Hit description=RNA recognition motif. (A.k.a. RRM, RBD, or RNP domain), putative
  Subcellular localization annotation: CTP_CleavageSite=60; ConfidenceScore=5.60e-01
MIKVRARLSNPLPKTQAVKGGMSGGFRISHARSGAFSRPGRGFGRGRQPFNNRGNFNRGRSFYRGGHSQIGRMGFRDDHDFSMHPDFRQRQFGPQGAVRGGHYAGSRGAAFAGPSRPYHDRAWYGIPDGGPSEPIPPRRPYSPGGQFDMPFMGRHFDDPYLYDDNMQGMKRPFYMTDPEPDYMGPTRLRPRLDYADPPIFPGTHHHDSFGAGSRQYPPDYYGSDVDLELWDRHLQI

SEQ ID NO: 174349 - protein, 667 aa, Glycine max
  Coding DNA Sequence Number=SeqID_57571
  Gene Ontology: Mol. function=nucleic acid binding
  Homolog annotation: Hit_ID=Q1S0C5; Match level="QueryCoverage=96%, HitCoverage=61%, E-value=1e-139, Identity=61%"; Hit description=RNA recognition motif. (A.k.a. RRM, RBD, or RNP domain), putative
  Pfam annotation: Domain name=RRM_1; Domain location=402-473; Score =93.8; E_value=5e-25; Accession=PF00076.12; Description=RNA recognition motif. (a.k.a. RRM, R
  Pfam annotation: Domain name=RRM_1; Domain location=482-551; Score =7.2; E_value=0.031; Accession=PF00076.12; Description=RNA recognition motif. (a.k.a. RRM, R
  Pfam annotation: Domain name=RRM_1; Domain location=574-645; Score =56.8; E_value=7.3e-14; Accession=PF00076.12; Description=RNA recognition motif. (a.k.a. RRM, R
  Pfam module annotation: Pfam domain module=RRM_1::RRM_1::RRM_1; Domain location=402-473::482-551::574-645
EQESLGSASSAKFVKKKTPGRPRSKAIDTPNSEEQCEAVTDETLIEDDTEVVEKVEDVGVVGAGSVEGEKEGGQGVGSVGLSDETEGKSMEVNEPVVEKVCELVEKGNDVMEVEVAASQDASVSFKRLGRPIVDLNISADNEDCTGEKEGEKGKEELKDQEGDQGKEELKEQEGEKGKEELRELDAEKGKEELRELDAEKAKEELKELDGEKGKEELKELDGEKGKEELKELDGEKGKEELKELDGEKGKEELTELEGQKGKEELTELEGQKGKGELTELEGQKGKVELKEQEGDKGKEKLKVQELEKAKGEETYLSGHKENTKSFGVEVKAQMQKEDANPIKDDGEGLQSCEKYDLGEQGKVELVEEDPEEPPEETLALEEEHRELEAIANQRKIKKEHEIFVGGLDRDATEEDLRKVFQRIGEIVEVRLHKNSSTNKNKGYAFVKFANKENAKKALSEMKNPVIHGKRCGTAPSEDNDTLFLGNICNTWTKEADYGIEGVESITLVPDVQHEGLSRGFAFLEFSCHADAMLAFKRLQKPDVIFGHAERTAKVAFAEPIHEPDPEIMAQVKSVFINGLPPHWDEDHVRELFKAYGEIVRIVLARNMSSAKRKDYGFVDFSTHEAAVACVDGVNKSELGDGASKNYSLLSIAFPSAGFQQCKKSGIL

SEQ ID NO: 174350 - protein, 74 aa, Glycine max
  Coding DNA Sequence Number=SeqID_57572
MNEFFERFLRLEEWILDKARPTLIPEATTMQHEPPPPLRATTMPSSSENSSPTKLERFVIFVPPFYFFLDDTWG

SEQ ID NO: 174351 - protein, 295 aa, Glycine max
  Coding DNA Sequence Number=SeqID_57573
MTYAYVRVLNILLIYTMLPDDVFIVVGSLWPRCQRCLVEIGYLMQEAFHSTHDTDQDNGIDAIIGLSCVKDNSETDGITGPDRVVALSVRKEKKEVRNEVPTIFSDKALKEKFDIIYSRLVKAFFVVTEVDNNNFTLKATLKGTKILILEQLLEDFKSKSLTSFGRIVHCINMLLVLQWAGNFQETTKPIKSTSNVPYGMLMTLIFRHFRVYMEDEPFFFIINHMIKATKPIKFIKPRYDDVFSWGANDVAALRLNPQPRMETTCTCSNEEDAQNKEKKKEREKGEEVEILTPSH

SEQ ID NO: 174352 - protein, 212 aa, Glycine max
  Coding DNA Sequence Number=SeqID_57574
  Gene Ontology: Mol. function=peptidyl-prolyl cis-trans isomerase activity; Cellular component=nucleus; Biological process=protein folding
  Homolog annotation: Hit_ID=Q94G00; Match level="QueryCoverage=58%, HitCoverage=93%, E-value=3e-49, Identity=79%"; Hit description =Peptidyl-prolyl cis-trans isomerase 1
  Pfam annotation: Domain name=Rotamase; Domain location=93-212; Score =123.5; E_value=5.8e-34; Accession=PF00639.11; Description=PPIC-type PPIASE domain
SSKETNQMLTRGANRARAFGFRIHNECEPHDAALMDVSDLARVTGAAKIESDRKRKKASTSAAEKENRNKHKKSKMSSSSSKGGGGIEVRASHILIKHEGSRRKASWKDPEGRIIKSTTRENAVSQLKALRDDIVSGKASFEDIASRFSDCSSAKRGGDLASLNCGRVTLEGPFGRGQMQKPFEEATFALKVGEISDIVDTDSGVHIIKRTK

SEQ ID NO: 174353 - protein, 177 aa, Glycine max
  Coding DNA Sequence Number=SeqID_57575
MTPIAPGWASETRPTLRLDGSLGGLLHRVIDKQPLLRTLLLTSLFGAIFSLVPWQRLGSMKVKVAVFSIAVVIVGGIQGVRLIVRIKLIRKAPPPHRQTPVEENARGRSRAEQHNSTTTTPPTMVKKQPTSPTPTVHSRSRNRAEEEEVWSRQKEEETAWKKKKKKKRLGARCRVFK

SEQ ID NO: 174354 - protein, 67 aa, Glycine max
  Coding DNA Sequence Number=SeqID_57576
  Gene Ontology: Mol. function=DNA binding; Cellular component=nucleus
  Homolog annotation: Hit_ID=Q8S8I2; Match level="QueryCoverage=98%, HitCoverage=32%, E-value=3e-08, Identity=44%"; Hit description =Protein ULTRAPETALA2
MVVIKVWSALEMEPALLPTSCAMQELIPMKVVFPHCRVFPRCLPEWNFVFVFTMNPDVSLPPSTPFP

SEQ ID NO: 174355 - protein, 159 aa, Glycine max
  Coding DNA Sequence Number=SeqID_57577
  Subcellular localization annotation: CTP_CleavageSite=71; ConfidenceScore=5.37e-01
MAEPSKKRKGTSSRSQQHSGSQEAPIPPSIPSGSLFSSEEQRTRYTNLFSSRSIVDPKFIDMEFFSNENFECFQAFENFNLIPFMSLKLPVYSELVKAFYSNLEIHEGTLNSEVYGIKMVIDQSLFYDLTKLPSEGVPFEGALIYDWKFDFSVPDARRL

SEQ ID NO: 174356 - protein, 196 aa, Glycine max
  Coding DNA Sequence Number=SeqID_57578
  Gene Ontology: Mol. function=protein-methionine-S-oxide reductase activity; Cellular component=cytosol; Biological process=protein metabolic process
  Homolog annotation: Hit_ID=Q1S0C0; Match level="QueryCoverage=88%, HitCoverage=64%, E-value=5e-75, Identity=80%"; Hit description =Peptide methionine sulfoxide reductase, putative
  Pfam annotation: Domain name=PMSR; Domain location=49-196; Score =148.8; E_value=1.4e-41; Accession=PF01625.11; Description=Peptide methionine sulfoxide reductase
MAVPAERNHNHFSVLIVLFLFLVHNALCIRFPDRIAQPALDPLDQHRLRVAVFALGSFWRSEAVFGCLPGVVRTTVGYAGGSKSNPEYRSLGDHAESVKLMAEEEGNGGEVEYDPQLISFRELLDVFWSSHDPRQVYGQGPDVGSQYRSIIFVNGTEESRMAAVSKEQEQTLSRSSIVTTQILQLGTFYPAEPEHQ

SEQ ID NO: 174357 - protein, 412 aa, Glycine max
  Coding DNA Sequence Number=SeqID_57579
  Gene Ontology: Mol. function=RNA-directed DNA polymerase activity; Biological process=RNA-dependent DNA replication
MVICVGNSHHQVVLQACGKIKFVKVLIDNIYALCDNENKKRLWEELKAIKASSMVCSCCILGKGGIGGGNGDMRMFNALISEMKLEGIPLVGRKFTWYKSNGTMRSRIDRVLATRDWLESWPQCAQWVLDRNVSNHCPIVERFTEGGGRRPKLDGVKFNTIDDHDNASLPGTFEEEEVKEAEFWSILKSDFMQFLTKFHQNGVFPQGSIASFYTLISKGENPQNLGLRRGDPMTPFLFNFVAEGLYGMMREAIEKELYTSYLVGDDSVQVNFFKSHFGDIGVDKDTWERGLGIKDLFAFSNSLLAKWRWGPLEGEGELWDLRRICDVKCVEKWFDNMCEWRMGNGERIRFWQDTWIGGSTFGKIISKIIPQLVAKTGDFEKAWFAWEEIHVTLMRESLDLVRLRKDVSDKWF

SEQ ID NO: 174358 - protein, 432 aa, Glycine max
  Coding DNA Sequence Number=SeqID_57580
  Homolog annotation: Hit_ID=Q10SS1; Match level="QueryCoverage=93%, HitCoverage=56%, E-value=2e-49, Identity=34%"; Hit description =Expressed protein
  Subcellular localization annotation: CTP_CleavageSite=45; ConfidenceScore=5.08e-01
MAAPPPPPPSTPSFLSPTQRYAAGALFGLALHEAHLNQTNPLPLPASEDSLSEEQRTSSSSGSSSDSVSEDPDLWVHSNSGLLRPVFKFLDIDSAAWSGLEETAGSSSATHHVGPFLRLLSQELDDGSSQRLDQERALSSAVDGIALDMRRNSESSESKREKLREYEHQCREKFSIDDVQPHCEKVDAHLEVQKEMDAAPLLDCKETQQGSVDWKIDERPIEEVRMLSDQRKVTVLYELLSGCLSNLGEDVGRRRKGYDARHRVALRLLATWLDVKWTKMEAIETMVACSAMALIKEKESKNEETQSKESKWAKLKRGGIIGAAALTGGTLLAITGGLAAPAIAAGLGALAPTLGTLIPVIGASGFAAAASAAGTVAGSVAVAASFGAAGAGLTGSKMARRVGGVDEFEFKAIGENHNQGVGFDIFHIPVFL

SEQ ID NO: 174359 - protein, 101 aa, Glycine max
  Coding DNA Sequence Number=SeqID_57581
MFLDLKLVKGGTISFRGMGKGKINGIEVATTPKDMDLAEREAFEEAMLQSIIEASLVEANEDIIETDPRATLICPRPMSDVDEQLFAAQFDTTNEYKLRWL

SEQ ID NO: 174360 - protein, 89 aa, Glycine max
  Coding DNA Sequence Number=SeqID_57582
MDLICALNVVLPLDHTKFGETFQIEEIVLEYTMKRFYRLKECYSGLRPDEKPPLDAVHHEIWGCYQTTNHTCFTQETSFNMVWDPNPLS

SEQ ID NO: 174361 - protein, 121 aa, Glycine max
  Coding DNA Sequence Number=SeqID_57583
MDPIIEEVKSNVEAEAASDSMVVQVYDPPSSRTYVSLLEAELARTRKALAQALKDHAHAKKEACRWFMIRDYFYKITGWKPPSPPTPPSSPIHLSYDFDDSDDEFLKKLDEKVVKQKGEKK

SEQ ID NO: 174362 - protein, 82 aa, Glycine max
  Coding DNA Sequence Number=SeqID_57584
  Subcellular localization annotation: CTP_CleavageSite=30; ConfidenceScore=5.05e-01
MVVSSQRTNIIKQDAFANTGRSTPLPTPIVSSTKTNQGLELLSIPRHEEECKKVWQTQVRIALSWIMKPLTLDSLLMRTHIP

SEQ ID NO: 174363 - protein, 264 aa, Glycine max
  Coding DNA Sequence Number=SeqID_57585
  Gene Ontology: Mol. function=nucleotidyltransferase activity; Cellular component=mitochondrion; Biological process=tRNA processing
  Homolog annotation: Hit_ID=Q6L5J0; Match level="QueryCoverage=65%, HitCoverage=82%, E-value=8e-52, Identity=51%"; Hit description =Putative tRNA His guanylyltransferase
  Pfam annotation: Domain name=Thg1; Domain location=53-253; Score =138.6; E_value=1.7e-38; Accession=PF04446.3; Description=tRNAHis guanylyltransferase
MNGKEAWDFIKDFDKSELNNLLFDEFNVNYNALESIFRQGSYVLKIIVEDIVKHTNNDVPIKRRRRFSEIHEFVKPNDDRTLNLMNLCAVVVLEKFWEDIVFAYGVSDEYSFILKKATNLYQRRANTIISAIVSFFTSTYVMRWKNFFPQSELKNPSSFDGRALCNSSTEILRDYLSWRQVDCHINNHYNSCFWKLVASRKSKRKAQNSLKGAQLEKKIEELAIDYNNLPVIMLVSLYIPLPMSEFDYTIAPCNNRYLANSKEV

SEQ ID NO: 174364 - protein, 87 aa, Glycine max
  Coding DNA Sequence Number=SeqID_57586
  Gene Ontology: Mol. function=protein serine/threonine kinase activity; Cellular component=nucleus; Biological process=protein amino acid phosphorylation
  Homolog annotation: Hit_ID=Q3C254; Match level="QueryCoverage=51%, HitCoverage=12%, E-value=1e-13, Identity=80%"; Hit description =Mitogen-activated protein kinase
MVVVAEALLVFAIDQDNYELLLFGCIKEDLGFKNGKPLAAGYVRQLPQYPRQQFVARFPSMSPGVVDLLEKMLVLDPNRRITVVTEI

SEQ ID NO: 174365 - protein, 95 aa, Glycine max
  Coding DNA Sequence Number=SeqID_57587
  Homolog annotation: Hit_ID=Q69T90; Match level="QueryCoverage=55%, HitCoverage=14%, E-value=4e-08, Identity=58%"; Hit description =Pantothenate kinase-like
MASFPATRQWEWRVPLKDEEGQPLGVSISNLLIANSSSDLPVIDLTRVSQELAYLASDAELVILEGMGSSSLYSLLPTYNKILFKNLYVAFYKIF

SEQ ID NO: 174366 - protein, 350 aa, Glycine max
  Coding DNA Sequence Number=SeqID_57588
MSSSSSCSSNIQIKSGPIDDDVLWMQAKHVSEHAWNEEEDRKLHIRRVVPICQGQEEILEEIIPLLRQSGLRVDEAPLIGPTNLGWADLCEELLRVKPQEGILRFIGGVLFVDKSSNKVSLRYLQFLRDFGQCSTYAWGPAVLAFLYIEMCSTTVYKTKSIGVSVGVLHNNCYVSVASNFFGWNCSVEGLLSFNSDYMVWYRRKTKMFIDPKNANTTTSAEVAETLQYMVSPQGRNTWTIDDLVPYVENITILSKEQERITEAEAIEAEEFSQQMEERGHGMYYTPPTFSQYPSQIYQYPFEGHHTDMSASEHSLGGVAKTHPHFSWPTMTPSQQHDAPIATPNAPLAPQ

SEQ ID NO: 174367 - protein, 120 aa, Glycine max
  Coding DNA Sequence Number=SeqID_57589
  Gene Ontology: Mol. function=pantothenate kinase activity; Biological process=coenzyme A biosynthetic process
  Homolog annotation: Hit_ID=Q69T90; Match level="QueryCoverage=45%, HitCoverage=15%, E-value=4e-15, Identity=72%"; Hit description =Pantothenate kinase-like
MEQEPMEEGNFNMYKEIQVIIFFDNSGADIILGIMPFAREVLRPRSQVVLAANDLPSINDVTCSELVEIISKPVKLASSKHRRRRLSAIQAFQLAGAFSVGRLKGSSHWHWRVRLNWSSH

SEQ ID NO: 174368 - protein, 65 aa, Glycine max
  Coding DNA Sequence Number=SeqID_57590
MSSLNMRKGFEGQRIKREISTLKLLKHPNVVRLYERNLDQLEDLLKKVKLKTIRTEPPSASIAGT

SEQ ID NO: 174369 - protein, 76 aa, Glycine max
  Coding DNA Sequence Number=SeqID_57591
MSQPFYLISLYYGIMVVTMVTVVVESDNEDDNNDGSDSNGNNSDGMVMVPITMVRSRIVVTETTTMMEAATMVVVV

SEQ ID NO: 174370 - protein, 79 aa, Glycine max
  Coding DNA Sequence Number=SeqID_57592
MHYVAYWALKESPLGQKGTTVHKNGKKGSFPVKLVPPLRCLFCAATTILVAAFRHDVMHQWRWGGVPPFVVASPIAVLF

SEQ ID NO: 174371 - protein, 93 aa, Glycine max
  Coding DNA Sequence Number=SeqID_57593
MVPPLAETLKMNVDGSCLYPSLNIGTGGDALKAETLALCHGLQLAWNNVVSNLCLESDNLQLVEIINSKVYLPFHLYDSLLLVILDYIEGRPS

SEQ ID NO: 174372 - protein, 265 aa, Glycine max
  Coding DNA Sequence Number=SeqID_57594
  Gene Ontology: Mol. function=structural constituent of ribosome; Cellular component=intracellular; Biological process=translation
  Homolog annotation: Hit_ID=Q2R0M9; Match level="QueryCoverage=93%, HitCoverage=38%, E-value=4e-44, Identity=40%"; Hit description =Expressed protein
  Pfam annotation: Domain name=DUF594; Domain location=188-247; Score =90.7; E_value=4.3e-24; Accession=PF04578.4; Description=Protein of unknown function, DUF594
MYQIFRILYHQDQETVPEKLKELIFEHIREKSKGAKHIKACKNFCAHRGDQVLNKWKCRSIAWSTEVEFDQSLLIWHIATDLCCYSDKDCDKLKNYEISRLMSDYMLYLLVKCPFMLPNGIGQIRFEDTCAEASELLQERKYISQTDQVCEVIGGVSVDEKFLPSKVKGDRSKSVLFDACRLAKSIKSLEEEKKWSKEQKWEMISRVWVEMLCHAASQCRGFHHAKQLSRGGELLTHVWFLMAHLGITEQFQISQGHARAKLIHS

SEQ ID NO: 174373 - protein, 167 aa, Glycine max
  Coding DNA Sequence Number=SeqID_57595
HLSNKNVEIYHTELDEFKAELERRNFHKRLTNLVDSSIDLALVKEFYANLYSPEGPSPKQGESLPAYSRYCKMPTDIREIEVALCILGRGFVLNAEGHPGKILRKDLTTLAQVWSVLSYSNLAPTSHTSDLTLDRARLIFGLVSQLDMNVGALISGQITSMAQSNSS

SEQ ID NO: 174374 - protein, 185 aa, Glycine max
  Coding DNA Sequence Number=SeqID_57596
  Gene Ontology: Mol. function=hydrolase activity, acting on ester bonds; Cellular component=nucleus; Biological process=lipid metabolic process
  Homolog annotation: Hit_ID=Q8LB81; Match level="QueryCoverage=97%, HitCoverage=44%, E-value=5e-52, Identity=55%"; Hit description =Putative GDSL-motif lipase/acylhydrolase
MFEQYALFEQYQQRLSALVGAAQAQRIVNGALFLMTLGGNDFVNNYFLTPVSARSRQFTVPQYCRYLISEYRKILMVSDTDMDACQTPESTRSWSRLYELGARRVLVTGTGPLGCVPAQLATRSSNGECVPELQQAAQIFNPLLVQMTREINSQVGSDVFVAVNAFQMNMNFITDPQRFGLSTFA

SEQ ID NO: 174375 - protein, 80 aa, Glycine max
  Coding DNA Sequence Number=SeqID_57597
MASMMEAMLGMKRVPTPTAYPQLYPTTLHDNMDHAPPVAFEGQPPQPIGGTNENARERTHGDADSYPPFTTKGPVPNTLP

SEQ ID NO: 174376 - protein, 141 aa, Glycine max
  Coding DNA Sequence Number=SeqID_57598
  Gene Ontology: Mol. function=hydrolase activity, acting on ester bonds; Biological process=lipid metabolic process
  Homolog annotation: Hit_ID=Q9SVU5; Match level="QueryCoverage=72%, HitCoverage=28%, E-value=7e-46, Identity=83%"; Hit description =Proline-rich APG-like protein
MELVTMSRTRVVLMTLTLVVVTVLNNTESAESARTFYVFGDSLVDSGNNNYLPTTARADSPPYGIDYPTGRPTGRFSNGYNLPDLISQHIGSEPTLPYLSPELTGQKLLVGANFASAGIGILNDTGIQFVTFPLLSLYLYV

SEQ ID NO: 174377 - protein, 181 aa, Glycine max
  Coding DNA Sequence Number=SeqID_57599
  Homolog annotation: Hit_ID=Q1SYR3; Match level="QueryCoverage=75%, HitCoverage=5%, E-value=6e-12, Identity=31%"; Hit description=RNase H, putative
GTSTWIVVTENKRGYISCGSVQVEDTSTWLFKENKGGYIPCGSLLVKDFTRLKEISRTGSCLGTGCRHGLLLNQARHCSIECRGVPPWYAQVTLGLYHFGKRDWQIFPGVTTAMWLASSDGKRSPYDMGIGENSGALITGGPLGDGVGALSWMSAEGAELPARAKKLSCSDPPIVGAGGRD

SEQ ID NO: 174378 - protein, 189 aa, Glycine max
  Coding DNA Sequence Number=SeqID_57600
  Gene Ontology: Cellular component=integral to membrane
  Homolog annotation: Hit_ID=Q5Z407; Match level="QueryCoverage=55%, HitCoverage=42%, E-value=1e-09, Identity=33%"; Hit description =Senescence-associated protein-like
MAAACVLYPTQTWNVYFHIVLWKLKYTILVAVLLLLEASLVGFIALDSDWEKDIPLDPTGQLDELRAFIEDNIDICTWVGIAVLVVQALSLLLALILRATVSARRADFDYEDGYDVRGRSWEPLLNPQPGQPSGSSKGDNSGNHSDFWSSRMRQKITVEHAATNHEFEAMSATILVIKQFNAVLTSEYM

SEQ ID NO: 174379 - protein, 515 aa, Glycine max
  Coding DNA Sequence Number=SeqID_57601
  Homolog annotation: Hit_ID=Q10RW7; Match level="QueryCoverage=97%, HitCoverage=51%, E-value=4e-30, Identity=29%"; Hit description =Expressed protein
MMTSDNKGHQEQRQARKSSTLGEMLSLTHKKKSVTSEVESINEDQEPGKSVSCSHSFNAEISIEGSPKNLPRSNSVPASSTVYENGLTVKVNDHKNTGKAQGSKEQKKPKSMRSSFKGKVATFLFSRSKKSTKEKPSSSQSKDASQSTSTVTATLVLPANSPGVLRGDVSQSINVDGFEECSLAALCESSGKNSTDSVSNGHEEDMITLEPGLTMPRPMVPEIHSSENPDQPSPISVLQPPFEDYNNNNASHESLNCMKSGDQGSQVPLKSNLIDKSPPIESIARTLSWDGSSAEVASSYALKPLMVSSLDSKVEDQEWLLLVHKLLSAAGLDDQHQHDSSYTRWHSLESPLDPSLRDALYANLNEKEPQPIMHERRRRKMRSNHKLVFDYVNAALLELVGYGSEKCLKRSKSHYRVQVQEGASAAASPLLVDHIVAQMKELIASGVRCEWENGGASTSLVVENVVRKEVVQIGWVELMELEIDILGKEIEGDLIQELVENAVVDLTGRASESLS

SEQ ID NO: 174380 - protein, 483 aa, Glycine max
  Coding DNA Sequence Number=SeqID_57602
  Subcellular localization annotation: CTP_CleavageSite=39; ConfidenceScore=5.16e-01
DLDSGADTGPKTSEFAFFKKLKKDASAGFRSRPMQKDSRLSSKKPESSGYSREKNGDIRVGIKGDTSSRIIEHVSTVRTDSFFSPSVEAWNKSDTEKLCSKGLLSRLFPMGTEANKYVDTHPGKLGNATRYDLPDSQETDDQFKEHYQIPKRKLLELESSPYLSNDMPSPMFLRLDERINLHSEFPTNHSHNFPPLYSITEPECKLSATPSFSATAKSGVTLESLFSKAANATRYGLHDSQELDVQFAEHHLIPKRKLLEHESSSSFSDHLLSPVFLQSVEIMNPHVDFPTYPLKFQPLFSMTEAKSNFGGIPSFIDKGYVTREFLSNNQEHEILALNHFKELGKLESESFPLMENFFDYTTDETSLPITCKYTKPNIAPELPILGYGEEQILNNTLDEYHVSPSSLLLDKPQVFNSILDSGFLRCQEFKFGNYVYEDMDTNFNPTALSFIGLEGQFPVPTIIVLIRKPGYHLHQMNVRGAYP

SEQ ID NO: 174381 - protein, 295 aa, Glycine max
  Coding DNA Sequence Number=SeqID_57603
  Homolog annotation: Hit_ID=Q9LKC1; Match level="QueryCoverage=77%, HitCoverage=25%, E-value=2e-24, Identity=37%"; Hit description =Arabidopsis thaliana genomic DNA, chromosome 5, BAC clone:F6B6
MGLEALPRGEPHLSMERSHRRDYSQQMYGPVGLPFKHWQQEDRFMDREMLHEVHPSTEQVAYKDMYEIWQQSQRASHDRGKWSEDVDEKRMALIRQKFMEAKRLSTDERLHQSEQFKDALEVLSSNSDLLIRLLDSQNVSDLYSTSPNETKRITLIKPLKMVDNDKSARKEKTNNRPIKKPSSVDQANPGNSPDSQKVDESPVRTTRIVLLKPSPGRTPEQKAVVSPTTSLNLKSRNFHHGPEYDDVLESIRVANEITQQMHKGPRSYQKDKTLYSSVFSNGYSDDESSFNKSYH

SEQ ID NO: 174382 - protein, 173 aa, Glycine max
  Coding DNA Sequence Number=SeqID_57604
  Gene Ontology: Mol. function=RNA-directed DNA polymerase activity; Biological process=RNA-dependent DNA replication
  Homolog annotation: Hit_ID=Q1SQN7; Match level="QueryCoverage=99%, HitCoverage=38%, E-value=5e-20, Identity=30%"; Hit description=RNA -directed DNA polymerase
MRQAIEKNIFFNFLVGKDKTQVNLLQYTDDTFFLVRQPYQMVEDDSLERFATILNCKITKLPFLYLGIPIWENPRRVETWKPIVDKVATMLNSWKHRTLSMGGQGGVGIKNLSYFNEALPGRWRWNLFNHDALWVKILESKYEGVVRHLIDLCLIASGSLGVAKRCGFGMIYG

SEQ ID NO: 174383 - protein, 102 aa, Glycine max
  Coding DNA Sequence Number=SeqID_57605
  Homolog annotation: Hit_ID=Q1S023; Match level="QueryCoverage=71%, HitCoverage=16%, E-value=3e-08, Identity=39%"; Hit description =Cyclin-like F-box; F-box protein interaction domain
MSSSFHTGVTPGNSVVGSGEDSHAIQKEKHKYLSTPNSLIEVPSDQPSLKVLKGCWRLFNHRRKTHFVVWLVRELGVDNSWIQLLKVSLDHLQDLGYPRFPT

SEQ ID NO: 174384 - protein, 147 aa, Glycine max
  Coding DNA Sequence Number=SeqID_57606
  Homolog annotation: Hit_ID=Q9FT11; Match level="QueryCoverage=80%, HitCoverage=76%, E-value=2e-28, Identity=45%"; Hit description =Hypothetical protein homologue of SPH
  Pfam annotation: Domain name=Self-incomp_S1; Domain location=33-144; Score=134.5; E_value=2.8e-37; Accession=PF05938.2; Description=Plant self-incompatibility protein S1
MEKKNRISAILAIFILAFASPIASDVYPEFVKWHVYIVNGLRNNQNLLAHCKSADDDLGVRNLSQGSNFTWSFRTDFAHSTLFWCHVKKDNNNACESATFDVFWYDERLFQKCDWKKCIWSARDDGIYLTNIHQNVDDLYYYWDAGE

SEQ ID NO: 174385 - protein, 352 aa, Glycine max
  Coding DNA Sequence Number=SeqID_57607
  Gene Ontology: Mol. function=binding; Cellular component=thylakoid; Biological process=photosynthesis
  Homolog annotation: Hit_ID=Q00TX4; Match level="QueryCoverage=56%, HitCoverage=71%, E-value=4e-24, Identity=33%"; Hit description =Homology to unknown gene
  Subcellular localization annotation: CTP_CleavageSite=64; ConfidenceScore=5.69e-01
MAITFGLVTPNSNTLCLTLTTPPLIANHRTTNVVFSGQSVFSYGHTNLSYSHQRASSFATIVCSAANKPSSSSEISFHDSVTRSLKKKRIGSNEYAKIRSEVLSPFRSVRMFFYIAFVASGALGGFIATTQLIGALANSSRASEVPEILKGLGIDLAAVSLFAFLYFRENKAKNAQVARLSREESLSNLKLRVDEKKIIPVNSLRGIARLVICAGPASFVTESFKRSEPFTDSLLDRGVLVVPFVTDGNSPALEFEETEELATRRKRLWQLAPVYINEWSEWLDEQKKLAGVPSDSPVYLSLRLDGRVRGSGVGYPPWNALVAQLPQICFSGSRSNEDYLYFGQITLSSLKD

SEQ ID NO: 174386 - protein, 189 aa, Glycine max
  Coding DNA Sequence Number=SeqID_57608
  Gene Ontology: Mol. function=transferase activity; Cellular component= cytoplasm; Biological process=auxin mediated signaling pathway
  Homolog annotation: Hit_ID=Q8H9E5; Match level="QueryCoverage=91%, HitCoverage=78%, E-value=4e-40, Identity=47%"; Hit description =Glutathione S-transferase
  Pfam annotation: Domain name=GST_C; Domain location=97-186; Score =10.6; E_value=0.019; Accession=PF00043.15; Description=Glutathione S- transferase, C-terminal domain
  Pfam annotation: Domain name=GST_N; Domain location=2-77; Score=69.7; E_value=9.6e-18; Accession=PF02798.10; Description=Glutathione S -transferase, N-terminal domain
  Pfam module annotation: Pfam domain module=GST_C::GST_N; Domain location=97-186::2-77
MGEVKLLGVWPSGFVYRIIWALELKGVKYEYIQGEFNKPDFSDLLLKYNPVYKKVPVLVLEGKPIAESMVILEYIEETWPQPHLLPQDPYERAVARFWVSFAEEKSVSFMSFFVSVGEEFQKARKEVREVLKVLEETIGDKKYFGGEEIGLLDINLGWIALFFGVIEDVVELQGAPRYQDKLPKSPRVV

SEQ ID NO: 174387 - protein, 423 aa, Glycine max
  Coding DNA Sequence Number=SeqID_57609
  Gene Ontology: Mol. function=oxidoreductase activity; Cellular component=mitochondrial outer membrane translocase complex; Biological process=aromatic compound metabolic process
  Homolog annotation: Hit_ID=Q1SA66; Match level="QueryCoverage=99%, HitCoverage=100%, E-value=0.0, Identity=76%"; Hit description =Pyridine nucleotide-disulphide oxidoreductase, class I; FAD -dependent pyridine ...
  Homolog annotation: Hit description=nucleotide-disulphide oxidoreductase
  Pfam annotation: Domain name=FMO-like; Domain location=26-423; Score=- 396.1; E_value=1.6e-05; Accession=PF00743.9; Description=Flavin -binding monooxygenase-like
  Pfam annotation: Domain name=Pyr_redox_2; Domain location=25-384; Score=-26.1; E_value=0.011; Accession=PF07992.4; Description =Pyridine nucleotide-disulphide oxidor
  Pfam module annotation: Pfam domain module=FMO-like::Pyr_redox_2; Domain location=26-423::25-384
MENLFRLVDYEDMFSKRCIWVNGPVIVGAGPSGLATAACLKQQGVPFMVLERAECIASLWQKRTYDRLKLHLPKQFCQLPNLPFPKDFPEYPTKKHFIDYLESYAQKFEINPRFNECVQCARYDETSGLWRVKTVATCGSAKSEFEYICRWLVVATGENAECVIPDIEGLGEFKGDVIHACEYKSGESFKGKKVVVVGCGNSGMELSLDLCNHNASPSMVVRSSVHVLPREVFGKSTFELAVLMLQWLPLWLVDKILLVLTWLVLGNMERFGLKRPSEGPLLLKNTKGKTPVLDIGTLEKIRSGDIKVVPEIKRFSNGYVEFVNGEKQGVDAVVLATGYRSNVPSWLQEGEFFSKNGFPKSPFPNGWKGNAGLYAVGFTRRGLSGASSDAMNIAQDIDQVWKQETRQKKQRTTACHRRCISQF

SEQ ID NO: 174388 - protein, 164 aa, Glycine max
  Coding DNA Sequence Number=SeqID_57610
  Gene Ontology: Mol. function=protein disulfide oxidoreductase activity; Cellular component=chloroplast; Biological process=cell redox homeostasis
  Homolog annotation: Hit_ID=Q8LBS4; Match level="QueryCoverage=64%, HitCoverage=60%, E-value=2e-27, Identity=58%"; Hit description =Putative glutaredoxin
  Pfam annotation: Domain name=Glutaredoxin; Domain location=74-124; Score=18.1; E_value=0.0024; Accession=PF00462.14; Description =Glutaredoxin
  Subcellular localization annotation: CTP_CleavageSite=52; ConfidenceScore=5.64e-01
MALALGNAIPLSNLKPCPKLSCCCMKKLFFTHSVPISRIPTTPKRTPTTVVRATSSFGSRLEDTIKKTVAENPVVLYSKTWCSYSSEVKILFKKLGVDPLVFELDEMGGSSRPTVAQGIGKDHRATHCAKCGKHIGGCTDTLKLYRKGELEPLLSKANAKKTGS

SEQ ID NO: 174389 - protein, 1511 aa, Glycine max
  Coding DNA Sequence Number=SeqID_57611
  Gene Ontology: Mol. function=motor activity; Cellular component =myosin complex; Biological process=protein amino acid phosphorylation
  Homolog annotation: Hit_ID=Q1SXC2; Match level="QueryCoverage=98%, HitCoverage=99%, E-value=0.0, Identity=79%"; Hit description=IQ calmodulin-binding region; Myosin head, motor region; Dilute; AAA ATPase; Myosin, N-terminal, SH3-like
  Pfam annotation: Domain name=DIL; Domain location=1311-1412; Score =93.5; E_value=6.5e-25; Accession=PF01843.9; Description=DIL domain
  Pfam annotation: Domain name=IQ; Domain location=737-757; Score=21.9; E_value=0.0022; Accession=PF00612.17; Description=IQ calmodulin -binding motif
  Pfam annotation: Domain name=IQ; Domain location=760-780; Score=27.0; E_value=6.8e-05; Accession=PF00612.17; Description=IQ calmodulin -binding motif
  Pfam annotation: Domain name=IQ; Domain location=785-805; Score=28.2; E_value=2.9e-05; Accession=PF00612.17; Description=IQ calmodulin -binding motif
  Pfam annotation: Domain name=IQ; Domain location=808-828; Score=13.2; E_value=0.98; Accession=PF00612.17; Description=IQ calmodulin-binding motif
  Pfam annotation: Domain name=IQ; Domain location=833-853; Score=28.3; E_value=2.7e-05; Accession=PF00612.17; Description=IQ calmodulin -binding motif
  Pfam annotation: Domain name=IQ; Domain location=856-876; Score=25.3; E_value=0.00021; Accession=PF00612.17; Description=IQ calmodulin -binding motif
  Pfam annotation: Domain name=Myosin_N; Domain location=9-50; Score =40.4; E_value=6.3e-09; Accession=PF02736.9; Description=Myosin N -terminal SH3-like domain
  Pfam annotation: Domain name=Myosin_head; Domain location=63-721; Score=1082.9; E_value=0; Accession=PF00063.11; Description=Myosin head (motor domain)
  Pfam module annotation: Pfam domain module=DIL::IQ::IQ::IQ::IQ::IQ::IQ ::Myosin_N::Myosin_head; Domain location=1311-1412::737-757::760 -780::785-805::808-828::833-853::856-876::9-50::63-721
AATANPIIGSHVWVEDSQVAWIDGEVLEVKGEEIKVLCTSGKTVVVKASSVYHKDTEAPPCGVDDMTKLAYLHEPGVLDNLRSRYDINEIYTYTGNILIAVNPFIRLPHLYDSHMMAQYKGAGFGELSPHPFAVADAAYRLMINEGISQSILVSGESGAGKTESTKLLMRYLAYMGGRANNASEGRSVEQKVLESNPVLEAFGNAKTVRNNNSSRFGKFVEIQFDQRGRISGAAIRTYLLERSRVCQLSDPERNYHCFYMLCAAPPEDIQKYKLGNPRAFHYLNQTNCFELEGVDELKEYQDTRRAMDVVGISSEEQEAIFRVVAAILHLGNIEFTKGQEIDSSVPKDEKSWFHLRTAAELFMCNAKALEDSLCKRVIVTRDETITKWLDPEAAALSRDALAKIVYTRLFDWLVDKINNSIGQDPDSKSLIGVLDIYGFESFKTNSFEQFCINLTNEKLQQHFNQHVFKMEQEEYKKEEIDWSYIEFVDNKDVLDLIEKKPGGIIALLDEACMFPRSTHETFAQKLYQTFKNHKRFSKPKLARSDFTICHYAGDVTYQTELFLDKNKDYVVAEHQELLYASKCPFVSGLFPPSPEESSKQSKFSSIGSRFKQQLQALLETLSATEPHYIRCVKPNNLLKPAIFENKNVLQQLRCGGVMEAIRISCAGYPTRKTFDEFADRFGLLAPEALDGSSDEVTACKRILEKVGLKGYQIGKTKVFLRAGQMADLDTRRSEVLGKSASIIQRKVRTYLARRSFVLIHLSAIQIQAACRGQLARQVYEGLQREASSVKIQRYLRMHVARKAYKELCSSAVSIQTGMRGMAARTELRFRKQTRAAIVIQSHCRKYLAQHHFTNLKKAAIATQCAWRGKVARRELRQLKMAARETGALQAAKNKLEKQVEDLTLRLQLEKRLRIDIEESKTQENEKLQSALQAMQLQFKETKLLLKKEREAAKREAERAPFIQEVPVVDHALLEKLTSENEKLKTLVSSLEKKIDETEKRYEEANKVSEERLKQALDAESKIIQLKTAMQRLEEKFSDMETENQVLRQQSLLDSSAKTVSEHLSTHISEKLENGHHVVEDQKTSEAQNVTPVKKFGTESDGKLKRSFIERQHENVDALVNCVMKNIGFHHGKPVAAFTIYKCLLHWKSFEAERTSVFDRLIQMIGSAIEQSLKSGGAADATPVKKPPNPTSLFGRMTMGFRSSPSSANLPTPPLDVVRKVEAKYPALLFKQQLTAYVEKIYGILRDNLKKELASMLSLCIQAPRTSKGVLRSGRSFGKDSPMGHWQSIIESLNTLLCTLKENFVPPVLIQKIFTQTFSYINVQLFNSNGEYVKAGLAELELWCCQAKEEYAGSSWDELKHIRQAVGFLLSMSFRVYMSHAFFPCVPTPFLHQIMSVQQLYRICTLYWDANYNTRSVSPDVLSSMRVLMAEDSNNAQSDSFLLDDSSSIPFSVDDFSTSLQEKDFSDMKPADELLENPAFRFLNEDIFRISELALYVHFCCPGQSGNKTVRK

SEQ ID NO: 174390 - protein, 91 aa, Glycine max
  Coding DNA Sequence Number=SeqID_57612
MVKPKQPNLQNMDCGTKMQGLSLNGRPAIDNSNKSEFNVFLDLDVNMDMLCAARKIERGVFVLSYNSFWSMPCNGKLRSITPQGSPDQCAI

SEQ ID NO: 174391 - protein, 179 aa, Glycine max
  Coding DNA Sequence Number=SeqID_57613
MKEGIGRILDLTPIGEKRKEILKRLTLTSHTSMGRTIGHITSQCPTKKTMIMRGQGIYSSQDEATTSPSFSESEEAKGEESSEEIYPQEEGQPLMVKEECKEVSVSSKRLAKKESHFTINTNIKETSPLRQPPHFLLCKKTLVSIVTPLGLEFIPQVKELLDKGLVCKSLNPCALLVPK

SEQ ID NO: 174392 - protein, 150 aa, Glycine max
  Coding DNA Sequence Number=SeqID_57614
  Homolog annotation: Hit_ID=Q1T1Y0; Match level="QueryCoverage=37%, HitCoverage=14%, E-value=3e-08, Identity=47%"; Hit description =Ankyrin
  Pfam annotation: Domain name=DUF1723; Domain location=11-60; Score =30.9; E_value=4.4e-06; Accession=PF08330.1; Description=Protein of unknown function (DUF1723)
LSPLIACSIDINNRGLISSFVERWHWETSIFHLPVGEVLIMLDDIASLLHLHIVGAIHDFQPLRTDEVVGLLVELLMVSVEALRDLTLAGWYAWGAAGLIHMYGQLNDVSLSTSRQLANYITLLQCWIYEHFSSVAECNANPDYDEVSPH

SEQ ID NO: 174393 - protein, 68 aa, Glycine max
  Coding DNA Sequence Number=SeqID_57615
MSLGVGLHHYLLLEKDLTSNSEVLEIMNFFPQHLVRSENPFHGHVPSYMVPHQLSGATSIKEYETNLS

SEQ ID NO: 174394 - protein, 201 aa, Glycine max
  Coding DNA Sequence Number=SeqID_57616
  Homolog annotation: Hit_ID=Q84VH5; Match level="QueryCoverage=85%, HitCoverage=29%, E-value=1e-73, Identity=73%"; Hit description =Envelope-like protein
PTEGVVDIAVSEHQIAKEITAKQVQHWPKKGKLSAGKLSVKYAILHRIGTANWVPTNHTSTVATESFAVKLPIAFPTVLCGIMLSQHPNILNNIDSVKKRESPLSLHYKLFEGTHVPDIVSTSGKAAASGAVSKDDLIAELKDTCKVLEATIKANTEKKMELERLIKRLSDNGVDDGEAAEEEEDAAEDTESDDDDSDATP

SEQ ID NO: 174395 - protein, 88 aa, Glycine max
  Coding DNA Sequence Number=SeqID_57617
MADLNEFDFKQQLNLFLQFNFLAMGVNVMGDRERWRELGSLDENLSILEKECGEFWWFYVLVKAQGSGNRAQLAKPVYPENNVSSTDG

SEQ ID NO: 174396 - protein, 163 aa, Glycine max
  Coding DNA Sequence Number=SeqID_57618
  Gene Ontology: Cellular component=integral to membrane
  Homolog annotation: Hit_ID=UPI00005F7B82; Match level="QueryCoverage =94%, HitCoverage=25%, E-value=3e-50, Identity=66%"; Hit description =COG1289: Predicted membrane protein
MMPDALPGWRRYLFNSSLRYLLRIFFALAGCAAVPWWLQQIEWTIPLTLGVVAAALADLDDRWTGRVRNLLITLLGIYSAGRAGAALRHHCVWCPADRGVHHAGHWPVSAVVDAAGAAADWRAVVQPADLYRPPDVSGAPGAGAAGRQLFPAGALSGSQGQSV

SEQ ID NO: 174397 - protein, 150 aa, Glycine max
  Coding DNA Sequence Number=SeqID_57619
  Gene Ontology: Mol. function=protein binding; Biological process =amino acid metabolic process
  Homolog annotation: Hit_ID=P75874; Match level="QueryCoverage=90%, HitCoverage=100%, E-value=4e-54, Identity=75%"; Hit description =Protein yccU
  Pfam annotation: Domain name=CoA_binding; Domain location=22-118; Score=83.5; E_value=6.6e-22; Accession=PF02629.9; Description=CoA binding domain
MASTLRRVNKEKNMNDQTIRDVLTQTQRIALVGASDRTERASYGVMKYLLDQGYDVVPVSPKLAGQQLLGQTVYGTLAEIPGKIDMVDVFRNSEAAWGVAQEAIAIGAKTLWLQLGVINEQAAVLARDAGLTVIMDRCPKIEIPRLGVTR

SEQ ID NO: 174398 - protein, 352 aa, Glycine max
  Coding DNA Sequence Number=SeqID_57620
  Gene Ontology: Mol. function=methylglyoxal synthase activity; Cellular component=cytoplasm; Biological process=methylglyoxal biosynthetic process
  Homolog annotation: Hit_ID=P0A731; Match level="QueryCoverage=43%, HitCoverage=100%, E-value=3e-63, Identity=78%"; Hit description =Methylglyoxal synthase
  Pfam annotation: Domain name=MGS; Domain location=224-317; Score =94.5; E_value=3.2e-25; Accession=PF02142.12; Description=MGS-like domain
MKLSLAVTGLLLLLVSATCHAITLKLDPQIDLLVLDGRKISGSLLKGADSLELERGQHQFLFRVDKPCADATHFRSELMIVTFTADGHSVAIRLPALNNRRERSLFDKSLNFQLIDERGNEIASIRDRLPGESSGNVEQAMINYNRTAQAASVPRFALQAASVPDASHSLDMVWQDASNLPALQRWLQRVDAATRQRSPMEQTVRTLKVQKHIALVAHDHCKASLLDWVKINQNALQPHVLYATGTTGNLINRHTGLDVNAMLSGPMGGDQQVGALIAEGKIDVLFFFWDPLNAVPHDPDVKALLRLATVWNIPVATNRATADFIIHSPMFASEVTIQIPDYQRYLTERLKA

SEQ ID NO: 174399 - protein, 318 aa, Glycine max
  Coding DNA Sequence Number=SeqID_57621
  Gene Ontology: Mol. function=endopeptidase inhibitor activity; Cellular component=membrane; Biological process=aromatic compound metabolic process
  Homolog annotation: Hit_ID=Q7W7E7; Match level="QueryCoverage=100%, HitCoverage=18%, E-value=1e-146, Identity=79%"; Hit description =Putative exported protein
MAAGIIVHVAENEAGPLLRQRVAVALDLEAGQQAVAGGRRAIQIVALHVDGQGVVRRQHVLVGGQRHLHAFGQEFLDLELPGGIRRARSGINAQFQHPGAGLGVRRQIDGAFDVALQVLGGLPQIGRDHAAVGALEGRCQRRRRHHAAVEVARQHRHVEGFTGAIEVAAGVDEQVVGAGNVAAGIEFGQVQRRFGQRQHGHFLVARGADDAGVGEAAVKAHVALAVGLGLGQHLAGAVHQFEQRAGDRLAALERHRVGLDAIAVAARVQADVADIKIGDLVLIAETAGLAHHRDVDAGFLQFLDAFDRQEGDVAAVRL

SEQ ID NO: 174400 - protein, 257 aa, Glycine max
  Coding DNA Sequence Number=SeqID_57622
  Gene Ontology: Mol. function=molybdenum ion binding; Biological process=nitrogen fixation
  Homolog annotation: Hit_ID=Q60C71; Match level="QueryCoverage=67%, HitCoverage=84%, E-value=5e-19, Identity=32%"; Hit description =Putative nitrogen fixation protein nifQ
MAATTSRRRGAAWAWGWASCTVIEVACPAGSGGPGRAVAEAMILTGSAARRGGERQAGVFTGGIRQELLPAQVGGVARHQARVVARQQRGDVLAAGQAEVAPQMVRAQAGVRQHAGDPGGGGRGPAAGLEQHAQQAREIRLRIGQAARRVGEQLCPQVGERGGRAALRTRKHAGQHLGQLDGRQAGAGQVMVRQALADHGGEEAGVRMAGRRVVQQGAGQGIDVAGGRRGGEKGIHGGWRGKDRRNRYKPEYMTNAG

SEQ ID NO: 174401 - protein, 201 aa, Glycine max
  Coding DNA Sequence Number=SeqID_57623
  Gene Ontology: Mol. function=DNA binding
  Homolog annotation: Hit_ID=Q1SFS3; Match level="QueryCoverage=97%, HitCoverage=38%, E-value=8e-76, Identity=70%"; Hit description =Lambda repressor-like, DNA-binding
  Pfam annotation: Domain name=DUF1723; Domain location=48-97; Score =12.3; E_value=0.018; Accession=PF08330.1; Description=Protein of unknown function (DUF1723)
MDIPLRSTRKYLFKKTDLLRLRELASLVSDPVDFQAHHGKLLKILKVNVEEGCLETLVQFYDPLYHCFTFPDYQLVPTLEEYSYLVGLPVPNKIPFHGFEPTPKPSDIAAALHLKTSIIQANLTSKGGLQGLPTHFLYQQASIFAEAASILAFHSILALLIYGLLFFPNVDNFIDINAIKIFLTKNPVPTLLADTYHSIHD

SEQ ID NO: 174402 - protein, 102 aa, Glycine max
  Coding DNA Sequence Number=SeqID_57624
MAKFDPEVVLEFYANAWPTEEGVRDMRSWVRGQWIPFDADALSQFLGDPLVLEEGQECEFSQRRSRADEFDEEAIAQLLCTPGQDFAQTAAGRRVCHPPGTL

SEQ ID NO: 174403 - protein, 202 aa, Glycine max
  Coding DNA Sequence Number=SeqID_57625
  Gene Ontology: Mol. function=N-acetyltransferase activity; Biological process=metabolic process
  Homolog annotation: Hit_ID=Q6ADC6; Match level="QueryCoverage=90%, HitCoverage=96%, E-value=2e-50, Identity=54%"; Hit description =Phosphinothricin acetyltransferase protein
  Pfam annotation: Domain name=Acetyltransf_1; Domain location=79-163; Score=54.1; E_value=4.6e-13; Accession=PF00583.14; Description =Acetyltransferase (GNAT) family
SKPGDRRRVLPRHLRPATAPDVFSYTIRPARAADLPHIREIYNHFVSNSAVTLDEKRSSIPYWREKFALLARLELPFLVAVSPAGAVLGYALAQPWAGKNAYKYTVEDSIYLGPGAGGKGLGAALLQALIDACEQIGLREMVAVISDQGAEASIRLHEKLGFVEAGRMGRVGYKFGRDLGTVYMRRVLRPTGRRRKLFGSGR

SEQ ID NO: 174404 - protein, 265 aa, Glycine max
  Coding DNA Sequence Number=SeqID_57626
  Gene Ontology: Mol. function=ferric-transporting ATPase activity; Cellular component=membrane; Biological process=peptide transport
  Homolog annotation: Hit_ID=Q0RGB2; Match level="QueryCoverage=96%, HitCoverage=85%, E-value=1e-62, Identity=51%"; Hit description =Dipeptide/oligopeptide transport protein of the ABC superfamily, ATP- binding component
  Pfam annotation: Domain name=ABC_tran; Domain location=40-229; Score =218.4; E_value=1.6e-62; Accession=PF00005.17; Description=ABC transporter
MSLIEARGLQRDFFVPKRTPFERTRTQTALAPTDLDVVDGSSLGIIGESGSGKSTLVRLLLGLDRPTSGTVTVDGKLVDARASAKALHWLRRETGLVFQDPYASLDPRMTAGQIVREPLWALGIPGEHRTRVREVLAQVGLEPEMADRYPHEFSGGQRQRIALARAIVHRPRILVGDEPLSALDVTVRAQILDLLRDLRRTTDLTLILVSHDIGVVQNLCDTVAVMKDGHIVEHGAMQDVLMHPAQDYTKKLLAAIPVIPKTPDR

SEQ ID NO: 174405 - protein, 122 aa, Glycine max
  Coding DNA Sequence Number=SeqID_57627
KVIQIEAIIDQFAIAVQKKRENGTRLDAQKQAHTLLLEKARAARHEVERLIKEAKEGQKIVTEQAKRKELQEKAANSIQKLVDEKGREGLKAFSASQAVADEAKVMESADQVLTKEIASLKK

SEQ ID NO: 174406 - protein, 197 aa, Glycine max
  Coding DNA Sequence Number=SeqID_57628
MSRRDKLWSFCTLLSSRGGGPDDMRRQIMVIPHILLPFRHSRVRWHAETNYGHSAPFFHPEAAGPMTCGDKLWSFRTPLLPFRHSCVRWHAETNYGHSAPFCHPEAAGPMTCGEKLWSFRTPLLPFRHSRVRWHAETNYGHSAPFCHPEAAGPMTCGDKLWSFRTSFCHSDTIVSDGTQRQIMVILHPFVIQRRRAR

SEQ ID NO: 174407 - protein, 176 aa, Glycine max
  Coding DNA Sequence Number=SeqID_57629
  Homolog annotation: Hit_ID=UPI00006A2901; Match level="QueryCoverage =94%, HitCoverage=99%, E-value=8e-63, Identity=77%"; Hit description =UPI00006A2901 related cluster
  Subcellular localization annotation: CTP_CleavageSite=52; ConfidenceScore=5.26e-01
MIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGINDEAFGYLKRVIVTPAVYPRLVEFLHFDIQSTGQKSHCVNIRRDHRNALF

SEQ ID NO: 174408 - protein, 300 aa, Glycine max
  Coding DNA Sequence Number=SeqID_57630
  Gene Ontology: Mol. function=helicase activity; Biological process =viral genome replication
  Homolog annotation: Hit_ID=Q1SRJ5; Match level="QueryCoverage=99%, HitCoverage=42%, E-value=6e-79, Identity=43%"; Hit description =Probable helicase [imported]-Arabidopsis thaliana-related
MYTVEFQKRGLPHVHLLLFLHANNKYPSPNDIGHIISAEIPSQEDDPELYKLVQNHMVHGPCGILRPTSPCMKEGKCSQFYPKKFQPITLIDGDGYPVYCRRNIGQTITKNWIIIDNRCIVPYNLKLLKKYQAHINIEWCNQTTSIKYLFKYINKGSDRVTVAIVHDDKGTLPHANTLNDEIKEYLDCRYEPSLISWMNTNQVFLEGQKLTYFEFVTKFVYNQKQRCWQLRKKGYTIGRLQWVPPTTGELFYLRMMLTVCRGPISFEDIRKIDGVEYSTYREACFAMGFLQDDREFIAAI

SEQ ID NO: 174409 - protein, 106 aa, Glycine max
  Coding DNA Sequence Number=SeqID_57631
MLEDDCRYLMVSKIPTVGISLKAQTEINGLLEGYLRHFSANQPEGLELLDVAQCCYKLTTKKLCVELQPLRVGHGATASDAPHHCGRRRLAHQPTFLPRRGRSATT

SEQ ID NO: 174410 - protein, 105 aa, Glycine max
  Coding DNA Sequence Number=SeqID_57632
  Subcellular localization annotation: CTP_CleavageSite=9; ConfidenceScore=5.11e-01
GSQPQRHPVDLKKSNRALGFLALVTGLCRPYRAPVPPSKFMSSWHRDCARKTPSGPEEGQQGLGVASSKYGSLLVLGSACRPQQGHQAPPTNQAFIKKYCAPRQA

SEQ ID NO: 174411 - protein, 301 aa, Glycine max
  Coding DNA Sequence Number=SeqID_57633
  Gene Ontology: Mol. function=nucleoside-triphosphatase activity; Cellular component=membrane; Biological process=defense response
  Homolog annotation: Hit_ID=Q7W3K0; Match level="QueryCoverage=73%, HitCoverage=91%, E-value=1e-90, Identity=74%"; Hit description=ABC transporter
MPQHSRQFVHDIFPDGRGDVERKKWCAEGAVGSLGVLLVRGVRLILVYRLGPIKQADLAQVHGIFMAVAQGRAPGAAMDPGIFPNRGVTCGSVRPGAVADAQRFAHVVVGDQHADAAAFQESHDALDLDHGDRVHAREGLVQKDEARAGGQRARDFDAAAFAAGKGDGRIAADMADLQFFQQGFHLLVDLGRGQRSSIRPQLQFEHGADAHVRALVDRHRGDDGTVDLDAARIRRHQAHDHVEAGGLAGAVGAEQAHDFAADHGQGHVLHHGPAVIGLAQAGCAQAALLDARGGGGYRSRH

SEQ ID NO: 174412 - protein, 559 aa, Glycine max
  Coding DNA Sequence Number=SeqID_57634
  Gene Ontology: Mol. function=transporter activity; Cellular component= integral to membrane; Biological process=transport
  Homolog annotation: Hit_ID=P39398; Match level="QueryCoverage=77%, HitCoverage=95%, E-value=1e-177, Identity=70%"; Hit description =Inner membrane transport protein yjjL
  Pfam annotation: Domain name=DUF95; Domain location=289-441; Score= -35.7; E_value=0.014; Accession=PF01944.7; Description=Integral membrane protein DUF95
  Pfam annotation: Domain name=MFS_1; Domain location=136-505; Score =238.0; E_value=2e-68; Accession=PF07690.6; Description=Major Facilitator Superfamily
  Pfam annotation: Domain name=Sugar_tr; Domain location=127-530; Score= -95.6; E_value=0.0007; Accession=PF00083.14; Description=Sugar (and other) transporter
  Pfam module annotation: Pfam domain module=DUF95::MFS_1::Sugar_tr; Domain location=289-441::136-505::127-530
MHTLILSAANNPFFNQSLEIISVIFHSHYQWDESDLKQRNIVALEEHMAILTALISRQDVDALQPLRAGRFAAAGTPRLITISTRTWEVAMENTSTRGGTTAPAPEHAGQDYVPARADVVRSPRIRKIQITAMLLLLFAAIINYLDRSSLSVANMTIREELGLSATEIGVLLSAFSLAYGLAQLPCGALLDRKGPRIMLAIGMFFWSLFQAAAGLVHNFTQFVLVRIGLGIGEAPMNPCGVKVINDWFNIKDRGMPMGMFNAASMIGLSVAPPILAAMMLVMGWRGMFVTIGVLGMFLAIGWYLTYRDRDNNKLSGEEIHYLQAGSVASRKEPLSFAEWRGLFKQRTMWGMMIGFSGINYTAWLYIAWLPGYLQSTYHLDLKSTGLLAAIPFLFGAAGMLLNGYVVDALVRRGFDAVKVRKVSIVSGMLLSAAFTTFVTRATDTTSAVTLIGMALFCIHFAGTSCWGLIHANVTARMTASVGSIQNFASFVFASFAPVITGWVLDTTKSFSLALMICAGVTVVGALAYLLLVRKPITDGVMRTLASSARHTYSSRRVIA

SEQ ID NO: 174413 - protein, 314 aa, Glycine max
  Coding DNA Sequence Number=SeqID_57635
MSRARRQHSLQRATFRHGEIIGIQLRRTGKGRQLLPLFIHLFGIPVRVRKVSRAGGGDIRLRIKHIQRRFTLNLHHHHIAVQPVAAVAFQQMKLPAGIINDTRGILRDELLKFLRLHARPQRQIVGTENARGAAAGIKARATRQRTVRILCQQIEMGENCRAPREGCQLAPFAEQRVRVRMQMPEVLCLGGKFTVILHKARALCRIFHFKQHQVLIDALAAQTAKQRPAPAGIAGEMHAFFAHEGFKLFSGDARFGVDGDIKKAINRLGHNRLQARRRVPLRGKGGLVELGIDDGFYQHAAGGGERDVAAIAVH

SEQ ID NO: 174414 - protein, 142 aa, Glycine max
  Coding DNA Sequence Number=SeqID_57636
  Homolog annotation: Hit_ID=Q40538; Match level="QueryCoverage=25%, HitCoverage=64%, E-value=5e-08, Identity=86%"; Hit description =Nicotiana tabacum (clone 5) activating factor DNA sequence
MGEEVSAQLAQASQGFLKKFPDAPSKLISSSPFFGYENVMEALQKPQMPFFNKMGEVVAAQLAQASYQAYRYRRPRGGARYQLLFPLVRVNFELGVIMVIAVSFGKPVVPAALMNRPTRGERRFAYWALAECILAYYVGTDE

SEQ ID NO: 174415 - protein, 185 aa, Glycine max
  Coding DNA Sequence Number=SeqID_57637
  Gene Ontology: Mol. function=ATPase activity, coupled to transmembrane movement of substances; Cellular component=integral to membrane; Biological process=proteolysis
  Homolog annotation: Hit_ID=Q46973; Match level="QueryCoverage=99%, HitCoverage=26%, E-value=3e-76, Identity=76%"; Hit description=MtfB
MAERRGSHWLNLKIDAINTGIRLSRLDMFFGGINTFVATCDQVTILWLGISLVMENQMTIGMFVAFGAFRAQFSDRVGSLVNFLLQLRMMSLHNERISDIALNEKEERKPDLGLKATMSPASLEIKALSFRYDSQSAPVFSGLSFRIRAGESVAITGPSGSGKTTLLKVLCGLSEPISGTVLMNG

SEQ ID NO: 174416 - protein, 106 aa, Glycine max
  Coding DNA Sequence Number=SeqID_57638
MSGFTHDSPQISASPHQLDLAPYASGPYNAQWNAPGLLHDKHTLRSSRILGEMETDFVVDLGMAFVDNWVAGVAGGDTEGLPKCFQGLSNNCLPFSGISEPRLEVD

SEQ ID NO: 174417 - protein, 286 aa, Glycine max
  Coding DNA Sequence Number=SeqID_57639
  Gene Ontology: Mol. function=transcription regulator activity; Cellular component=nucleus; Biological process=regulation of transcription
  Homolog annotation: Hit_ID=Q0WL61; Match level="QueryCoverage=85%, HitCoverage=58%, E-value=2e-20, Identity=34%"; Hit description=BHLH transcription factor like protein
  Subcellular localization annotation: CTP_CleavageSite=58; ConfidenceScore=5.23e-01
MGGRENALGLQSVSETTVISSVSMAMPSGVVANPFLASSAWDPLVPLSQTLGGSLMVSHSEFANSAYPSVLENQGMNCDSHFVQYVSDSNFEHMALKVPSFGQTGSYDIANTGYLPNHNPSNESGMERSPINNEQSKLEGSTSEEGAAPDEHKRKRGLDYNFTFSSNKNAEGEALKDSSGKSCDDDVKEQCEKKPRVAQNSTANLCGKQLLKQKKDDSESEEGSKENFIHVRARRGQATNSHSLAERVRREKISERMRLLQELVPGCDKSCTLTNSSFSVFFWEWC

SEQ ID NO: 174418 - protein, 94 aa, Glycine max
  Coding DNA Sequence Number=SeqID_57640
MQTFSKDNQQFQIDGASSKEHVFPEIFRKKVLPETFQKNLLPEEQFVFYRKNLFPEAFRKNKLLFFRKKVLPKSFQKKVLPVEQFILPEEGSSG

SEQ ID NO: 174419 - protein, 317 aa, Glycine max
  Coding DNA Sequence Number=SeqID_57641
  Gene Ontology: Mol. function=protein-methionine-S-oxide reductase activity; Biological process=protein metabolic process
  Homolog annotation: Hit_ID=Q8LIY0; Match level="QueryCoverage=77%, HitCoverage=35%, E-value=1e-95, Identity=71%"; Hit description =Putative CSLC9
CQCELPESYEAYRKQQHRWHSGPMQLFRLCLPDIIRAKISVWKKFNMIFLFFLLRKLILPFYSFTLFCIILPMTMFVPEAELPAWVVCYIPAAMSFLNILPAPKAFPFIVPYLLFENTMSVTKFNAMISGLFQLGSAYEWVVTKKSGRSSEGDLVSLIEKGPKHQRGSSAPDLEEMKEELRKQEQQKASKKKKKHNRIYMKELALAFLLLTASARSLLSAQGIHFYFLLFQGISFLLVGLDLIGEQHKGAKARPYEITEDTYLGAMESVEEDGPIMLLFLAHAPPSKLGKVAVANGFVTLCGLSSWELVARLEAPLQ

SEQ ID NO: 174420 - protein, 378 aa, Glycine max
  Coding DNA Sequence Number=SeqID_57642
  Gene Ontology: Mol. function=protein-methionine-S-oxide reductase activity; Biological process=protein metabolic process
  Homolog annotation: Hit_ID=Q9ZQB9; Match level="QueryCoverage=94%, HitCoverage=50%, E-value=1e-119, Identity=60%"; Hit description =Putative glucosyltransferase
MAPPLFNWGVKDTHRGTPVVVKMENPNWSMVELEGPEEEDLMLTNSPSSGVSRDKGRGKNAKQLTWVLLLKAHRAAGCLTSLAPALVGLVAAVKRRVAAGKTDADTGGGRENENPAVKTRFYSCIKLFLCLSVVLLVFEIAAYFEGWYFGAARFQLEHLLWAPSFGVKGFFDWLYARWVFVRVEYLAPPLQFLTNACIVLFLIQSMDRLVLCLGCFWIRFKKIKPVPKGGGVVDLESGEEKGFSFSPMVLVQIPMCNEKEVYQQSIAAVCNLDWPKGKLLIQVLDDSDDPTTQSLIKEEVQKWQQEGANILYRHRVIRDGYKAGNLKSAMNCSYLKDYEFVAIFDADFQPTPDFLKKTVPHFKVGNLMISFNVVCVSL

SEQ ID NO: 174421 - protein, 239 aa, Glycine max
  Coding DNA Sequence Number=SeqID_57643
  Gene Ontology: Mol. function=squalene monooxygenase activity; Cellular component=integral to membrane; Biological process=electron transport
  Homolog annotation: Hit_ID=Q8GSM8; Match level="QueryCoverage=99%, HitCoverage=32%, E-value=2e-55, Identity=53%"; Hit description =Squalene monooxygenase 1
  Subcellular localization annotation: CTP_CleavageSite=31; ConfidenceScore=5.21e-01
MVDLYVLGWIICAVLSLAALRNFAFTRKNCCASSETGATRRAVNVTTAAGECRSSSRDGAVDIIIVGAGVAGSVLAHTLGKMVVLHLHSIFASNLKLLVVSMNKQFDLDLEDGRRVLVIERDLSEQDRIVGELLQPEGYLKLIELGLEGSANLTMCIWHMIFFSRLWLIMGAGNTHKFVGADCVEKIDAQQVFGYALFKDGKHTRLSYPLEKFHSDVAGRSFHNGRFIQRMREKAASLP

SEQ ID NO: 174422 - protein, 235 aa, Glycine max
  Coding DNA Sequence Number=SeqID_57644
  Gene Ontology: Cellular component=chloroplast thylakoid membrane
  Pfam annotation: Domain name=Methyltransf_11; Domain location=69-165; Score=0.6; E_value=0.048; Accession=PF08241.2; Description =Methyltransferase domain
MDVVFLLLLCLLTLPCRLESVSRVEGCQYPTMVYGPVIVCLGDYLCAGEVLRAIPILQKAYGDSLHKVLHVGPDTCYVVSKLLKEEETEAWGIEPYDIEDADGNCKTLIGKGIVRMADIKFPLPYRPKSFSLVIVSDALDFLSPRYLNKTLPDLARVSADGIVIFTGFPDNQKAKVADVSKFGRTAKMRSSSWWVRFFLSINLEENETASKKFAQASTKSSYIPNCQIFHLKSLH

SEQ ID NO: 174423 - protein, 181 aa, Glycine max
  Coding DNA Sequence Number=SeqID_57645
  Gene Ontology: Mol. function=squalene monooxygenase activity; Cellular component=integral to membrane; Biological process=electron transport
  Homolog annotation: Hit_ID=Q8GSM8; Match level="QueryCoverage=91%, HitCoverage=32%, E-value=8e-76, Identity=82%"; Hit description =Squalene monooxygenase 1
  Pfam annotation: Domain name=SE; Domain location=35-181; Score=88.5; E_value=2.1e-23; Accession=PF08491.1; Description=Squalene epoxidase
MCATGAGTATSLIEEKGIIKGMRYKTKDNKEFSACAPLTIVCDGSSSNLRRSLCNPKVDVPSRFVGLVLENCPCANHSHLILGDPSPVVFYPISSSEVRCLVDVPGQKVPSISNGEMAKYLKTVIAPQIPLELHDAFIAAVDKGNIRTMRNRSKPAASYPTPGAQLMGDAFNMGWNDRGII

SEQ ID NO: 174424 - protein, 187 aa, Glycine max
  Coding DNA Sequence Number=SeqID_57646
  Gene Ontology: Mol. function=squalene monooxygenase activity; Cellular component=integral to membrane; Biological process=electron transport
  Homolog annotation: Hit_ID=Q8GSM8; Match level="QueryCoverage=94%, HitCoverage=42%, E-value=8e-83, Identity=73%"; Hit description =Squalene monooxygenase 1
  Pfam annotation: Domain name=SE; Domain location=1-145; Score=109.4; E_value=1e-29; Accession=PF08491.1; Description=Squalene epoxidase
MIRGKFMQIPPELHDAFIAAVDKGNIRTMPNRSMPAAPYPTPGALLMGDAFNMRHPLTGPVASTINTLARALYKVFCASLDPARKEMRQACFDYLSLGGLFSEGQVSLLSGLNPRPLSLVLHFFAVAIYSVGRLLLPFPSPKRMWIGVRLISSASGIILPIIKAEGVRQMFFTATVPTYYRIPPADA

SEQ ID NO: 174425 - protein, 184 aa, Glycine max
  Coding DNA Sequence Number=SeqID_57647
  Gene Ontology: Mol. function=heat shock protein binding; Cellular component=integral to membrane; Biological process=protein folding
  Homolog annotation: Hit_ID=Q6ATJ1; Match level="QueryCoverage=84%, HitCoverage=65%, E-value=6e-38, Identity=47%"; Hit description =Putative DnaJ protein
MKEDAEKDKGNDNNKIWGAILFGFIGATVTTFAVGQLRRSAEWFYTQLSRTQSSWKGESGGSFRSAFQEEAWRRHNKRMQEELEEEIERVERIRRMQSVFNRERNKYKRSYESWRESGPGAYHQHSQREDWYWKADTSFRDKRTNYRETPRESGNYALSHHYSVLGLDRCELDWLLNCDSVRSQ

SEQ ID NO: 174426 - protein, 103 aa, Glycine max
  Coding DNA Sequence Number=SeqID_57648
MVFDKTVVLSFKPKIVLQKPTISRLRAQLVARTTVLLAEFYVITDNTIIVTQRIIKKLPIEANFRLTNCKSTLAKPPPYTLANLVVDVEASIRGRDSGAQCQG

SEQ ID NO: 174427 - protein, 68 aa, Glycine max
  Coding DNA Sequence Number=SeqID_57649
MRLPGKESLLMKFPITINEILDVSISFLNDHLEETPGSTKIEEITQSVSISHSAGREKRVASARDFGW

SEQ ID NO: 174428 - protein, 100 aa, Glycine max
  Coding DNA Sequence Number=SeqID_57650
MGQRTKVTRWLCLQFRSGFNTVSEIEQEAPYKDDELVGLQEVLELDPDVINESLADVDGGGEEIDADLLKQLGLIKPDKDECMLSENDIESDFDDTNTSL

SEQ ID NO: 174429 - protein, 49 aa, Glycine max
  Coding DNA Sequence Number=SeqID_57651
MVFLAILGFRFSGSHRHLLFERGEVWKVCDFVRMSITIIVRRWNANTFV

SEQ ID NO: 174430 - protein, 274 aa, Glycine max
  Coding DNA Sequence Number=SeqID_57652
  Gene Ontology: Cellular component=membrane
  Homolog annotation: Hit_ID=Q75LY2; Match level="QueryCoverage=58%, HitCoverage=20%, E-value=6e-54, Identity=65%"; Hit description =Expressed protein
  Pfam annotation: Domain name=DUF221; Domain location=1-272; Score =4.0; E_value=1.4e-08; Accession=PF02714.6; Description=Domain of unknown function DUF221
  Subcellular localization annotation: CTP_CleavageSite=87; ConfidenceScore=5.28e-01
MGCGRKFVMQLVTGYLPSAILVLFLYAVPPVMMLFSTVEGSVSRSGRKRSACTKFLYFTIWNVFFVNVFAGSVISQLAVFSSITELPAQLAKAVPVQATFFTTYVLSSGWASLAFETMQLYPLFCNLFQRFILGYKEDTMNGNLTFPYHTEVPRILLFGFLGFTCSILAPLILPFLLFYFVLAYFVYRNQVLIDMDRRDERCGRMDQIYEQVQSAYCQATHSTQSECFSSHQGDREHVRTPEELETGKEISQKDLSWPPVLRSLSLDNSVLGGK

SEQ ID NO: 174431 - protein, 189 aa, Glycine max
  Coding DNA Sequence Number=SeqID_57653
  Gene Ontology: Cellular component=membrane
  Homolog annotation: Hit_ID=Q2QLP9; Match level="QueryCoverage=99%, HitCoverage=52%, E-value=5e-34, Identity=49%"; Hit description=Early- responsive to dehydration protein, putative, expressed
  Subcellular localization annotation: CTP_CleavageSite=45; ConfidenceScore=5.43e-01
MDIAALLTSAGVNIAVCVVLFSLYSVLRKQPSNVRVYFGRRVASRCSKSRDLCLERFVPSPTWVMKAWETTQDEMLSTGGLDAVVFSRMECAAAFVFFKSRYAALTVAQNLQTSNPMLWVTDLAPEPPDVYWANLCIPYRQLWIRKISIFVASVTFVLVFLIPVTFAQGLTQLDKLERMFPFLAGTLQK

SEQ ID NO: 174432 - protein, 390 aa, Glycine max
  Coding DNA Sequence Number=SeqID_57654
  Gene Ontology: Mol. function=DNA binding; Cellular component=nucleus; Biological process=regulation of transcription
  Homolog annotation: Hit_ID=Q0PJD7; Match level="QueryCoverage=50%, HitCoverage=100%, E-value=1e-97, Identity=86%"; Hit description=MYB transcription factor MYB161
  Pfam annotation: Domain name=Myb_DNA-binding; Domain location=108 -153; Score=35.7; E_value=1.6e-07; Accession=PF00249.21; Description =Myb-like DNA-binding domain
  Pfam annotation: Domain name=Myb_DNA-binding; Domain location=54-102; Score=50.3; E_value=6.3e-12; Accession=PF00249.21; Description=Myb -like DNA-binding domain
  Pfam module annotation: Pfam domain module=Myb_DNA-binding::Myb_DNA -binding; Domain location=108-153::54-102
MSYARISLDIKGSEWSGVDSKKTRVISNNQSKLAESNNNNMGRAPCCDKSNVKKGPWSPDEDAKLKSYIEQHGTGGNWIALPQKIGLKRCGKSCRLRWLNYLRPNIKHGGFSEEEDNIICSLYVCIGSRWSVIAAQLPGRTDNDIKNYWNTRLKKKLLGKRRKELQARNKGNGVVEHENNSSLLLQENSAQQLHPCWPQIPAVLPLSPYTNQSPSFNDQDSIRKLLIKLGGRFSDDYQRILDGLNLQFPHGSLSSTQLLQEEQVHFVSSAGCMNSIGNNQVQFGQSNEYRAELVQGQSSFTTTTIGEMVSANDYSQRLLGGSLEFFYGEEMITDKIMGGACASSSCGQSTDWGETSSLIYPPLVASNYEGVRQEMPRECVFQELSYPGAQ

SEQ ID NO: 174433 - protein, 212 aa, Glycine max
  Coding DNA Sequence Number=SeqID_57655
  Gene Ontology: Mol. function=zinc ion binding
MKQALLDRYGVEPTNQMQLYCAKQRVHQTTKGGPLGGTLLSVVVLDRNKGIFPIAFTVVEIENKDSLKFFLTLLREVLQLVPEWKDDFVTIMSDQQKGLDRAIAEMFPYAKHKLMVTFQKRYERVTTCQNLMPPRVKTYLDKTLQATRSLVVTFAGNDEFQVMDVYTNFVPLQILKLLVAYGEVIRPVPDVDANSDRGGYPNIGPPTLKRQP

SEQ ID NO: 174434 - protein, 99 aa, Glycine max
  Coding DNA Sequence Number=SeqID_57656
  Gene Ontology: Mol. function=branched-chain-amino-acid transaminase activity; Cellular component=mitochondrion; Biological process =branched chain family amino acid metabolic process
  Homolog annotation: Hit_ID=Q9SNY8; Match level="QueryCoverage=55%, HitCoverage=14%, E-value=2e-18, Identity=70%"; Hit description =Branched-chain amino acid aminotransferase
MPIIGTNNCFASQPSPLRSHSSDDEYADVDWDSLGFGLMTTDYMYITKCCEGQNFGQGQLSRYGNIELSPSAGVLNYGQVSNHIWLLNMDVYQLKTSRN

SEQ ID NO: 174435 - protein, 89 aa, Glycine max
  Coding DNA Sequence Number=SeqID_57657
MASAKPKPRKRLGEFLKEQQEPFILELYLLEKGCSTNIGESGKSIERWDSDIIDEHVNVNVSVPREVESTDQTIEDTDRFSFSTATNST

SEQ ID NO: 174436 - protein, 37 aa, Glycine max
  Coding DNA Sequence Number=SeqID_57658
MGNSRLPQLQELKPKALVTRILIARVKQAYKICLCRT

SEQ ID NO: 174437 - protein, 144 aa, Glycine max
  Coding DNA Sequence Number=SeqID_57659
MKDCKNTSGEDVSFTSRISQSLINSSQALRTASALSGALDDLECEASTAQVPQPVQEDVSDDISKPSPSESFIVEDGLATPQEDTAAITPLVTPQPPPEHIISELDLSSPQPEPEPFALVLDLPISQDLPFTPGLDLNDAAQDD

SEQ ID NO: 174438 - protein, 97 aa, Glycine max
  Coding DNA Sequence Number=SeqID_57660
MERDEKRFEYRFYCSSEENNVEEDNEGGIGAVDALISIGEIKRKMKKKKIAIYGSRFDEEMSEIGRFGGLGMEERRKEEGAVQGFLENVIFIEQDAW

SEQ ID NO: 174439 - protein, 176 aa, Glycine max
  Coding DNA Sequence Number=SeqID_57661
MNQDVSGMEERMSSCCVFVPKKITEDSLLSVALWSSLIQSAKREKCSKELREFLGANPDVCHVLKSKTLLHKAKQLLFYCVREISTPINLSRKDCRQQQCLKQLTRGPEELGKIIWERTRELGGNETNLITKLLSLDSMDEWSELKPQVRHICVEVAEAVLGTRDYENCSRDDSSL

SEQ ID NO: 174440 - protein, 187 aa, Glycine max
  Coding DNA Sequence Number=SeqID_57662
MLLITATRSFISLLTWNNNHKRNNVVILGTPHQIFPSLSQQSLPQLLAVIGYRSPSPETLSYSGTSFYFFYSLSSLNPKSSTLICMSLSKIKQKSSYFKLRYASAPLWFRSGCTWWRTRRRSGVAELCQTTAVELREANRIEPTVAVFLLAIVLRDDCGGGEWGRRLAVVLLDEVSRVVFLVGHNGD

SEQ ID NO: 174441 - protein, 103 aa, Glycine max
  Coding DNA Sequence Number=SeqID_57663
  Gene Ontology: Mol. function=nucleic acid binding; Cellular component= ribonucleoprotein complex; Biological process=positive regulation of gene-specific transcription
  Homolog annotation: Hit_ID=Q6YVH4; Match level="QueryCoverage=68%, HitCoverage=18%, E-value=3e-17, Identity=59%"; Hit description =Putative heterogeneous nuclearribonucleoprotein A2
  Pfam annotation: Domain name=RRM_1; Domain location=12-81; Score =80.3; E_value=6e-21; Accession=PF00076.12; Description=RNA recognition motif. (a.k.a. RRM, R
MNFKMDSDSAKLFVGGISRDTTEHVLKLHFAKYGVVSDSTISVDRTTRSPRGFGFVTFSDLSAADKALQDTHVILGRTVSFIARLRISRNCFLGRSEKSNSQE

SEQ ID NO: 174442 - protein, 142 aa, Glycine max
  Coding DNA Sequence Number=SeqID_57664
MEHSLKNDVYFQEKVSVPFSWEHEPGLSKVNHQKNDSRHSNLVLQPPPPRSSSRNGRKKQLRVEDAENPNFILCAVQPSSRRIRSFRLESDQKGDPFVKAYKKCTETPKDPFMHKGSSNKSNKNNGSWLNIVSCNRKAIENT

SEQ ID NO: 174443 - protein, 219 aa, Glycine max
  Coding DNA Sequence Number=SeqID_57665
  Gene Ontology: Mol. function=oxidoreductase activity; Biological process=electron transport
  Homolog annotation: Hit_ID=Q7WL46; Match level="QueryCoverage=97%, HitCoverage=56%, E-value=2e-90, Identity=76%"; Hit description =Putative secreted oxidoreductase
STLEDPNRALPDRQPDRHAHARVHHRDRGGGVHRHHRERRRPMRAIDALPALQHPQPRPQRLRRQVQHGVVDGLVVEREGILAVAVRIADDQFAIGRGADQQVDAVFQQHRRARLDLLAQRQRRRQVREGAVVHAGQASEQRAVQRHGTRLESRAQHLQARHFQVQRREPFGQQRQIVVAGADEDVRTGEVARGGRDLPLLDGARQGAGDEFDAQRFGQ

SEQ ID NO: 174444 - protein, 91 aa, Glycine max
  Coding DNA Sequence Number=SeqID_57666
AYGCWYPVGGYGGNGYAVPSDAPSNLWIGIVGSGAGSWGYTGIMGSATNFKFDQAFNANEFVPGNVTSPHGVKQDVIDSSSLKGSNGGISS

SEQ ID NO: 174445 - protein, 61 aa, Glycine max
  Coding DNA Sequence Number=SeqID_57667
MVGVCTQVVLSACRIMPFAWYLEELGQFVYVDEVFQQTHLRKDIGQFVNDRSRRTHVRPLP

SEQ ID NO: 174446 - protein, 38 aa, Glycine max
  Coding DNA Sequence Number=SeqID_57668
MPSGKEVWVLPAPAPAVTIVKSNHAPSHPNPTAMLSTL

SEQ ID NO: 174447 - protein, 60 aa, Glycine max
  Coding DNA Sequence Number=SeqID_57669
MTKLGLCVPTDMTVSEWQRGADNRKNDQTWSLRAIGHNCVCLAKGGADNRKVSPRIMGAE

SEQ ID NO: 174448 - protein, 100 aa, Glycine max
  Coding DNA Sequence Number=SeqID_57670
MIQEKKMKSEERTQQQWEKCSQVEIQQESILQVNTPHHQLIVNEERNREWDKSLSDILSLITNTSLTLIWNAFLGYMSFMSLQLRGKNAKDVFYMTLMPP

SEQ ID NO: 174449 - protein, 89 aa, Glycine max
  Coding DNA Sequence Number=SeqID_57671
TVRERWRQFKFDLTSKWAFEADKDSADDTDVRKKSHAIQKQNIAPHMLSRGGYEFLENKLMEEKKNKQLEEPTKSGSTDFVINTPSLIR

SEQ ID NO: 174450 - protein, 58 aa, Glycine max
  Coding DNA Sequence Number=SeqID_57672
MEKGTSLPMEKEEEPMWLSQKDVDLELEDKEFWERESAKELFVNVTKRCMEWEKVKEM

SEQ ID NO: 174451 - protein, 171 aa, Glycine max
  Coding DNA Sequence Number=SeqID_57673
  Gene Ontology: Mol. function=DNA binding
  Homolog annotation: Hit_ID=Q1S0F5; Match level="QueryCoverage=88%, HitCoverage=29%, E-value=1e-16, Identity=34%"; Hit description=IMP dehydrogenase/GMP reductase
MYDTFDQRCEKSGAKIVCCTPALYVWLVSHLFPQEGRPGCPLQGHHLSDEKGKANWDQLLASMEGASINWFPHWKEGRIGILCSCKGFPNVPLMGTRGCINYNPILSIRQLGYPMRGVPSEESIAPFIARGFSDPNARVLQGVHKAWDMVQRNDKELRGSSNGIIGAIVSA

SEQ ID NO: 174452 - protein, 226 aa, Glycine max
  Coding DNA Sequence Number=SeqID_57674
  Gene Ontology: Mol. function=DNA binding
  Homolog annotation: Hit_ID=Q1SP03; Match level="QueryCoverage=83%, HitCoverage=33%, E-value=8e-18, Identity=32%"; Hit description=IMP dehydrogenase/GMP reductase
MGKNPNGKRFYQVKIKGLDVTSLKELGRLMGPLQRQAFRKVYRKILDLTTAEVFTEAVVSLAQYYDQPLRCFTFGDFQIVPTVEEFEEILGCPLGGRKSYLFSGFLPSLSKIAAVVGDSARGLDRMKQTRNDIVGLPRKYMEGKARDMASQEEWVLFADILALLIFGVVFFPNVDSLVDLASIDAFLAYHHSKESPVEAAQSTGFLDGRKERREFSSHVGTTQMFR

SEQ ID NO: 174453 - protein, 97 aa, Glycine max
  Coding DNA Sequence Number=SeqID_57675
MKAMPSKPTRKGKKCYLNPTYQGNPCGVIQIFVACIKRSAPSEDHVISDEDTTKDKDHEALEGPMTRGRLKQAQVEKDGGLEAEALPRLLIVAEGPN

SEQ ID NO: 174454 - protein, 155 aa, Glycine max
  Coding DNA Sequence Number=SeqID_57676
MWFYHRNQRVQSLVIAIFLHTRIAQFVQFPTLNSQKLLPPLSFFFFFSYPFPLHIGYALHPLFTKFSRCNSVLHQRDSEFGSNTALKVIVVTHNAQCGINLQWHVHGGKVGEMGYVREHEIQRREKGYTGTENVITKEREIGYMNYGGEKIEILF

SEQ ID NO: 174455 - protein, 135 aa, Glycine max
  Coding DNA Sequence Number=SeqID_57677
  Gene Ontology: Mol. function=microtubule motor activity; Cellular component=microtubule associated complex; Biological process =microtubule-based movement
  Homolog annotation: Hit_ID=Q9C7B9; Match level="QueryCoverage=91%, HitCoverage=11%, E-value=3e-16, Identity=44%"; Hit description =Kinesin heavy chain, putative; 55116-47986
  Subcellular localization annotation: CTP_CleavageSite=72; ConfidenceScore=5.91e-01
MASKQGVMKSRRFGLSGSKGANSPSSSTTSSSKQFQETSADGLSSPASSSARSKPQHFTPETAVALPLDGKRVKENVTVTIPVNLIEVCAWDSPREIRQGEEIAWYADGETILRNEYNPSIAYAYGIICKTDIYG

SEQ ID NO: 174456 - protein, 339 aa, Glycine max
  Coding DNA Sequence Number=SeqID_57678
  Gene Ontology: Mol. function=microtubule motor activity; Cellular component=microtubule associated complex; Biological process =microtubule-based movement
  Homolog annotation: Hit_ID=Q6YZ52; Match level="QueryCoverage=77%, HitCoverage=51%, E-value=1e-123, Identity=81%"; Hit description =Kinesin motor protein 1-like
  Pfam annotation: Domain name=Kinesin; Domain location=42-330; Score =407.3; E_value=2.2e-119; Accession=PF00225.13; Description=Kinesin motor domain
MNEKFEGGSKTKSKRYFCSKIFWIQGPKKKPIESLNIGHCTKKRPFEDLQGNDHKDVMILFEMKRFQMSLKYRVFGPTTTTRQVYDVAAQHVVSGSMEGINGTVFAYGVTSSGKTHTMHGDQRSPGIIPLAVKDAFSIIQEVVNDLLNPAGQNLRIREDAQGTYVEGIKEEVVLSPAHALSLIAAGEEHRHVGSTNFNLLSSRSHTIFTLTIESSPCGENSEGEAVTLSQLNLIDLAGSESSKAETTGMRRREGSYINKSLLTLGTVISKLTEDKASHIPYRDSKLTRVLQSSLSGHGRVSLICTVTPSSSSTEETHNTLKFAHRAKYIEIRAAQNKAS

SEQ ID NO: 174457 - protein, 570 aa, Glycine max
  Coding DNA Sequence Number=SeqID_57679
  Gene Ontology: Mol. function=microtubule motor activity; Cellular component=microtubule associated complex; Biological process =microtubule-based movement
  Homolog annotation: Hit_ID=Q9C7B9; Match level="QueryCoverage=97%, HitCoverage=53%, E-value=1e-151, Identity=55%"; Hit description =Kinesin heavy chain, putative; 55116-47986
MVLNFNYVKLEDGQVRLQSRLEQEEEAKAALLGRIQRLTKLILVSTKASPSTRFPNRPGPRRRHSFGEEELAYLPYKRRDLILDEENIDLYVNLEENAATVDDSFKGEKKTKKHGLLNWLKLRKRDSALTGTSDKSSGAKSTSTPSTPQAESGNHVESRLSHSQPAESSPSADLASEAREDKYIHVDSLLGQETPLTSIKSVDQIDLLREQHKILSGEVALHSSALKRLSDEATRNPQNGQVEMKMLKDEITAKSEQIDLLEKHISNSFIASDKTEESGALQTVAELMEQLNEKSFQLEVKAADNRVIQEQLNQKICECESQQETIASLKQQLADALELRNFSPVVNHSQNFSGTKDYCGELHLDRGNVTVNNSNEGIHLQAQISEIEDLKQRVAELTESKEQLEFRNQKLAEESSYAKGLASAAAVELKALSEEVAKLMNQNERLAAELAASKNSPAERRTSGTVQNGRRESHVRVRRNDQGASNANIKRELALSKERELSYEAALLEKDQKEAELQRKIEESKQREAYLENELANMWVLVAKLKKSQGAETDVSVSTKESLQLDGFDV

SEQ ID NO: 174458 - protein, 83 aa, Glycine max
  Coding DNA Sequence Number=SeqID_57680
MFTRAWILRFIGGVLFVDKGSSKVSLRWLRRGNQHIANDDLILFCHKLDIMKRHEFVWEPYTTNVMSVLPPICLVGSVAWCAM

SEQ ID NO: 174459 - protein, 134 aa, Glycine max
  Coding DNA Sequence Number=SeqID_57681
RDSNVSMTDLVSAEDDTAKKNVYTENHSGISARQRDSNVSMTDLVSAENDAFRLTDNKKNVYTANHSGISAGQRDSNVSMTDLVSTEDDVNLRVSTGLSAAIDEGRRRRCQSSRAIRLFVLQTAKKNVYTDNHS

SEQ ID NO: 174460 - protein, 164 aa, Glycine max
  Coding DNA Sequence Number=SeqID_57682
  Homolog annotation: Hit_ID=Q0WNH1; Match level="QueryCoverage=48%, HitCoverage=13%, E-value=5e-10, Identity=52%"; Hit description =STICHEL
  Subcellular localization annotation: CTP_CleavageSite=42; ConfidenceScore=5.04e-01
MSEMRVSELHLKKELTQIRKAARVLRDPGTTSSWKSPLSSSRSVAAWNNDTASRRLTTISQLGPNNTNDKDKRVFLYNWKNYKSSSEKYNDEEEEEEDDDGSSSLLGDRDRDSLSDARNGCDSKSDTYLAAAVGGGGGGGTRSSIFRCGDANLVSRRTVPVKKK

SEQ ID NO: 174461 - protein, 195 aa, Glycine max
  Coding DNA Sequence Number=SeqID_57683
  Gene Ontology: Mol. function=beta-N-acetylhexosaminidase activity; Biological process=carbohydrate metabolic process
  Homolog annotation: Hit_ID=Q1ZR57; Match level="QueryCoverage=96%, HitCoverage=23%, E-value=1e-18, Identity=33%"; Hit description=N -acetyl-beta-hexosaminidase
MDSWSTVSVGLQQHTQQLEQFTRLANSSHTLALQILAEALEPAHYYTRQHLKFQANNYHQFEPLNRLADALPAESDTVRSLNQWAERLISDAEDTESADALRHVFTRWQNNSGDALALTDNNYQLAAIKPVVQQVDKLASLGLRLTDLVARQGTLDDKEYASIQAQLDTAAKTQDELVIAAVYPLEKLLRATKIK

SEQ ID NO: 174462 - protein, 249 aa, Glycine max
  Coding DNA Sequence Number=SeqID_57684
  Gene Ontology: Mol. function=chitin binding; Cellular component =extracellular region; Biological process=chitin metabolic process
  Homolog annotation: Hit_ID=UPI000044A8F0; Match level="QueryCoverage =95%, HitCoverage=99%, E-value=3e-39, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
DCTSTFRDYTPSFRGIHVLTFRGLHVLAFRALHVLTFKGLHVLTFRGLQILTFRGLHALTFRGLHILAFRGLHTLTFKGLHVLTFRELHALPFRGIHVLTFRGLHVLPFRGFHALTFKGLQLLTFRGLHLLTFRRVHALTFRGPHTLTFRGLHAFTFRGQHLLTFRGLHVLPFRGLHILTFRGLHAITIRGKHVLAFRGLHALAIRGLHVLAFRGIHSLVFRGLHALAFRGLHLLALRGLRALAFRGLH

SEQ ID NO: 174463 - protein, 108 aa, Glycine max
  Coding DNA Sequence Number=SeqID_57685
MSMNRQAICRSYPPDHCRPYGGHQDWSNQTSSCQQWCPQKVKIFEIKNWTRLKREEYWIRCSLDENSVEDDKEGGIGAGDAPVAPGRGVRVAATEVDEPLHFLDNSSI

SEQ ID NO: 174464 - protein, 658 aa, Glycine max
  Coding DNA Sequence Number=SeqID_57686
  Gene Ontology: Mol. function=nucleotide binding; Cellular component =integral to membrane; Biological process=unidirectional conjugation
  Homolog annotation: Hit_ID=P09130; Match level="QueryCoverage=66%, HitCoverage=60%, E-value=1e-113, Identity=46%"; Hit description =Protein traD
  Pfam annotation: Domain name=TraG; Domain location=1-412; Score= -155.2; E_value=8e-05; Accession=PF02534.5; Description=TraGTraD family
MVKNAEVMNFLIHGTIGVGKSTLIRWLLDYIRRRGDRAIVYDSGGTFIETHYDERLDKILNAHDSRCENWVLWREARDVVDYENMTAALMPVEGDSDPFWVSSSRTIFSDTAMQFASRPDRSIETFLKTCLSIDLKSLREFLKNTPSANLVEEKIEKTAISIRSVLTNYAKSLRYLQGLDKEGKPEFSIREWMTDAQYDSSWLFISTTARHRKAVRPLISMWLSLATLLLQSMGENSDRRVWFVGDEIASLQKIPEFNETLAEARKFGGCFVLGIQNIPQLVHIYGREMAKAILDLLNTRAYGRSPSAEVAKMVEEELGHQRRREAREQNSYGLDQVRDGISISKDKVNEPIVDYDQIMKMPNLRFYVRLPGEYPVVKLSLKYRRQKKYHPALMERDFRDRLSPELERIIENNERSARAADISFPTGEEWLEGEDRASAPAPVKPAAASPSAAPAKADAPVTRPEPATVREVKPSVAPGQPAVPATPAPDISASSGASNVRPFPRREVVPRVTTVPAESSTPAIVPEGGTATAPSEIIRVVSTPAPARKEAGSPLSPLERMRRLQNSTSGNAETDSEAPAGEAPELHMQMEKDDGGRLTVRHISPRKTEQQREEERAALHGDANERMADDEKNILRHRDDYAAYQEMSDSLDPGGYER

SEQ ID NO: 174465 - protein, 404 aa, Glycine max
  Coding DNA Sequence Number=SeqID_57687
  Gene Ontology: Mol. function=hydrolase activity; Cellular component =membrane; Biological process=conjugation
  Homolog annotation: Hit_ID=Q5J499; Match level="QueryCoverage=87%, HitCoverage=54%, E-value=1e-61, Identity=41%"; Hit description=TraI protein
  Pfam annotation: Domain name=TrwC; Domain location=2-265; Score =266.5; E_value=5.4e-77; Accession=PF08751.1; Description=TrwC relaxase
MPTQWLGEGARELGLEGPVDLDTFTGILHGSLPNGVVLGKDVQGAHVHRPGHDFTFSAPKSVSMLILAGGDKRLLEAHHDAVKETLAIMEQMVSARDTKEGVTRITPTGKMVAALFTHDTSRNLDPQIHTHAVVANVTELDGKWKALATDAIHGAGFIETVYRNQITYGKIYRNLLKGKAEDIGYETLPTGGRHDLWEIKGFTGEVLDEFSSRHREIHARAGEDASLKSRDVAALDTRQRKQDISQYGADETAPLRTRQEPPASPELAVNASDRVPEAGTEATLKSAVREQEEPIAKPETADGRARLRDRWQRQMDDVGFDLQGVMNEAREREKSRPDAGEVQDAPVQAMEAVRTAISVLSDNKMRFTYGDILLTAHNAGELQTAFRPAQALDQRFIQPARPLD

SEQ ID NO: 174466 - protein, 90 aa, Glycine max
  Coding DNA Sequence Number=SeqID_57688
SALDGEEHIGEWRNPIGKITKITFPSHEGSALDGEEHIGEWKNPIGKITNITFPSQEGPLLTVKNTLENGGFNRENNKDHISQSRGPALD

SEQ ID NO: 174467 - protein, 279 aa, Glycine max
  Coding DNA Sequence Number=SeqID_57689
  Gene Ontology: Mol. function=amino acid-polyamine transporter activity; Cellular component=membrane; Biological process=amino acid transport
  Homolog annotation: Hit_ID=Q9FMC0; Match level="QueryCoverage=83%, HitCoverage=51%, E-value=3e-60, Identity=48%"; Hit description=Amino acid transporter-like protein
  Pfam annotation: Domain name=Aa_trans; Domain location=50-277; Score=- 155.8; E_value=0.052; Accession=PF01490.8; Description=Transmembrane amino acid transporter protein
MIDSNNNVNMSHHNPNFTGTKEVVVEDEESPLLALPLLRNREEDEQGSGSKASVTGSVFNLSTTIIGAGIMALPAAIKVVGVGVGVVAIVFLAFLTHTSLEILLRFTRVAKASTYANLMGDAFGSSGTLLFHLSVLINNFGILVVYVIIIGDVLSGTSSSGVHHFGVLEGWFGQCWWTARTFVLLLTTLFVFAPLGFFKRIDSLRHTSALAVALAIVFLLITAGITFVKLLNGSIASPRLLPNITDVTSIWNLFTAVPVLVTAFVCHYNGKLPDCILQF

SEQ ID NO: 174468 - protein, 101 aa, Glycine max
  Coding DNA Sequence Number=SeqID_57690
MKGFKSFKNNDYLQKKDCVVLKSREISSIREGKKSSSKALKVQMVGFNGSDNSEGSTNDKVALVSKKFKQMMKRKRKYHHFSRRKDTILKKKYNEERNEII

SEQ ID NO: 174469 - protein, 76 aa, Glycine max
  Coding DNA Sequence Number=SeqID_57691
MEMQRKIKEKRLKPYTTRMAKIQGPKERKTYSNIYKEEWIQPWPMGSKIYPKVLENPRAFFSSSSPILLESSIQYP

SEQ ID NO: 174470 - protein, 86 aa, Glycine max
  Coding DNA Sequence Number=SeqID_57692
IATREHKADNQVSSTAHVCLLKSFLRITLDVHDNLGQETKVQQRLTMSEAISALVKEFSNRRTDHLGRKRRGRRFLVRVTKAALDS

SEQ ID NO: 174471 - protein, 101 aa, Glycine max
  Coding DNA Sequence Number=SeqID_57693
MLRWHKALGSYLAHGPEICPKAHENHRAFACISGPIYLESSIQCPCGVGLHHIGTKVVEGNDGNPMTPETLGGRLAIFIVPNCIGEGPKASMPVTGPMTIS

SEQ ID NO: 174472 - protein, 82 aa, Glycine max
  Coding DNA Sequence Number=SeqID_57694
MEWFHRISQPFMTAPREPSRHSPMVHDDTFIIQDPSQQGIDAAAMPKPPSHVAADDACQRITKNLENMINMRMVTPKLNHTL

SEQ ID NO: 174473 - protein, 65 aa, Glycine max
  Coding DNA Sequence Number=SeqID_57695
MEEMWHLQSSFFLLHFAVIDLQEANDSIDEEYPKPTSSTWRHITKEGEVGKFQDSKQVEGMMVKV

SEQ ID NO: 174474 - protein, 236 aa, Glycine max
  Coding DNA Sequence Number=SeqID_57696
  Subcellular localization annotation: CTP_CleavageSite=61; ConfidenceScore=5.19e-01
MGKKSTLRLMRTLGPSPASLAQSSWSLLSNALGGVGLHHLPLPSQPMLKFASPPPSKAEVVAIAKAKQFYHVDAKKRARANYVRKRAIEGFDVASKSDIVETDLGVAPLHPRPVTVEDEVIVDALLAQPMLEIYISRLKSIYGATKYVSFNAMNVRLEIRKKVDTTAAPKLLIDIFNKLHPRLSITNIDSINWLLHSRSQPWTKPELVLVSNGNIRIYHGFRGYGLSKGQTNNQAW

SEQ ID NO: 174475 - protein, 56 aa, Glycine max
  Coding DNA Sequence Number=SeqID_57697
MAGVGRYMAPTDIFQPTLRNFLYKRWPIMTARFFGASSTEGSFRPTLACCSSHLGG

SEQ ID NO: 174476 - protein, 421 aa, Glycine max
  Coding DNA Sequence Number=SeqID_57698
  Gene Ontology: Mol. function=nucleic acid binding; Cellular component= intracellular; Biological process=DNA integration
  Homolog annotation: Hit_ID=Q1S330; Match level="QueryCoverage=52%, HitCoverage=21%, E-value=1e-60, Identity=54%"; Hit description =Integrase, catalytic region; Zinc finger, CCHC-type; Peptidase aspartic, catalytic
MNLINVLDINNFSKCPISVEAKYAKKPFKPVKNRTTELLELIHTDLADFKNTVSRGVPLHLHTSSSVINEQVNEPRRSKRKRIESSFGPDFVTAFVVENNDVDKINDVFVSTFLIEEDPKTYNEAVTSIDANFWKEAINSELDSIMYNHTWDLVDLPKGSKPIRCKWIFRKKLRTDGTIDKFKARLVVVGYTQKKEIDYFDTYSPVTKISTIRSLVALAAIHGLIVHQMDVKTAFLNGDLREEIYVEQPEGYVIQGQENKVWSVMFLMNCTRPDIAYAVSRLSRYTHNPGGGAISWKSSKQTCIARSTMESEFIALDLAGQEAEWLRNLLADVPLWGKRSILVSLHCDSEAAIGIAKNSVYNGKRRHICIRHSSVRELLKNGVISLQFVRSENNLADPFTKGLTKKVVLESSRGMGLKPLC

SEQ ID NO: 174477 - protein, 82 aa, Glycine max
  Coding DNA Sequence Number=SeqID_57699
  Homolog annotation: Hit_ID=Q1SAS4; Match level="QueryCoverage=100%, HitCoverage=3%, E-value=1e-20, Identity=66%"; Hit description=RNase H, putative
MVVRAFDGTRREVRGEIDLPIQIGPHTCQVTFQIMDINPPYSCLLGRPVDPFGGSRSLYTPPEIEVRSGRAFGYRIERGRHL

SEQ ID NO: 174478 - protein, 102 aa, Glycine max
  Coding DNA Sequence Number=SeqID_57700
MQFGVEKLVRSNYKYWRLCMEAFLQGQDLWDLMAKNDMKMPPDTPDTMEARRKWKVKYGKMLFVLRMTVNKELIDHIRDLDTPKDVWETLEKLFSKKNVARL

SEQ ID NO: 174479 - protein, 99 aa, Glycine max
  Coding DNA Sequence Number=SeqID_57701
  Gene Ontology: Mol. function=nucleoside-triphosphatase activity; Cellular component=nucleus; Biological process=meiotic recombination
  Homolog annotation: Hit_ID=Q96449; Match level="QueryCoverage=74%, HitCoverage=90%, E-value=3e-12, Identity=67%"; Hit description =Meiotic recombination protein DMC1 homolog
MHNTVLVWILEYTFCLRLNHMHIRSYCSRHQCRRCDEASGRRDIYLQWLDDAHEEVISDPGGGVFVTDPKKPAGGHVLVHAATSYVFQITAGGIADAKD

SEQ ID NO: 174480 - protein, 104 aa, Glycine max
  Coding DNA Sequence Number=SeqID_57702
  Subcellular localization annotation: CTP_CleavageSite=41; ConfidenceScore=5.25e-01
MAQKLVSPMIKGFSFPLAILHFQIREPYRSQCNLFTPTNPRQSAATGRRNPKILKPTTILSTPDTDDGAALDVTGKSVEFLAAEYAEDSAECLYVYKNVYSLIP

SEQ ID NO: 174481 - protein, 290 aa, Glycine max
  Coding DNA Sequence Number=SeqID_57703
  Gene Ontology: Mol. function=protein serine/threonine kinase activity; Biological process=protein amino acid phosphorylation
  Pfam annotation: Domain name=LRR_1; Domain location=13-34; Score=3.4; E_value=65; Accession=PF00560.23; Description=Leucine Rich Repeat
  Pfam annotation: Domain name=LRR_1; Domain location=36-58; Score =17.3; E_value=0.057; Accession=PF00560.23; Description=Leucine Rich Repeat
  Pfam module annotation: Pfam domain module=LRR_1::LRR_1; Domain location=13-34::36-58
MKTLPAEITYLKGLISMKVANNKLVELPAAMSSLSRLESLDLSNNRLTSLGSLELASMHRLQELNLQGNDEARYKDDCSSSVEMDLYESNFQENDETLSDGEAYNAFGPHNTSSSMLTSPSSSSRCFASRKSGKRWKRRYYLQQKARQERLNNSRKWKAVDHDDLLLSKKIHRISESGNHDSLASESCAEIESENGSLDDNNKRIFSERAVNDNAIDNDNNDEVITEKQFSGEDCCTTESKDEKDASLCSLEKRQSEQEEASCLELLESVSKSKRHLDRDLDNPKPCKSR

SEQ ID NO: 174482 - protein, 139 aa, Glycine max
  Coding DNA Sequence Number=SeqID_57704
  Gene Ontology: Mol. function=protein serine/threonine kinase activity; Cellular component=membrane; Biological process=protein amino acid phosphorylation
  Homolog annotation: Hit_ID=Q2HTT4; Match level="QueryCoverage=97%, HitCoverage=23%, E-value=7e-09, Identity=33%"; Hit description =Protein kinase
  Pfam annotation: Domain name=Pkinase; Domain location=1-139; Score= -114.9; E_value=0.1; Accession=PF00069.15; Description=Protein kinase domain
SYLEKLSEAGEKHVPVELALLIAKDVSCALSELHSRHIIHRDIKSENILFDLDRKRDDGTPTVKLCDFDSAVPLRSTLHACCIAHAGTPPPCVCVGTPRWMAPEVMRTMYKKNSYGLVRSSSYQSAIYFEFITNCVADI

SEQ ID NO: 174483 - protein, 184 aa, Glycine max
  Coding DNA Sequence Number=SeqID_57705
MEAMKEQMTTMMEAMMSMRKMMEVNTAIVVVVSITTEVDPTHPPGLNQVQSKHSFPPYGLPPNAAHALDENVDNSAAIPIESQQPQAGPPAMVEKDKFDHIEERLRVIEGGRNYAFANMAELCLVPDVVIPPKFKVSDFDKYNGTTFPKNHLKMYYRKMGAYTKDEKLLMHFFQESLTGAAITW

SEQ ID NO: 174484 - protein, 565 aa, Glycine max
  Coding DNA Sequence Number=SeqID_57706
  Gene Ontology: Mol. function=oxidoreductase activity; Cellular component=glycerol-3-phosphate dehydrogenase complex; Biological process=glycerol-3-phosphate metabolic process
  Homolog annotation: Hit_ID=Q1M4Q3; Match level="QueryCoverage=53%, HitCoverage=97%, E-value=1e-137, Identity=75%"; Hit description =Putative erythrulose 4-phosphate dehydrogenase
  Pfam annotation: Domain name=AP_endonuc_2; Domain location=284-499; Score=-3.1; E_value=0.02; Accession=PF01261.14; Description=AP endonuclease family 2
GQQAYLVQNTDKRVIFINPYEGDKALIGTTDIPWQGKAEDVSADDSEQQYLIDVVNRYFKVKLRASDVITRFSGVRPLFDDGKGNPSAVTRDYVFDLDNQQDAPLLHVFGGKITTFRKLAEHALQQLAPFFPNMGADWTRSATLPGGEIAHADFDSFLEEIKTRWPWLPQPLRKHYARLYGARMSTLLGTAGSLSDLGEHFGGQLYEAEVRYLVQYEWAQQPEDILWRRTKHQLHLSAAQRTAFSQWCRMPLTLSLNTNPLVNRFADPGDLIHTVAQQIRIRDLQLTHEFINPGWPAATLTHMTRRMQQALRATGVRVTSGMTGPYGRLNHFGHPDAAVRRYYIDWFKTFADITAELGGVAVGSQFAIFTQRDFNDAARREALIAIAIDCWAEVAEHAKAAGLRYLFWEPMSVGREFGETIPACMALQQRLSAAQFALPMWMMADIDHGDVTSADPRDYDPYAWAEAVPRVSPIIHIKQSMMDKGGHRPFTLQYNAGGRIQPQPLLEALARGGAQDNEICLELSFKEREPTDSNVVAEIAESVAFWADHIDTRGAGFASRVSMPC

SEQ ID NO: 174485 - protein, 93 aa, Glycine max
  Coding DNA Sequence Number=SeqID_57707
MPVAGGDFNYLRVTFGACFPMPWSLEIGISSAKWRLTVPSLPKGFNEIDFVVVAVILLITLVIATEALGVAKPSVASYLSQEILAEQEVDRVH

SEQ ID NO: 174486 - protein, 37 aa, Glycine max
  Coding DNA Sequence Number=SeqID_57708
DHEQLGVSYYYLRNKGDITSTDVKDTRLPPSSASLTS

SEQ ID NO: 174487 - protein, 115 aa, Glycine max
  Coding DNA Sequence Number=SeqID_57709
MFDQQAAVSPGKPPKSPDHEVNDPLHLTETSMRVGNSDVYGFLEPQSIQRYGQSQFESESYIKSWMQSSKRDVYLRAYLNGPDNYLKGIINSALKGLDDTPQPKSKAVARWIVVK

SEQ ID NO: 174488 - protein, 142 aa, Glycine max
  Coding DNA Sequence Number=SeqID_57710
  Gene Ontology: Mol. function=transferase activity; Cellular component= nucleus; Biological process=regulation of transcription from RNA polymerase II promoter
  Homolog annotation: Hit_ID=Q9LXM2; Match level="QueryCoverage=68%, HitCoverage=34%, E-value=1e-23, Identity=62%"; Hit description=CCR4 -associated factor 1-like protein
MSLESALLETSNMATRCALRRANQPDDFSLRRVPPSTTEKLGPVHHAANDIVADQTGQHHQFCESKRVDPKVVILLEIDALAMQQLNIVMGVGVTCDVEISEVEFPDEGVGGAEGGKISRIVGKGEADLDQVEAITLALSTT

SEQ ID NO: 174489 - protein, 109 aa, Glycine max
  Coding DNA Sequence Number=SeqID_57711
  Subcellular localization annotation: CTP_CleavageSite=32; ConfidenceScore=5.07e-01
MKEPSKKRKGTSSRSQRHSGAQEAPIPSSIPSGSLFSSEEQRIRYTNLFSSRSIEDPKFIDMEFFSNENFECFQAFENSNLIPFMSLKLPVYYELVKAFYSNLEIMKVF

SEQ ID NO: 174490 - protein, 44 aa, Glycine max
  Coding DNA Sequence Number=SeqID_57712
MISKVMVGVRLGRRPMAVSQPSLSVLAYVYGSASTRREMIPNIT

SEQ ID NO: 174491 - protein, 139 aa, Glycine max
  Coding DNA Sequence Number=SeqID_57713
  Gene Ontology: Mol. function=hydrolase activity
  Homolog annotation: Hit_ID=Q4HIX7; Match level="QueryCoverage=39%, HitCoverage=45%, E-value=7e-19, Identity=81%"; Hit description=Cell wall-associated hydrolase, putative
MRTTCTWTERPYEASLFPGIGFGLFLRSLGGGQRRPPSGGARAISLPKGNGGVQRFPRARRRLALECKGRRELDCKTHPSSRDETHIDGKVWHLDVGSSPPGAVVCSKGWAVRPLKRYVSWVQNVVRQFGPYPVWALEH

SEQ ID NO: 174492 - protein, 82 aa, Glycine max
  Coding DNA Sequence Number=SeqID_57714
MPFGEALQQCPLYSKFLKDMLTRRHKRLGELEIMPTQMTLQLADRSITKPYGVIEDVLVRVKHLSSQQTLWSWISLKILTSL

SEQ ID NO: 174493 - protein, 222 aa, Glycine max
  Coding DNA Sequence Number=SeqID_57715
  Gene Ontology: Mol. function=oxidoreductase activity; Cellular component=membrane
  Homolog annotation: Hit_ID=Q2XK55; Match level="QueryCoverage=85%, HitCoverage=76%, E-value=4e-75, Identity=70%"; Hit description =Hypothetical protein precursor
MAVGSTAMGALVAPMAADAAASSAAAPQQAREYQPVWFTAEEFAFIKAAVARLIPNDERGPGALEAGVPEFIDRQMNTPYATGSNWYMQGPFNPDLPKELGYQLPLVPQQIYRLGLADADGWSKQQHGKVFAELTPTQQDALLSAFENGSAQFPQVPAKTFFAFLLQNTREGYFSDPIHGGNQGMVGWKLIGFPGARADFMDWVERGERYPFPSVDIRGERA

SEQ ID NO: 174494 - protein, 673 aa, Glycine max
  Coding DNA Sequence Number=SeqID_57716
  Gene Ontology: Mol. function=calcium ion binding; Cellular component =extracellular region; Biological process=pathogenesis
  Homolog annotation: Hit_ID=Q8XQP2; Match level="QueryCoverage=57%, HitCoverage=85%, E-value=9e-32, Identity=32%"; Hit description =Probable hemagglutinin/hemolysin-related protein
  Pfam annotation: Domain name=CBM_4_9; Domain location=374-523; Score=- 14.2; E_value=0.046; Accession=PF02018.8; Description=Carbohydrate binding domain
LVAEGSTQADAFGHWQVEIARLDGGAGPYHFQASNSPTRDPAAPLFDLYVSDNGTRLKPTIDAAHDNVGPEQGKLINGATTDDMAPTLQGKAEANSMVYIHARHIDGHWVVLGSVKADAWGNWITEVRALRGGYGTYEFQAAKTPDRDTSAEVFSLNMVPEKPGIVSAWDNFGAQTGVLHQGDVTDDLTPTLKGHAAANSVVYIYARHVNGVWVTLGSAVADAHGHWQSEVRALRGGFGKYEFQVSDSPVRDAAADVFDLTIISGKTEIISAWDDSGPKQGQLKSGDITDDMTPTLKGTSAPNKVVYIFGCHIEGHWVLMDSVTADATGNWSYQSYDRSPWKGLTQFQVSDSAIRDVNAPTFLLEINVDPPKVDHKGLVWNFNDGTQQGWIASGLYHKNDNIGVKRWSAGNSSYELGSMTNGSNTNGFKGEVVYRYIQVEAGKTYQFDFDGYRIPGGSLKPKIGLDVNGQKVIPNMGLDAAWNHFSGLYTASKTEVVRVAVTNEVNNGNGNDFAIDNIGVKEISRVRGQPDLVKDANGHPRYIDFKTGVSYTIDDSLKMTLIKGPNIGGEQKTLKHGEIIVGRGGQMKLDFDGVAEKVVLKSDYVHSKGNYIDFYDTQGKLLHSYELKAHPGTLRSDIVEYHAPAGKLIGSAVVRVNPAEVDSVNNPGRRAHQ

SEQ ID NO: 174495 - protein, 142 aa, Glycine max
  Coding DNA Sequence Number=SeqID_57717
  Subcellular localization annotation: CTP_CleavageSite=45; ConfidenceScore=5.57e-01
MAISSSTRQLAPVSPSSMACCTKLGLASLTGELRVGVCSSQATCSSFAGGGTAFWWKTPVLLAICAAGSRYSFKVHDEFDYNSVVFQWKGSKKAIQIKRGISFNALKKKIGDKENILPCKFLMTKTLRRCWKVLNNNKKCQF

SEQ ID NO: 174496 - protein, 124 aa, Glycine max
  Coding DNA Sequence Number=SeqID_57718
  Gene Ontology: Mol. function=RNA-directed DNA polymerase activity; Cellular component=intracellular; Biological process=RNA-dependent DNA replication
  Homolog annotation: Hit_ID=Q1SAS4; Match level="QueryCoverage=100%, HitCoverage=5%, E-value=5e-36, Identity=54%"; Hit description=RNase H, putative
MKPHKEETEIVNLGVGEEKKEVKVGTGMTTPTRDGLVALLRDYQDIFAWSYQDKPDLNPDTVQHRLPLNSGCSPVKQKLRRMKPEMSLKIKEEVKKQFDVGFLAVARYPEWVANIVPVPKKDGK

SEQ ID NO: 174497 - protein, 56 aa, Glycine max
  Coding DNA Sequence Number=SeqID_57719
MLEKESDMGVWKSSKQDGPSQFDDWFEGPTTESNPPQTPEQDLLNGEARYDTKYSA

SEQ ID NO: 174498 - protein, 73 aa, Glycine max
  Coding DNA Sequence Number=SeqID_57720
MLNPTQKRRCKMLLMNSLSEADWLSEAHPLSEASSLLSRWETLEEDKSEIYALHAQPACPTLSLLTLSAPTLA

SEQ ID NO: 174499 - protein, 68 aa, Glycine max
  Coding DNA Sequence Number=SeqID_57721
MGSSLAMGCSYQLDVCVCGSCGGGVKGDEGWLLYEDTGLLRSMLLYDNCCGGGSCSCGHEGCGDDGCG

SEQ ID NO: 174500 - protein, 46 aa, Glycine max
  Coding DNA Sequence Number=SeqID_57722
MWQEYEGDLWGPDPTKKRTAKGRPVSTHIPTEMDEDENERSNYYTK

SEQ ID NO: 174501 - protein, 71 aa, Glycine max
  Coding DNA Sequence Number=SeqID_57723
MKKACGANDHMLIFRCVHYFSGSRGRTTFMLTGCERSGEYRCRKKEFIKRETRKCGCPFKLRCKQVVGGEG

SEQ ID NO: 174502 - protein, 176 aa, Glycine max
  Coding DNA Sequence Number=SeqID_57724
  Homolog annotation: Hit_ID=UPI00005F7ECE; Match level="QueryCoverage =94%, HitCoverage=74%, E-value=4e-17, Identity=34%"; Hit description =COG2200: FOG: EAL domain
  Pfam annotation: Domain name=EAL; Domain location=1-162; Score= -103.0; E_value=0.00083; Accession=PF00563.11; Description=EAL domain
MDQINLIDKYKHWFHENQVIATLNVDDYSLQSLANTHFAERINAMRCIHFEISENSTRLVKDRVHGDPSLNSYSFWLDDFGSGYAGFSALYNSQFRFVKLDRFLLWDFMKKSGGEGLMRALLRFFYLNHYKVIIEGVETPEHKKWLDEMPYYALQGKLWKESSIKDLNSLLTAEYF

SEQ ID NO: 174503 - protein, 82 aa, Glycine max
  Coding DNA Sequence Number=SeqID_57725
  Subcellular localization annotation: CTP_CleavageSite=59; ConfidenceScore=5.25e-01
MVPLMALLLVISRHWPQFLALFGAGNEAPRLTLNLRADPLPQGNPVSSSSSSGSSPGTCASSGSGVTSSGRSDISTSIPHIG

SEQ ID NO: 174504 - protein, 58 aa, Glycine max
  Coding DNA Sequence Number=SeqID_57726
MKGQLQDQDSSFLVRDPLLEAKEPLKELIHSPLKVVNLGEQKLLVKMNLLDLLLPTLY

SEQ ID NO: 174505 - protein, 144 aa, Glycine max
  Coding DNA Sequence Number=SeqID_57727
MVGKDLGSTDDPMMCKFKTSTPSHHMACLPNYTPPNVVYIPNEDVNNSTPILIKSQQPQSDHAHVSRPMEETHEIPHHDLANFEPCLGYAAEGQAVGGIPLQNTLEGPQYHPQLHLLHSTADKNPHDYGRNGKVGSSKGKAHGR

SEQ ID NO: 174506 - protein, 90 aa, Glycine max
  Coding DNA Sequence Number=SeqID_57728
  Subcellular localization annotation: CTP_CleavageSite=78; ConfidenceScore=5.37e-01
MRFMRTLGPSSAALAQSSWSLLLMALVTGPFLGRIASYGTVGPTGWSMDSSPFTHLYMLLNRKTWSESVGLGKTSPLMAMPKVKQDITQY

SEQ ID NO: 174507 - protein, 141 aa, Glycine max
  Coding DNA Sequence Number=SeqID_57729
FASTDSSEFPPIKLAIEAKGEESSEEIYPQEEGQPLVVKEKCKGASVSSKSLAKKETHFTIKTLAKKTLASIATPLGLEFIPQVKKLLDEGLVCKSLNPCALLGPRIGIIKHQVPKIGGMMNVLNGATLFCKITRAPNIFM

SEQ ID NO: 174508 - protein, 219 aa, Glycine max
  Coding DNA Sequence Number=SeqID_57730
  Homolog annotation: Hit_ID=Q8H6Q8; Match level="QueryCoverage=95%, HitCoverage=7%, E-value=4e-14, Identity=25%"; Hit description=CTV.20
MEKATPSDPRPAPIIEDIKQDNSGKVEIAFNRRNSFSSRIKASRSEYESARRSFSVRTCSIPVGLTRSELHNQFPTVYLQGLDTTSSIPRMTYNQHQEDDQKKDFDSSVNDPQRRWFFQNYRGTNRKQIQDKFYEFVERVKVNVLFFDWFHAYSIKKDIDYPWKQDIIGDPSTNIISNWQVRDGEMIQSELPPTTKYQLPNIKDSNNKPVMATPFKTRY

SEQ ID NO: 174509 - protein, 122 aa, Glycine max
  Coding DNA Sequence Number=SeqID_57731
MSVFACYQAFCLTDSKKNFYTANHSGISASHRDSNVSMTDLVSAEDDVNLRVSTCLSAAFDEGRRRRYSKKNVYTANHSGISAGQCDSNVSMTDLVSAEDDVNLRVSTGLSVPIGEGRRRRR

SEQ ID NO: 174510 - protein, 243 aa, Glycine max
  Coding DNA Sequence Number=SeqID_57732
MGEQWRQFKYDLTSKWAFAADKESVDDTDMRKKAQANQKHNIAPHVLSREGYEYSENKLMDEKRKKKLEEAAQSGSTDTVIDPLSPIRQHMKWKMARTKKTGQMTSEAAKEIAEKIESLEEQASYGFFVAIGRPEHRSRVGVVGVGVTIKKYFGLAPRTSRMSSSMAPEDLEQLMQQIRDQLEESITEKCFEGLDDTPQSKSKAGARWIVVKYFNDVRPLEPERLKALRIQWAKYYLKVRNET

SEQ ID NO: 174511 - protein, 80 aa, Glycine max
  Coding DNA Sequence Number=SeqID_57733
MAGTFFLLKKQNSLEIMSGEKEMTPNRVVNWPFRTLYTIKPVIILGMPQKVLLEYMTFMESLAKRRKCKEVVFFVTFMAL

SEQ ID NO: 174512 - protein, 91 aa, Glycine max
  Coding DNA Sequence Number=SeqID_57734
MGRSRRCGCSNLERAKHGSDSGFVWDMMLGDYTSAKGDDGSGGGWWMKVLFAADRRRIAVLGSDGRPQANAGVIGNCGEEGRVKFGGEGVQ

SEQ ID NO: 174513 - protein, 501 aa, Glycine max
  Coding DNA Sequence Number=SeqID_57735
  Gene Ontology: Mol. function=oxidoreductase activity; Cellular component=integral to membrane; Biological process=electron transport
  Homolog annotation: Hit_ID=O81974; Match level="QueryCoverage=98%, HitCoverage=98%, E-value=1e-165, Identity=58%"; Hit description =Cytochrome P450 71D8
  Pfam annotation: Domain name=p450; Domain location=32-496; Score =403.6; E_value=2.8e-118; Accession=PF00067.12; Description =Cytochrome P450
MEAQSYLLLIGLFFVLHWLAKCYKSSVSQKLPPGPKKLPIIGNLHQLAEAGSLPHHALRDLAKKYGPLMHLQLGEISAVVASSPKMAKEIVKTHDVSFLQRPHLVFGQMISYGGLGIAFAPYGDHWRQMRKMCATELLSTKRVQSFASIREDEAAKFIDSIRESAGSPINLTSRIFSLICASISRVAFGGIYKEQDEFVVSLIRKIVESGGGFDLADVFPSIPFLYFLTGKMTRLKKLHKQVDKVLENIIREHQEKNKIAKEDGAELEDQDFIDLLLRIQQDDTLDIQMTTNNIKALILDIFAAGTDTSASTLEWAMAEMMRNPRVREKAQAELRQAFREKEIIHESDLEQLTYLKLVIKETFRVHPPTPLLLPRECSQPTIIDGYEIPAKTKVMVNAYAICKDSQYWIDADRFVPERFEGSSIDFKGNNFNYLPFGGGRRICPGMTLGLASIMLPLALLLYHFNWELPNKMKPEEMNMDEHFGLAIGRKNELHLIPNVNL

SEQ ID NO: 174514 - protein, 281 aa, Glycine max
  Coding DNA Sequence Number=SeqID_57736
MEDICKRWTEYLDSTRSRVNHPQSINCDFCGEEHFNDNCHLYSMKNSWWGQELYPYNQYEERTPNLESVFTKFTAYHPSSTANQNSMQNQEIQVGNSYSMENYQWEQELQPYNQYEEERTSNLDTLLMQFKEVTEYTQQAFKSLEIQVGKLAEEVTKFMARREENFIKVEAQEESPVRKHDSKEKDEDKSEEKAQQWEKYSQVEIQQESILQVNTHPHQLIVKEERHGEHEKALSAILSLITSTSLAMIWKVLPEYMTFMESLARRQKYKEYVFFVTFMPP

SEQ ID NO: 174515 - protein, 165 aa, Glycine max
  Coding DNA Sequence Number=SeqID_57737
  Gene Ontology: Mol. function=protein dimerization activity
  Homolog annotation: Hit_ID=O81190; Match level="QueryCoverage=82%, HitCoverage=26%, E-value=9e-14, Identity=28%"; Hit description =Putative transposase
  Pfam annotation: Domain name=hATC; Domain location=47-116; Score=5.9; E_value=0.0077; Accession=PF05699.5; Description=hAT family dimerisation domain
MDRAKEEIQRAFNNNEGKYKDILAIIDKRWDCQLHRPLHAAVEVHKQLPVYRRAGERFGMTVAMKARTEISPAKWWKLYGGKTPHLQTIVIKIHSKKRSRLEHQKLQDLVYVKYNQDLLDRFECHDVIDPIALNDIDDNNEWLLGELEGEEAGNDLVFDEDDDLN

SEQ ID NO: 174516 - protein, 194 aa, Glycine max
  Coding DNA Sequence Number=SeqID_57738
  Gene Ontology: Mol. function=ligase activity; Cellular component =cytoplasm; Biological process=response to auxin stimulus
  Homolog annotation: Hit_ID=Q3LFT5; Match level="QueryCoverage=57%, HitCoverage=18%, E-value=2e-31, Identity=66%"; Hit description =Putative auxin-regulated protein
MLEKVEEFNMDKVIQEFELLTRDAERVQRETLKRILEDNASAEYLQSLGLNGRTDPESFKACVPMVTHKELEPYIYRIIDGDASPILTGKPITTMSLSFWMIFLQFWHYPGETKGVSYNVVVTVKQDEIEISGLITGFGDAMHKGFVLDWMRAQDCVVCEESNGYCKFDQATKQSRCLCSDGRTEAKSCKKGAR

SEQ ID NO: 174517 - protein, 70 aa, Glycine max
  Coding DNA Sequence Number=SeqID_57739
MKENLRAGESRSTRQPPSGREDHLVPKSHTGSQLSCAKQGARARLVGREPFIWSIPSAFFAIFLHFLPHP

SEQ ID NO: 174518 - protein, 157 aa, Glycine max
  Coding DNA Sequence Number=SeqID_57740
MVYDKAAIAFRGSKALTNFIKPPTREDLCDCGPNETEASVAVSGENDSSEESHLSSPTSVLGLQSVELMLDEVSETDLPSKEESSSQDSFLFLDSHSPSIDCYFNFETLPPVFLHETSITQQPDFHDKFSDISHLVNEDFQSWNWDIDSYFSDPLLI

SEQ ID NO: 174519 - protein, 47 aa, Glycine max
  Coding DNA Sequence Number=SeqID_57741
MANLPDILRFSINSVERASDIERDKFGNTAKCKLASSPSITGKHGLL

SEQ ID NO: 174520 - protein, 492 aa, Glycine max
  Coding DNA Sequence Number=SeqID_57742
  Gene Ontology: Mol. function=nucleotide binding; Cellular component =protein complex; Biological process=microtubule-based process
  Homolog annotation: Hit_ID=P38557; Match level="QueryCoverage=99%, HitCoverage=99%, E-value=0.0, Identity=85%"; Hit description=Tubulin gamma-1 chain
  Pfam annotation: Domain name=Tubulin; Domain location=46-247; Score =329.3; E_value=6.8e-96; Accession=PF00091.15; Description =TubulinFtsZ family, GTPase domain
  Pfam annotation: Domain name=Tubulin_C; Domain location=249-413; Score=102.0; E_value=1.7e-27; Accession=PF03953.7; Description =TubulinFtsZ family, C-terminal domain
  Pfam module annotation: Pfam domain module=Tubulin::Tubulin_C; Domain location=46-247::249-413
MPREIITLQVGQCGNQIGMEFWKQLCLEHGISKDGILEDFATQGGDRKDVFFYQADDQHYIPRALLIDLEPRVINGIQNSDYRNLYNHENIFVSDHGGGAGNNWASGYDQGQHVEEQILDMIDREADGSDSLEGFCLCHSIAGGTGSGMGSYLLETLNDRYSKKLVQTYSVFPNQMETSDVVVQPYNSLLTLKRLTLNADCVVVLDNTALNRIAVERLHLSNPSFAQTNSLVSTVMSASTTTLRYPGYMNNDLVGLLASLIPTPRCHFLMTGYTPLTVERQNDFGASKLFHKFVSSLVKISVGKLLNWKANLIRKTTVLDVMRRLLQVYSWQAKNIMVSSYARTKDASQAKYISILNIIQGEVDPTQVHESLQRIRERKLVNFIEWGPASIQVSGLMLASHTSIRHLFSKTLSQYEKLRKKQAFIDVYRKFPMFADNDLSEFDESRDIIESLVDEYKACESPDYIKWGMEDPNNMLTGEGNATGSLDSKSVA

SEQ ID NO: 174521 - protein, 357 aa, Glycine max
  Coding DNA Sequence Number=SeqID_57743
  Gene Ontology: Mol. function=transporter activity; Cellular component= mitochondrial inner membrane; Biological process=transport
  Homolog annotation: Hit_ID=Q6ZA15; Match level="QueryCoverage=96%, HitCoverage=84%, E-value=1e-123, Identity=63%"; Hit description =Putative mitochondrial carrier protein
  Pfam annotation: Domain name=Mito_carr; Domain location=15-144; Score= 78.0; E_value=2.9e-20; Accession=PF00153.17; Description =Mitochondrial carrier protein
  Pfam annotation: Domain name=Mito_carr; Domain location=152-254; Score=44.3; E_value=4e-10; Accession=PF00153.17; Description =Mitochondrial carrier protein
  Pfam annotation: Domain name=Mito_carr; Domain location=263-355; Score=74.5; E_value=3.4e-19; Accession=PF00153.17; Description =Mitochondrial carrier protein
  Pfam module annotation: Pfam domain module=Mito_carr::Mito_carr::Mito_ carr; Domain location=15-144::152-254::263-355
MSPTHTNTNSDTQLRIQERALSAAGAAFVSAIIVNPLDVAKTRLQAQAAGVPYQGVCQMAPFQTNTTPHDIRCSAVSSSEPPLPCPSVCNRYKGTLDVLYKVTRQEGFPRLWRGTSASLALAVPTVGIYMPCYDILRNMVEDFTTQNAPNLTPYVPLVAGSVARSLACISCYPVELARTRMQAFRATQSGKPPGVWKTLLGVIHPDKGTNIFQSLHRYRFWWTGLGAQLSRDVPYSAICWSTLEPIRKSILGLAGDGASAATVLGANFSAGFVAGTLASAATCPLDVAKTRRQIEKDPERALKMTTRTTLLEIWRDGGLRGLFTGVAPRVGRAGPSVGIVVSFYEVVKYVLQLRHPT

SEQ ID NO: 174522 - protein, 196 aa, Glycine max
  Coding DNA Sequence Number=SeqID_57744
MDSHALELSNYVIANSCEVVLFVECFGDNEVVVDDNFSKDDNDESLKNAYVYVHKNDDIPNSQRVNKDVDGKKVVVGGKKPDGRGKQGAGWGKKVVDRDNKGTSGGNKPTGRGKRVEHNLLNVNGSFLVSPNLPKDDIEDGYVSEQLCNDDSDEDVLKKKYERFNPKLLCKEFKWRLGLEFVFDRLASPPICPSSN

SEQ ID NO: 174523 - protein, 55 aa, Glycine max
  Coding DNA Sequence Number=SeqID_57745
MEFSQSHRVEMISMAVALVAIVGGTAYYYYVTKKPKENISKNSTPCREENRKGHF

SEQ ID NO: 174524 - protein, 110 aa, Glycine max
  Coding DNA Sequence Number=SeqID_57746
MCNYRIGCLRMLPDFSQRRVLHVIELGGLWMTKEGCGRPYIVSACHRTCRLWMTKCADNHKVCPRATGPSGHDSRIETFSRSRRKDVDISEKGVDDHIGLCMSTGLLAFS

SEQ ID NO: 174525 - protein, 70 aa, Glycine max
  Coding DNA Sequence Number=SeqID_57747
MPAGIGQQSLYVWVTWIISLIKVLDAPNESGRTRSERPAPSQRGAVVPIARAELSGIVKAGHCVAACACL

SEQ ID NO: 174526 - protein, 127 aa, Glycine max
  Coding DNA Sequence Number=SeqID_57748
  Gene Ontology: Mol. function=two-component sensor activity; Cellular component=membrane; Biological process=two-component signal transduction system (phosphorelay)
  Homolog annotation: Hit_ID=Q8P9W8; Match level="QueryCoverage=86%, HitCoverage=51%, E-value=8e-34, Identity=55%"; Hit description =Chemotaxis protein
  Pfam annotation: Domain name=PAS_3; Domain location=43-125; Score =46.4; E_value=9.7e-11; Accession=PF08447.1; Description=PAS fold
  Pfam annotation: Domain name=PAS_4; Domain location=27-126; Score =21.9; E_value=0.0014; Accession=PF08448.1; Description=PAS fold
  Pfam module annotation: Pfam domain module=PAS_3::PAS_4; Domain location=43-125::27-126
MHWFPFKRLFRRKRDTRNADLYGQIAAIHKAQAIIEFDLDGHVLMANQNFLDAMGYTLDELRGQHHRIFVAPDRRGSPEYQAFWDKLKRGEYDAGRYRRIHKDGSDVWLQASYNPILDESGRPFKVV

SEQ ID NO: 174527 - protein, 170 aa, Glycine max
  Coding DNA Sequence Number=SeqID_57749
  Homolog annotation: Hit_ID=Q8TGM6; Match level="QueryCoverage=47%, HitCoverage=65%, E-value=6e-09, Identity=52%"; Hit description =Protein TAR1
MLLRGVYADLPRAPASWLVEIWVHGRLRRDKMVDEPRSRPITCEPVSSGPIDDPLRARTLPTRPQSGEASSVADRAQVPWKGAPERVRAPSCPDPVAPRGAVGESGCLGMQPQSGGKFRPRLNTGERPIANKYREGKMKKDFEKRVKECLKLSGGKRMGAGDVSRSDVER

SEQ ID NO: 174528 - protein, 278 aa, Glycine max
  Coding DNA Sequence Number=SeqID_57750
  Homolog annotation: Hit_ID=Q6CQE5; Match level="QueryCoverage=23%, HitCoverage=60%, E-value=1e-08, Identity=63%"; Hit description =Protein TAR1
  Subcellular localization annotation: CTP_CleavageSite=83; ConfidenceScore=5.32e-01
MSRVDRRTGSHRSTSDRDTSPAPIRFPPDNFKHSLTLFSKSFFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGCSREVSIHPAQQHCYMFALGKRCVTPRQACPRPNGFGRNLRSKTRWFTGFCNSHQVSHFATFFIDARAEISVAESHCM

SEQ ID NO: 174529 - protein, 214 aa, Glycine max
  Coding DNA Sequence Number=SeqID_57751
  Gene Ontology: Mol. function=nucleotide-sugar transporter activity; Cellular component=integral to membrane; Biological process =nucleotide-sugar transport
  Homolog annotation: Hit_ID=Q654D9; Match level="QueryCoverage=85%, HitCoverage=56%, E-value=8e-80, Identity=76%"; Hit description =Putative CMP-sialic acid transporter
  Pfam annotation: Domain name=DUF6; Domain location=29-158; Score=4.5; E_value=0.036; Accession=PF00892.11; Description=Integral membrane protein DUF6
  Pfam annotation: Domain name=Nuc_sug_transp; Domain location=66-214; Score=-83.6; E_value=6.5e-08; Accession=PF04142.6; Description =Nucleotide-sugar transporter
  Pfam module annotation: Pfam domain module=DUF6::Nuc_sug_transp; Domain location=29-158::66-214
MGVGTKRCIRARVYLVSLRGSAEVEEEEDAVGILTTLSQSKGEYKYDYATVPFLAEIFKLAVSSLLLWKECKKSPLPKMTTEWKTVSLFPIPSVIYLIHNNVQFATLTYVDTSTYQILGNLKIVTTGILFRLFLGRRLSNLQWMAIVLLAVGTTTSQVRGCGEASCDSIFSAPIQGYMLGVLSACLSALAGIYTEFLMKKNNDSLYWQNIQLYT

SEQ ID NO: 174530 - protein, 148 aa, Glycine max
  Coding DNA Sequence Number=SeqID_57752
MAQELEKERENEIEIDMNMMEEYEGEENNGALTHSHLPNTSLAELNMLLVLLSLFYFSSDECIEYHEESQEKTKKDEVAVTKTCIARLQSKRREKHEPKLGRKPISSRFQTTAWKKNVKQNLATAEYCTNQHKDCGDMMKQAKAKHLF

SEQ ID NO: 174531 - protein, 288 aa, Glycine max
  Coding DNA Sequence Number=SeqID_57753
  Gene Ontology: Mol. function=transcription regulator activity; Cellular component=mitochondrial inner membrane; Biological process =regulation of transcription
  Homolog annotation: Hit_ID=Q6I583; Match level="QueryCoverage=71%, HitCoverage=90%, E-value=2e-88, Identity=58%"; Hit description =Putative peroxisomal Ca-dependent solute carrier
  Pfam annotation: Domain name=Mito_carr; Domain location=133-222; Score=82.5; E_value=1.3e-21; Accession=PF00153.17; Description =Mitochondrial carrier protein
  Pfam annotation: Domain name=Mito_carr; Domain location=30-121; Score= 127.2; E_value=4.7e-35; Accession=PF00153.17; Description =Mitochondrial carrier protein
  Pfam module annotation: Pfam domain module=Mito_carr::Mito_carr; Domain location=133-222::30-121
MASETKVVNLAEEAKLAREGVTTPSYAFTTICKSLVAGGVAGGVSRTAVAPLERLKILLQVQNPHSIKYNGTIQGLKYIWRTEGFRGLFKGNGTNCARIVPNSAVKFFSYEQASKGILHLYRKQTGNEDAQLTPLLRLGAGACAGIIAMSATYPMDMVRGRITVQTEKSPYQYRGMFHALSTVLREEGPRALYKGWLPSVIGVIMLSLLAFWEIHIASGSNNVGPVGCSWGRGRTYTALKISNLSSARQCLPSLGDNLIGLLSKAAYRCGIDSVYSVSCAEHRIHMGL

SEQ ID NO: 174532 - protein, 78 aa, Glycine max
  Coding DNA Sequence Number=SeqID_57754
MGAKYLKVVKRGSHPNNGWSPDEIRGSKDKTLISFGRNTIRPVNLPASGTRKNFENDQYRHIIVILSNSFLLVDERRG

SEQ ID NO: 174533 - protein, 33 aa, Glycine max
  Coding DNA Sequence Number=SeqID_57755
MWAFELPDERAMEQIAGDNGDDTQNVPHQRKSS

SEQ ID NO: 174534 - protein, 69 aa, Glycine max
  Coding DNA Sequence Number=SeqID_57756
MTSGGNVGGVYDDDSSDDNESGGRDISGGCDSDDESNISDSDNDGVSGNGDDEDSIDDNGDSDINGIHE

SEQ ID NO: 174535 - protein, 91 aa, Glycine max
  Coding DNA Sequence Number=SeqID_57757
  Homolog annotation: Hit_ID=Q8S8S3; Match level="QueryCoverage=71%, HitCoverage=79%, E-value=3e-13, Identity=58%"; Hit description =Expressed protein
  Subcellular localization annotation: CTP_CleavageSite=51; ConfidenceScore=5.63e-01
MASSVSTTPPLYFDEKWKLSKKEGSTRSRSSSTPFIKNSSSQRRCAFASKCARLVKEQRARFYIMRREEEEEEEEEKGSVRVVLRNPINGG

SEQ ID NO: 174536 - protein, 158 aa, Glycine max
  Coding DNA Sequence Number=SeqID_57758
  Gene Ontology: Mol. function=3-dehydroquinate dehydratase activity; Biological process=aromatic amino acid family biosynthetic process
  Homolog annotation: Hit_ID=Q2XPY5; Match level="QueryCoverage=77%, HitCoverage=17%, E-value=3e-27, Identity=49%"; Hit description=YSL transporter 1
MNSSHPEGLLDILLGLGGMGTYLLGMSPYIASQVDGGNTPINTKTISLGWMFGFLFVVSFVGLFSIVPLRKVMILKYKLTYPSGTATALLVNSLHTPKGAKLAKKQIALLFKSFCGSFAFGFFQWFFTAGDDCGFSTFPTFGLQAYSKRIIVNMTLIT

SEQ ID NO: 174537 - protein, 121 aa, Glycine max
  Coding DNA Sequence Number=SeqID_57759
  Subcellular localization annotation: CTP_CleavageSite=74; ConfidenceScore=5.04e-01
MYMTQMQFVNTGAQGNCPLLRYNIWAAWRPTYVFKKVTQTLGRFDKVRGSRRNPCMMYMRKAQHGDSPVESPTVATYPSAGGQREGSWVHLPRKENARSHHQRLFEENVEKTGKVWSTNFK

SEQ ID NO: 174538 - protein, 34 aa, Glycine max
  Coding DNA Sequence Number=SeqID_57760
MWDAGGDAFDSMEDVGFLEFAELSLDEPELENEH

SEQ ID NO: 174539 - protein, 249 aa, Glycine max
  Coding DNA Sequence Number=SeqID_57761
  Gene Ontology: Mol. function=nucleic acid binding; Cellular component= intracellular; Biological process=chromatin modification
  Homolog annotation: Hit_ID=Q69JB8; Match level="QueryCoverage=67%, HitCoverage=45%, E-value=6e-84, Identity=77%"; Hit description =Putative WIP1 protein
  Pfam annotation: Domain name=zf-C2H2; Domain location=167-189; Score =19.4; E_value=0.013; Accession=PF00096.16; Description=Zinc finger, C2H2 type
  Pfam annotation: Domain name=zf-C2H2; Domain location=82-104; Score =20.6; E_value=0.0057; Accession=PF00096.16; Description=Zinc finger, C2H2 type
  Pfam module annotation: Pfam domain module=zf-C2H2::zf-C2H2; Domain location=167-189::82-104
  Subcellular localization annotation: CTP_CleavageSite=56; ConfidenceScore=5.38e-01
QNPSTTTATTSDDHHHQRGGVTVALHIGLPSPTTTTSSTNSATTPTTTSKLPDLHLASAAPNIQGQYWIPSPAQILIGPTQFSCTVCNKMFNRFNNMQMHMWGHGSQYRKGPESLRGAKPASSMLRLPCYCCAEGCKNNIEHPRSRPLKDFRTLQTHYKRKHGAKPFGCRKCGKPFAVRGDWRTHEKNCGRLWFCICGSDFKHKRSLKDHVRAFGDGHAPHTVESCDRVGEDEDDEELEVEDEEEEDYH

SEQ ID NO: 174540 - protein, 264 aa, Glycine max
  Coding DNA Sequence Number=SeqID_57762
  Gene Ontology: Mol. function=protein serine/threonine kinase activity; Cellular component=nucleus; Biological process=protein amino acid phosphorylation
  Homolog annotation: Hit_ID=Q6L4G6; Match level="QueryCoverage=58%, HitCoverage=17%, E-value=1e-46, Identity=57%"; Hit description =Putative receptor-like protein kinase
  Pfam annotation: Domain name=Pkinase; Domain location=1-263; Score= -114.6; E_value=0.098; Accession=PF00069.15; Description=Protein kinase domain
  Pfam annotation: Domain name=Pkinase_Tyr; Domain location=2-144; Score=-166.8; E_value=0.031; Accession=PF07714.7; Description =Protein tyrosine kinase
  Pfam module annotation: Pfam domain module=Pkinase::Pkinase_Tyr; Domain location=1-263::2-144
MTWPIRMQIAIETTIALAYLHTSNIIHRDVKTNNIVLDINVSVKVADFGLSRLLPNDVSHVSIAPQGFLGYLDPQYFQFYRLTDKSDVYSFGVVLIKLISSMPAVDAARERDEVNLANLSMKKIQKGKLSELVDPSFGFESNQFWKLSINYESENLEKEDDDGVISSTSSSEVHPPQPASQDSGQEERCAESPPTFICGKRRKNQRKPVKKKILSSGDVFTFEEGISTSHVDKSGAFAPTYPPFERESDLRSSFLSVNQAILFT

SEQ ID NO: 174541 - protein, 34 aa, Glycine max
  Coding DNA Sequence Number=SeqID_57763
MKTPMHPTTYLGLDEESTKICKKQGSTALYTAEA

SEQ ID NO: 174542 - protein, 111 aa, Glycine max
  Coding DNA Sequence Number=SeqID_57764
MSLPSAVHVSSTFDAVHVSSIIKRGASSDWEICSSVVFRIGSFAKHVKKEGVETRIVITERAGWTKSVSYLCFPLISDERYLAPLVAQYVKSRDVPKIKRKQAYAIRENSV

SEQ ID NO: 174543 - protein, 197 aa, Glycine max
  Coding DNA Sequence Number=SeqID_57765
  Subcellular localization annotation: CTP_CleavageSite=20; ConfidenceScore=5.06e-01
MVSSTSNTRPPSTTTVATVACGAQRGSGVAFNSELVLLGQFQLHGVGGADGRIDGVAELVGRGIGVDLDHEHGGGVLLHPAAHLGVLRIFQQAVGHGHRELLGLGVVGRRPDLADVVGAEIFHRRAHVDHLGAVTFDVEHHAVVAVLVDLVGVAQLVQVAGHGLVGLGLGGGGAGGGQGDQQGGEKGPFHEDPVKQC

SEQ ID NO: 174544 - protein, 122 aa, Glycine max
  Coding DNA Sequence Number=SeqID_57766
MTSESAQEIADKIDSLEEQYYGRASRTCSSSSTSISQQQLDEIVARLREDMTGQIREELRTQLEEENKRSLEIMTNALKEAIKKELSNKGSPESLQIQPDIQQLGARVSTKGSNVVINVQAS

SEQ ID NO: 174545 - protein, 218 aa, Glycine max
  Coding DNA Sequence Number=SeqID_57767
  Homolog annotation: Hit_ID=Q1S1N3; Match level="QueryCoverage=40%, HitCoverage=26%, E-value=3e-11, Identity=45%"; Hit description =Calcineurin-like phosphoesterase family protein, related
  Pfam annotation: Domain name=DUF1723; Domain location=82-131; Score =56.2; E_value=1.1e-13; Accession=PF08330.1; Description=Protein of unknown function (DUF1723)
MSIPHWHHPTSNFISLVFGLPLDIILMDHKPLSRHQHVHRSHTMINDLITSYYHTIPEPELQIIPLLSCAGFQHIALIKQCKIDPALITALVERWRLETHTFHLPWGKCTITLEDVAHHHDMSWAWYRMPFFAPRVPRPKTTFPLAKRWSGGRLEYRATPYGDLVGYRSRIDHMESHEFGLQEDIPVDPMNLDLLHQIDMRDNHYIDWMEYHAGWINI

SEQ ID NO: 174546 - protein, 215 aa, Glycine max
  Coding DNA Sequence Number=SeqID_57768
FSSYRMQKVYTNTHSGISARQRDSKVSMTDLVSAEDDVNLHVSTGLSAAIDEGFSSYRMQKVYTNNHSGISARQRDSKVSMTDLVSAEDDGTEDDVSLCVLSGFSSYRQQKVYMDNHSGISGRQRDSKVSMTDLVSAEDDVAEDDVSLCVLSGFLSYRMQKVYTDNHSGISGRQRDSKVCMTDLVSAEDNLNLHVSTGLSAAIDEGGSSRVARRR

SEQ ID NO: 174547 - protein, 65 aa, Glycine max
  Coding DNA Sequence Number=SeqID_57769
MKMKANKTRNELKVSDSNTYRLKTKERMKNGQSTVKNGGNLHGFAHGNVSEALRKHLGLDFLHGN

SEQ ID NO: 174548 - protein, 107 aa, Glycine max
  Coding DNA Sequence Number=SeqID_57770
MEAMKEQMTTMMEAMMRMKRMMKVNAATVIAASIATEVVLTHPSDLNQVNPTVADMVGQGGEVLRRETHELPRHTVANFEPHLGYATEGQAFGGILFEPDKCTRWRK

SEQ ID NO: 174549 - protein, 58 aa, Glycine max
  Coding DNA Sequence Number=SeqID_57771
RVLFSLSGWTEVVRLAGWPFAQPKCTSHPSSIFFLTLSRGVLRSADGSLSQKIGLASG

SEQ ID NO: 174550 - protein, 55 aa, Glycine max
  Coding DNA Sequence Number=SeqID_57772
MVNNPSEFNIHRKVEIPKLQLKITVKTSAKARGNWKENWCHPMKKLSQEERGQPP

SEQ ID NO: 174551 - protein, 70 aa, Glycine max
  Coding DNA Sequence Number=SeqID_57773
MATGENVFEQQRHPYLRKGGHAGAHDPYPSPRHAPSKVLPWNAQQLADGLLVKPRGLTPPLAKLTMLTLL

SEQ ID NO: 174552 - protein, 211 aa, Glycine max
  Coding DNA Sequence Number=SeqID_57774
  Gene Ontology: Mol. function=transferase activity
  Homolog annotation: Hit_ID=Q8UAX4; Match level="QueryCoverage=99%, HitCoverage=46%, E-value=2e-87, Identity=78%"; Hit description =Glutamyl-tRNA amidotransferase subunit A
RVPLSSLSLVVPETVFFDGIEDEVAAAFEQAVDRLVRAGASVRRQAFPIFSELFDLIKEKGALVTAEAFALHKTRLEGADAARMDPRVVARTKLGANISVPDYIAIIDARERMTAAFSGMIGKGELLMSPTLPHVAARVAPLLQNDDAFFAMNAKTLRNTQIGNFFDLCGVSIPCGTGDAGMPVGLLLSGLDGTDDHVLGAAMATEEIVRA

SEQ ID NO: 174553 - protein, 141 aa, Glycine max
  Coding DNA Sequence Number=SeqID_57775
  Gene Ontology: Mol. function=hydrolase activity, hydrolyzing O -glycosyl compounds; Biological process=carbohydrate metabolic process
  Homolog annotation: Hit_ID=Q84N00; Match level="QueryCoverage=63%, HitCoverage=23%, E-value=4e-19, Identity=54%"; Hit description =Putative class 5 chitinase
  Subcellular localization annotation: CTP_CleavageSite=45; ConfidenceScore=5.09e-01
MPTPTPLPSFSSSQNPQRATFINSTITLPRTFGFHDIDLDWEFPRTANKMKNLGLLFKEWRIAIAAEVIAIGREPLLLTVAVYFSVDYFLSKTSSLRYPMGSIHRLLGRLLDRMVSRCYFKCCSLTAKQVRKLCMTVGLFV

SEQ ID NO: 174554 - protein, 47 aa, Glycine max
  Coding DNA Sequence Number=SeqID_57776
MEMRVAMVEPRVVVNFARFVAVEFETCAPPIAEQVRQKKLQLQEREN

SEQ ID NO: 174555 - protein, 34 aa, Glycine max
  Coding DNA Sequence Number=SeqID_57777
WKRVAFCEGGLRGARYGSHAGRNSVVECETWRRM

SEQ ID NO: 174556 - protein, 155 aa, Glycine max
  Coding DNA Sequence Number=SeqID_57778
  Gene Ontology: Mol. function=ribulose-phosphate 3-epimerase activity; Cellular component=cytosol; Biological process=carbohydrate metabolic process
  Homolog annotation: Hit_ID=Q9SGI6; Match level="QueryCoverage=82%, HitCoverage=55%, E-value=4e-54, Identity=79%"; Hit description =Putative D-ribulose-5-phosphate 3-epimerase
  Pfam annotation: Domain name=Ribul_P_3_epim; Domain location=2-133; Score=45.3; E_value=1.2e-13; Accession=PF00834.9; Description =Ribulose-phosphate 3 epimerase family
MKNVRGDSNNNNPCPEHGRWLLWIDNWKELIQRIKSHGMIPGVALKPGTPVGEVYPLVEAENPVEMVLVMTVEPGFGGQKFMAETMDKVRILRKKYPSLDIEVDGGLGPSTIDVAASAGANCIVAGSSVFGAPEPAQVISLLRSSVEKAQQTSIQ

SEQ ID NO: 174557 - protein, 632 aa, Glycine max
  Coding DNA Sequence Number=SeqID_57779
  Gene Ontology: Mol. function=protein-tyrosine kinase activity; Cellular component=integral to membrane; Biological process=protein amino acid phosphorylation
  Homolog annotation: Hit_ID=Q70KR1; Match level="QueryCoverage=91%, HitCoverage=89%, E-value=2e-50, Identity=28%"; Hit description=Nod -factor receptor 5
  Pfam annotation: Domain name=Pkinase; Domain location=323-608; Score =61.9; E_value=2.1e-15; Accession=PF00069.15; Description=Protein kinase domain
  Pfam annotation: Domain name=Pkinase_Tyr; Domain location=331-608; Score=12.3; E_value=3.2e-13; Accession=PF07714.7; Description =Protein tyrosine kinase
  Pfam module annotation: Pfam domain module=Pkinase::Pkinase_Tyr; Domain location=323-608::331-608
MAMEKGFVRVEGGVIITHGGVDVLSYETTSPDSSGSGSYYHCIENVSQNQCETFALFFANSYYSLSNLTFYLGLNKFVIAQANGFSADTEFFSQDQPLLIPIHCKCIGGGFSQAELTKTTIKGESFYGIAQSLEGLPTCKAIRDNNPGVSPWNLDDKVRLVVPLRCSCPFSSQVRPQPKLLLSYPVSEGPLVKPKEPNTGFQTTSIPVTTSPHKKSPMWKTELCIGLAGVALGVCIAFAAFFFFIRLKHKKEEENSCKEGDLELQYLNQSVRTTSTSDKKISFEGSQDALDVKIVDTDAATPRRKLLLDTYTIEDVRKATEDFSSSNHIEGSVYHGRLNGKNMAIKRTKAEVVVSKIDLGLFHDAIHHHPNILRLLGTSMLEGEQQEESFLVFEYAKNGSLKDWLHGGLAIKNQFIASCYCFLTWSQRLRICLDVASALQYMHHVMNPSYVHRNVKSRNIFLDEEFGAKIRNFGMAGCVENDTEDPQFYSTNPASWSLGYLAPEYVHQGVISPSVDIFAYGVVLLEVLSGQTPISRPNEKGEGCIWLTDKIRSILVSENVNELRDWIDNALGENYSFDAAVTLANIARACVEEDSSLRPSAREIVEKISRLVEELPQGEHDVLMCESSSKPL

SEQ ID NO: 174558 - protein, 110 aa, Glycine max
  Coding DNA Sequence Number=SeqID_57780
  Homolog annotation: Hit_ID=Q1RSC2; Match level="QueryCoverage=62%, HitCoverage=11%, E-value=2e-09, Identity=47%"; Hit description =Pentatricopeptide repeat
  Subcellular localization annotation: CTP_CleavageSite=59; ConfidenceScore=5.49e-01
MSESSSKPKYPKAPHKHIHKKMRKTLFVAPTSVLVSRLSVFHLRPAPPIFEFNTIFGSRVKMKRDLNAITLFKHMHVKGIVGIVEPGLGIFKILVSCSCHLGHMKFAFFM

SEQ ID NO: 174559 - protein, 836 aa, Glycine max
  Coding DNA Sequence Number=SeqID_57781
  Gene Ontology: Mol. function=transferase activity; Cellular component= mitochondrion; Biological process=protein amino acid phosphorylation
  Homolog annotation: Hit_ID=Q6Z2B6; Match level="QueryCoverage=84%, HitCoverage=85%, E-value=1e-131, Identity=36%"; Hit description =Pentatricopeptide (PPR) repeat-containing protein-like
  Pfam annotation: Domain name=PPR; Domain location=222-255; Score=6.6; E_value=1.2; Accession=PF01535.11; Description=PPR repeat
  Pfam annotation: Domain name=PPR; Domain location=256-290; Score =43.8; E_value=6e-10; Accession=PF01535.11; Description=PPR repeat
  Pfam annotation: Domain name=PPR; Domain location=291-325; Score =43.1; E_value=9.5e-10; Accession=PF01535.11; Description=PPR repeat
  Pfam annotation: Domain name=PPR; Domain location=326-360; Score =38.0; E_value=3.3e-08; Accession=PF01535.11; Description=PPR repeat
  Pfam annotation: Domain name=PPR; Domain location=361-395; Score =48.7; E_value=1.9e-11; Accession=PF01535.11; Description=PPR repeat
  Pfam annotation: Domain name=PPR; Domain location=396-430; Score =32.2; E_value=1.8e-06; Accession=PF01535.11; Description=PPR repeat
  Pfam annotation: Domain name=PPR; Domain location=502-536; Score =41.3; E_value=3.2e-09; Accession=PF01535.11; Description=PPR repeat
  Pfam annotation: Domain name=PPR; Domain location=537-571; Score =46.8; E_value=7.2e-11; Accession=PF01535.11; Description=PPR repeat
  Pfam annotation: Domain name=PPR; Domain location=572-606; Score =34.9; E_value=2.7e-07; Accession=PF01535.11; Description=PPR repeat
  Pfam annotation: Domain name=PPR; Domain location=607-641; Score =24.2; E_value=0.00047; Accession=PF01535.11; Description=PPR repeat
  Pfam annotation: Domain name=PPR; Domain location=642-676; Score =45.9; E_value=1.4e-10; Accession=PF01535.11; Description=PPR repeat
  Pfam annotation: Domain name=PPR; Domain location=677-711; Score =49.5; E_value=1.1e-11; Accession=PF01535.11; Description=PPR repeat
  Pfam annotation: Domain name=PPR; Domain location=712-746; Score =36.5; E_value=9.3e-08; Accession=PF01535.11; Description=PPR repeat
  Pfam annotation: Domain name=PPR; Domain location=747-781; Score =61.2; E_value=3.3e-15; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR; Domain location=222 -255::256-290::291-325::326-360::361-395::396-430::502-536::537 -571::572-606::607-641::...
  Pfam module annotation: Domain location=642-676::677-711::712 -746::747-781
  Subcellular localization annotation: CTP_CleavageSite=39; ConfidenceScore=5.37e-01
MDFARLNTPKPPPIFTRPLTWVTSTALRLHRRQLSPPPRRRYLPPLRRHLLLTPHSPLYLLFSPVKLLTLPNVNPFSPHLTPHHFDRLFLSLHRTVNPKTTHEFFRFATRHCNFRFTVRSYCLLLRSLLADSFVPRARFLLARLIDGHVPTWSSKTTTSFHDRLREIASSMLELNQGSDEQRLGELDLLLHILCSQFKCLGSRCAFDIFVMFSKRGVFPCLKTCNLLLSSLVKANELHKSYEVFDLACQGVAPDVFTFTTAINAFCKGGRVGDAVDLFCKMEGLGVFPNVVTYNNVIDGLFKSGRFEEALRFKDRMVRSKVNPSVVTYGVLISGLMKLEMFEEANEVLVEMYSMGFAPNEVVFNALIDGYCRKGDMGEALRVRDEMAMKGMKPNFVTFNTLLQGFCRSNQMEQAEQVLVYILSSGLSVNMDVCSYVIHRLMERSGFVSALKIVTKLLSGNIRVSDSLLTPLVVGLCKCEGHSEAIELWFKLAAVKGLAANTVTSNALLHGLCERGNMEEVFEVLKQMLEKGLLLDRISYNTLIFGCCKWGKIEEAFKLKEEMVQQEFQPDTYTYNFLMKGLADMGKIDDVHRLLHEAKEYGFVPNVYTYALLLEGYCKADRIEDAVKFFKNLDYEKVELSSVVYNILIAAYCRIGNVTEAFKLRDAMKSRGILPTCATYSSLIHGMCCIGRVDEAKEIFEEMRNEGLLPNVFCYTALIGGHCKLGQMDIVGSILLEMSSNGIRPNKITYTIMIDGYCKLGNMKEARELLNEMIRNGIAPDTVTYNALQKGYCKERELTVTLQSDHKSNIGLPLEEEITYNTLIHKLHPHTAISNRE

SEQ ID NO: 174560 - protein, 191 aa, Glycine max
  Coding DNA Sequence Number=SeqID_57782
MVAVDLATTYSYVSAFKGCYFPGSKALNAKKRYVPSYTWANIFCVKEMANKGSFEMVSDGLKDVGVGMGMIRRDSNGYILGLAINFLPHKISPKMAEALASKRTIQTARERRFSHFILETNYLQLAQAWKSKRALNPTYFDDVLEDCRYVSRGVVNFKILFVKRLGNKVVESLAKLALDTREKYWLDDLLT

SEQ ID NO: 174561 - protein, 71 aa, Glycine max
  Coding DNA Sequence Number=SeqID_57783
MEDVEEKIYKIELQNPAQNCQCKSSCIFSFLPCQMLHIVIKNKGSLEESILLNKDRIKEEKDLASCSKGSI

SEQ ID NO: 174562 - protein, 118 aa, Glycine max
  Coding DNA Sequence Number=SeqID_57784
MSFDLNCKLKKHEVLREVPPMFVTLYEEIETLGNKLGKFVAGQEAINKIIKVQRNLKDKSGHGFKGKKIWVMKFTSARTSLKRATHHRDSPALSNSHMLTREKDPKRFGYLRGKIVML

SEQ ID NO: 174563 - protein, 193 aa, Glycine max
  Coding DNA Sequence Number=SeqID_57785
  Subcellular localization annotation: CTP_CleavageSite=73; ConfidenceScore=5.16e-01
MGHLSHYARRVLSRKMQQVEPSCHSSSESSKFTSTSFLKMKEQRKENHWPLRFKSQNPTLCPMSHLPKPFNVSDALEEEFEDDDDSDEEDDELSLITRKIKNVKKQEPLQDLDDSSFNEDNDEETNLCQIVDASTNKGEPTLDASSKDEDSQPEETVNFDGVKHLEREHEDFKKAHQVHLVNFVLETSSPSSE

SEQ ID NO: 174564 - protein, 82 aa, Glycine max
  Coding DNA Sequence Number=SeqID_57786
MTEGCGEEVALQPSPPLLKFFHVPGGRFWPVARVGGAGLWPRAKFRIGFVGDLEGRDESKRQGLNLSGSWQQGHSATYNTPS

SEQ ID NO: 174565 - protein, 249 aa, Glycine max
  Coding DNA Sequence Number=SeqID_57787
MGLCSSVHRNEQTNMKHHLTLSFESKTESLLIPSSPFEDKEKPKNGNFVVVADDDAFKPQQWSPSRSTTTFSVKDCGDNDGKEESFFDSKAWLDSDCDDDFYSVKGEFTPSRGSTPVHHIFLNKTTPSEPCSVPEPSPTTQKKKLLDLFRESVRENQSDDAENTFGNEKKEVKPTMVHDLIPKSAHSTPYVSGGNSACSSERTMNDDHAPIREKPVKSVQCCLPSLASCRSFSERKRKTSPAIAANGTA

SEQ ID NO: 174566 - protein, 124 aa, Glycine max
  Coding DNA Sequence Number=SeqID_57788
  Homolog annotation: Hit_ID=Q1T0S0; Match level="QueryCoverage=56%, HitCoverage=14%, E-value=5e-17, Identity=56%"; Hit description =Pentatricopeptide repeat
MSKARSRTGPSEYPQCRLPIILVSPEQPVNKVSGEGYEITSLIIEKGVKGFFLTASFAKFRSENVHIPERVEEEMGGAGSALKAEPAATGGLGVAAGEDFIGKAGFGKCGAVFRYWIGLISPLS

SEQ ID NO: 174567 - protein, 228 aa, Glycine max
  Coding DNA Sequence Number=SeqID_57789
MGLNQAPAFMERFIKSRKERALRCPYRTRARARVMSEEEDKVQERIKAGIEALKEQMATMMEAMMSMKKIIAVAKVDPTPPSGLNQINHPISDMVGQRGKELGSTSDPHFVQVQNKHAFPPYGLPPNYTPPNVVHIPNENFNDSTPILIESQQPQSDHAPIPQPIGVTHERPHHNLANFEPCLEYATEGQAIGGVPLSNTLESPQSRSQPQPLHFAVGRTPPSMGEKG

SEQ ID NO: 174568 - protein, 376 aa, Glycine max
  Coding DNA Sequence Number=SeqID_57790
  Gene Ontology: Mol. function=RNA-directed DNA polymerase activity; Cellular component=intracellular; Biological process=RNA-dependent DNA replication
  Homolog annotation: Hit_ID=Q1T0S0; Match level="QueryCoverage=99%, HitCoverage=75%, E-value=1e-174, Identity=78%"; Hit description =Pentatricopeptide repeat
  Pfam annotation: Domain name=PPR; Domain location=134-168; Score =44.6; E_value=3.3e-10; Accession=PF01535.11; Description=PPR repeat
  Pfam annotation: Domain name=PPR; Domain location=169-203; Score =39.4; E_value=1.2e-08; Accession=PF01535.11; Description=PPR repeat
  Pfam annotation: Domain name=PPR; Domain location=204-239; Score=9.3; E_value=0.58; Accession=PF01535.11; Description=PPR repeat
  Pfam annotation: Domain name=PPR; Domain location=240-274; Score =26.5; E_value=9.7e-05; Accession=PF01535.11; Description=PPR repeat
  Pfam annotation: Domain name=PPR; Domain location=30-64; Score=3.1; E_ value=3.2; Accession=PF01535.11; Description=PPR repeat
  Pfam annotation: Domain name=PPR; Domain location=313-347; Score =33.5; E_value=7.2e-07; Accession=PF01535.11; Description=PPR repeat
  Pfam annotation: Domain name=PPR; Domain location=65-98; Score=10.7; E_value=0.4; Accession=PF01535.11; Description=PPR repeat
  Pfam annotation: Domain name=PPR; Domain location=99-133; Score=30.5; E_value=6.1e-06; Accession=PF01535.11; Description=PPR repeat
  Pfam module annotation: Pfam domain module=PPR::PPR::PPR::PPR::PPR::PP R::PPR::PPR; Domain location=134-168::169-203::204-239::240-274::30 -64::313-347::65-98::99-133
MVDILGRMKVMEKLRDLLEEMREGGLVNMNTVAKAMRRFVGAGQWVDAVRIFDDLQALGLEKNTESMNLLLDTLCKEKFVQQAREIFLELKQHIAPNAHTFNIFIHGWCKICRVDEAHWTIQEMKGYGFHPCVISYSTLIQCYCQEGNFSRVYELLDEMQAQGCSANVITYTSIMCALGKAKKFEEALKVPERMRSSGCRPDTLFFNSLIHTLGRAGRLDDAADVFKVEMPKAGVSPNTSTYNSMISMFCYHAQEKRALEILKEMENSGGCKPDAQTYHPLIKSCFRSGKIDGVLSEILNDMINKQHLSLDLSTYTLLIHGLCREDRCNWAFSLFEEMIDQDIIPRYRTCRLLLDEVKQKNMYQAAEKIEDLMKKL

SEQ ID NO: 174569 - protein, 219 aa, Glycine max
  Coding DNA Sequence Number=SeqID_57791
  Gene Ontology: Mol. function=transcriptional elongation regulator activity; Cellular component=nucleus; Biological process=DNA replication
  Homolog annotation: Hit_ID=Q9C7A8; Match level="QueryCoverage=93%, HitCoverage=97%, E-value=2e-72, Identity=66%"; Hit description=DNA replication complex GINS protein PSF2
  Pfam annotation: Domain name=Psf2; Domain location=20-167; Score =310.2; E_value=3.8e-90; Accession=PF04128.4; Description=Partner of SLD five, PSF2
  Pfam annotation: Domain name=Psf3; Domain location=16-156; Score= -29.8; E_value=0.0078; Accession=PF06425.2; Description=Partner of SLD five, PSF3
  Pfam module annotation: Pfam domain module=Psf2::Psf3; Domain location=20-167::16-156
MAGQSNHDLSLFSAEELEFIAEDEIVDIVPNLKMSALNFISGDFGPFTPQIVTQVPLWLATALKKRGKCSICPPQWMSVEKLSQVLEAERDSQEMSDQLPFHYVEISRLLFDHARDNIPDVYMVRSLIEDIRNVRFHKVETDLEAFNGRTIAVKIKNLSAMEVNIVRPFIGRALQAFYKHDSPELIPDPERVSDRRPQVINNAPRVCLISMEIFFAFTV

SEQ ID NO: 174570 - protein, 113 aa, Glycine max
  Coding DNA Sequence Number=SeqID_57792
MCKKEHESFKGYAQRWRDMVAQVVPPMTEKEMIRMIVDILPVFYYEKMVSYTPSSFADLVFTSERIKVCLKRGKFDYLALMNEKVGANEENEKEGGTHVVTVIPAWPNLPPAP

SEQ ID NO: 174571 - protein, 206 aa, Glycine max
  Coding DNA Sequence Number=SeqID_57793
  Homolog annotation: Hit_ID=Q1SH13; Match level="QueryCoverage=31%, HitCoverage=14%, E-value=4e-07, Identity=48%"; Hit description =Nodulin-like
MNKNKRKKYDLMLLLHEFLSLRSCQSLTQGKDENVEPLLASSSYDQDDSSEVAVLLNSSEGAVNQKRRHKCWEGFMFIEAIVKADFFVGVGMGFLFSIIGIAQAPSCLFQPLSLTRTSKPPVDLDQMGRRGVGVRGADGGLGSIHLYVRTVDLRKRRLGAARLGGGAVARCRSIKTTRLPASMEGKLCNPRIKEQKRRKGSHLLLA

SEQ ID NO: 174572 - protein, 88 aa, Glycine max
  Coding DNA Sequence Number=SeqID_57794
MVATTLQPRINLESLFDSNDNNNLGFIFIVDGNNYGLRFIIVECYVSNGKLRRTLYCQNLPLHFSPLHVSERSTAMPILQSAPTVRVG

SEQ ID NO: 174573 - protein, 445 aa, Glycine max
  Coding DNA Sequence Number=SeqID_57795
  Gene Ontology: Mol. function=RNA-directed DNA polymerase activity; Cellular component=chromatin; Biological process=chromatin assembly or disassembly
  Pfam annotation: Domain name=RVP_2; Domain location=302-427; Score= -49.2; E_value=0.0069; Accession=PF08284.2; Description=Retroviral aspartyl protease
MADATRSKVYADHLEDAITKLTASQLAMNTKIDYLLQRMTQLEANQQQLQFHHLLRRDRHRRRTRFDGSDPTGWTFKITQFFEYHSMPNQERLTIASFYMEGSALAWFQWMHRKVQLSSWSAFLHALHSRFALSTYEDPTGLSAMFVLSCFISGLSPAIRREVQVLQPVSLVQVVAYARLQEEKFLDARRPPAHRSPTTTVTTTVSRSLTTNATSPLLPNPSRTSAPSIPFKRLTSEELVVRREKGLCFHCDEKYSRGHKCSPSLFLLVVKDDELASDVTSLRSPSPTADLLPEPPPAQLSLHALSGHSAPETLRLKGAINELHVNILIDGGSTHNFLHHRVATVLGLSPKEIAPLRVTVGNGDEIRCHQLCMAVKVQIQRYFFTVDFHILPLCGAYVVLGVEWLKTLAPMLTDYTSLTMKFITKGKLVELHRDREKDGEPVSPS

SEQ ID NO: 174574 - protein, 741 aa, Glycine max
  Coding DNA Sequence Number=SeqID_57796
  Gene Ontology: Mol. function=RNA-directed DNA polymerase activity; Cellular component=chromatin; Biological process=chromatin assembly or disassembly
  Pfam annotation: Domain name=Chromo; Domain location=670-720; Score =27.1; E_value=6.1e-05; Accession=PF00385.14; Description='chromo' (CHRromatin Organisation MOdifier
  Pfam annotation: Domain name=rve; Domain location=366-522; Score =95.6; E_value=1.5e-25; Accession=PF00665.16; Description=Integrase core domain
  Pfam annotation: Domain name=zf-H2C2; Domain location=307-348; Score =8.9; E_value=0.024; Accession=PF09337.1; Description=His(2)-Cys(2) zinc finger
  Pfam module annotation: Pfam domain module=Chromo::rve::zf-H2C2; Domain location=670-720::366-522::307-348
MADHLLHLESVFQILVAGHIVTGEGVRPVPEKVQAIQTWPTPRSPWALRGFLGLARFYRRFIRGYAALAAPLTKLLCHGQFQWSSEANVTFQKLKDAITVAPALTFPNFKVPFVVETDTLGVGMGAVLSQGGHPIAFFNKQFCPRMANSSTYVRELAAITVAVKKWRQYLLGHQFIIMTDHRSLRELMNQAVQTPEQHCYLARLLGFNYTIQYRSGQTNIVADALSRVMEEPPASLYLLSMPRFVFIEDLHKELTSLPAFMELRKQVQADPTTYPDYSLTLELILHKGRIWLPSNLSFIKLLLEEFHQSPAGAHMGVQKTLHCLQENFTWSSIREYTRAFIASCLTCQYTKYDNRKPGGLLCPLPVSAQPWEDLSMDFIVGLPTYRGNTCIFVVVDHFSKGLHLGMLPTHHTAHTVAMLFMEMVGRLHDMSRSIVFDRDPLSISKFWRELFSLSGTKLRLSSAYHPQSDGQTKVANRIIEQYLRAFFHQKPSAWGRYLLLAEWSYNTPCHSTTGMTPFEVTFGQKPPNFPQYISGTSKIDAVNDILSQREAVFELLRRKLSKAQIQMKATADKQRRDQEFEVGDWVLVKLRPHRQTLASGLAYSKLVKRYYGPFQVTARMGKVAYKLHLPNHSRIHPVFHSSLLKPYVASAVPRDITDLSPMALDNHPVITPLAIVASKMIPSKTGPKHMVLVQWKGLGLEETSWEEWSEFKALHHLEDKVLFDGHGSVTKNTKGVPLAKE

SEQ ID NO: 174575 - protein, 58 aa, Glycine max
  Coding DNA Sequence Number=SeqID_57797
MVVENETDEESLKKHAELVLAFLVCGEGCEREQQTKATGEVTAIWTMEETSKRCRTPT

SEQ ID NO: 174576 - protein, 274 aa, Glycine max
  Coding DNA Sequence Number=SeqID_57798
  Gene Ontology: Mol. function=4 iron, 4 sulfur cluster binding
  Homolog annotation: Hit_ID=Q6M9M7; Match level="QueryCoverage=67%, HitCoverage=46%, E-value=1e-21, Identity=34%"; Hit description =Hypothetical RNA methyltransferase pc1998
  Subcellular localization annotation: CTP_CleavageSite=53; ConfidenceScore=5.56e-01
MTLRLVSAPPSFSLFSCRATASTALPPPTPTPTPAPTLISSIPQSPPLTCALHCPHFQSCSGCTHEFNLHRPVILDDATNFFRKHGVSDFTFDTCKLWGWRCRAKLAVRGSSTEPLIGLYEEAHHPNINAAVELLRRGIIEIGVEPYIEDEGTGDLRYVQMAVTTYNTSLPAAQRYKNGKVQVTLVWNSRNENSPGSDKLNALANFLWKNGGQRSRLHLIHSVWANFQTSTNNKIVCCMGYREEPILDPLVGHLHLPRFRLEVLGARASVEKPP

SEQ ID NO: 174577 - protein, 435 aa, Glycine max
  Coding DNA Sequence Number=SeqID_57799
  Gene Ontology: Mol. function=3-isopropylmalate dehydratase activity; Cellular component=chloroplast; Biological process=leucine biosynthetic process
  Homolog annotation: Hit_ID=Q1SSZ5; Match level="QueryCoverage=66%, HitCoverage=65%, E-value=1e-80, Identity=50%"; Hit description=3 -isopropylmalate dehydratase large subunit
  Pfam annotation: Domain name=Aconitase; Domain location=63-430; Score= -200.8; E_value=0.0004; Accession=PF00330.10; Description=Aconitase family (aconitate hydratase)
MRIYDEFKEIVKIQKFRRLVSYSGFYCFATLISYFYVNNTTRAGFSRADQFYASYPAGTELLTDTTKLYKAALGNCFEAEEWGPFEFCVMAKHFERQGKSPYAYHAKMFRNTPKVWDCEKLMFIPDHYIFPNAEHAHYIVDISRKFCVEQDIKYFYAIQDCSNFRANPDCKGVCHVALAQEAFILGTGKVLLKVPPALRFVLEGEMPCYLLAKGLILHINGEISMSGASYKGMKFVGTTIENLSMEERMAVCNMVVEAVGKNSIVVTTYKYLGDMTLAPYEPVFSDENARFLVQYRFNASKMEPLVTKPHSSANLALVCECNNVKIDRVDIASFTARRTTVKVPMFLVPATQKGLDGYSSQNTAQGQHSVEFAVGADNPESAICASLATGLLETRKSDQILEQISEGQVFANLKQELDTADVTDLSALYLIYPSD

SEQ ID NO: 174578 - protein, 60 aa, Glycine max
  Coding DNA Sequence Number=SeqID_57800
MKFVQEKGRTKVKRGKRMKNNREKKRNEFGPKVSTTISSRPCARQIGQDKAECHALIGEE

SEQ ID NO: 174579 - protein, 231 aa, Glycine max
  Coding DNA Sequence Number=SeqID_57801
MEDILKRWTEHLESTRLRVSHPPPGHELHPYNQNEEKTFSDMENVFMQFMEKSQASFKANQNSIQNLEIQVGKSYSMKNCQWEQELQPYNQYEEERISNLGNLLMQLMETSEATQHAIKNLEIQFGKLAKEVAKFFVTREYNFVEVEAHEESLVEEHDSREKDGKKSEERTQQQWEKCSQVEIPPESILQVNTPPHQLIVKEERHEEHVKMQGRCVLCDLHATLKALDLSS

SEQ ID NO: 174580 - protein, 138 aa, Glycine max
  Coding DNA Sequence Number=SeqID_57802
MNIIFQLSDELYYTSIIGGVVVVIGLYLVVWGKAKEQKHLMPPSPEKVTLQRQQQLPVTVPISDDANDNNKAQLVIIGDRKDDVEARTTTRKNNSIEYEIRIKLERMIQPGAKFLEHLLRIQLDQNASSRRGENVIHH

SEQ ID NO: 174581 - protein, 93 aa, Glycine max
  Coding DNA Sequence Number=SeqID_57803
  Subcellular localization annotation: CTP_CleavageSite=35; ConfidenceScore=5.49e-01
MVLNFSTFTQCGTSPQTCTPTISPSSVIFFYMVVSPSSGSHYYPRYLYRRSTHGTRRLDPPLGRLSIQGIPKAKDPSPPSYLSKPVTKSNYRL

SEQ ID NO: 174582 - protein, 92 aa, Glycine max
  Coding DNA Sequence Number=SeqID_57804
MEKVAWPGAQPSLVREGGGPIAQVPQQVEDASSEAIVPEPFVYEANEAGGTQTRQNTATAKRTLSYPNFVQGPLLDDMRPLFGPCKVLGTHH

SEQ ID NO: 174583 - protein, 289 aa, Glycine max
  Coding DNA Sequence Number=SeqID_57805
MVEKKNKRIKSIQHRPTTPKTKTEKEPAKGGLSVRGKWVAHSPSSPTTPKATSWLSEEHYEALYTFSYAKNEMIQLKYVNFVWLRSEGFAFFELIENHRLKKPVEMKGAYYTNLVWFDIVGLLSEGIMANQLGLKEARFAFNKVDKYKSMMKNPSTYVVVVTKTKGKKCFGTGPLMLEHGLLACVLKINWVDIIVDIMLKMKRVGPFKCPYAVLISRILDYFGVDTQEKVFGFVKAEFEPEEVGIGWTEKSKEDQTVQEEAKEKPMSPFEQMMLVKMDELLRIHKEDYT

SEQ ID NO: 174584 - protein, 61 aa, Glycine max
  Coding DNA Sequence Number=SeqID_57806
MTFRRIEVVMIPRLEEEGFLVRWFFDGHHSLKSLAPSIMVPMPCSREEHVRIEPTLEAPSK

SEQ ID NO: 174585 - protein, 84 aa, Glycine max
  Coding DNA Sequence Number=SeqID_57807
MATEWRRKKGDWRRHFKEKMSQGQTHHHRKPWIRVGSPLIQDQVQDSPLSVLRCHEACEKRLSHEVPKVTVELSSSVGQARIPR

SEQ ID NO: 174586 - protein, 164 aa, Glycine max
  Coding DNA Sequence Number=SeqID_57808
MVAFVRQYQYNSDMASDRMQLQNMCKREHESFKEYAQRWRDLEAQVTPPMMDREMITMIVDTLLVFYYGKMVGYMPLSFADLVFAGERIEAGLKKGKFDYAASTNSGDKRPGANGKNKKEGRTHAMAIVLTWPNFPPAQQYQYSANISPSHYLPPYQPRTPNHP

SEQ ID NO: 174587 - protein, 682 aa, Glycine max
  Coding DNA Sequence Number=SeqID_57809
  Gene Ontology: Mol. function=leucyl aminopeptidase activity; Cellular component=intracellular; Biological process=protein metabolic process
  Homolog annotation: Hit_ID=Q7WD42; Match level="QueryCoverage=53%, HitCoverage=72%, E-value=1e-176, Identity=85%"; Hit description =Probable cytosol aminopeptidase
  Subcellular localization annotation: CTP_CleavageSite=61; ConfidenceScore=5.20e-01
MGTLAPVSTWPDVPQHPGDDAGQAARMACSTSACRRAARIAGGGVSDGMAVPAPSSGASVSSGTPWSSTGSVSSGKSSPPAGSVSTGTSASATSVSRGKASSGYASVAPRAAPTGGADGDSVGSARWVRVGMPGSEGWWGMGAPEDRDGAARGGARGVVALRRMAGALVGAPALARGLLVVGIVGDDFEQALEGVEARGAGIVEIEQPGLGLAVRDGCLGRLPGISRGQDDGRFGRQRIVGQDVRHERGVVEGPEHAIEGRQARAFLTVHHQPLTRQAKSMRVMPVSVRGGSSLVQQELHQQRHGTARGALVLAALPGGAGDVQVGPAVRLGEARQEAGGRDRAGRGAADVGQVGEVGLELILVGVVHRHAPGGVKGLAAGGGQGLGQRVVLGEQAGVDMTQGHDAGAGQGGDVDDGGRLEALGVGQRVAQHQAALGVGIEDLDGQAGHAGDHVAWLVGLAAGQVFAGRDQADHVQRQFQFGQRAERAEHAGGAAHVVLHFVHGGGGLERDAAGVEGDALADQHDGAVGRLGALLGGFAGVAQDDEAQRFLGAARHRQERAHAQGLDLLAVHDLDLERLEFARQALGGVAQVGGGADIARQVAQGAGQFHAVGDGGAFAQALLRLAGVGALDDLHDLLELGTGVAVGLAEAGVVVIGGAAGGDGRAAGAGDEGHVGDGVGGQ

SEQ ID NO: 174588 - protein, 117 aa, Glycine max
  Coding DNA Sequence Number=SeqID_57810
MGSNQAHAFKKRVSSSQCQVWKKECALQCPYRTHAKARVMSEIEEVQDQMKADMEAMMSMRKMMEVNTATVVAASTTTEVDPTHPSGINQASHPVPDMVGQGGGALGSTSGPHFVQV

SEQ ID NO: 174589 - protein, 181 aa, Glycine max
  Coding DNA Sequence Number=SeqID_57811
CFEESARHGIIGGYRKWLRVRTQGLDWLPKLRVAREEEAEAPEESEEEYDELKDINMATAKALERETKRARKEEHDRNKFQGVVWGRNSELKLQRDERDQSRVECMILKDELKAYLRSKRSLSQQLSETEGNMLAIVDKYKEELNLAVAHEHRLVDEYAKVSVVKEARGRVTNSLHGEVMM

SEQ ID NO: 174590 - protein, 120 aa, Glycine max
  Coding DNA Sequence Number=SeqID_57812
  Gene Ontology: Mol. function=helicase activity
  Homolog annotation: Hit_ID=Q9LTU4; Match level="QueryCoverage=97%, HitCoverage=8%, E-value=2e-32, Identity=57%"; Hit description =Helicase-like protein
MTKHVIAAEIISGKNIDLAVYIPRMSMSPSQSPWPFKLLKRQFPIMLSYAMAINKSQGLLLSMVGLYLPKPVFTHGQLYVALLRVNSTKGLKILIHDDEQKSMNSTTNVVFKEVFRNIKR

SEQ ID NO: 174591 - protein, 63 aa, Glycine max
  Coding DNA Sequence Number=SeqID_57813
MELESPPSTGCTQHRVGRTRNVEVMGVCHVRRSGLEEVVAHNDGFRGCGGGAYMVVEEKNKGG

SEQ ID NO: 174592 - protein, 127 aa, Glycine max
  Coding DNA Sequence Number=SeqID_57814
MVENGNYIPYNDQLNKIPKSQWTKEQSDFLNSKTRNVMLYALSEEEYTKDEGSKGEKFLALSSQKNIKTSLSKEQVLRSLSKALKVDNSSNEESEEDFDEDKLDFISRKIYKMWKNKGGSRWSSSKR

SEQ ID NO: 174593 - protein, 264 aa, Glycine max
  Coding DNA Sequence Number=SeqID_57815
  Gene Ontology: Mol. function=nucleic acid binding; Cellular component= beta-galactosidase complex; Biological process=DNA integration
  Homolog annotation: Hit_ID=Q1SH19; Match level="QueryCoverage=99%, HitCoverage=17%, E-value=1e-73, Identity=48%"; Hit description =Integrase, catalytic region; Zinc finger, CCHC-type
MSMMGELKFFLRPQIKQTPNGIYIHQTKNVKELLEKLNMNNAKEMKTPIHPTTYLGLDKESTKVDGTQYRAMIESLLYLTVSKPDIMFNISNWNPNLGLLFKRRENFRLLSFCDVDYVDDKVERNSTSGSYHFIGGNFITWTCKKQVLTTLSTAEAEYMSATSSYAQLLWIKNQLEDYNIYESKIPIYYDNTAGISLSQNPTLYSKARHVEIKHYFIRDHVRTGTMDLQFVPTDDQLADIFTTPLIDEWLILLRNHLGMVSINE

SEQ ID NO: 174594 - protein, 60 aa, Glycine max
  Coding DNA Sequence Number=SeqID_57816
  Homolog annotation: Hit_ID=Q2QNJ3; Match level="QueryCoverage=75%, HitCoverage=7%, E-value=4e-08, Identity=56%"; Hit description =Phospholipase/Carboxylesterase family protein, expressed
MWIHFPLYSNHRRTCYSQFPSTVKVTGYLKCRKASLCPRLPFFPPQYQTFGYVLVVSIET

SEQ ID NO: 174595 - protein, 122 aa, Glycine max
  Coding DNA Sequence Number=SeqID_57817
MSKGEAPLNARRSGLCDGCKKIEAKAMDYLATVGDSGSHCERRGWVLSPIDDEVSDFVWVDNHGDDGAINRDGGRDTSDGCSDNDSRGNDRSGDGGGNDVDDVGDNGDDGGSGASVGRQWWL

SEQ ID NO: 174596 - protein, 58 aa, Glycine max
  Coding DNA Sequence Number=SeqID_57818
MVIFNHRDAAKDKGEEVRGGSFLEKLPGETSLRSKNLATHTPLITKLTSLRSFSEKFP

SEQ ID NO: 174597 - protein, 42 aa, Glycine max
  Coding DNA Sequence Number=SeqID_57819
MEISEFLRDCEIPRGGGDIPSPLDFSIGKCTVSLALDRAGIE

SEQ ID NO: 174598 - protein, 56 aa, Glycine max
  Coding DNA Sequence Number=SeqID_57820
MEYFGVHKNMDQNQHCQPTQQAHDKNQYQSNPMMAPTNPSSQTVGPYVPSSYPGEK

SEQ ID NO: 174599 - protein, 1230 aa, Glycine max
  Coding DNA Sequence Number=SeqID_57821
  Gene Ontology: Mol. function=RNA-directed DNA polymerase activity; Biological process=RNA-dependent DNA replication
  Pfam annotation: Domain name=Exo_endo_phos; Domain location=759-949; Score=-0.3; E_value=0.013; Accession=PF03372.13; Description =EndonucleaseExonucleasephosphatase family
  Pfam annotation: Domain name=RRM_1; Domain location=261-331; Score =27.2; E_value=5.8e-05; Accession=PF00076.12; Description=RNA recognition motif. (a.k.a. RRM, R
  Pfam module annotation: Pfam domain module=Exo_endo_phos::RRM_1; Domain location=759-949::261-331
MPKGLKMKKLIERPDGTLVHDTSYVGEDAWEDDREAPEERVKQIIEDDERKTASSSTLLASKLVYQHPQQGQHLNRAILWKVGRGDKFKFWEDKWTGGDSQLAEKYRRLYTISDQQHQSIQQLGAFNEEGREWHLQWRRPLFDSEIEMAVAFLQEVEGFRISPDSQDQWVWAAEPNGRYSARSAYRVIREAISGEGQGGGYKELWKLRAPSKVAMFAREKRERHSATRIEDTHQTHSSIRNDHRQSYNRDSWRGRNDITSFYFTRFSEKATEKDLWHHFKKFGDVREVFIPNNRNKTGRRYGFARFKGVEDVHYLERKLDNVVYGGLRMFVNTPKFGRNRTQQPKSESKQSMYAEHRGTEARWPRQMQKRMIQGSYTEVVSGNQRGTRTRRAVVTENCSNEGSWSSVYLEVSETGINWLKEAWVGRLKNLAMFDKAEDDVYWDDGEDIDLKYLGDDMVLILGLTDERAKKMMAEENEGGATPFHSLEKWSPKLRMGYRLTWDDVAAARRMDKVRVLLKTSRRPLLQHMVKVHIKGEVYRVYIAEEGGGENPDRTQWRSWGGYGSSEEIESFESDKEDDCSSMLRLEQEGGVTDVARSLAGSEMEDQSIIPVRGAVQPAIHPECAVLSVVAPPDATADLHEAIVAAAEHGQEDMHEVATAGEQDQPATGISATSKGSQVQLVGPLPNGCSKPNIQLDKPSTLETSITTATVHCGISDTTVIATVTTSPKRQLATQKAPTKQEQEAKAIWQLAKELGELSMNIISYNVRGLGRGVKWPAIKKLVIRHNIDMICLQETKKETIDKSTCQALWGDSDVNWEAQPATNSAGEILCIWSNKNFKLERKVQGPGFIMLEGKWHQEAQIIHITNIYSPCDIQNKRVLWAILTILGTHVKDSASITRMWGKETLMSSMNGSKSWRFMVSSEWLVKWPGSTQQALDRNFSDHCPILLSSKTVDWGPKPFKILDCWLSDNSQHFGDTFKKYTKLEEELNKLESDTSHRHLTLEESLTRKKLQEELWIAAQSDEPLLRQKARSRWIREGDCNSRYFHLLMNARRRNSCLKGVMINGAWIEEPTRVKEVVRSFFIERFQEPDPERPRLDGQKYPRLYLISSQQNHTIQQMGVHNDSGWEWQFTWRRLLFDNEIDMATEFLKDIETQQIQPQRSDGWAWMADSNGQFLAKSAYIVMRESSSEAIKDTTFADLWKMKVPVVWQHGGGHRELGVKGGDGGGWLLHG

SEQ ID NO: 174600 - protein, 234 aa, Glycine max
  Coding DNA Sequence Number=SeqID_57822
  Gene Ontology: Mol. function=nucleoside-triphosphatase activity; Biological process=proteolysis
  Homolog annotation: Hit_ID=Q1SLH6; Match level="QueryCoverage=66%, HitCoverage=16%, E-value=2e-44, Identity=58%"; Hit description =Peptidase M41; AAA ATPase
  Subcellular localization annotation: CTP_CleavageSite=43; ConfidenceScore=5.70e-01
MELTIPRNPNPLLVSSPPPLSRNPNVFTLTVPRRRRRIRFRVSAAAEPDGPSWSQSLLRGSRRFWGKFGEMVKKETGLDFENRSVKKVGEFVNGDELRRLGTDWVFRFVDWNRWERWKNIKDWEPKRIGALVLYIFVVTFACRGVYVTIQAPFLSRQKKELTEAYMEALIPEPSPTNIKRIEGGLCLLPALVIDRDREEEYDGLRFPMVYLHIDDIFKIKIRINGIRSPNQNQI

SEQ ID NO: 174601 - protein, 139 aa, Glycine max
  Coding DNA Sequence Number=SeqID_57823
MTTLTWIWMTSLFSNILPIDHNANLPLQMDCAHNTPSGPKEVQQGPGVSNSGYGPLSVLPGGRSPNKEWHPQRHPSGPGEVQQGPGVSSSGYGPLDCARKTPSGPEEVQQGLGVASSNYGLLSVLRGACRPQQVHQAPY

SEQ ID NO: 174602 - protein, 110 aa, Glycine max
  Coding DNA Sequence Number=SeqID_57824
DGFRDDSLRIMKDIEKENSKCQLMQNCTYPKDTMYNHSLVIIGHEHLLMTTPTTTRPTTPTRTTNNKNNNKNNKNKNNNNKNKNNKNKNKNKNKDKNKNNNKQERKYKNT

SEQ ID NO: 174603 - protein, 69 aa, Glycine max
  Coding DNA Sequence Number=SeqID_57825
MDSISEDNLIKTPKPKYGWLRRRATESTPLLTINAKVEYNKDSEHESDSEGDYKIDGKGHRENENERQH

SEQ ID NO: 174604 - protein, 61 aa, Glycine max
  Coding DNA Sequence Number=SeqID_57826
MDNWNEDFSEDENENSTLLSILEDEISDVEHVGALVIAPSEQPKFIGRKGYPTQDLVVICD

SEQ ID NO: 174605 - protein, 133 aa, Glycine max
  Coding DNA Sequence Number=SeqID_57827
MKNAFEKKQVRVQLEEEQGRRDFARTAAGRRVRIMRTSMTTLTQTWMTLQLGNVLPRDHNSDLPLPKCQLVYAILTRMSAHVAQVIANAIYLSAGMPPTRHPLDPNKSNRALGFPALITGLCQSFGVPVTPTK

SEQ ID NO: 174606 - protein, 147 aa, Glycine max
  Coding DNA Sequence Number=SeqID_57828
  Gene Ontology: Cellular component=integral to membrane; Biological process=protein transport
  Homolog annotation: Hit_ID=Q944A9; Match level="QueryCoverage=87%, HitCoverage=49%, E-value=5e-45, Identity=65%"; Hit description=Novel plant SNARE 11
MDQLSAISEDLAEIDGHIADNFRALSNGFQKLEKIKDSNRQTRQLEDLTEKLRECKRLIKEFDKEVKTLENSFDRETNKMLNEKKQSMIKELNSYVGLKKQYATNIENKRIELFEGPNEGYTEENGLLASCKHTDFFIIGCAGIHVS

SEQ ID NO: 174607 - protein, 96 aa, Glycine max
  Coding DNA Sequence Number=SeqID_57829
  Gene Ontology: Mol. function=GTP binding
  Homolog annotation: Hit_ID=Q9ZRD1; Match level="QueryCoverage=68%, HitCoverage=19%, E-value=1e-17, Identity=62%"; Hit description=NTGP4
MVLSRNGGRPYTDELFTQLKKGAMELHNQQREVDSLKGYSKGEILEFKKQMQQTYDEQLKRITEMLNMVILSFMLFNFQYQLHICIAAYCMISNLG

SEQ ID NO: 174608 - protein, 122 aa, Glycine max
  Coding DNA Sequence Number=SeqID_57830
MKHGHAAEVPRPASETHWTHKRVRLRCDAVSVAAAVAGHGWMQKTRDRTRPKKWTRASKRGPTKYFIIYLKNTYLKRKSRLLFAASEPPRRRLRFPLCSVILIIQFKGSLSPQARYSNDHIF

SEQ ID NO: 174609 - protein, 466 aa, Glycine max
  Coding DNA Sequence Number=SeqID_57831
  Homolog annotation: Hit_ID=Q1T4Y5; Match level="QueryCoverage=37%, HitCoverage=78%, E-value=7e-60, Identity=51%"; Hit description=Zinc finger, CCHC-type
MSVIGLIAAVAVEFKVVCVGVAVHWKRQIAQCAGGVGDDEVLEGKKRRVGKVTFIKSNIFRDVQPAQPDYIIRSYLVKVTAEFFGTIESIMAKFFAAETLNSTHVPSFWLGLYCIHHWNRCGFVLIHSVLSEKALFLTEQIIETFIQRGPQIHEMRVKIRDRETILLKVGNFMLKLESSSCVILIVDFLQLSPHLGCSLEGSKIENNGGINRGDNPGHDLSILNDPLGILFLVDGFVRSGVAAINMTPQILTGDQQQHKIAWVKWDIVCLPKEAGGVLESKYGGWRGLSEVTRGKGELVWWRDLKLVFNHPQHGELMNTTISWRVESGDKLGVGPLFDNEIDMAVSFLSDVASHPIQPQKGDQWVWKANPSGQYTPKSAYDMVWGKTYEQQQDGVFQQLWKLKLPSKITMFAWSGGEHRSSILSLWQDNASMVGVLVLGGYVGCLPKSPEAALSPTYTWSDRGNEV

SEQ ID NO: 174610 - protein, 355 aa, Glycine max
  Coding DNA Sequence Number=SeqID_57832
  Gene Ontology: Mol. function=nucleic acid binding; Cellular component= intracellular; Biological process=DNA metabolic process
  Homolog annotation: Hit_ID=UPI0000162FA8; Match level="QueryCoverage =85%, HitCoverage=22%, E-value=9e-91, Identity=60%"; Hit description =ATP binding / ATP-dependent helicase/ helicase/ nucleic acid binding
  Pfam annotation: Domain name=Helicase_C; Domain location=119-202; Score=75.1; E_value=2.2e-19; Accession=PF00271.21; Description =Helicase conserved C-terminal domain
MVSAHLRSIRRVTHRVIHAPSPKVQDMRGCIGENPSPISAKDSAKIEYFAKFMSKNEVILKARQLMQQSLSHGASSPKLSKMLDVLLEHFKTNDPQNSRVIIFSNYRESVRDIMNALGDIGELVKATEFIGQSSGKAMKGQSQKVQQAVLKKFRSGAYNVIVATSIGEEGLDIMEVDLVISFDANISPLRMIQRMGRTGRKHDGRVDILRIPHVLKPEVKCVELSIEKFIPRPKNVKDDELHISPSKDKLTVAEIDLLETYFHPTVENNSRMSLIAFPHFQTFPSRVHKVKHSSGTLMLIDMMQRLQGLVSFPEDDKTSSLQEDLCLGHGKPVTTTELDEAKKGNIICSIFSPKF

SEQ ID NO: 174611 - protein, 78 aa, Glycine max
  Coding DNA Sequence Number=SeqID_57833
MSEAGRGKPDPVGGGDEGKSTPPLCFEGGDGSILCGDNDNGDNGNINSISDNKDISDGRSDNGGGDDEGDIDGGGNQW

SEQ ID NO: 174612 - protein, 316 aa, Glycine max
  Coding DNA Sequence Number=SeqID_57834
  Gene Ontology: Mol. function=nucleic acid binding; Cellular component= nucleolus; Biological process=regulation of transcription, DNA -dependent
  Homolog annotation: Hit_ID=UPI0000162FA8; Match level="QueryCoverage =80%, HitCoverage=19%, E-value=5e-82, Identity=60%"; Hit description =ATP binding / ATP-dependent helicase/ helicase/ nucleic acid binding
  Pfam annotation: Domain name=DEAD; Domain location=122-291; Score =11.3; E_value=6.2e-07; Accession=PF00270.19; Description=DEADDEAH box helicase
  Pfam annotation: Domain name=ResIII; Domain location=118-286; Score =25.3; E_value=3.5e-07; Accession=PF04851.6; Description=Type III restriction enzyme, res subunit
  Pfam module annotation: Pfam domain module=DEAD::ResIII; Domain location=122-291::118-286
MVMQTSPIGVDGYRDKVNPNYRMASNNPYEIMDDEGFDWEAAAREIDVVCQTTSDVKGKGRVFEKRKQQSTLDKFISIANANAEKETPPPQFQEDDQSPAFIHHIDTEAAKTWIYPVNVPLRDYQFDITQSALFSNTLVALPTGLGKTLIAAVVMYNYFRWFPQDLFNWENHLMLPVTTGKIVFAAPSRPLVMQQIEACHNIVGIPQEWTVDMTGQLSPPKRAQFWKTKRVFFVTPQVLEKDIHSGTCLVKYLVCLVIDEAHRAMGNYAYCEAVREVTTSKATFQHTPHAQDYGLGAWQYRWPKCLTIDLGQTLID

SEQ ID NO: 174613 - protein, 1470 aa, Glycine max
  Coding DNA Sequence Number=SeqID_57835
  Gene Ontology: Mol. function=nucleic acid binding; Cellular component= beta-galactosidase complex; Biological process=DNA integration
  Homolog annotation: Hit_ID=Q1SRN1; Match level="QueryCoverage=97%, HitCoverage=99%, E-value=0.0, Identity=49%"; Hit description =Integrase, catalytic region
  Pfam annotation: Domain name=rve; Domain location=582-724; Score =58.4; E_value=2.3e-14; Accession=PF00665.16; Description=Integrase core domain
  Pfam module annotation: Pfam domain module=RVT_2::rve; Domain location=968-1224::582-724
MASPFRNDGVFPSSHVKLSHLISVKLDGKNFKQWKQQIDGVVRGHKLQRFVTVPVIPHRSPSTSDPNLSEVNDAYLDWEQQYALVCKWLLSTISDSLLPKLVDCTHAWQVWTEVHRYFATLLTTKARQLRSELCRLSKGTLTIESFMECVREINESLISIGDPVPLRNLIEIVLDALPEEYDPIVAAVNSKEDLSSLVELESCLLAHESRLEKHRKAILTEPVSVNLMQAQPSDSSSPMEPSSPATESFPTGTSHVTAHAENNNYNSEAICHKSGHDTSICYYRYSQSASMPFSPQRAPFNPFLMNARPVYAPSFGYASPRSAAPRPSPPQAFMASSDPTFSNQWWYPDSGASHHVTPDSSNVSDAHSVTGSEQVFMGNGQGLSINSIGSMNFTSPNFPHKPLTLHSLLLVPHITKNLISVSKFAQDNQVFFEFHPSFCLVKSQDSSEVLLRGVVGADGLYKFQSPSSQVSKFKSLSSLNSSVALGSNNCNPSTSCNTLLHSNAQSDCITDCTPSVSMNTSNVSCVNSPLVHATTFTNSQSPQHSIVPNIIPTSKYALWLTRLGHPHYQALAEVLKTCNIPIPPKSLAEFCTACCLGKSHRLPTSLSTTVYAQPFELVVCDLWGPAPIQSLGVVQSDGGGEFRSFPKYLNNLGITHRFTCPHTHHQNGIVERKHRHIVETGLALLAHSNLPLKMWDHAFVTAAYLINRMPSMSLANQSPYFKLLHKLPDYSHLRVFGCTCFPFLRPYNAHKLDYRSQECIFLGYSTIHKGYKCLAATGRIYISRDVLFNETRFPYSILFPSSSSATSTSSPHTSSAWSIPAVPVSVIPLTQVSSVPATPTTSVSLSSPMSAPINTANSPIITPSNDASPASENSSLHSPITPSSLTPITFDIAEASTISPSSIPATNSPLSPVPTPQQPSIHPHNTHPMQTRAKSGITKPKIHPTLLLNHMEPTSVGQALSSPHWFQAMKDEYHALLKNQTWTLVSPSVSRKPIGCKWVFRVKENPDGSINKYKAMLVAKGFHQQAGTDFTETCSPVVKPVTVRTVLTLAVTHKWPIQQIDVNNAFLNGTLEEEVFMLQPPGFEAADKTLVCKLNKAIYGLKQAPRAWFDKLKGSLLHHGFLASKCDPNLFLLHTASLTIMVLIYVDDIIITGNSASFITALIKNLNTDFSLKQLGKLDYFLGIEVTHLPNGSLLLSQAKYLTDLLAKINMLNANGMPTPMVSTSKLSKIGSPAVSDPTQFRSVVGALQYATLTRPEISFSVNKVCQFLSNPLEEHWKEVKRILRYLSGTLHHGLLIQPASPHQPLSLLGFCDADWASDPDDRRSTSGACVFLGPNLISWWSKKQRLVARSSAEAEYRSMAQLAAEILWVQSLLQELKCRLLTPTILEKVLSKNLIVKHVPAQDQWADLLTKPLSAVKFLPLRDKLRVINKLSLLDAPSAEHIELAQEQFMQQQEKYVQKQGQDKMVVEG

SEQ ID NO: 174614 - protein, 163 aa, Glycine max
  Coding DNA Sequence Number=SeqID_57836
  Gene Ontology: Mol. function=iron-sulfur cluster binding; Cellular component=integral to membrane; Biological process=electron transport
  Homolog annotation: Hit_ID=Q015K0; Match level="QueryCoverage=71%, HitCoverage=35%, E-value=8e-29, Identity=52%"; Hit description =Homology to unknown gene
  Pfam annotation: Domain name=SNARE_assoc; Domain location=1-113; Score=145.1; E_value=1.9e-40; Accession=PF09335.1; Description=SNARE associated Golgi protein
MSAGLLFGSVVGTIIVSISGTVAASVAFLIARYFARERIVKLVEGNKKFVAIDKAIGENGFRVVTLLRLSPLLPFSLGNYLYGLTSVKFIPYVLGSWLGMLPGTWAYVSAGIVSNENITAILIASFMKAYYKASFMKAYYKASFRYLWQKQRKTEKVRAMRRM

SEQ ID NO: 174615 - protein, 152 aa, Glycine max
  Coding DNA Sequence Number=SeqID_57837
  Gene Ontology: Mol. function=RNA-directed DNA polymerase activity; Cellular component=chromatin; Biological process=chromatin assembly or disassembly
MGFQFEVLYKPELENKATDALSRQMSSGELGAITISPLWPSPTSTKDKAKLEYISEGQPLPLELAFGVELGPNSHAKTVACRINPKVSPRYFGPFQILSRVGEVAYKLKLPESAKVHLVFHVSQLVEEATWESVSSIRSRFPSFSLEDKANV

SEQ ID NO: 174616 - protein, 116 aa, Glycine max
  Coding DNA Sequence Number=SeqID_57838
MHIQQDHNLVGGVVVRQRQIHKERKQDIKETFNEDGEVVQEGIDLVLVDIANGGKTANNTEEQETGQEGALQGGSILEVEVSVGVGVGVTFDFGLVVIGTKQALQARLRRGSVDLA

SEQ ID NO: 174617 - protein, 243 aa, Glycine max
  Coding DNA Sequence Number=SeqID_57839
  Gene Ontology: Mol. function=heat shock protein binding; Cellular component=integral to membrane; Biological process=protein folding
  Homolog annotation: Hit_ID=Q2R8U4; Match level="QueryCoverage=73%, HitCoverage=70%, E-value=2e-56, Identity=60%"; Hit description=DNAJ heat shock N-terminal domain-containing protein, putative, expressed
  Pfam annotation: Domain name=DnaJ; Domain location=90-153; Score =104.8; E_value=2.5e-28; Accession=PF00226.21; Description=DnaJ domain
MAFAAAPLIQVVLYGNPKFLFLRSTARCTVHASRRPPPPGPGVDTRIHWENEDEGWIGATNTKHQQTHKPNNNMLQADDFPDFLTASLGSHYEFLGVSPDADVEEIKVAYRKLSKEYHPDTTSLPLKTASEKFMKLREVYNVLSNEESRKFYDWTLAQEAASRHAEKMKMKLEDPRQQQLKNWEPVPDMVDRLGGRNMKLSDQAVSAITIDLFIIVFALCSLSEVGKLLPALHSGIASLSSKQ

SEQ ID NO: 174618 - protein, 260 aa, Glycine max
  Coding DNA Sequence Number=SeqID_57840
  Homolog annotation: Hit_ID=Q6ZI83; Match level="QueryCoverage=84%, HitCoverage=46%, E-value=9e-64, Identity=55%"; Hit description =RanBPM-like
MFCFSLSPSLSLSLPLPLPLPLILFRRSFRGLGRLKLICLTYRIVRSYLLHYGYEDTLNSFDVASKSTVPPIYIAQESGIDEQEITYALNHRKTLRQLIRNGDIDVAFGKLREWYPQIVEDNISATCFLLHCQKFIELVRVGALEEAVKYGRIELSSFYDLPVFKDLVQDCVALLAYERPLESSVGYLLKDSQREVVADTVNAMILSANPNMKDSKHCLHSYLERLLRQLTACCLERRSLNGEQGEAFQLQRVLSSSRRG

SEQ ID NO: 174619 - protein, 122 aa, Glycine max
  Coding DNA Sequence Number=SeqID_57841
  Subcellular localization annotation: CTP_CleavageSite=30; ConfidenceScore=5.29e-01
MACFSTALTTSRNRSTASTTMKSLPPPPPPAATGPPPPLPSTEDHTHSSQLPYIGSLVTLHHHLALCLPHLQMDPWCEANHVRAEKKVRPIDSTTSPFQVDQTTRIAVCPAVVSFPTCQTSR

SEQ ID NO: 174620 - protein, 53 aa, Glycine max
  Coding DNA Sequence Number=SeqID_57842
MERFGVFGGRAPITSKDVFGDVETGWVLSMLEEHQMLIQDKAQFVGQNNNWSN

SEQ ID NO: 174621 - protein, 91 aa, Glycine max
  Coding DNA Sequence Number=SeqID_57843
MKLGLTMLKAQVEGLMCVTEFCTSYYRLLHPMVTINVPALKSLATPLPSLLLRPPSTSPISHAAASVEGAEIVLLVRYLGGIEIKFVYQGE

SEQ ID NO: 174622 - protein, 511 aa, Glycine max
  Coding DNA Sequence Number=SeqID_57844
  Gene Ontology: Mol. function=binding; Cellular component=nucleus; Biological process=protein amino acid phosphorylation
  Homolog annotation: Hit_ID=Q1T2K1; Match level="QueryCoverage=96%, HitCoverage=86%, E-value=2e-58, Identity=25%"; Hit description =Tetratricopeptide-like helical
  Pfam annotation: Domain name=PPR; Domain location=134-168; Score=3.7; E_value=2.7; Accession=PF01535.11; Description=PPR repeat
  Pfam annotation: Domain name=PPR; Domain location=200-234; Score =27.6; E_value=4.5e-05; Accession=PF01535.11; Description=PPR repeat
  Pfam annotation: Domain name=PPR; Domain location=26-60; Score=22.7; E_value=0.0013; Accession=PF01535.11; Description=PPR repeat
  Pfam annotation: Domain name=PPR; Domain location=273-306; Score =15.4; E_value=0.11; Accession=PF01535.11; Description=PPR repeat
  Pfam annotation: Domain name=PPR; Domain location=329-363; Score =35.5; E_value=1.8e-07; Accession=PF01535.11; Description=PPR repeat
  Pfam annotation: Domain name=PPR; Domain location=416-450; Score =43.2; E_value=8.9e-10; Accession=PF01535.11; Description=PPR repeat
  Pfam annotation: Domain name=PPR; Domain location=99-133; Score=32.8; E_value=1.2e-06; Accession=PF01535.11; Description=PPR repeat
  Pfam module annotation: Pfam domain module=PPR::PPR::PPR::PPR::PPR::PP R::PPR; Domain location=134-168::200-234::26-60::273-306::329 -363::416-450::99-133
MALLYISTPNVTLSFVLAPFPHLDTVSSTALISGYVQAGLPHEALHVFDKMHTSAAISDQHGFESSIYVASSLINMYGKCQMLDDARQVFDAISRKNMIVWNAMLGVYSHNGFLSNVMELFLDMTTCGVHLDEFAYTSILSTCACFECLDIGYQLHSAIMKKRFTSNLFANNALIDMYAKAGALKEASKQFEHTTYRDHISWNAIIVGYVQEEAETGALSLFQRMNLDGIVPEELGLETNLFAGSSLIDMYSKCGDIEDTHKIYSSMPEQSVVSVNALIAGYALKNTKESINLLYEMQILGLKPSEITFASLIDVCKGSAKFSNLKSTVMWTALISAHIQNECSDVALSLYQEMHDNNILPDQATFVTVLRTCALLSSLHDDELTSSALVDMYAKCGDIKSAVQVFEELATKKDVISWNSMIVGFAKNGYAKCALKVFDEMTQSCITPDDVTHSLDCLPLVSMQAPSSHCARMVDLLGRWGFLKEAEEFIDKLEVEPNLGQFIGCLQNTWG

SEQ ID NO: 174623 - protein, 77 aa, Glycine max
  Coding DNA Sequence Number=SeqID_57845
MKGETVKEEVHAPIPQLGGSCMGLTQQSSKHFAPVPIKPKSITRIYSDGRGWYGGRHGTNYGFTVVQLWLNGCHKWD

SEQ ID NO: 174624 - protein, 475 aa, Glycine max
  Coding DNA Sequence Number=SeqID_57846
  Gene Ontology: Mol. function=transferase activity; Cellular component= intracellular; Biological process=metabolic process
  Homolog annotation: Hit_ID=Q1SVP9; Match level="QueryCoverage=94%, HitCoverage=99%, E-value=1e-157, Identity=63%"; Hit description =Immunoglobulin/major histocompatibility complex; Tetratricopeptide- like helical
  Pfam annotation: Domain name=PPR; Domain location=163-197; Score =42.3; E_value=1.7e-09; Accession=PF01535.11; Description=PPR repeat
  Pfam annotation: Domain name=PPR; Domain location=198-232; Score =35.4; E_value=2e-07; Accession=PF01535.11; Description=PPR repeat
  Pfam annotation: Domain name=PPR; Domain location=233-267; Score =33.5; E_value=7.1e-07; Accession=PF01535.11; Description=PPR repeat
  Pfam annotation: Domain name=PPR; Domain location=269-303; Score =48.7; E_value=1.9e-11; Accession=PF01535.11; Description=PPR repeat
  Pfam annotation: Domain name=PPR; Domain location=304-338; Score=2.8; E_value=3.5; Accession=PF01535.11; Description=PPR repeat
  Pfam annotation: Domain name=PPR; Domain location=339-373; Score =26.2; E_value=0.00012; Accession=PF01535.11; Description=PPR repeat
  Pfam annotation: Domain name=PPR; Domain location=411-445; Score =11.5; E_value=0.32; Accession=PF01535.11; Description=PPR repeat
  Pfam module annotation: Pfam domain module=PPR::PPR::PPR::PPR::PPR::PP R::PPR; Domain location=163-197::198-232::233-267::269-303::304 -338::339-373::411-445
MEESTASLLFLPFHTLKTKALPFSTLIDVLCSHLHQSNGSVEHSLSKVKPKLDSQSIIQVLNTCRDRPYQPQLGVRFFVWAGFQSGYRHSSYMYTKASYLLRIHHNPQIIRDVIESYEAEGSLVTVNMFREVLKLCKEAQLADMALWVLRKMEDTFNLHADTVMYNLVIRLCCKKGDIETALKLTSEMSSNGLCPDLITYMAIVEGFSNAGRSEEAYSVLKVMRLHGCSPNLVILSAILDGFCRSGSMERALELLDEMEKGGVCTPNVVTYTSVIQSFCKRGQWKEALDILDRMKAFGCHANHVTVFTLVESLCADGHVEQGYGLFDKFVVEHCVSYGDFYSSLVISLIRIKKLEEAEKLFKEMLAGDVRLDTLASSLLLKELCMKDRILDGFYLLEAIENKGCLSSIDSDIYSILLIGLCQRSHLKEATKLAKIMLKKSVLLQPPHKDAAIDILIKSGEKDLVNQLTGIHKKGL

SEQ ID NO: 174625 - protein, 804 aa, Glycine max
  Coding DNA Sequence Number=SeqID_57847
  Gene Ontology: Mol. function=transporter activity; Cellular component= integral to membrane; Biological process=transport
  Homolog annotation: Hit_ID=Q6ZC71; Match level="QueryCoverage=47%, HitCoverage=99%, E-value=1e-135, Identity=61%"; Hit description=Sac domain-containing inositol phosphatase 3-like
  Pfam annotation: Domain name=Syja_N; Domain location=104-321; Score =235.8; E_value=9.3e-68; Accession=PF02383.9; Description=SacI homology domain
MAKSGNKNMGSTAKVHPSNDPELDPDSYALEKFRLYETRARFYLIGSDRNKRFFRVLKIDRSEAWDLNISQDPVLYSPQEIKSLLQRIAEGNRATGGLTFVAKVFGIAGCIKFLESYYLILVTKRRQIGSICGHAIYSIKESQLRTIPHVSIQSDLAHSKTELREGLKEEEQQTRYLKRGVNDRGRVANDVETEQIVLDEESGSCKGKMSSVVQMRGSIPLFWSQEASRFSPKPDIILQRYDPTYQATKLHFEDLAKRYGNPIIVLNLIKTVEKRPREMMLRREFANAVGYLNQILPVENHLRFIHWDFHKFAKSKSANVLAVLGGVASEALDLTGFYYSGKTSIIKRANKSNRTSTGRDTSVRDLRASSGDLVRIGNSNEMLNSVVNQDKETDMNHQNKKDNFGSDAPHFQSGVLRTNCIDCLDRTNVAQYAYGLQALGRQLHAMGLTDVPKVDPDSSIAAALMDMYQSMGDALAQQYGGSAAHNTVFPERQGKWKATTQSREFLKSIKRYYSNAYTDGYFQPQEGKPALWELDSDYYLHVSGIGDDLIPEKCSEPNISPSGRGGMVFMPIPACRDDFSRIKLTSFDMLIEKTCSKIKNVRLCCEPDQRPGGVSGNSGVAPDAAEIQLKSPNWLFGQRKYEEGSSAAKVASRESGVEGSHANGFCDLNWLSSGNDMNEEDVFQRYLTMTSTNEANGWYGGSLLGDQDESSEIYKHYAELCQGPALELFQNDPEKEQHYADALSTSSYEIVNDAVVAAEMEAALKEYDQVGADLGIIPKSCKFYVDDPSWLTRWLTGDEKVPRI

SEQ ID NO: 174626 - protein, 71 aa, Glycine max
  Coding DNA Sequence Number=SeqID_57848
MKSLTWTQVKPPIESSLLDLPTTLTNMSHKENCLVLCHKENPLLHVCHLQPTTYTMVLVDDDSRWPIALRK

SEQ ID NO: 174627 - protein, 144 aa, Glycine max
  Coding DNA Sequence Number=SeqID_57849
MKCPSCSVDISDYLQNIQVDIDLKSAIESLKAKVEEIGETGESSEDADGLQDDGAGKDEDTDSGNKNSIVESDSLPEESNVGELKDTTNKGPDPAVKYNGKRKIGDYGNQSSDDKMEKRGKYYKTTEEALHEEDDSSSNPLNPQ

SEQ ID NO: 174628 - protein, 307 aa, Glycine max
  Coding DNA Sequence Number=SeqID_57850
  Gene Ontology: Mol. function=peptidase activity
  Homolog annotation: Hit_ID=Q8RWB6; Match level="QueryCoverage=65%, HitCoverage=46%, E-value=2e-76, Identity=68%"; Hit description =Putative serine protease-like protein
MTIANNIKTTIPKIETVKEFMGLMKERSQIANKSLVGTLMSTLTTTKFDGSRTMHEHVNEITNITTRLKTLGMTDLAKPSLSRVALAFLMATEFPYCASLDSVSLVPKENWHSNKRPADEQEYSNEVEVRASVEPSEDELADLSRACDKLWDLDLNLLVPCKDYEIDCGEGKKEYQKEDMAQGSLFTWVSDDVFKKPTFARFLSLLDNYNPHQGCKEVVTSEERQEQASFIEEISRTAPIKYLHKYLASKGIVSETCQEFKRMITSLWFDLYGRGGTSGSSSAFEHVFVGETKQCGEVSGFHNMLQL

SEQ ID NO: 174629 - protein, 547 aa, Glycine max
  Coding DNA Sequence Number=SeqID_57851
  Gene Ontology: Mol. function=hydrolase activity, acting on glycosyl bonds; Biological process=polysaccharide catabolic process
  Homolog annotation: Hit_ID=Q5F305; Match level="QueryCoverage=99%, HitCoverage=100%, E-value=0.0, Identity=94%"; Hit description=Beta -amylase
  Pfam annotation: Domain name=Glyco_hydro_14; Domain location=88-505; Score=873.8; E_value=8.2e-260; Accession=PF01373.8; Description =Glycosyl hydrolase family 14
  Subcellular localization annotation: CTP_CleavageSite=40; ConfidenceScore=5.03e-01
MALTLRSSTSFINQKETKVLKTSDDIPATVSFSKFKPLVRLRAKNSMQEAHHTRENSFNEASRSEKWEKVLAPSVAHNHNDSKRVPVYVMLPLDTVTMEGRLNKPRAMNASLMALKSAGVEGVMVDAWWGLVEKDGPLKYNWEPYAELVQMVQMHGLKLQVVMSFHQCGGNVGDNCSIPLPPWVLEEISKNPELVYTDRSGRRNPEYISLGCDSVPVLRGRTPLQVYSDYMRSFRDRFRDYLGSVIVEIQVGMGPCGELRYPSYPETNGTWRFPGIGEFQCYDKYMKASLAAAAEDIGKKEWGGGGPHDSGQYNQFPEDTGFFKREGTWNTEYGQFFLEWYSGKLLEHGERILVSAKGIFQTTGVKLSGKVAGIHWHYRARSHAAELTAGYYNTRHNDGYLPIARMLAKHGVVFNFTCMEMKDREQPDFAYCSPEGLVHQVKMATTTARAELAGENALERYDADAYAQVLSTSKSESGSGLAAFTYLRMNKRLFEGDNWRHLVDFVRNMSEGGRRERLPAADSHGSDLYVGHIKATREKHTQEAALV

SEQ ID NO: 174630 - protein, 101 aa, Glycine max
  Coding DNA Sequence Number=SeqID_57852
MSFLRRSSWTITFKRHRTSKTQRKDAHAKVEYVKRLYDEVNVQIAKKNESYTKQANKKRKEVVLELGDDLGHLRANVFQEGGNDENPETGQIQAKGPSGEG

SEQ ID NO: 174631 - protein, 1019 aa, Glycine max
  Coding DNA Sequence Number=SeqID_57853
  Gene Ontology: Mol. function=transferase activity; Cellular component= integral to membrane; Biological process=response to oxidative stress
  Homolog annotation: Hit_ID=Q9SKA3; Match level="QueryCoverage=99%, HitCoverage=100%, E-value=0.0, Identity=69%"; Hit description=Highly similar to phosphoribosylanthranilate transferase
  Pfam annotation: Domain name=C2; Domain location=286-366; Score =103.0; E_value=9e-28; Accession=PF00168.20; Description=C2 domain
  Pfam annotation: Domain name=C2; Domain location=4-90; Score=79.9; E _value=8e-21; Accession=PF00168.20; Description=C2 domain
  Pfam annotation: Domain name=C2; Domain location=449-530; Score=58.2; E_value=2.7e-14; Accession=PF00168.20; Description=C2 domain
  Pfam annotation: Domain name=C2; Domain location=614-701; Score=79.1; E_value=1.4e-20; Accession=PF00168.20; Description=C2 domain
  Pfam annotation: Domain name=PRT_C; Domain location=864-1019; Score =409.8; E_value=4e-120; Accession=PF08372.1; Description=Plant phosphoribosyltransferase C-terminal
  Pfam module annotation: Pfam domain module=C2::C2::C2::C2::PRT_C; Domain location=286-366::4-90::449-530::614-701::864-1019
MNKLVVEVVEASDLMPKDGEGSASPFVEVKFDEQQHSTETRHKDLNPCWNEKLVFNINNPRDLAHKTIEVVVYNNNHNDRNHNNFLGRVRLSGSSIPLSESQASVERYPLEKRGLFSNIRGDIALRCYTLHDHHHHAHAAAEHHHHHPQVDTPPPPAAAAAAAEEEEEEYQDTPFQEINPNMNTVLDEESAVGGGDKKKKKMQKKEKEVRTFHSIPAAPAMETTQRRVDFAKAGPPNVMLMQQIPKQNPEYSLVETSPPLAARLRYRGGRDKISTTYDLVEQMNYLYVNVVKARDLPVKDITGSLDPYVEVKLGNYKGLTKHLDKNQNPVWNQIFAFSKDRLQSNLLEVTVKDKDIVKDDFVGRVMFDLTEVPLRVPPDSPLAPQWYILEDKKGQKIHNNGEIMLAVWMGTQADESFPEAWHSDAHNISHSNLANTRSKVYFSPKLYYLRVQVIEAQDLVPSDKGRAPDAIVRVQLGNQMRFTRPSQIRGINPVWNDELMFVAAEPFEDFIIVTVEDKVGSSVEILGREIISVRSVPPRHESSKKLPDSRWFNLHRPSAVGEEETEKKKDKFSSKIHLRVCLEAGYHVLDESTHFSSDLQPSSKHLRKKNIGILELGILSARNLLPMKAREGRTTDAYCVAKYGNKWVRTRTLLDTLSPRWNEQYTWEVHDPCTVITVGVFDNHHINGSSDARDQRIGKVRIRLSTLETDRVYTHFYPLLVLQPNGLKKNGELHLAVRFTCTAWVNMVAQYGRPLLPKMHYVQPIPVRHIDWLRHQAMQIVAARLSRAEPPLRREAVEYMLDVDYHMWSLRRSKANFHRIMSLLKGVTAVCKWFDDICTWRNPITTCLVHVLFLILVCYPELILPTIFLYLFVIGIWNYRFRPRNPPHMDARLSQAETAHPDELDEEFDTFPTTKPSDIVRMRYDRLRSVAGRVQTVVGDLATQGERAQAILGWRDSRATSIFIIFSLIWAVFIYITPFQVVAILIGLFMLRHPRFRSKMPSVPVNFFKRLPSKSDMLI

SEQ ID NO: 174632 - protein, 247 aa, Glycine max
  Coding DNA Sequence Number=SeqID_57854
  Gene Ontology: Mol. function=4 iron, 4 sulfur cluster binding; Cellular component=integral to membrane; Biological process =metabolic process
  Homolog annotation: Hit_ID=Q01CK2; Match level="QueryCoverage=99%, HitCoverage=53%, E-value=3e-84, Identity=54%"; Hit description=[T] KOG2492 CDK5 activator-binding protein
MDTIITKGKSSNKPLVVAGCVPQGSRDLKELQGISIVGVQQIHRVVEIVEETLKGHEVRLLTRKKLPTLDLPKVRKNKFVEILPINVGCLGACTYCKTKHARGHLGSYTIDSLGFKRYGLAVRTLEHLIAEILRHPCVYSFLHVPVQSGSDTILSAMNREYTVSEFRTVVDTLTELVPEMQIATDIICRFPGETDEDFVQTVNLIEEYKFPQVHISQFYPRPGTPAARMKKVPSNVVKRRSRELTCL

SEQ ID NO: 174633 - protein, 162 aa, Glycine max
  Coding DNA Sequence Number=SeqID_57855
  Gene Ontology: Mol. function=transcription regulator activity; Cellular component=nucleus; Biological process=regulation of transcription
  Homolog annotation: Hit_ID=Q9C8P8; Match level="QueryCoverage=69%, HitCoverage=49%, E-value=8e-12, Identity=36%"; Hit description=Helix- loop-helix protein 1A, putative; 28707-26892
MEGSRLQKQTNLKAKRFDKQRRGEEKAMQPTSGGGGLARFRSAPASWLESVLLKEEEEEEDPLSFTQLLSTIDDAPSHSQHQLYGAALSNKDKTPEIFMLEDSVPCRVRAKRGCATHPRSIAERVRRTRISDRIRKLQELVPNMDKVFLFFLSFTFQFIYQP

SEQ ID NO: 174634 - protein, 383 aa, Glycine max
  Coding DNA Sequence Number=SeqID_57856
  Homolog annotation: Hit_ID=Q9XES7; Match level="QueryCoverage=99%, HitCoverage=100%, E-value=1e-117, Identity=62%"; Hit description =Seed maturation protein PM27
MMMNVLGLSLVLTSLAAAGIFSPNPRTEKHGASTIVKEGHRVVVVEYDQGGHQKTKISISPEQPTHHHDHDDDLIKEAASVLPNLCQGISSSSQYSHQPQNHMDHGPLNLHAPNPKELICDAYGKCKHKISDAMEKAQEAIHKKKDKICKTKETVYDKAHDVHEYAQDTVEAAKEDMASNVSNAKDALKLLIGGSMESLNSLMGVANLLGFATAYGICVWVTFISSYVQSRTMPRQQFAVVQSKIYPVYFRAMAYSIALAFLAHFLAHRNTNSDMLQSYNLLASLATLFLNYLYLEPRATKLMLERIKIEKEEGRGRSQDMMSSRTVDPKEPADQEDALRSRIIKLNDKLKKFNSYSSFLNILNLMSLTWHLVYLAQRLHHIC

SEQ ID NO: 174635 - protein, 118 aa, Glycine max
  Coding DNA Sequence Number=SeqID_57857
  Gene Ontology: Mol. function=transition metal ion binding; Biological process=electron transport
MYPVVRYIKILKGYTKNLHRLEASIIERYIAEEAIKFFSEYIEKAKHVGLPESRHDDRVGVLPYILQHEGLVKQSNPKMSKNWVLKKHNKTFSDWFKDTIFADENASETLRKLADGPK

SEQ ID NO: 174636 - protein, 51 aa, Glycine max
  Coding DNA Sequence Number=SeqID_57858
MFYCKGNPGLAEVMAAIFAIEKAVENSWRHLWLETCSFFKLLSPRTWFPDP

SEQ ID NO: 174637 - protein, 52 aa, Glycine max
  Coding DNA Sequence Number=SeqID_57859
  Gene Ontology: Mol. function=transporter activity; Cellular component= integral to membrane; Biological process=oligopeptide transport
  Homolog annotation: Hit_ID=Q9C7H5; Match level="QueryCoverage=92%, HitCoverage=53%, E-value=1e-10, Identity=61%"; Hit description =Oligopeptide transporter, putative
MAIIDGTEENNAYSDKHLKRSSGYVKAQKYCSLHSNLLLDKEGRNLSKHHKA

SEQ ID NO: 174638 - protein, 44 aa, Glycine max
  Coding DNA Sequence Number=SeqID_57860
MRECKCTPSNEPRSATEHESCSLLEYLWCWKLYKSVSKCLLDSV

SEQ ID NO: 174639 - protein, 260 aa, Glycine max
  Coding DNA Sequence Number=SeqID_57861
  Gene Ontology: Mol. function=transcription factor activity; Biological process=regulation of transcription, DNA-dependent
  Homolog annotation: Hit_ID=Q65QR1; Match level="QueryCoverage=100%, HitCoverage=87%, E-value=1e-117, Identity=76%"; Hit description=LysR protein
  Pfam annotation: Domain name=HTH_1; Domain location=1-47; Score=49.6; E_value=1e-11; Accession=PF00126.17; Description=Bacterial regulatory helix-turn-helix protein, lysR family
  Pfam annotation: Domain name=LysR_substrate; Domain location=70-260; Score=7.4; E_value=0.00027; Accession=PF03466.10; Description=LysR substrate binding domain
  Pfam module annotation: Pfam domain module=HTH_1::LysR_substrate; Domain location=1-47::70-260
MNFREAAVRLAISPSVVTRTIAELENQLGEPLFKRNTRSIVLTSFGELFLPKAMRLLEDSEALFQTARDDNDMKGVVRITLFRFPGHEQVLYKLLTSLDPYPELFIDWRLDMMKLDTVQNRIDMGIRIEREPNPNFIVRPITLVHHALMTSPGLIEKLGAPKNFDDLRQRYPFSGLLNPETGKVFEYMLDGVDTFVPRHLEFFTTDSQSEIQAALAGKAVIQSSNLACREYLEDGRLVNVLPELKLETWQLYLYRPYQTL

SEQ ID NO: 174640 - protein, 64 aa, Glycine max
  Coding DNA Sequence Number=SeqID_57862
MGPNKLSTFVPAANKSEVPPESELGSFIRALLGHPVGQPMRISLGFLNVAHLTTQYMDVTSLLA

SEQ ID NO: 174641 - protein, 183 aa, Glycine max
  Coding DNA Sequence Number=SeqID_57863
  Gene Ontology: Mol. function=chromatin binding; Cellular component =chromatin; Biological process=chromatin assembly or disassembly
  Pfam annotation: Domain name=Chromo; Domain location=131-183; Score =18.6; E_value=0.0063; Accession=PF00385.14; Description='chromo' (CHRromatin Organisation MOdifier
MELLKDYDCTIVYHPVKEFQDLVASGVRFEVTGAESLLAHVHVRSTLVYTIKVTQGEDPHLRKIVEETQAGKVFDFVVDSEVGEPWLVGPNLIQEVVEKGKLSSRFISPFEILERVGQMAYCLSLPPDLSKQPATIVDKRVKCLRYKDVVLVKVAWRGPAGEEMTWEPKIVMRDKYPNLFATQ

SEQ ID NO: 174642 - protein, 270 aa, Glycine max
  Coding DNA Sequence Number=SeqID_57864
  Gene Ontology: Mol. function=oxidoreductase activity; Cellular component=chloroplast thylakoid membrane
  Homolog annotation: Hit_ID=Q38M75; Match level="QueryCoverage=76%, HitCoverage=69%, E-value=8e-72, Identity=62%"; Hit description =Ripening regulated protein-like
  Pfam annotation: Domain name=ADH_zinc_N; Domain location=116-234; Score=-13.3; E_value=0.064; Accession=PF00107.16; Description=Zinc -binding dehydrogenase
  Subcellular localization annotation: CTP_CleavageSite=85; ConfidenceScore=5.63e-01
MKEGNWLWMMNSYSQVASSTVLVFHLTSHCVMVSPSLLTSRAAKISSGSATSVTPLPSPLAYGGGLAEFVVASESLTAARPSEVSAAEAAALPIAGLTASDALTQIAGVKLDGTGQLKNILVTAASGGVGHYTVQLAKLGNTHVLDYRTPEGAALKSPSGRKYDAVINCTTGISWSTFDPNLTEKAVVVDLTPNASSLWTAAVKKITFSKKQLVPFFVNVQREGLEYLLQLMKDGKLKSVIDSKFPLSKAEDAWAKSIDGHATGKIIVEP

SEQ ID NO: 174643 - protein, 105 aa, Glycine max
  Coding DNA Sequence Number=SeqID_57865
METILRGRSDARGRQENLLGRRSTQQEAATGEEAATNMKQKQHARKNDEVIVVVCMREGEDKREAKEGDEEGEDLAYAEEKMEKEKTKRGGENGKGEDKATTREE

SEQ ID NO: 174644 - protein, 277 aa, Glycine max
  Coding DNA Sequence Number=SeqID_57866
  Gene Ontology: Mol. function=N-acetyltransferase activity; Biological process=metabolic process
  Homolog annotation: Hit_ID=Q01FG8; Match level="QueryCoverage=56%, HitCoverage=26%, E-value=5e-15, Identity=31%"; Hit description =Homology to unknown gene
  Pfam annotation: Domain name=Acetyltransf_1; Domain location=156-244; Score=41.4; E_value=3e-09; Accession=PF00583.14; Description =Acetyltransferase (GNAT) family
  Subcellular localization annotation: CTP_CleavageSite=53; ConfidenceScore=5.40e-01
MAHLLASNPNASQKLICSNLEYYGVRSRRGSRTTSACYRVGRKRRCGLVLQCSSTTDQDVRLQIENGSSGKLKQQFEYLVCEYGWKVRRLFENADEIKKASQVQAEAFHVPVSLFNDLFFQFFQAEVLSGLLYKLKNSPPNRYACLVAETAIDDPDSAKQLVGVIDVTVLRDQNVLQHLPPEAEEYLYISGIAVSKTFRRRKIATALLKACDMLSILWGFEFLALRAYEEDLGARKLYTNAGYQVVSRDPPWTSPALTIITEEFAYFTWITESTTTE

SEQ ID NO: 174645 - protein, 413 aa, Glycine max
  Coding DNA Sequence Number=SeqID_57867
  Gene Ontology: Mol. function=protein serine/threonine kinase activity; Cellular component=nucleus; Biological process=protein amino acid phosphorylation
  Homolog annotation: Hit_ID=Q53VM4; Match level="QueryCoverage=99%, HitCoverage=74%, E-value=1e-178, Identity=77%"; Hit description =Ser/Thr protein kinase
  Pfam annotation: Domain name=Pkinase; Domain location=1-176; Score =166.3; E_value=7.7e-47; Accession=PF00069.15; Description=Protein kinase domain
  Pfam annotation: Domain name=Pkinase_Tyr; Domain location=1-180; Score=-110.6; E_value=1.1e-05; Accession=PF07714.7; Description =Protein tyrosine kinase
  Pfam module annotation: Pfam domain module=Pkinase::Pkinase_Tyr; Domain location=1-176::1-180
MEYVKSGELFDYIVEKGRLQEDEARNFFQQIISGVEYCHRNMVVHRDLKPENLLLDSKCNVKIADFGLSNIMRDGHFLKTSCGSPNYAAPEVISGKLYAGPEVDVWSCGVILYALLCGTLPFDDENIPNLFKKIKGGIYTLPSHLSPNARDLIPGMLVVDPMRRMTIPEIRQHPWFQARLPRYLAVPPPDTMQQAKKIDEEILQEVVKMGFDRNQLVESLGNRIQNEINPLLPSMYFRVLWHTICYWTTDSVFPVAILELSFKRPCQEDGEGQQNIWYLGTPTEGCIGNDSGFNQMQNSSVVGNRFPGYLEYPGVGSRQQFPVERKWALGLQSRAHPREIMTEVLKALQELNVCWKKIGHYNMKCRWVAGIPGHHEGMVNNNVDNNNFFGDDSNIIENDAVSTSNVVKFEVQL

SEQ ID NO: 174646 - protein, 64 aa, Glycine max
  Coding DNA Sequence Number=SeqID_57868
MQAFPEPETGRQQVSSPEKGEKRRNKKVKRQDLGAAETPLYPATFHAKSSTKVTATFKKAMPAL

SEQ ID NO: 174647 - protein, 75 aa, Glycine max
  Coding DNA Sequence Number=SeqID_57869
  Gene Ontology: Mol. function=protein serine/threonine kinase activity; Biological process=protein amino acid phosphorylation
  Homolog annotation: Hit_ID=Q53VM4; Match level="QueryCoverage=82%, HitCoverage=12%, E-value=1e-26, Identity=93%"; Hit description =Ser/Thr protein kinase
MDGPAGRGGAGLDMFLPNYKLGKTLGIGSFGKVKIAEHVLTGHKVAIKILNRRKIKNMEMEEKDFPIFPAVCFVL

SEQ ID NO: 174648 - protein, 607 aa, Glycine max
  Coding DNA Sequence Number=SeqID_57870
  Gene Ontology: Mol. function=indole-3-acetic acid amido synthetase; Cellular component=cytoplasm; Biological process=response to auxin stimulus
  Homolog annotation: Hit_ID=O81829; Match level="QueryCoverage=99%, HitCoverage=99%, E-value=0.0, Identity=82%"; Hit description=Indole -3-acetic acid-amido synthetase GH3.5
  Pfam annotation: Domain name=GH3; Domain location=16-579; Score =1270.6; E_value=0; Accession=PF03321.4; Description=GH3 auxin -responsive promoter
MPEAPRDYNLFEQNKKTLEFIEDVTANADQVQKRVLSEILSNNANVEYLKRHDLHGQTDRETFKKLLPVITYEDIQPDINRIANGDTSPILCSKPISEFLTSSGTSGGERKLMPTIEEELGRRSLLYSLLMPVMSQFVPGLEKGKGMYLMFIKSEAKTPGGIVARPVLTSYYKSSYFKDRPYDPYTNYTSPNETVLCPDSYQSMYSQLLCGLCQHKEVLRVGAVFASGFIRAIRFLEKHWPLLCHDIRTGTINNTITDLSVRDAVMKILKPDPRLGDLIQSECGKSSWQGIITRLWPNTKYVDVIVTGTMSQYIPTLDYYSNGLPLVCTMYASSECYFGVNLNPLCKPSEVSYTLIPTMCYYEFLPVNRSNGVSHDSLHTPRSLNEKEQQELVELVDVKLGQEYELVVTTYAGLYRYRVGDVLRVAGFKNKAPQFNFVCRKNVVLSIDSDKTDEVELQNAMKNAVTHLVPFDASVSEYTSYADTTTIPGHYVLYWELSLKGSTPIPPCVFEDCCLAIEESLNSVYRQGRVSDKSIGPLEIKIVEQGTFDKLMDYAISLGASINQYKTPRCVKFAPVVELLNSRVVEKYFSPKCPKWVPGHKQWINQN

SEQ ID NO: 174649 - protein, 81 aa, Glycine max
  Coding DNA Sequence Number=SeqID_57871
MIFSLLSINNRQIQTEHNSPAYIIPLLQPVITHGEQVYLRVRKMLLKKMVASDDLNSLEELIGRLKRLKKNVGFVDLNEAN

SEQ ID NO: 174650 - protein, 233 aa, Glycine max
  Coding DNA Sequence Number=SeqID_57872
  Homolog annotation: Hit_ID=Q1SN43; Match level="QueryCoverage=28%, HitCoverage=12%, E-value=5e-09, Identity=43%"; Hit description =Nucleic acid-binding, OB-fold, subgroup
MNPKVTNRIMMKQIWVHDDICWNITKIFLDSTTFVIFDQDATILFSKSCANMFETHHKKGFAGTFPREITNLVDRSFLFKVDVKSGCSSQFKKTFRDFMPNFCDVVENDSQCCEKEAIDLSKDFEEFTPNKHNFCCKSVMGELTLNESEFATQTKENDVLFYSSGDLTLPKNMEGEDKQLEGWCFVNVKTNENSILKGKTNGVGMDVELMQSQSLEIHLPLKSLKKRIKVEKI

SEQ ID NO: 174651 - protein, 93 aa, Glycine max
  Coding DNA Sequence Number=SeqID_57873
  Subcellular localization annotation: CTP_CleavageSite=55; ConfidenceScore=5.02e-01
MYCESMRPICRNGSNGSVSLMCKKKIPHFKSLKISQNAQHSENMTRRKKSNKNAMANAPGNDDFLRDTMIGGFMTFDFFLHVCVLPYNVIPFM

SEQ ID NO: 174652 - protein, 295 aa, Glycine max
  Coding DNA Sequence Number=SeqID_57874
  Gene Ontology: Mol. function=helicase activity; Biological process =viral genome replication
  Homolog annotation: Hit_ID=Q2R1R7; Match level="QueryCoverage=98%, HitCoverage=20%, E-value=1e-54, Identity=37%"; Hit description=AT hook motif-containing protein, putative
MEFGRDIVFKNIYGQLQRLHETHTSFILLQYPLLFPYIEDAFQEDIPISQLTNNMENCRRVCVTLRESIAFRIQDRSVEFNTILNARRLFQQFSIDCYSMVESQCLTWIRFNQKAIRFDVLNGLQEVVSRGEKNPSSIGKHVILPSSFTGGMRYMFQNCQDAMAICELPNPDLYPKLSKAVATYMLHGPCGLANLKSLCMKDRKCSKYFPKKFENSTTIDDDGYPCYRRRDMGMSIQKNGVTLDNRNVVPYSPMLLMRYEGHINTEYYNKSNSIEYLFKYVTKGPDRATIEIRNS

SEQ ID NO: 174653 - protein, 116 aa, Glycine max
  Coding DNA Sequence Number=SeqID_57875
MSSRKKKMKKNKNAIDDAPRNDDFLRDTMIGAFMTFDFFFQFWKTFKNEVSTDWELIDKQGRVSKVELLENDKDSIAIYKGVADIDDPRVSAYQWRRRNCEDTLNASKEMMFIPPL

SEQ ID NO: 174654 - protein, 143 aa, Glycine max
  Coding DNA Sequence Number=SeqID_57876
WFIHSTIIATGKHIEGVVFLQRSGSDIALVGPTYTCPSFSLGLEFLIVCPYCTERKTIPPPNRSLIEQVSNYEYIQHEHYASSTGIGLDCLNKISARFLDRYQLSIKLVIFYTYNMRQKINVTPQILGPMLEELQASWHLTFS

SEQ ID NO: 174655 - protein, 561 aa, Glycine max
  Coding DNA Sequence Number=SeqID_57877
  Homolog annotation: Hit_ID=Q9LI95; Match level="QueryCoverage=82%, HitCoverage=89%, E-value=1e-159, Identity=62%"; Hit description =Arabidopsis thaliana genomic DNA, chromosome 3, P1 clone:MUO22
  Pfam annotation: Domain name=DUF1336; Domain location=303-544; Score =497.1; E_value=2e-146; Accession=PF07059.3; Description=Protein of unknown function (DUF1336)
  Subcellular localization annotation: CTP_CleavageSite=71; ConfidenceScore=5.27e-01
MGGCVSVPSNAIKAPRKIRRRITKPRLKFSNSLPGEIIKKRNSNAGARVTDYSVSEVVRMNFENGATTTCRRSEVSNSAFHLTQLQWHHSQYDADANLVSQEETYFDSVSILESDSDDEFNSVHGDLYADGFPIVGSTVGNIPCGQVLQYGRSTCFTDNRCQYEEYHESYVKVDGGNQDSLKGKDESGFALISTQGVGMSCLGKSQGSFKGIKEYKHGLEEKPQENARKSGLLRLAPSVSFNDKTPNRPSKRLSQIFRLSFKRRSCDIEDANELSQSKRYLIRPRAGHTIPCQNGEKPSHGCWSEIPPSTFQLRGENYFKDKHKSPAPNHSPYIPIGVDLFVCRRKIHHIARHLELPNVKANGKIPQLLIVNIQLPTYPVAMFLGDSDGEGMSLVLYFKVSETLDEHISSQFQESIMKLVEDETEKVKGFAKESSVAFRERLKIMVGLINPEDMRLSSAEKKLVNAYNGKPVLSRPQHNFYKGPNYFEIDLDIHRFSYISRKGLDAFRDRLKDGILDLGLTIQAQKQEELPEKVLCCLRLNKIDLNDNGQMPMLMTVDGEC

SEQ ID NO: 174656 - protein, 72 aa, Glycine max
  Coding DNA Sequence Number=SeqID_57878
  Homolog annotation: Hit_ID=Q9LK62; Match level="QueryCoverage=90%, HitCoverage=4%, E-value=6e-10, Identity=53%"; Hit description =Multidrug resistance-associated protein 7
MVNPVKQLFSKCTVITIAHRITSILDSDMVLFLNQVLIEEYDSPKKLLKNKSSSLAQLVAEYARRSDSGFGT

SEQ ID NO: 174657 - protein, 207 aa, Glycine max
  Coding DNA Sequence Number=SeqID_57879
MSVVTAQPQTSPTAEVRLISTELQVQECYKLYVEPTRGCRKLTMEDEYMVSPKFPFNFKLPFFLSICEVTCDSYIEEELERLPISSGLARYLKPFILESVLFHSVAAIQLATGQQGIFPRAIVHQTVIRKGRITLPGKYNVILRSDTDIMELVGAHREDLSSVMSSKRMPTFKTLSITTKDTDSLRDLELEPKVRSRMSIVICQIFS

SEQ ID NO: 174658 - protein, 42 aa, Glycine max
  Coding DNA Sequence Number=SeqID_57880
MCEMCTVEMQCYSISGGMIVVAEACKRINELKCCAQRDLLVQ

SEQ ID NO: 174659 - protein, 598 aa, Glycine max
  Coding DNA Sequence Number=SeqID_57881
  Gene Ontology: Mol. function=protein serine/threonine kinase activity; Cellular component=nucleus; Biological process=protein amino acid phosphorylation
  Homolog annotation: Hit_ID=Q9FF35; Match level="QueryCoverage=95%, HitCoverage=58%, E-value=1e-128, Identity=45%"; Hit description =Similarity to protein kinase
  Pfam annotation: Domain name=Pkinase; Domain location=274-546; Score =134.1; E_value=3.8e-37; Accession=PF00069.15; Description=Protein kinase domain
  Pfam annotation: Domain name=Pkinase_Tyr; Domain location=274-546; Score=113.2; E_value=7.7e-31; Accession=PF07714.7; Description =Protein tyrosine kinase
  Pfam module annotation: Pfam domain module=Pkinase::Pkinase_Tyr; Domain location=274-546::274-546
  Subcellular localization annotation: CTP_CleavageSite=62; ConfidenceScore=5.43e-01
MVRTGLIYDHCSSSALTNTSFNSSLFRYSQNVTNITIFYGCPSSVFANRNYSFPCKEDHNMSAFYGDPETARVQDCEGPRIEVQVSKEPVLGEGIEGLNKALSEGFRVHLISEAQVQQCLECVVSNGTCGANDESQFTCFCQDGTEGLDCSDHHRIYDWRGAEIFKVLDFFKGDQQLVASEFEIYFPDSGNKWNWERKVGIGVSAAVLGAIVVSIGFYICSRQKKKKNLHAVSSSVQSKETSYSSSIEDTEKGCTYFGVHFFTYSELEEATNFFDPARELGDGGFGTVYFGKLHDGRVVAVKRMYENSYRRVEQFVNEVEILTGLHHQNLVSLYGCTSRHSRELLLVYEYIPNGTVADHLHGQRAKPGTLAWHTRMNIAIETASALVYLHASEIIHRDVKTNNILLDNHFSVKVADFGLSRLLPTHATHVSTAPQGTPGYVDPEYNEYYQLTDKSDVYSFGVVLIELISSMPAVDISRRRHEINLSNMAIKKIQSGALHEIVDTTLGFETDFKVRKMISAVAELAFQCLQSSKDVRPSMAEVLDRLEDIRSDGSHRSKHEVLDISEDDAALLKNVPPPPSPDSHLVTISNSTPPNDSQ

SEQ ID NO: 174660 - protein, 629 aa, Glycine max
  Coding DNA Sequence Number=SeqID_57882
  Gene Ontology: Mol. function=protein serine/threonine kinase activity; Cellular component=nucleus; Biological process=protein amino acid phosphorylation
  Homolog annotation: Hit_ID=Q1RZY7; Match level="QueryCoverage=93%, HitCoverage=97%, E-value=0.0, Identity=64%"; Hit description=Protein kinase
  Pfam annotation: Domain name=Pkinase; Domain location=108-392; Score =302.8; E_value=6.5e-88; Accession=PF00069.15; Description=Protein kinase domain
  Pfam annotation: Domain name=Pkinase_Tyr; Domain location=108-372; Score=45.6; E_value=2.9e-15; Accession=PF07714.7; Description =Protein tyrosine kinase
  Pfam module annotation: Pfam domain module=Pkinase::Pkinase_Tyr; Domain location=108-392::108-372
  Subcellular localization annotation: CTP_CleavageSite=25; ConfidenceScore=5.55e-01
MGCASSKKTVAGAGGSTPEGPCMVRSSSRRQGNNGSGRNRKGVAAEAREGEAREWSKGSLRGGTGSVSLRLSCRFVEAEQNAAGWPPWLTSVAGEAIQGWVPLKTDSFERLDKIGQGTYSSVFQAREVETGRMVALKKVRFDKLQAESIRFMAREILILRTLDHPNIMKLEGIITSQLSNSIYLVFEYMEHDLAGLVASPDIKFTDSQIKCYMRQLLSGIEHCHLKGIMHRDIKVSNILVNNEGVLKIADFGLANTLSPNSKQPLTSRVVTLWYRPPELLLGSTSYGVSVDLWSVGCVFAELFLGKPILKGRTEVEQLHKIFKLCGSPPEEFWKKNKLPLATMFKPKANYETSLQERCRGFPATAVNLLETLLSIDPSKRRTASSALMSEYFSTKPYACNPSHLPKYPPSKEMDAKNREEVRRKKNGGKVREAVTSKRQRQVHKVSHDHINFNQPALKEEMQNVSQNPGTNDGRAYVTKGKVAGAMHKEQPKPSYDAKSEAAQVVNGCNGYSVYSGPAPISGSSGFTWAKRRKPKASSILSDGSRSKVSALDPTFAKGTYDLTEHGIEVSERKHSYNTSHRDETSSYVSKKYQAPLVQQKSFDVADTYNSNYYMDFDFTDKMDALIDTQ

SEQ ID NO: 174661 - protein, 54 aa, Glycine max
  Coding DNA Sequence Number=SeqID_57883
MEEPIAFVMKHRRMQRLNLNSSQGGPLYMLFFAIHYMASILMETWHGCIFLHQN

SEQ ID NO: 174662 - protein, 596 aa, Glycine max
  Coding DNA Sequence Number=SeqID_57884
  Gene Ontology: Mol. function=sequence-specific DNA binding; Cellular component=nucleus; Biological process=regulation of transcription
  Homolog annotation: Hit_ID=Q39658; Match level="QueryCoverage=93%, HitCoverage=89%, E-value=1e-118, Identity=55%"; Hit description=SPF1- like DNA-binding protein
  Pfam annotation: Domain name=FLYWCH; Domain location=483-551; Score =1.1; E_value=0.053; Accession=PF04500.7; Description=FLYWCH zinc finger domain
  Pfam annotation: Domain name=WRKY; Domain location=305-363; Score =148.9; E_value=1.3e-41; Accession=PF03106.6; Description=WRKY DNA -binding domain
  Pfam annotation: Domain name=WRKY; Domain location=494-553; Score =156.4; E_value=7.4e-44; Accession=PF03106.6; Description=WRKY DNA -binding domain
  Pfam module annotation: Pfam domain module=FLYWCH::WRKY::WRKY; Domain location=483-551::305-363::494-553
  Subcellular localization annotation: CTP_CleavageSite=74; ConfidenceScore=5.63e-01
MSTPNTDSGTAPPPRPTITLPPRPSAEAFFSAAAGASPGPMTLVSSFFGSDAAADCRSFSQLLAGAMASPMAFSAAAAAADNSGKDDDGPHKGFKQSRPMNLVIARSPVFTVPPGLSPSGFLNSPGFFSPQRGVGSIDGDVGLKFGDFGWTDSGVSEDFWGLHYITSFVGRAAGSFSLVIIINVIFLPWGWWIYSFEVFTIASIQCIQSPFGMSHQQALAQVTAQAVLAQSHMHMQADYQMPAVTAPTEPPVRQLSFALNEASEQQVVSCVSSVSEPRNAQLEAPELSQADKKYQPSSQAIDKPADDGYNWRKYGQKQVKGSEYPRSYYKCTHLNCVVKKKVERAPDGHITEIIYKGQHNHEKPQANRRAKDNSDSNGNVTVQPKSESNSQGWVGQLNKFSEKIPDSSVAKSDQTSNQGAPPRQLLPGSSESEEVGDVDNREEADDGEPNPKRRQAKFLLFRNTDVGVSEVPLSQKTVTEPKIIVQTRSEVDLLDDGYRWRKYGQKVVKGNPHPRSYYKCTSAGCNVRKHVERASMDPKAVITTYEGKHNHDVPAARNSSHNTASSNSMPLKPHNVVPEKHPLLKDMDFGSTDQRP

SEQ ID NO: 174663 - protein, 213 aa, Glycine max
  Coding DNA Sequence Number=SeqID_57885
  Homolog annotation: Hit_ID=Q9ZU41; Match level="QueryCoverage=92%, HitCoverage=48%, E-value=3e-26, Identity=39%"; Hit description =Predicted by genscan and genefinder
  Pfam annotation: Domain name=DUF789; Domain location=88-205; Score= -54.3; E_value=5e-12; Accession=PF05623.3; Description=Protein of unknown function (DUF789)
MLGTALQFSGVRGEDRFYIPVKARKNQNQRKQSHRAKNNEPENADLASKNKVDVSENSNNNSNIKSKSDSNLNQSLKPTLSPSVEAVSNIDRFLEFTTPSVPAQYFSKTTMRGWKFCDVEYQSYFTLSDLWESFKEWSAYGAGVPLVLDQSDSVVQYYVPYLSAIQLYAHSAEKSSAKPSRQGKLKTTLFFPVNNADLSPQLSIFNPSLPLRP

SEQ ID NO: 174664 - protein, 103 aa, Glycine max
  Coding DNA Sequence Number=SeqID_57886
  Homolog annotation: Hit_ID=Q1SUH7; Match level="QueryCoverage=91%, HitCoverage=6%, E-value=5e-15, Identity=43%"; Hit description =WW/Rsp5/WWP; Synaptojanin, N-terminal; Galactose-binding like
MIVVILDSNQVFIVVSLCTRTNTYVIYVDPTTDTLRHKAKLGFNLFKLQGKALDFITKGLRFAYRSKMFTRVLYNRQALTMVCLRIVKAWCPNVPMMTGCPAL

SEQ ID NO: 174665 - protein, 89 aa, Glycine max
  Coding DNA Sequence Number=SeqID_57887
MVEKSMWKINIFYKDDYKEVGCMEMGEKDRGIGSTSVNNTYRRASNIQASCQLALSLSETFSTHSVSGVRLNPTSSTHQNYRLNYSLEF

SEQ ID NO: 174666 - protein, 171 aa, Glycine max
  Coding DNA Sequence Number=SeqID_57888
  Gene Ontology: Mol. function=protein-tyrosine kinase activity; Cellular component=integral to membrane; Biological process=protein amino acid phosphorylation
  Homolog annotation: Hit_ID=Q17U57; Match level="QueryCoverage=75%, HitCoverage=56%, E-value=2e-31, Identity=51%"; Hit description =Receptor protein kinase, putative
  Pfam annotation: Domain name=Pkinase_Tyr; Domain location=56-171; Score=-119.9; E_value=4.1e-05; Accession=PF07714.7; Description =Protein tyrosine kinase
MDKDKSNTHSFLHSIVKHFKFGSPKERNNEADIQQMAAQEQKIFAYETLAAATKNFSAIHKLGEGGFGPVYKGKLNDGREIAVKKLSHTSNQGKKEFMNEAKLLARVQHRNVVNLVGYCVHGTEKLLVYEYVAHESLDKLLFSKFFYANPLFCPTKIIDEMNPMFQKVASS

SEQ ID NO: 174667 - protein, 314 aa, Glycine max
  Coding DNA Sequence Number=SeqID_57889
  Gene Ontology: Mol. function=chorismate mutase activity; Cellular component=chloroplast; Biological process=aromatic amino acid family biosynthetic process
  Homolog annotation: Hit_ID=Q30CZ6; Match level="QueryCoverage=83%, HitCoverage=82%, E-value=9e-97, Identity=67%"; Hit description =Putative chorismate mutase
  Pfam annotation: Domain name=CM_2; Domain location=74-141; Score =18.7; E_value=0.002; Accession=PF01817.11; Description=Chorismate mutase type II
  Subcellular localization annotation: CTP_CleavageSite=74; ConfidenceScore=5.49e-01
MEAEVLRATMSPPPFPLSGSSTKTHRACFPFNPISWNGKTLGLSLQAFPPSSSGHVPSEKSDDGSENLTLESIRRSLIRQEDSIIYSLLKRAQHLYNAKTYDPEDFSMDGFHGSLVEYLVRESEKLHAKVGRYMCPDEHPFFPHDLPESMLPCHYAQVLHHNADSININDQVWMMYFGDLIPRLAKEGDDGHYESTSICDIMCLQALSKRIHYGKFVAEAKFQANPDNYKDAILAQDKDRLMDMLTYPKVEEENMIRVEEKAKKFGLVVDLNAKKPRAEPLYIINPSVVSDLYGHWVMPLTKEVQVAYLLRRLD

SEQ ID NO: 174668 - protein, 107 aa, Glycine max
  Coding DNA Sequence Number=SeqID_57890
MFVRGVRYTSEDSEGDYYRDSCSEGSSDYEYGKRTEFMTQRSSQHLTGGVSLKMDTLSMHDKCSTVQEGFSSDDSETGNPQDLLFEYFEQDPPYSREPLADKEITDP

SEQ ID NO: 174669 - protein, 655 aa, Glycine max
  Coding DNA Sequence Number=SeqID_57891
  Homolog annotation: Hit_ID=Q6ZFY2; Match level="QueryCoverage=30%, HitCoverage=47%, E-value=4e-53, Identity=52%"; Hit description =Receptor protein kinase-like
  Pfam annotation: Domain name=Pkinase; Domain location=2-188; Score= -39.6; E_value=3.3e-06; Accession=PF00069.15; Description=Protein kinase domain
  Pfam annotation: Domain name=Pkinase_Tyr; Domain location=1-188; Score=-82.6; E_value=2.1e-07; Accession=PF07714.7; Description =Protein tyrosine kinase
  Pfam module annotation: Pfam domain module=Pkinase::Pkinase_Tyr; Domain location=2-188::1-188
MDDAESQKREQLDWKRRIGIITGVAKGLLYLHEDSHNCIIHRDIKASNILLDDKWTPKIADFGMARLFPEDQSQVHTRVAGTNGYMAPEYVMHGNLSVKADVFSYGVLVLELITGQRNSSFNLDVDAQNLLDWAYKMYKKGKSLEIVDSALASTIVAEEVAMCVQLGLLCTQGDPQLRPTMRRVVVMLSRKPGNMQEPTRPGVPGSRYRRPRRHSALSSTVGTSGASDSHTSDSSNNYNTTVTTSATGTISATAETDPKGKRPIREAMRRTLVRNGSLYTRNLLHHSALALAASSRPQFRLFSSNENPPPVPQIDDVNNKELKAQIETYFKGDEKVLPSIMEAILKRKLSGNHEDTDDELMEELRMRPLDDVDDRDFESDFESIHDTDEEIDDLYNARDVVMKRMVKDEYFNMDDKKWDDIVEDGIKHGLLRDTKECEEILEDMLSWDKLLPGELEPEEAYEQFKKFEDEIVAKYLDKMEKEEASQFDDTVVPDKKKDLDDPPGEGPILRWQTRVVFAPGGDAWHPKNRKVKLSVTVKELGLSKYQFRRLRELVGKRYHPGRDELTITSERFEHREENRKDCLRTLLSLIEEAGKANKLVDDARSSYVKERLHTNPAFMERLHAKSMRLRESNQSYHGFRLQKQPPCLERKASYI

SEQ ID NO: 174670 - protein, 57 aa, Glycine max
  Coding DNA Sequence Number=SeqID_57892
MMRVSSMLELRFTKVTWESRIVRYLLKYHPYGLTLNDMPECRELLPKRFNEFSVYMR

SEQ ID NO: 174671 - protein, 62 aa, Glycine max
  Coding DNA Sequence Number=SeqID_57893
MNKKLSFATGNSRCSRRYLIKAIPDIREHNRSVRTLTKQESNGCRVRATDSGGIHSCHIRRS

SEQ ID NO: 174672 - protein, 110 aa, Glycine max
  Coding DNA Sequence Number=SeqID_57894
MAQNIRTIPLPGRNTHDPIFWKHTQHSNYTIKSELIPLSQISLTGLTLGLCPKKSRGNKLLLLSHMGHLAKKNIWVFENKKQILRQTLAVADSMYYQANTSTGHNHTLKR

SEQ ID NO: 174673 - protein, 93 aa, Glycine max
  Coding DNA Sequence Number=SeqID_57895
MTLYAKSTTLTRRSGHNFVRAVETLRGRMCERRHKPSRNKTLPLTCCLVGDSLEEQASQGSFVAHGRQDVLTTIIGRPEHPSRVRATGASVMI

SEQ ID NO: 174674 - protein, 79 aa, Glycine max
  Coding DNA Sequence Number=SeqID_57896
MAPPLPKGTFFNVGSARGINYFRLEELDMRCVTDINPGGTCYGTYASSPIARLDAARKALFDLRVLFLPLSWLHPADRK

SEQ ID NO: 174675 - protein, 258 aa, Glycine max
  Coding DNA Sequence Number=SeqID_57897
  Gene Ontology: Mol. function=chitin binding; Cellular component =extracellular region; Biological process=chitin metabolic process
  Homolog annotation: Hit_ID=UPI000044A8F0; Match level="QueryCoverage =81%, HitCoverage=99%, E-value=4e-33, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MNDPLHESISCFLIRVDPWVLVPITFRGLHVLAFRGLHVLAFRGLHVLTFRGLHVLAFRGSFTLTFRGLHVLTFRGLHALAIRGLHVLTFVGLHALTFRGPHILTFRGLHALAIRGLHVLIFRGQHVLAFKGSCPFTFRGPHVLTFVGLHALTFRGPHILTFRGLHTLAIKGLHVLTFVGLHALTFRGLHVLANRGLHALTFRGLHILANRGLHTFTSRGLHILALRGLHALTFRGLRVLIFSVLHICTLREFKVLCP

SEQ ID NO: 174676 - protein, 275 aa, Glycine max
  Coding DNA Sequence Number=SeqID_57898
  Homolog annotation: Hit_ID=Q7WNL6; Match level="QueryCoverage=38%, HitCoverage=82%, E-value=9e-39, Identity=70%"; Hit description =Putative membrane protein
  Pfam annotation: Domain name=DUF1232; Domain location=22-79; Score =83.4; E_value=7e-22; Accession=PF06803.3; Description=Protein of unknown function (DUF1232)
MSTRDHLKTWARRIKRDGLTLWFAGKHPRTPWHAKALGVFVVAYALSPIDLIPDFIPVLGYLDDVLLLPGLIWLAIKLLPPDVLQECRGQADAWIQAKREKPRSREPQRAQFRDRAQFLVAPFLGRAQRCGQQHGRLVGFIEAAQHAVGNGKGLGEARIQRLLATIAPALVQDHLRLRIAPDQVQRHAFATQPQQLGLADVQRPIGLGIERGAGGLELLEPVRIRAERFGRHVQVDLADLALESDAAKERGPHQQDGIRGQVFDHHVLEHARLDL

SEQ ID NO: 174677 - protein, 215 aa, Glycine max
  Coding DNA Sequence Number=SeqID_57899
  Pfam annotation: Domain name=Transposase_23; Domain location=2-65; Score=-10.9; E_value=0.018; Accession=PF03017.5; Description =TNP1ENSPM transposase
MQVVHREKFFPLVALGRVYEGSTAVHNIPLLHGQVKVGVEEVKDAEAPVLVPTNEVQLVGQALNTFLAWLTHLVKHVLEQAVVSPTKPPDRPNHELFLKPLQVMWDATVFGVFNQDFPLYIKHEDLSKISHGGQCLSISVIQLWILHLTKTSMRAGNSDVNGFLEPQSIQRSGQSQFESESYIKSWMQSSKHDIYLGAYLNGPLEAERLKALRIQ

SEQ ID NO: 174678 - protein, 48 aa, Glycine max
  Coding DNA Sequence Number=SeqID_57900
  Gene Ontology: Mol. function=DNA binding; Cellular component =chromatin; Biological process=regulation of transcription, DNA -dependent
  Homolog annotation: Hit_ID=P26585; Match level="QueryCoverage=99%, HitCoverage=31%, E-value=1e-15, Identity=83%"; Hit description =HMG1/2-like protein
MKGGKAKTKLKRAYPKLAVNKKGAATKDRKPVGKGKAVKDPNMPKRPP

SEQ ID NO: 174679 - protein, 53 aa, Glycine max
  Coding DNA Sequence Number=SeqID_57901
MVKARQKGGKRGMWLPPSSPRRVGLLPPEGTAFCWNPLEGPSGPGCYLHTPFY

SEQ ID NO: 174680 - protein, 268 aa, Glycine max
  Coding DNA Sequence Number=SeqID_57902
  Gene Ontology: Mol. function=RNA-directed DNA polymerase activity; Cellular component=intracellular; Biological process=RNA-dependent DNA replication
  Homolog annotation: Hit_ID=Q1SAS4; Match level="QueryCoverage=99%, HitCoverage=14%, E-value=1e-108, Identity=62%"; Hit description =RNase H, putative
LSIYEPVEHNNPALSPNFEFPVYEAEEEEDDEIPKELARLLEYEKKTIRPHEEVVEVINLGTEKDKKEVKIWGHRLRQLSDEGICPGLDPRIVEAPSEVQKQIDAGFLITSEYPQWLANIVPVPKRDGKVRMCVDYRDLNKASPKDDFPLPHIDVLVDSAAKSKVFSFMDGFSGVMPFGLINAGATYQRGMTTLFHDMMHKEIEVYVDDMIVKSGTEEEHVEYLLKMFQRLRKYQLRLNPNKCTFGVRSGKLLGFIVSQKGIEVDPDK

SEQ ID NO: 174681 - protein, 248 aa, Glycine max
  Coding DNA Sequence Number=SeqID_57903
  Gene Ontology: Mol. function=calpain activity; Cellular component =intracellular; Biological process=proteolysis
  Homolog annotation: Hit_ID=Q1SW04; Match level="QueryCoverage=89%, HitCoverage=36%, E-value=7e-26, Identity=35%"; Hit description =Cyclin-like F-box; F-box protein interaction domain
  Pfam annotation: Domain name=F-box; Domain location=16-63; Score =39.5; E_value=1.2e-08; Accession=PF00646.23; Description=F-box domain
MRSEKNHRNMRSEKKPWSPLLCDELIEKILSRLPVKPLIQFKCVCKGWNSLMSDPYFIKLHLSKSAAKDDLEHLQLMKNVCLGSIPEIHMESCDVSSLFHSLQIETFLFNFANMPGYHLVGSCNGLHCGVSEIPEGYRVCFWNKATRVISRESPTLSFSPGIGRRTMFVFGYDPSSDKYKVVAIALTMLSLDVSEKTEMKVHGAGDSSWRNLKGFPVLGTLPKVGGVYLSGTLNWVVIKGKEIIHSEI

SEQ ID NO: 174682 - protein, 112 aa, Glycine max
  Coding DNA Sequence Number=SeqID_57904
MLSMKAREGTPSLPIPEIFPLPMPPKPIVTPSCGFRSRNIDLSLVMCQEHPLSRYQLLYPNFVRGLSFVDLLILASRLTMLNASYSAKQGTIQCSDQECKKYQKRGPKGSFH

SEQ ID NO: 174683 - protein, 44 aa, Glycine max
  Coding DNA Sequence Number=SeqID_57905
MASIIVIIYSFMAFMSAFICSCTSSISLITLALTRVRGKCKDYA

SEQ ID NO: 174684 - protein, 297 aa, Glycine max
  Coding DNA Sequence Number=SeqID_57906
  Gene Ontology: Mol. function=nucleic acid binding; Cellular component= integral to membrane; Biological process=DNA integration
  Homolog annotation: Hit_ID=Q1SJY4; Match level="QueryCoverage=64%, HitCoverage=38%, E-value=7e-27, Identity=35%"; Hit description=Zinc finger, CCHC-type
MELNTKARYTLTYALSKNKYNKICRLRTAKEIWDSLSINYESTEDVGLRKVVTLTRHYKSFIMKDGEFVDDMFGRLQVLLNNLEALGHRYSKTQINLKVLDNFPKVWEPKTTTIQEARDLKNLAWDELLGILRVHEVHLQNREHMQKKNFATLKSEETSFIIEEKKSLSKALKVQIQESDESDNSNGSINDEVTLMSRKFKQMMKKKGKFQHSSRCLNLQLKKKRYSKDKKKKSLMVTWDDSDSEKSSSLDNEQDNICLMVDIDDKVKCKKFKEKFKASASENTKLSKSNEDLKKKI

SEQ ID NO: 174685 - protein, 98 aa, Glycine max
  Coding DNA Sequence Number=SeqID_57907
MNLYGTTEVKVEDFSNEPPQLSQINLEETYNEDMVKEEEGINAFPSYVASQYLDVVENGKGKRPKYEHDDDPITCLEPSWVEETVDVVISKMSRCPKP

SEQ ID NO: 174686 - protein, 170 aa, Glycine max
  Coding DNA Sequence Number=SeqID_57908
MVTDNGRRREATKTAEEDHTCPVETVANSREGKHRTGSSHFWDGTIKLSIPKIGTEMCPERDYKAVKTGAGPYPGFPDKVTGGGSAMFRWLEGSAWPSRAENDALLWWRVATLLLTRLAGVGRAPRGAHNPGFVGKFDGGRRRQRQTVDSGRRSAAGIGQNGIIPALIPC

SEQ ID NO: 174687 - protein, 93 aa, Glycine max
  Coding DNA Sequence Number=SeqID_57909
MVEANQSSYGIYAAFASEADNKKQAATAVFKIGKITTKIVKMKKKMDIDDIFEIKKKMDTNVIEEKKEKMDIDAIKEKKKMLDDKEKSKDVFE

SEQ ID NO: 174688 - protein, 71 aa, Glycine max
  Coding DNA Sequence Number=SeqID_57910
MEAIKAKIERLLKANFIQNTRDLNATTPKDEYPMPDVDMLVDSATENEILSLLDWNTKKPLMTSRDILLIH

SEQ ID NO: 174689 - protein, 133 aa, Glycine max
  Coding DNA Sequence Number=SeqID_57911
MKKSSPEKPFCMLGMHVVPFGAVAGDRVYLFHSTCHCPSLQLVRVNALVAHCLQRRCEHVVSIDGDFTAVIEPQDNKPEGRRQQRQRPVLLLPRWWLPEHSLCVEPLEVAPLMLLHTVNIFRADEERERERWT

SEQ ID NO: 174690 - protein, 163 aa, Glycine max
  Coding DNA Sequence Number=SeqID_57912
MGKWQGNVWECEFIWRREWFSWELPFVEDFVNFVSNRRRYRGEVNKWIWKVESSGSYTVKYAYLAFRNTVFGSHATYGSTYILSSRGFYNNIFINMCYHQVRGYIGNRRWKILWCATPWVISNWRNDNSFRGNTGACIQSYEKNAHADCSTVCAIFARHAIPT

SEQ ID NO: 174691 - protein, 123 aa, Glycine max
  Coding DNA Sequence Number=SeqID_57913
  Homolog annotation: Hit_ID=Q6D1W1; Match level="QueryCoverage=67%, HitCoverage=89%, E-value=2e-18, Identity=44%"; Hit description =Protein nrdI
MGNIVGGSHQFKAVEIGNLTFLRNDVARQAEARAKVAIARSNHTANTAPALRGVERNTPRRQAETGDKPVRVFRLAGKIDQWKHRFIPRRQRAGAGRRFYRDGSRSSGRCASSPRAPGDSQAI

SEQ ID NO: 174692 - protein, 42 aa, Glycine max
  Coding DNA Sequence Number=SeqID_57914
  Gene Ontology: Mol. function=pyridoxal phosphate binding; Biological process=amino acid metabolic process
  Homolog annotation: Hit_ID=Q9M835; Match level="QueryCoverage=97%, HitCoverage=11%, E-value=1e-09, Identity=71%"; Hit description=L -allo-threonine aldolase, putative
ARQLSKTIGGGMRQIGLLCAATFVAFQENVGRLESDHKKARL

SEQ ID NO: 174693 - protein, 220 aa, Glycine max
  Coding DNA Sequence Number=SeqID_57915
  Gene Ontology: Mol. function=nutrient reservoir activity; Cellular component=cellulose and pectin-containing cell wall
  Homolog annotation: Hit_ID=Q43557; Match level="QueryCoverage=89%, HitCoverage=50%, E-value=9e-90, Identity=82%"; Hit description =Unidentified precursor
  Pfam annotation: Domain name=DUF642; Domain location=50-220; Score =127.7; E_value=3.3e-35; Accession=PF04862.3; Description=Protein of unknown function, DUF642
MKGRFMFLSVLLCATFHVSFSITDGSNFVLIIVCLVANGNFELGPKPSALKGTVVIGGSHSIPEWEISGFVEYIKSGQKQGDMLLVVPEGAYAVRLGNEASIKQRIKVIKGMYYSITFMVARTCAQEERLNISVTPDWGVIPIQTLYTSSGWDPIAFGFKAENETVEMLIHNPGKEEDPACGPLVDSVALRTLYPPRATNRVKSSAYLSWYFENSLMLYN

SEQ ID NO: 174694 - protein, 213 aa, Glycine max
  Coding DNA Sequence Number=SeqID_57916
  Gene Ontology: Mol. function=DNA binding; Biological process=DNA integration
  Homolog annotation: Hit_ID=Q1S1X7; Match level="QueryCoverage=35%, HitCoverage=5%, E-value=2e-19, Identity=57%"; Hit description =Integrase, catalytic region; Zinc finger, CCHC-type; Peptidase aspartic, catalytic
MMDARGGKTVVMYTSLKVLAYFIHHKRRIVAKPSLEHFLSLCKFAFSSISINSVGSPQDNLSQQNSIRAMTFVKFDVEKITGDEVLEEVSREKAVDMLWEKLESQYMTKSLHRHLCLKKQLCTMQMHEACNFHMMPNRDWFVTFQEVEGGKVLMGNDGACRIIGKGIMQIKMVDGIVRTSTNMRYVPKLCKNLISLSTLDFLGCSYRELKMYC

SEQ ID NO: 174695 - protein, 53 aa, Glycine max
  Coding DNA Sequence Number=SeqID_57917
IMVRTRGLGHALGYVTGRGVGRGDRDDYDDAPQRQRPTTSARRQRVPVICGTR

SEQ ID NO: 174696 - protein, 145 aa, Glycine max
  Coding DNA Sequence Number=SeqID_57918
  Gene Ontology: Mol. function=catalytic activity; Biological process =cellular metabolic process
  Homolog annotation: Hit_ID=Q0G1C7; Match level="QueryCoverage=98%, HitCoverage=42%, E-value=2e-35, Identity=53%"; Hit description=NDP -glucose 4,6-dehydratase
PRLITGPGRLGILGKLFALISKGLPVPMIGNGNNRYQMVSVNDCVDAAILAVDKGCPHGPFNLGSTNPPTTKELLHGIIKHANSRSIVIPIPSAIIKPALSALDKCGLTLLYPEQFGIADKDVLLDTIDTNNTLGWKPSRKDIDA

SEQ ID NO: 174697 - protein, 126 aa, Glycine max
  Coding DNA Sequence Number=SeqID_57919
MAESSKKRKGSSSTTTTVGHRHHGTFDDPPASIPPSFSSPSQGVPFEGTLVDDWKHVYSSHDARKMVCNDHAGMTSKLLVGSFTFECRIMHHILCRILLPRSTNLAQASEEDLILLWALQAGHQID

SEQ ID NO: 174698 - protein, 235 aa, Glycine max
  Coding DNA Sequence Number=SeqID_57920
MEFGQMASQHLPLNEADIQVFGAHDHSTHLVTLAKVYEGASTIHHVPYVDDVVKMSFGKVCDSNTQAPFPTLKVQYVSQALDTFIVWPKHLVKPISHKDSQICPKKQVEPVHRSNPIGGIEPLGDLIKNLYDPYEKPLECCGMELNLGFQIFLNELTIRLGHGFMYGFLESQSIHNAKDRRDECQHYIETWLKESQRELYQGPYLNQNVVEWFCSLRKKLDIHIKAAINKLSFKL

SEQ ID NO: 174699 - protein, 961 aa, Glycine max
  Coding DNA Sequence Number=SeqID_57921
  Gene Ontology: Mol. function=protein serine/threonine kinase activity; Cellular component=integral to membrane; Biological process=protein amino acid phosphorylation
  Homolog annotation: Hit_ID=Q2HSI2; Match level="QueryCoverage=97%, HitCoverage=97%, E-value=1e-159, Identity=58%"; Hit description =Protein kinase
  Pfam annotation: Domain name=LRRNT_2; Domain location=21-62; Score =20.6; E_value=0.0056; Accession=PF08263.3; Description=Leucine rich repeat N-terminal domain
  Pfam annotation: Domain name=LRRNT_2; Domain location=326-366; Score =13.6; E_value=0.033; Accession=PF08263.3; Description=Leucine rich repeat N-terminal domain
  Pfam annotation: Domain name=LRR_1; Domain location=112-134; Score =13.3; E_value=0.86; Accession=PF00560.23; Description=Leucine Rich Repeat
  Pfam annotation: Domain name=LRR_1; Domain location=136-164; Score =0.8; E_value=2.1e+02; Accession=PF00560.23; Description=Leucine Rich Repeat
  Pfam annotation: Domain name=LRR_1; Domain location=166-188; Score =5.5; E_value=26; Accession=PF00560.23; Description=Leucine Rich Repeat
  Pfam annotation: Domain name=LRR_1; Domain location=190-212; Score =14.0; E_value=0.55; Accession=PF00560.23; Description=Leucine Rich Repeat
  Pfam annotation: Domain name=LRR_1; Domain location=240-262; Score =14.4; E_value=0.42; Accession=PF00560.23; Description=Leucine Rich Repeat
  Pfam annotation: Domain name=LRR_1; Domain location=264-286; Score =15.1; E_value=0.26; Accession=PF00560.23; Description=Leucine Rich Repeat
  Pfam annotation: Domain name=LRR_1; Domain location=287-308; Score =13.6; E_value=0.72; Accession=PF00560.23; Description=Leucine Rich Repeat
  Pfam annotation: Domain name=LRR_1; Domain location=394-416; Score =11.8; E_value=1.7; Accession=PF00560.23; Description=Leucine Rich Repeat
  Pfam annotation: Domain name=LRR_1; Domain location=418-439; Score =14.7; E_value=0.33; Accession=PF00560.23; Description=Leucine Rich Repeat
  Pfam annotation: Domain name=LRR_1; Domain location=89-110; Score =12.6; E_value=1.3; Accession=PF00560.23; Description=Leucine Rich Repeat
  Pfam annotation: Domain name=Pkinase; Domain location=615-891; Score =145.9; E_value=1.1e-40; Accession=PF00069.15; Description=Protein kinase domain
  Pfam annotation: Domain name=Pkinase_Tyr; Domain location=615-891; Score=135.4; E_value=1.6e-37; Accession=PF07714.7; Description =Protein tyrosine kinase
  Pfam module annotation: Pfam domain module=LRRNT_2::LRRNT_2::LRR _1::LRR_1::LRR_1::LRR_1::LRR_1::LRR_1::LRR_1::LRR_1::LRR_1::LRR _1::Pkinase::Pkinase_Tyr; Domain location=21-62::326-366::112 -134::136-164::166-188::190-212:...
  Pfam module annotation: Domain location=:240-262::264-286::287 -308::394-416::418-439::89-110::615-891::615-891
MMRLNFLLCFCFFTLVVSETDPNDVKILNTFRRGLNNSELLPWPEEGGDPCGSPPWKYIFCNGNRVAQIQTKNLGLVGPLPQNLNQLVMLENLGLQNNNLNGPLPSFKGLNNLKYIFLGRNDFDSIPLDFFEGLKSLEVLALDYNEKLNASSGGWSFPAALADSAQLRNLSCMSCNLVGPIPGFLGDMASLSVLLLSGNNLTGEIPATLNAVPALQVLWLNNQRGEGLTGKIDVLASMISLTSLWLHGNKFEGSVPDSIADLVSLKDLDLNGNEFVGLIPSGLGGMKLDRLDLNNNHFVGPIPDFAASKVSFENNEFCVAKPGVMCGFEVMVLLEFLGGLGYPRILVDEWSGNDPCDGPWLGIRCNGDGKVDMILLEKFNISGTLSPSVAKLDSLVEIRLGGNDISGGIPSNWTSLRSLTLLDLSGNNISGPLPSFRKGLKLVIDENPHVSAPEGSLPSPVSSSGSGSGSWSTKGESPPADKHNPNPSGDSSPNPKSSSSFESNKSSIGKKLVPIVAPIAGVAAVAFVLIPLYVYCFRKKKGVSEGPGSLVIHPRDASDLDNVLKIVVANNSNGSVSTVTGSGSGITTGSSESRVIEAGNLVISVQVLRNVTKNFARENEVGRGGFGVVYKGELEDGTKIAVKRMESGVITSKALDEFQSEIAVLSKVRHRHLVSLLGYSVEGNERILVYEYMPQGALSMHLFHWKSLKLEPLSWKRRLNIALDVARGMEYLHSLAHQIFIHRDLKSSNILLGDDFRAKVSDFGLVKLAPDGKKSVVTRLAGTFGYLAPEYAVTGKVTTKADVFSFGVVLMELLTGLMALDEDRPEETQYLASWFWHIKSDKEKLMSAIDPALDIKEEMFDVVSIIAELAGHCSAREPNQRPDMSHAVNVLSPLVQKWKPLDDETEEYSGIDYSLPLNQMVKDWQETEGKDLSYVDLQDSKSSIPARPTGFAESFTSVDGR

SEQ ID NO: 174700 - protein, 69 aa, Glycine max
  Coding DNA Sequence Number=SeqID_57922
MTHFSFVPHGHQDLLNTAIGRPEYLGHFRVAGVGVTISQYFGHASRGSNNSTASINLQQLAEIIRNLKE

SEQ ID NO: 174701 - protein, 225 aa, Glycine max
  Coding DNA Sequence Number=SeqID_57923
  Gene Ontology: Cellular component=intracellular; Biological process =ribosomal large subunit biogenesis and assembly
  Homolog annotation: Hit_ID=Q9FNH2; Match level="QueryCoverage=99%, HitCoverage=100%, E-value=1e-112, Identity=78%"; Hit description =Arabidopsis thaliana genomic DNA, chromosome 5, P1 clone:MHF15
  Pfam annotation: Domain name=Ribosomal_S8e; Domain location=1-202; Score=287.3; E_value=3e-83; Accession=PF01201.12; Description =Ribosomal protein S8e
MPQGDYIERHRRDYGYRLDHFERKRKKEARQVHKRSSIAQKALGIKGKMIAKKNYAEKAQMKKTLVLSNTIKQKRKEKAGKWDVPLPKVRPVAEDEMFKVVRTGKRKTKQWKRMVTKATFVGPGFTRKPPKYERFIRPTGLRFTKAHVTHPELKCTFNLELIGVKKNPNGPMYTSLGVITRGTIIEVNVSELGLVTPAGKVVWGKYAQVTNNPENDGCINAVLLV

SEQ ID NO: 174702 - protein, 106 aa, Glycine max
  Coding DNA Sequence Number=SeqID_57924
MMLGLYIEILKMIKITQPDEGVTFLGETKGVVMLRKERRVLKKLKEVDGGSVWGPCVESLLGDVIVKWHVPLEVVGGTSLKVSPFGTCGADREHTRFCASKVEAEA

SEQ ID NO: 174703 - protein, 68 aa, Glycine max
  Coding DNA Sequence Number=SeqID_57925
MTQEMQTMKDDKLQLQMQLSIVSDQVRELNAQLGEGRCSDSLPCSHTAIALDVIVDVVGVCISKEFKK

SEQ ID NO: 174704 - protein, 127 aa, Glycine max
  Coding DNA Sequence Number=SeqID_57926
MDIDPSRGGESQRRCISTNMEVDLPEARGLRAAMDKLTCKIQSYMRSIVPCSVNTKSVRSVSVLNNLETIQLDDFDVNIPQGQSREGLSAPFTRSMAKMSAKGKKMGKSVVDKGQGDSNATSKNIVD

SEQ ID NO: 174705 - protein, 147 aa, Glycine max
  Coding DNA Sequence Number=SeqID_57927
MDIAAIIGLKPLGKTYALGLIEDQIERTEVDIGFTAKSYGAFIKNNAKDTQEVSDEEHINFLMEDICLNKFLLASVYKVIGEAVKIMDTLGKMKHIARTLWIVQLWLNAILANHITPEKDILDDLNLKIEGARLTFLTPSKEFCTYE

SEQ ID NO: 174706 - protein, 419 aa, Glycine max
  Coding DNA Sequence Number=SeqID_57928
  Gene Ontology: Mol. function=RNA-directed DNA polymerase activity; Biological process=RNA-dependent DNA replication
MAGDRPPRVILEFYSSSSTKQYFTSIGNLFHGLPNEDPYAHLATYIEICNTVKIAGVLEDAIRLNLFSFSLAGEAKRWLHSFKGNNLRTWDEVVEKFLKKYFPESKTTEGKQLLDASAGGKIKLKTPNKAIELIENMSASDHVVLRDRAYTSAEKSLLELTSRCILAQNKLLAKQIETLIESLRDVPCVVELMSQAWGNFSQNQGQGWRFHPGNNFNKDQGGSSNQGPNFNERTAMLEDPLTQFMQVSISNHKSIGSAIKNLEVLVGQIAKQLAEKPTGNFVANIEKNPKEECKVVLTRCKRKENLENKERVEGVVKGVNDEEVEDERKKKDANNKEKELRDEKNEEEEKYAIIQGILPQKFKDARSVTIPCSIGTVSVGKALIDLGASINLIPLSMSQSIWNLKIVPTRITLQLDCGY

SEQ ID NO: 174707 - protein, 80 aa, Glycine max
  Coding DNA Sequence Number=SeqID_57929
  Subcellular localization annotation: CTP_CleavageSite=66; ConfidenceScore=5.55e-01
MEKLKIGHCSSSGSSSIKWSKTPYALSILCAMIMTSISKWSTSVSRGLVLRRSSRSLSASSLVKVVSDSASGGVSGGVDD

SEQ ID NO: 174708 - protein, 217 aa, Glycine max
  Coding DNA Sequence Number=SeqID_57930
MDFFSDKSFECIQAFQNSNLIPFMSLKLPVYSELVKAFYSNLEIQESTLISEVYGIKMVIDQSLFFYDLTQLSSDGVPFEGALDDDWKFDFSMHDARRLVCTNQADMTRRLLAGSLALESCILHYLIARILLPISSNLAQVSEEDLIVMWAFHIDRQIDWAHLFRFDGLQTYVGERFDALEQQVYMQFDAMDSRITKVEEDVTIIRDCLDLPPPPSV

SEQ ID NO: 174709 - protein, 32 aa, Glycine max
  Coding DNA Sequence Number=SeqID_57931
MEMNGDEVLQMSGSLHTIMFYNIDYALSEMAR

SEQ ID NO: 174710 - protein, 124 aa, Glycine max
  Coding DNA Sequence Number=SeqID_57932
MVEANQSSYGIYTAFAEESNQALAATAPFNIDDSFYVNNKPAYSSFMARVSAYIANNMNQAAIVFKDCFAWDYEDMSISRELMEHRLVIYEGKKLVKQAPWRFAHNAMEAIKAKIEKLLNVNFI

SEQ ID NO: 174711 - protein, 161 aa, Glycine max
  Coding DNA Sequence Number=SeqID_57933
MDVRNVAVEDDLEEKEDAQSHSETSPSKQLSLLEPMVEEYIVWVDLNLDIPLNHEIAQHTSPEEEHPSVDPSAIFIPILTVETNKPIVDQVTVFDKARLKQINLGLRGISKGQKAPHDDPRSNKKTNKSKEALVKKEEDLLAKLKPIQDEFRSGRLKLLEL

SEQ ID NO: 174712 - protein, 159 aa, Glycine max
  Coding DNA Sequence Number=SeqID_57934
  Subcellular localization annotation: CTP_CleavageSite=35; ConfidenceScore=5.65e-01
MNVGALISGQITSMAQSNSSRLGFPALITALFTIRGARRARARPAEAPSTSAAPPPARTLAAPSTHLLQTFNVLKPCFKAYIRGRLFYYEVYSWPGTQPPFHREDEGLTAQVPQQRKDESSETSTSKTLIKRKRVVETQEAAATSEKSLEATSEPLEPV

SEQ ID NO: 174713 - protein, 271 aa, Glycine max
  Coding DNA Sequence Number=SeqID_57935
MHALLGSFKNGNWSNFDDLDRMLVASAKRNIPGLSARKNPEEDELYRFAKRTDPRGEGDILTTCIFAIFHLVLLFVVKKASWYGKLNPLLDLPCRAELSSFHKESGCDKLVEYVCLNTVLVELSLTRGICGRCLIRIRLSFHEESRLQVVPFVVRLMKQANVLPLKKTPKEFIIWEINRDEGILKEDFQASSRVHIINKDSGGHTLTISSTKTRVTMSNHKSIESALKNLEVQVGQLAKQIADKFVEVKDEDSVVHKKKTTDKKSTDGKKK

SEQ ID NO: 174714 - protein, 121 aa, Glycine max
  Coding DNA Sequence Number=SeqID_57936
  Gene Ontology: Mol. function=protein serine/threonine kinase activity; Cellular component=membrane; Biological process=protein amino acid phosphorylation
  Homolog annotation: Hit_ID=Q1S4F8; Match level="QueryCoverage=81%, HitCoverage=14%, E-value=2e-30, Identity=62%"; Hit description =Protein kinase
MHQYVEEPGFGSGALEITNKLASENIIGERGFGYVYKAIMPDGRVGALKLLKAGSGQGERKFRAEVDIISRIHHHHLVSLIGYCISEQQRVLIYESVPNGNLSQHLHGNEVNDQFWIGKRG

SEQ ID NO: 174715 - protein, 153 aa, Glycine max
  Coding DNA Sequence Number=SeqID_57937
  Gene Ontology: Mol. function=transition metal ion binding; Cellular component=nucleus; Biological process=proteolysis
  Pfam annotation: Domain name=Transposase_21; Domain location=31-151; Score=-70.6; E_value=1.4e-08; Accession=PF02992.5; Description =Transposase family tnp2
  Subcellular localization annotation: CTP_CleavageSite=34; ConfidenceScore=5.07e-01
MGDFLQTNSKKLLYLGCKNFLTMLSAVLSLVNMKARYRSSDKSFSSLLQVVHDLLPEENTLPKSYYHTKKILCPMGPRQPGNDIDVYLCPLIEDLTKLWDKYSVKGHHACLICEEDTSYMQLRHGRKIVYTRHRRFLKPHHPYQRLKKAFNGS

SEQ ID NO: 174716 - protein, 272 aa, Glycine max
  Coding DNA Sequence Number=SeqID_57938
  Pfam annotation: Domain name=NC; Domain location=114-185; Score=25.1; E_value=7.7e-05; Accession=PF04970.4; Description=NC domain
MVSHVINADSALVSCGEFQNSKEPCQATVWKVYTRRKKIGSGGGSIYVGDDKVIHFTRHGQEVGTGTALDLLLISSGPAKPRESCPTCTAPQEEHGVISSCMNCFLAGGVLYRFEYAVTPALFLAKARGGTCTLAVSDDDDIVVHRAKYLLENGFGCYNVFKKNCEDFAIYCKTGLLEIGQSGQAVSIIGGPLAAALSSPLRMVTTNVYGMAATAVGVYCASRYMADIGMRPNVVKVPVEELTSRLATGLLQVVEPQIPTNIARQSPQLVTQ

SEQ ID NO: 174717 - protein, 127 aa, Glycine max
  Coding DNA Sequence Number=SeqID_57939
MAVEWRRKRERTRHFKEKMSLEKAHHHRRPWIRAWRKKKINDGRGREEHKILCSKRALKSEIIGPNLGTWAQKSTMRFMGTLGPSSTALAQSSWSLLLMALVTGPFLGRIASLDVLETLCFEAMLDL

SEQ ID NO: 174718 - protein, 114 aa, Glycine max
  Coding DNA Sequence Number=SeqID_57940
MKILLMSHLGYSDKGFYNEKCKCQGACHKYAWGVAALTYLYDHLSYASKYNSKSCGGYVTLLMSWVLAHLPMFATYRSISYSFRSYVELVGHQSCARGHESSSAHTKMFAIVGL

SEQ ID NO: 174719 - protein, 102 aa, Glycine max
  Coding DNA Sequence Number=SeqID_57941
MGREMKKGKHHHERKMSNIRSIDRKSIVENRGEATRCNNAKLEAESHQLKRHSRGREKQAKRVLAEKEKQMEVKVEESEQIYKEKDELKLGGCDNCPRLIRT

SEQ ID NO: 174720 - protein, 43 aa, Glycine max
  Coding DNA Sequence Number=SeqID_57942
MSVKNLVGRLVVHDKTNHTLVWVYTGKEKAQLEGHFFHHKHYL

SEQ ID NO: 174721 - protein, 108 aa, Glycine max
  Coding DNA Sequence Number=SeqID_57943
  Subcellular localization annotation: CTP_CleavageSite=85; ConfidenceScore=5.08e-01
MDVLCLVGNKCETNQTQRAGKQQMIRALLFSHLRSNVSNRSAKTATTGLSLLWWYFCGRPAMPFRSLFYAVQTLLRNPLTTVAISAQGRGDIRRKRYGFFFPPERNIP

SEQ ID NO: 174722 - protein, 154 aa, Glycine max
  Coding DNA Sequence Number=SeqID_57944
  Gene Ontology: Mol. function=RNA-directed DNA polymerase activity; Biological process=RNA-dependent DNA replication
MHPEFPEEDIMALFGEKADDEDRDKWIVWFKDASNTLGHGVGAAYIKKLAEFFDDVSFHHVPREENQMADALATLASMFQLTSHGDLLYIEFRCHRKPAYCCLIEEEQDGKRWYFDIKRYVEYKECPEGASDNDKRMLRRLAIGFFLGGGILYK

SEQ ID NO: 174723 - protein, 73 aa, Glycine max
  Coding DNA Sequence Number=SeqID_57945
  Gene Ontology: Mol. function=RNA-directed DNA polymerase activity; Biological process=DNA integration
  Subcellular localization annotation: CTP_CleavageSite=44; ConfidenceScore=5.08e-01
MERKSTNGGCHSISGCLVSWTSKKQGTIALSTVWQSIYQLQVVVLNSYGSNTSLRITTCLRVKFISFAIILLP

SEQ ID NO: 174724 - protein, 234 aa, Glycine max
  Coding DNA Sequence Number=SeqID_57946
  Gene Ontology: Mol. function=nucleic acid binding; Cellular component= membrane; Biological process=DNA integration
MDDRPEEVREPTGRLLRKHHPESQIISDPKDKLQTRNSLKHTVLLFEIKPKQIDNTDVWKLVELPKGKFGIGAKWVFINKLDETSKVVRNKARLVVKGYSQQEGIDYTKTFFLVARLEAICILLSFVAYHGMMLYQMDVKCTFLKGLIKEEVYVEQPSRFESSIYPHHAKFEMSVIGELEFFLGLQIKKIDGGIYIHETKYVKELLKIFKIDDAKQMKTFMHPTTVLGLDEESK

SEQ ID NO: 174725 - protein, 104 aa, Glycine max
  Coding DNA Sequence Number=SeqID_57947
MGKTFHYFRKNPSSGNLPKDLLLEVPEEPQTGLPEGATVTKLSPFFPASSTLSYRRRAQPSFPLQTVSSILHSPHPNNKERNRSLFRSDQKGNNGNGDMGLLSN

SEQ ID NO: 174726 - protein, 212 aa, Glycine max
  Coding DNA Sequence Number=SeqID_57948
MVYKEDKVIALSAPIQSEDLLNTHGIFVMDKNENKTLHLTFNTTGWERDQPIVDDDVIQEIDEEMKLGAMSFGLKVEVEAEIEINKMNVPVTMQPYCSNLEVDLSPLEQEKEAKEKPRIPCPRTQPGSVIRTSPLWWLRVVGILTMGEAKESHDEEHKPIFVIDSTLALIYRKVIHCRCSGTLEPYDIADLCHREARLFLCHWPAIFVRRGN

SEQ ID NO: 174727 - protein, 108 aa, Glycine max
  Coding DNA Sequence Number=SeqID_57949
MAVSKLRNDAKKERRRNGIFPKLLELQGSKRISEQYSRKWKRCAHSRNLFNDPNGHIGDKFLVKRNTKFREDPTVNECWAAFLPRQLHVASLRSFIKRLPQEASSWLL

SEQ ID NO: 174728 - protein, 43 aa, Glycine max
  Coding DNA Sequence Number=SeqID_57950
MTPPRKNESFDIPIIKNVEDAFQAFPKDWNNKTRWSQHQGDCC

SEQ ID NO: 174729 - protein, 45 aa, Glycine max
  Coding DNA Sequence Number=SeqID_57951
MTVSKLRNDAKRGKLEDFALVEGFLSVWGFNGEQRRFVVANGGCG

SEQ ID NO: 174730 - protein, 87 aa, Glycine max
  Coding DNA Sequence Number=SeqID_57952
  Gene Ontology: Mol. function=DNA binding
  Homolog annotation: Hit_ID=O82166; Match level="QueryCoverage=73%, HitCoverage=22%, E-value=3e-10, Identity=47%"; Hit description =Putative AT-hook DNA-binding protein
MKQEQIREIEVGEEKTHIFYHYAAFEDTYLTPAMTHVVGDDFEDVTVASNFEDVGTERVGAILHYDERRLRLLNGPLCRLPPHHMEV

SEQ ID NO: 174731 - protein, 458 aa, Glycine max
  Coding DNA Sequence Number=SeqID_57953
  Gene Ontology: Mol. function=DNA-directed DNA polymerase activity; Cellular component=DNA polymerase III complex; Biological process =DNA replication
  Homolog annotation: Hit_ID=Q9SB72; Match level="QueryCoverage=82%, HitCoverage=43%, E-value=2e-61, Identity=39%"; Hit description=DNA polymerase III like protein
MMLDQMSLLGKKINISLAYELTGIVSDDELLDLLDLALSSDTSNTVIRARELMRSRIDPLHLVSQLANLIMDILAGKCENGGSDVRSRFSRRHNSEADLQKLNNALKILSETEKQLRNSKNQTTWFIVALLQLSSVDCQSVDANDTKLSLRGACNGGQRLEHVTTGLCDNKSYRLEPEDHKGTLDSIWYKATEMCHSSQLKTFFRNKGKLSSLHVDGSTACLAIAELEFHHRHHVSKAEKSWKAIASSLQFILGCNIELRITYAPCASDSKYAKLRSSFSIFGCSHRIRQQKSLSSNEQVSESDYADYTSENPMMKDRISTSDCGMDAVTALRSSEGNLLSSGERFLNRSFQETKRTSSAEVDFSKEEGYNCAHLDPSMLDSDNNHQSNCFPKTLWLQKKFRSSHSSKLTFQGIQPQKDFVISVPKMCACSGTYTYANEPSIFSSSCKNCTKASEKVG

SEQ ID NO: 174732 - protein, 366 aa, Glycine max
  Coding DNA Sequence Number=SeqID_57954
  Gene Ontology: Mol. function=DNA-directed DNA polymerase activity; Cellular component=DNA polymerase III complex; Biological process =DNA replication
  Homolog annotation: Hit_ID=Q9SB72; Match level="QueryCoverage=99%, HitCoverage=37%, E-value=5e-51, Identity=40%"; Hit description=DNA polymerase III like protein
MDGRRHSVDIPISKTLVALRRVRSLRDPTTNSMSKLSSLVDNVHWENGSGNEISLRFSDAAGPCDSDDNAAFRSRNLGFKGHRKPDDADFLLNHGLLNSRLKPSGMMSCKDDQQDDEMVHSKPNLQCISGDKSPSESCGSNLGGKGLDLSCIVLPSNNFKDGDSCYIETARSSQLGRTDYSKSAKKSLRKNQVKPSEVAISIASNEGSPCPSGYDAFSPYSAKVGINQDVDVLDNNDDGCGISCCWSKSPRFRESNLYGEIEDRPLISHRVDETDLDAHRSMRHNGGGISPTLETPRSLSMKFRPKSFSDLVGQNVVVRSLLAAISRGRITSFYLFYGPRGTGKTSTSRMFAAALNCLSVVEKRPC

SEQ ID NO: 174733 - protein, 67 aa, Glycine max
  Coding DNA Sequence Number=SeqID_57955
MAECGVCDRLVSEESRPTSAFQKPRWGWDRGTLLKSGQDSTVKAFKKNVRIGNLVEELYSRTDSHIG

SEQ ID NO: 174734 - protein, 189 aa, Glycine max
  Coding DNA Sequence Number=SeqID_57956
VLFPNMEGLVDLAVIDAFLAFHHGKESPVDAILAMYDTFDRGGSLDGTRGCINYNPVLAIRQLGYLMRGAPLEDGLAPKDKELRGSGPIGGYREWLKAHVQGLDWLPSLRTAKREEDEALEEDEEVQALRTELKQAQTIKERFQSAALKIRKENAELRDVNVATTKALEQKTKRARRDEHGRNKFRGAL

SEQ ID NO: 174735 - protein, 88 aa, Glycine max
  Coding DNA Sequence Number=SeqID_57957
  Subcellular localization annotation: CTP_CleavageSite=71; ConfidenceScore=5.75e-01
MVSALMVPMFYTLCDVAKRSSRAKRTLWAQCTSTAKRNFSVLSVTRESGRAQGSRSRTKREISLPSEMFVSCQAQRTTGAKSKSTYSR

SEQ ID NO: 174736 - protein, 87 aa, Glycine max
  Coding DNA Sequence Number=SeqID_57958
MGANNHSGISAYHGCRMTKLGLCLSSGTTVSEWQRGADNRKVSPRIIMTKLGLCVPTDTTVSEWQRGADNRKNDQTWSLRANGHDCV

SEQ ID NO: 174737 - protein, 202 aa, Glycine max
  Coding DNA Sequence Number=SeqID_57959
YTMNSVITVLYFNGRVYEDNDDVIFEGSKKAIQIKHGISFNALKKKIGDKKNILPCKFVMTKTLKRCWKVLNNKTKCQFWNCTYKRMWLVVQCFILQIRLHHVEIIYLMLRQPPTNMSNLHIDKDDDDDDYVVSNSYVEESLDEDDSVDGISDTDDDVTDMIQPVRIVHPAEGAQRIENPFWNDALHYNNINWSYPDEEDIC

SEQ ID NO: 174738 - protein, 101 aa, Glycine max
  Coding DNA Sequence Number=SeqID_57960
  Homolog annotation: Hit_ID=Q59IV5; Match level="QueryCoverage=37%, HitCoverage=12%, E-value=1e-07, Identity=73%"; Hit description =Plastidic phosphate translocator-like protein2
MKDDARWKLLVRKVASAKALSSLALPIRGSRNMEYLKSLLLRRYLLRTKTAMLEEYQPDTSPFVNPSLGEGTSLALLLSFFLCFTAKMLPKTKSTYMGDRA

SEQ ID NO: 174739 - protein, 103 aa, Glycine max
  Coding DNA Sequence Number=SeqID_57961
  Gene Ontology: Mol. function=catalytic activity; Cellular component =integral to membrane; Biological process=metabolic process
  Homolog annotation: Hit_ID=Q10I42; Match level="QueryCoverage=92%, HitCoverage=30%, E-value=3e-35, Identity=79%"; Hit description=HAD -superfamily hydrolase, subfamily IA, variant 3 containing protein, expressed
MACALDWIIDQAFAQGVQVAVCSTSNEKAVSAIVSFLLGPERAEKIKIFAGDVVPRKKPDPAIYLLAASTLGVEPSRCVVVEDSAIGLAAAKAAGMTCIVTKS

SEQ ID NO: 174740 - protein, 236 aa, Glycine max
  Coding DNA Sequence Number=SeqID_57962
  Gene Ontology: Mol. function=hydrolase activity; Biological process =metabolic process
  Homolog annotation: Hit_ID=Q10I42; Match level="QueryCoverage=46%, HitCoverage=34%, E-value=8e-50, Identity=85%"; Hit description=HAD -superfamily hydrolase, subfamily IA, variant 3 containing protein, expressed
  Subcellular localization annotation: CTP_CleavageSite=11; ConfidenceScore=5.16e-01
MAAASSIISISSASLFTPTTTQCLLKHNYKDHDHVHVPSSSSSYFTTHAALKISRPTTTTFGITTTTTRVNNVPPRRFSCSASSSSSSSTLPSALLFDCDGVLVDTEKDGHRISFNQTFQERELGVTWDVDLYGELLKIGGGKERMTAYFNKVGWPANAPTDEQERKEFIASLHKQKTELFMALIEKKLLPLRPGVAKLAYDDDKRKNSSRGRRLTKELRGTGNLEREKVSRSFIE

SEQ ID NO: 174741 - protein, 630 aa, Glycine max
  Coding DNA Sequence Number=SeqID_57963
  Gene Ontology: Mol. function=binding; Cellular component =intracellular; Biological process=RNA processing
  Homolog annotation: Hit_ID=Q23EK9; Match level="QueryCoverage=78%, HitCoverage=42%, E-value=1e-16, Identity=19%"; Hit description=TPR Domain containing protein
  Pfam annotation: Domain name=TPR_1; Domain location=136-169; Score =18.2; E_value=0.03; Accession=PF00515.18; Description=Tetratricopepti de repeat
  Pfam annotation: Domain name=TPR_1; Domain location=227-260; Score =11.3; E_value=0.24; Accession=PF00515.18; Description=Tetratricopepti de repeat
  Pfam annotation: Domain name=TPR_1; Domain location=261-294; Score =23.1; E_value=0.00097; Accession=PF00515.18; Description =Tetratricopeptide repeat
  Pfam annotation: Domain name=TPR_1; Domain location=350-383; Score =20.9; E_value=0.0047; Accession=PF00515.18; Description =Tetratricopeptide repeat
  Pfam annotation: Domain name=TPR_1; Domain location=430-463; Score =1.2; E_value=3.9; Accession=PF00515.18; Description=Tetratricopeptide repeat
  Pfam annotation: Domain name=TPR_1; Domain location=513-546; Score =16.8; E_value=0.053; Accession=PF00515.18; Description =Tetratricopeptide repeat
  Pfam annotation: Domain name=TPR_1; Domain location=570-603; Score =20.2; E_value=0.0073; Accession=PF00515.18; Description =Tetratricopeptide repeat
  Pfam annotation: Domain name=TPR_2; Domain location=136-169; Score =19.9; E_value=0.0094; Accession=PF07719.7; Description =Tetratricopeptide repeat
  Pfam annotation: Domain name=TPR_2; Domain location=227-260; Score =19.4; E_value=0.013; Accession=PF07719.7; Description=Tetratricopepti de repeat
  Pfam annotation: Domain name=TPR_2; Domain location=261-294; Score =21.0; E_value=0.0043; Accession=PF07719.7; Description =Tetratricopeptide repeat
  Pfam annotation: Domain name=TPR_2; Domain location=350-383; Score =22.9; E_value=0.0012; Accession=PF07719.7; Description =Tetratricopeptide repeat
  Pfam annotation: Domain name=TPR_2; Domain location=430-463; Score =1.6; E_value=21; Accession=PF07719.7; Description=Tetratricopeptide repeat
  Pfam annotation: Domain name=TPR_2; Domain location=479-512; Score =10.2; E_value=2.2; Accession=PF07719.7; Description=Tetratricopeptide repeat
  Pfam annotation: Domain name=TPR_2; Domain location=513-546; Score =19.3; E_value=0.014; Accession=PF07719.7; Description=Tetratricopepti de repeat
  Pfam annotation: Domain name=TPR_2; Domain location=570-603; Score =21.0; E_value=0.0043; Accession=PF07719.7; Description =Tetratricopeptide repeat
  Pfam module annotation: Pfam domain module=TPR_1::TPR_1::TPR_1::TPR _1::TPR_1::TPR_1::TPR_1::TPR_2::TPR_2::TPR_2::TPR_2::TPR_2::TPR _2::TPR_2::TPR_2; Domain location=136-169::227-260::261-294::350 -383::430-463::513-546::...
  Pfam module annotation: Domain location=570-603::136-169::227 -260::261-294::350-383::430-463::479-512::513-546::570-603
MAEKSGAAEESSNPMAFHHTTTKLVVLADLNVEAEAEAEEDDSSLVPPPLITILANDENSQDKSSLSKDTDSIEAESKKLNKLSKSRSRKTDSSLDFVADVDGDQHVQGPPSSREEKVSSVKTGLVHVARKMPKNAHAHFILGLMYQRLSQPQKAVLAYEKAEEILLRPEAEIDRPELLSLVQIHHAQCLILESSSENSSDKELEPDELEEILSKLKESVKSDIRQTAVWNTLGFILLKTGRVKSAVSVLSSLLSIAPENYDCLGNLGIAYLKIGNLELSAKCFQELILKDQNHPAALVNYAALLLCKYASVVAGPGASAAEGAMTDQIMSANVAKECLLAAVKADSKSAHVWANLACAFSISGDHRSSSKCLEKAAKLEPNCMSTRYAVAFHRIKEAERSQDPSELLSCAGNEMASIIRDGDSSLVEIPIAWSGLAMVHKAQHEIAAAYESEQNGLREVEERAVCSLKQAIAEDPNDAVQWHQLGIHSLCARQFKTSQKYLKAAVACDKDCSYAWATLGVSLQLSEEPSQAEEVYKQALSLATTKQAHKQYQRAKAMFTKSLELQPGYALAFNNLGLVFVAEGLLEEAKYCFDKALQSDSLLDAAKSNLIKVVAMSKLCKGLSSCGLKE

SEQ ID NO: 174742 - protein, 623 aa, Glycine max
  Coding DNA Sequence Number=SeqID_57964
  Gene Ontology: Mol. function=cysteine-type peptidase activity; Biological process=ubiquitin cycle
  Homolog annotation: Hit_ID=Q2QTR5; Match level="QueryCoverage=69%, HitCoverage=69%, E-value=5e-74, Identity=37%"; Hit description =Expressed protein
MADDSNRLVRLLCRPKPLNTKGSDPGIHFWLIGSPFFPPLTVASFLRRIHALPSAASPDLPKESEDLRTLIPRGFEVVGALASGDDAHARAAVDAARTLRNLLYGEGTDRPVIGAVCGFDSGELRFFVSESENATGLESISSVIEERDSKKFVWENGCLLHCELPIKLPLYYSLKNPTDVEKSYVQATEAVIAKLRDPQAVYLLETSNKASQDISPPVIIRGLQLDFSTDLSKIKALADDDDGFDASSLSCSYFPISSKAGSPVFSAEGHHQLLLSLLQNTFQEETRLLIVDIKLDVLCYSSRKLPLKYAISSLIIPGLVDQLNVVQKLMLPNLLAQHPWLKSYHFSPPGILHPITVFYELSFGETEMKQVEVRRSLHSRLGLPYDRPLLRISNALDFSKLNNNDMVSLQKGSTLLRDVHIGIPSSGVTGGTVSLVQESMWVIGSVSTSQEEGMTSTTQWTCRSGGGETARETQETLQISRLSALRVSLKTFEKKNCGLLPRNEAMSGRLKGVSNVKQLEGQLDNLIVGGLKLHMNLPKHEREDKTHLQDREIDRATSGGRDKGKAVMAQPHCQPNKGQQKTSEMGDGKCQENCTNGVRKWSSEWIIYVPLVAVTESGNAHWL

SEQ ID NO: 174743 - protein, 201 aa, Glycine max
  Coding DNA Sequence Number=SeqID_57965
  Gene Ontology: Mol. function=chitin binding; Cellular component =extracellular region; Biological process=chitin metabolic process
  Homolog annotation: Hit_ID=UPI000044A8F0; Match level="QueryCoverage =81%, HitCoverage=99%, E-value=2e-12, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MKSISCFLIRVDPWVLVPIAFRGLHDLAIRGLHVLAFRELHVLAFRGLHVLTFRGLHILALEDYTSSPSEGYTPSPSEDYTSSPSEDCTSLPSEGYIGLYVLPFRGLRVPAFRGLHDLRGLYALAFRGLHVLTFRGLHALAFRGLHALAFIGLHALTFRGLHVLAFRGLHVFTFRGIHILAFTPSEDYTSSPSEGCTPSPS

SEQ ID NO: 174744 - protein, 95 aa, Glycine max
  Coding DNA Sequence Number=SeqID_57966
QGVPFEGTLVDDWKFDYSRHDAHRMALQANAPLPYPHLVNIFLHHFNVPLDDEPDVKVKRSFSIGAGVVTSFGYRKYADGQWVRKQDLPLPTPDE

SEQ ID NO: 174745 - protein, 81 aa, Glycine max
  Coding DNA Sequence Number=SeqID_57967
  Gene Ontology: Mol. function=RNA-directed DNA polymerase activity
VPINPKRIKVIPEWLTPPSIRKIWDFHDLTNFYKRFVPYFSILVAPLVELVRNLVPSWEDAQEMGFQVLRKKAQSFKNLGI

SEQ ID NO: 174746 - protein, 211 aa, Glycine max
  Coding DNA Sequence Number=SeqID_57968
  Gene Ontology: Mol. function=drug transporter activity; Cellular component=membrane; Biological process=multidrug transport
  Homolog annotation: Hit_ID=Q8ZKH8; Match level="QueryCoverage=76%, HitCoverage=36%, E-value=3e-54, Identity=69%"; Hit description=DNA -damage-inducible protein F
  Pfam annotation: Domain name=MatE; Domain location=20-181; Score =129.8; E_value=7.7e-36; Accession=PF01554.9; Description=MatE
MGLMQLFSSSDKALWRLALPMILSNITMPLLGVVDTAVIGHLDSPIYLGGVAVGTTATSFIFMLLLFLRMSTTGLTAQAFGAGDKQALARALMQPLLIALAAGLLLALLRSPASSLAATLMGGSAEVQQQAQIFIEIRWLSAPAKLANLVILGWLLGVQYARAPMVLLIVGNLVNILLDLLLVLKLHWGVAGAAAATALAEYVTLAVGLWM

SEQ ID NO: 174747 - protein, 72 aa, Glycine max
  Coding DNA Sequence Number=SeqID_57969
  Subcellular localization annotation: CTP_CleavageSite=34; ConfidenceScore=5.15e-01
MCLLFWLKICSIISAYFRPILVLKFQVKSSVKTSAKTRGNWKGGLVPSLEEFESRSKGPTTLSAIGLKSTPN

SEQ ID NO: 174748 - protein, 86 aa, Glycine max
  Coding DNA Sequence Number=SeqID_57970
MPHGLFPYKGHALMPLRHFTEHLVGARLGINSKRTGTMWHSTKRRSKYTNEKLESLGMEYLLVGDEQKRETESKNAKNGDPRAANL

SEQ ID NO: 174749 - protein, 67 aa, Glycine max
  Coding DNA Sequence Number=SeqID_57971
MEIGRSSRGPPPPSGFHCWPRSLVGVGNIGWWGLGHVGAEVTAWVSPSFFLALLAPNLLLLVLAGAA

SEQ ID NO: 174750 - protein, 100 aa, Glycine max
  Coding DNA Sequence Number=SeqID_57972
FTSDSPHVSASPHQLNFAPYASRSYSAQWNAPGLLHDKHMLHLSRILGKMEVEEPWLGLFRCKIPSFVGVLVRAKGGVRDWKVAIGLSNDIVGLVGNLDV

SEQ ID NO: 174751 - protein, 99 aa, Glycine max
  Coding DNA Sequence Number=SeqID_57973
MIGENHSKCINLTQCVARKSLAQGFCRKSKGEDHFRSWFPFSCLLGQGLTFSPWVKVYDKLGFWLKACRTAGHDICQGLASGSRIKGMSYIISMIPMQQ

SEQ ID NO: 174752 - protein, 271 aa, Glycine max
  Coding DNA Sequence Number=SeqID_57974
  Gene Ontology: Mol. function=phosphopyruvate hydratase activity; Cellular component=phosphopyruvate hydratase complex; Biological process=cell division
  Homolog annotation: Hit_ID=Q1GZ06; Match level="QueryCoverage=95%, HitCoverage=63%, E-value=1e-117, Identity=80%"; Hit description=Cell division protein FtsA
  Pfam annotation: Domain name=FtsA; Domain location=58-227; Score =259.0; E_value=9.9e-75; Accession=PF02491.10; Description=Cell division protein FtsA
  Pfam annotation: Domain name=MreB_Mbl; Domain location=2-217; Score= -224.2; E_value=0.0012; Accession=PF06723.3; Description=MreBMbl protein
  Pfam module annotation: Pfam domain module=FtsA::MreB_Mbl; Domain location=58-227::2-217
MSGIRLEVRVHIVTGAIAAAQNIVKCIKRCGLEVSDLILQPLASSESVLTDDEKELGVCLVDIGGGTTDLAVFKNGAIRHTAVIPIAGDQITNDIAVALRTPTQSAEEIKVKHGCALRQLADPREVVEVPAVDGREPRQLSCQALTEVIEDRVEEIYEFVQQELRRSGMESMIASGIVITGGAAQMRGMVELGEEIFHTPVRLGVPRGVEGLSEVVGNPRYATGIGLLLMAKQQVEKQMVGNLQSGSVGRLLERMKSWFTGRECGANQSLK

SEQ ID NO: 174753 - protein, 76 aa, Glycine max
  Coding DNA Sequence Number=SeqID_57975
MNSELRVEDRRIAHSSLDGGGHMNSARQSIHRSPNKSRGWRIGEHRYAINSWGSSLDAGGDMNRARQSIHGSLKKS

SEQ ID NO: 174754 - protein, 334 aa, Glycine max
  Coding DNA Sequence Number=SeqID_57976
  Gene Ontology: Mol. function=nucleoside-triphosphatase activity; Cellular component=membrane; Biological process=transport
  Homolog annotation: Hit_ID=Q665C3; Match level="QueryCoverage=95%, HitCoverage=99%, E-value=1e-138, Identity=56%"; Hit description=ABC sugar transporter, fused ATP binding domains
  Pfam annotation: Domain name=ABC_tran; Domain location=41-229; Score =159.8; E_value=7.1e-45; Accession=PF00005.17; Description=ABC transporter
MMNTLSTSPANAEAFISLEKISKKFPGVLALDNVSLTLNKGEVHCLAGQNGCGKSTIIKVISGVYQPEKGAAITLDGKLFHTLTPQLSSYYGIQVIYQDLSLFPNLSVAENIVIHRYLPGGDFWVHRESMRKKALAAMQRVGVALDPDRKVEKLSIADRQLVAICRAIAADASLVIMDEPTASLTRSEVNGLLRVVNELKAAGICVVFVSHRLDEVMEVADRISVMRDGKLVGTYPASELDSHELAFLMTGQRFTYSHLPHRAPADVTPLLEISQLSRKGQYHNISLSLRQGEITSIIGLLGSGRTELCLSLFGMSQPDSGEIRINGHVVEIPL

SEQ ID NO: 174755 - protein, 336 aa, Glycine max
  Coding DNA Sequence Number=SeqID_57977
  Gene Ontology: Mol. function=sugar porter activity; Cellular component=membrane; Biological process=transport
  Homolog annotation: Hit_ID=Q665C4; Match level="QueryCoverage=99%, HitCoverage=84%, E-value=3e-65, Identity=48%"; Hit description=ABC sugar transporter, permease subunit
  Pfam annotation: Domain name=BPD_transp_2; Domain location=3-161; Score=4.0; E_value=0.00015; Accession=PF02653.6; Description =Branched-chain amino acid transport system  permease component
MNGISWFSFTAADGYDYGLTLPLLCLLGVIIVTGVLMNRTRVGRQIYAMGSNRDAASRLGLNILRLHFYVYGFMGLLAGIAAVVQAQITQSVAPNSLLGYELTVLAAVVLGGTSMTGGRGSLTGTILGVMLLAFLQNGMTLLSISSYWHQVFSGAIILLLQRRQFPVDLLAVTDSGHAGAGDGHYHADRRDQPFDHCRCQRVFAGDGGDSGGASEPAGICRAGAACGSGCGAGDWGAQWRADCLYRGFTNSGDARHHDADRRAEYSADQRRGHFRLPAGNSVPQQRQPAGYPGRPGVIPAGGAAAVGVSGTHYARPQPVPDGFQRAGDAVQWGQHA

SEQ ID NO: 174756 - protein, 87 aa, Glycine max
  Coding DNA Sequence Number=SeqID_57978
MQYNPLNDNTRRGYLSFMKQIQYDVDMTKSKGKDPLEGLGGPMTRARARKAKEALQQVLSILFEYKPKFQGEKSKVVSCIMTQMEED

SEQ ID NO: 174757 - protein, 116 aa, Glycine max
  Coding DNA Sequence Number=SeqID_57979
MVRLQSSFFLLHSASIHLQEVKDSIDEEDPRPTSSIRSYVRVSHHLEKETKGLRVEDVWVQRGMIRLAFKERLRHFGWLRWVAGVNALIMVVDEVKMKRCNKLQHTKTRRKSITIT

SEQ ID NO: 174758 - protein, 114 aa, Glycine max
  Coding DNA Sequence Number=SeqID_57980
MVIFTHEVVAEDKGEEAPNNGDLASHCYERLYTLRTDVDKRIRGMDNGRRGGNGYRMRVSPIIDAQALDRGDNALSAVMSGLSEVFTRLVRDFALSVPLSFFVGLLHAKLELDC

SEQ ID NO: 174759 - protein, 104 aa, Glycine max
  Coding DNA Sequence Number=SeqID_57981
  Homolog annotation: Hit_ID=Q2QYH7; Match level="QueryCoverage=76%, HitCoverage=14%, E-value=2e-07, Identity=37%"; Hit description =Cytochrome P450 family protein, expressed
MEMSTMQVVLGMVLVLLMHVFNVLVLRPRSLRAKLHRQGIHGPSPHFYFGNIPKMKTLLLQVQLAPTTQVNDKVQRVSLSHKWPFPLFPHIQKWINQYVGRGCC

SEQ ID NO: 174760 - protein, 121 aa, Glycine max
  Coding DNA Sequence Number=SeqID_57982
  Gene Ontology: Mol. function=nucleic acid binding; Biological process= DNA integration
  Homolog annotation: Hit_ID=Q1SLU0; Match level="QueryCoverage=99%, HitCoverage=13%, E-value=1e-18, Identity=41%"; Hit description =Peptidase S8 and S53, subtilisin, kexin, sedolisin; Integrase, catalytic region
MTLNSPKEIWDWKSMKGMSTFVSYSRIAEKILVTVPKRYEASISTLETTNELSKISSTEVIHALHAQDQRRLMREESKVKGVLPAKHQNANKYKKNKNLDGMGASSASTNAKGNWKKSYLP

SEQ ID NO: 174761 - protein, 109 aa, Glycine max
  Coding DNA Sequence Number=SeqID_57983
  Gene Ontology: Mol. function=nucleic acid binding; Biological process= DNA integration
MGHETVICKNRNQPHSEATKVVDPEEEYLFAATGFSSIESSQNWLIDSGCTNHMTNNKDLFKEQSIICILKVRVGDGKFIRVNGKGTVAISTNKGTKLIFDVLYVTEID

SEQ ID NO: 174762 - protein, 602 aa, Glycine max
  Coding DNA Sequence Number=SeqID_57984
LTWKADVCIGVPRHLPRPLCRPWTVHKPLSFELACRRKTLSNVKGDYQVSRVVALTSIRVASLLSPQAWTTIVWVVVIKLSREDMLLVLQVKSDVSGECSACTLLMHMCHPWSGYVLETQYVGEWDYIVVQTFGVHLLFIMSFISDFVMGMGGNDSGVRFSNPSEEETCDGASNSKSSFFQRIVGSYHVGGDTSRLRMRAQPFTNSLDRELIPVTTIIPLSTFGGARSSGHGDVRASLSVRRSHSVGSLSSPPAVVGNDVAALQRQLRLTDPEDSWKIVIQAYKSDDFPFMRAMLSYPPFFFMYHCLFEGLRSPMPLLQHPACAFVCFVDIMRDFAWRTLVKQGKLAGGIVPPSIDPPVGEGVVKVSPDVSFSILAKRKRDDDAGCQVAKSQGLISASKQGGFTVITTSVASASPVMAPPSTIVAPLLSASVTTTSAPEISPPSSALPVSASTMLASIAFFLFSSKSSSKEVCAILEENGLRHLEALCKVASLEVEVAKWRVTTRTVWRVECPKVANTTIAFVEHCKGLSREKNELADKVENIAVEKDELTKVVVDLHARLKESESELRVSKDREATKELKEELLVYKKDVIDQHKKGFYLQ

SEQ ID NO: 174763 - protein, 96 aa, Glycine max
  Coding DNA Sequence Number=SeqID_57985
  Subcellular localization annotation: CTP_CleavageSite=45; ConfidenceScore=5.22e-01
MTIITSTAMTIIVIVVAATITVNANDVMAATPVMMVATVIVMVVVAATATKVMVVEVVAVDDNNSDDDDDHGGSCNSDHGSDNDSHSDGDMLIEIF

SEQ ID NO: 174764 - protein, 400 aa, Glycine max
  Coding DNA Sequence Number=SeqID_57986
  Gene Ontology: Mol. function=oxidoreductase activity; Cellular component=integral to membrane; Biological process=electron transport
  Homolog annotation: Hit_ID=Q2QYH7; Match level="QueryCoverage=90%, HitCoverage=65%, E-value=3e-76, Identity=43%"; Hit description =Cytochrome P450 family protein, expressed
  Pfam annotation: Domain name=p450; Domain location=40-400; Score= -146.8; E_value=0.00027; Accession=PF00067.12; Description=Cytochrome P450
MEMNTVQVVLVAVVVVLIHVFNVLLLRSRSLRAKLHRQGIHGPSPHFYFGNIPEMKTLLLQVQSAPITQVKDKDDHDSLSHKWPFTLFPHIQKWISQYGEDVYPTCRRMGRMWLMVSDIEMVKEIIMYTSLNLGKPSYLSKDMGPLLGQGILTSSGPIWAHQRKIIAPELYLDKVKAMVNLIVDSTNVTLRSWEARLESEGAVSEIKIDDDLRSLSADIIARTCFGSNYIEGKEIFSKLRDLQKLLSKIHVGIPGFRDATKVKNGAIICFRYLPNKSNRQMWRLEKEINSKISKLIKQRQEETHEQDLLQMILEGAKNCEGSDGLLSDSISCDVFMIDNCKNIFFAGHETTAITASWCLMLLAAHQDWQDRARAEVLEVCGKGAPDASMLRSLKTIGHNA

SEQ ID NO: 174765 - protein, 172 aa, Glycine max
  Coding DNA Sequence Number=SeqID_57987
RVVRQFGYTQTIPAPPVDSWVSYDDIHDRWMHYEDHIVPTGEVCVVPEACSSDYMDWFFRISHPFMTPGHALDPLPHGHAPQPRVVPQTPQTDIPRVLELGASSTSAEEPRHAVKVCDDIAERLERHLSLRVVTLGSSTHEVIEECLRLARSVTRDHLVYVRSRRKRRTDQA

SEQ ID NO: 174766 - protein, 283 aa, Glycine max
  Coding DNA Sequence Number=SeqID_57988
  Gene Ontology: Mol. function=catalytic activity; Biological process =alkaloid metabolic process
  Homolog annotation: Hit_ID=Q56SE1; Match level="QueryCoverage=91%, HitCoverage=98%, E-value=3e-63, Identity=48%"; Hit description =Methyl jasmonate esterase
  Pfam annotation: Domain name=Abhydrolase_1; Domain location=54-278; Score=37.5; E_value=4.7e-08; Accession=PF00561.10; Description =alphabeta hydrolase fold
MCKRERYFLPFLVALVLFFLSFCVNGMHFVLVHGGLHGAWCWYKVANKLKSEGHNVTTLDMAACGVNPKQRQEVHSVSEYNEPLMTFMASLPPEEKVILVGHSLGGLSASIAMENYPEKISVAVFITATVVSQNLTYPAFLQERRRRLISLNLDEFFILDGVNKAPILSSLGVELLASRFYQLTSNEDLTLAFCLVRPLPPITSDVKLLMKQTAVTKYKNGRVSKVFIISEKDNLHTEDFQRWVIESTGPYAEVKVIKDSDHMVMFSKPKKLSFELLKIAYKY

SEQ ID NO: 174767 - protein, 152 aa, Glycine max
  Coding DNA Sequence Number=SeqID_57989
  Gene Ontology: Mol. function=oxidoreductase activity; Cellular component=integral to membrane; Biological process=electron transport
  Homolog annotation: Hit_ID=Q2QYH7; Match level="QueryCoverage=77%, HitCoverage=22%, E-value=2e-20, Identity=43%"; Hit description =Cytochrome P450 family protein, expressed
MVKEIIMYLFGFREVYLFVQRSGSTLGPRYLPNKSNRQMWRLERKINSNISKLIKQRQEETHEQDLLQMILEGAKYCKGSDGLLSNSISHDRFVIDNYKIIFFAGHEIIAITESWCLMLLALHQDWQDRARAEVLEVCGIGALDAMQVCLEA

SEQ ID NO: 174768 - protein, 47 aa, Glycine max
  Coding DNA Sequence Number=SeqID_57990
MEQVEEVSRDGDEHHANCVGSVVDAKITESKASEAVGFMSFHFTSTL

SEQ ID NO: 174769 - protein, 1625 aa, Glycine max
  Coding DNA Sequence Number=SeqID_57991
  Gene Ontology: Mol. function=translation initiation factor activity; Biological process=regulation of translation
  Homolog annotation: Hit_ID=Q76E23; Match level="QueryCoverage=99%, HitCoverage=96%, E-value=0.0, Identity=48%"; Hit description =Eukaryotic translation initiation factor 4G
  Pfam annotation: Domain name=MA3; Domain location=1438-1552; Score =65.6; E_value=1.6e-16; Accession=PF02847.7; Description=MA3 domain
  Pfam annotation: Domain name=MIF4G; Domain location=982-1204; Score =198.8; E_value=1.3e-56; Accession=PF02854.9; Description=MIF4G domain
  Pfam module annotation: Pfam domain module=MA3::MIF4G; Domain location=1438-1552::982-1204
  Subcellular localization annotation: CTP_CleavageSite=26; ConfidenceScore=5.41e-01
FNKKSNNAQGGQSRVNPPGHSTEFNSASTARTINNGTHVQPQLHGASDGPGTKSSESSAAHTSAGILPKAPTSLQPPLISDPVPPSSPAKGDASKAFPFQFGSIAPGFVNGMAIPARTSSAPPNIDEQKRDQALHDSYKSVPSVPIPPVPKQQQPPRKDAGVTEQSNAGDSRETHNGGTKAKKDPQVSALTPASHMPKPSVPVTGIPMPTPYHQSQAPLQFGSANPQIQSHGMSTASLQMPIPMPLPIGNATQVQRPVFVPGLQPHPMHPRGIMHQGQNMSFAPQMGHQLPHQLGSMGIGIGPQYPQQQGGKFAAPRKTTVKITHPETHEELRLDKRTDACSDGGSSGARSHPNIPSLSPVKSFPASHPVNYYSSSSYNTNSPYYPSSSIPLTSSPISPNSQPPIFNYPVNHGPQGANFMNSSSLGSPPISKASTPTGVASLAIKPSGTSANVDSSLSNSSISDVQNTESPSSTASCDASSSVLQKGSETCSEISLPQYKLSSDSVPVVDNNEGGRESLSRSNSLKDKKPGKKGQLSHHQVSVQSPTADNVPFCAVDHGIYDTGVSKPVGTKTNHSAELTTEDLPTSNTIPSSTSTAVEVKTNGSAEVVACVSAEGSCAQTVDRVHNNNPDKIDKLFEGKFGISDLQSADLPETTSKHVKDGSENTGDESSTKDRPIIEPNKAKTTSKGKKKRREILQKADAAGSTSDLYNAYKGPEEKKEAVLSSESTESATTTTLKQLPKDAAQSDALASEKCSHSKAELDDWEDAADMSTPKLEVHDKSQQVGDGSGSTAKKYSRDFLLKFADQCTDLPEGFKVTADIEALMSGNIGSSHVFERDSHPSPGRIVDRPGGMSRMDRRGDVVMEDDRWSRVSGAFRSGRGLDGIGGNVGFRSGQGGNFGVLRNSRAQTPPQYVGGILSGPMQSVGNHGGRNNPDGERWQRSASFQQRGLIPSPTQTPLQMMHKAENKYEVGKASDVEEVKQRQLKAILNKLTPQNFDRLFEQVKAVNIDNAVTLTGVISQIFEKALMEPTFCEMYANFCLHLASELPDFSEDNEKITFKRLLLNKCQEEFERGEREEEAANKADEGEVKQSAEEREERRVKARRRMLGNIRLIGELYKKKMLTERIMHECIKKLLGQYQDPYEEDIEALCKLMSTIGEMIDHPKAKEHMDAYFERMKLLSNNMNLSSRVRFMLKDSIDLRKNKWQQRRKVEGPKKIEEVHRDAAQERQAQAGRSGRGLGNNQSARRNPMDFGPRGSSMLSSPNSQMGGLRGLPTQVRGYGAFQDARFEERQSYEARTLAVPLPQRPSGDDSINLGPQGGLARGMSTRGSTAISNLPISDVLPVHGDSHRMNTGLNGHSNLSERTPYSSREDHVSRYGTDRSSGPSAYDQSSAPEHNVNHGNRGLRSEDRNLEPLAHLQGSIVSQNASSEKIWPEERLRDMSLSAIREYYSARDENELALCVKDLNSPSFHPSMVSLWVTDSFERKDAERDLLAKLLVNLVKSQHGTLNQDQLIKGFESVLSTLEDAVNDAPRAAEFLGRIFAIAITESVVTLKDIGQLIHDGGEEPGSLLEVGLAADVLGSTLEVIQSEKGDAVLNKICSGSNLRLETFRPPNAKTSRKLEKFI

SEQ ID NO: 174770 - protein, 69 aa, Glycine max
  Coding DNA Sequence Number=SeqID_57992
  Subcellular localization annotation: CTP_CleavageSite=45; ConfidenceScore=5.75e-01
MSFNQSKSENNDAVYRKPGRSSSFNQQRGSYGRGGGTAPTSNSLSSSRRVVLGLFFGTWMRFRVRSLVL

SEQ ID NO: 174771 - protein, 64 aa, Glycine max
  Coding DNA Sequence Number=SeqID_57993
  Subcellular localization annotation: CTP_CleavageSite=33; ConfidenceScore=5.23e-01
MPCAKLRTSKLTSAMSLPASLDRRAVACLVVVACVAVGCFALCRARPAMPCYPSELGYMMKTFC

SEQ ID NO: 174772 - protein, 76 aa, Glycine max
  Coding DNA Sequence Number=SeqID_57994
MAFGVNHSFLFGILFAALVLTPGQANVDVDPPGLICLRGSCVGNTQCALLCVGNGHVKGGSCVGLIPGLILCCCNN

SEQ ID NO: 174773 - protein, 85 aa, Glycine max
  Coding DNA Sequence Number=SeqID_57995
MRVILHQPRLREMLGAPNNIAREEGSSEKTNCSTGRRLFRMNKLFYRKNLLPESFLKEGSSDNTNCSSERRPLASGMVFKGDFTA

SEQ ID NO: 174774 - protein, 104 aa, Glycine max
  Coding DNA Sequence Number=SeqID_57996
MTPRKLASKRSRKDKGWSFLRERRVQLRDDEYTDFQEEIVRRWWASLVTPMAKFDPDIVLEFYVNAWPTEEGVRDMRSWVRGQWIPFNADALNQFLGYPWDPSR

SEQ ID NO: 174775 - protein, 367 aa, Glycine max
  Coding DNA Sequence Number=SeqID_57997
  Gene Ontology: Mol. function=zinc ion binding; Biological process =regulation of transcription
  Homolog annotation: Hit_ID=Q1T0F7; Match level="QueryCoverage=80%, HitCoverage=80%, E-value=2e-52, Identity=44%"; Hit description=Zinc finger, Dof-type
  Pfam annotation: Domain name=zf-Dof; Domain location=79-141; Score =134.7; E_value=2.6e-37; Accession=PF02701.6; Description=Dof domain, zinc finger
MVYTSIPAYIDPANWQQQQPNHQQQGNNTAASSHLILPQPIQPPQPPPSQPHGLGGSTTAGSIRPGSMADRARMANIPMQEAQQKCPRCESTNTKFCYFNNYSLSQPRHFCKACRRYWTRGGALRNVPVGGGCRRNKRSRGSSGNNTRSPANSDRQTASAGSASTTSGSSSADLVAGLGGGTGVPPSLRFMASLHQLGDHHHHLGGGGGEIGLSYGLNYGAISGPMGGIGDLNFHIGGSLSGGGCSMLSGLEQWRVPQTHQFPFLSGLEATSSHGLYPFEGASGSDGYGSTPIKVSTSGVMSQLASVKMEDNHHHHHQELGLPRQFLGVNNNPSTNEQYWSGGGGATSAWTDLSAFSSSSTTSNNAL

SEQ ID NO: 174776 - protein, 84 aa, Glycine max
  Coding DNA Sequence Number=SeqID_57998
MARRILYQISVYPEAKVSEEEFGGIGKLEGKNRWDARLEDEMKKIVMVLRKKDMADYLKLSKEVLNFNKVLAVSMNASWKKPQS

SEQ ID NO: 174777 - protein, 273 aa, Glycine max
  Coding DNA Sequence Number=SeqID_57999
  Gene Ontology: Mol. function=ubiquitin-protein ligase activity; Cellular component=ubiquitin ligase complex; Biological process =protein ubiquitination
  Homolog annotation: Hit_ID=Q64HA9; Match level="QueryCoverage=77%, HitCoverage=35%, E-value=3e-32, Identity=35%"; Hit description =Spotted leaf protein 11
  Pfam annotation: Domain name=Arm; Domain location=180-220; Score =14.1; E_value=0.21; Accession=PF00514.13; Description=Armadillobeta -catenin-like repeat
  Pfam annotation: Domain name=Arm; Domain location=222-262; Score=7.0; E_value=1.6; Accession=PF00514.13; Description=Armadillobeta-catenin -like repeat
  Pfam annotation: Domain name=Arm; Domain location=95-132; Score=5.6; E_value=2.4; Accession=PF00514.13; Description=Armadillobeta-catenin- like repeat
  Pfam annotation: Domain name=U-box; Domain location=31-95; Score= -8.2; E_value=0.0038; Accession=PF04564.6; Description=U-box domain
  Pfam module annotation: Pfam domain module=Arm::Arm::Arm::U-box; Domain location=180-220::222-262::95-132::31-95
MESGNNIVSPTEDFSRHTHEPYAKLCPESLHIPYEFRCPISLVIMKDPVIICTGQTSDASSELIDPDILVSKLSSNDIEELQCAVGELRLLTKKNGQNRMLIAEAGAIPCLVDLLYALDTQTSVSVVSNSFKIPQHQEHVATVWKLVKMQQPPFSASLGWMGTELQLVDAAKALLNLCLSQGNKGQAITASIVPKLIEMLTEPDGDMRDEAFAVMAVVAAGHSDGQATIGSMNVVSTLVELVSNGPPRNKENATSVLEMVQKGPSEKLHSFLS

SEQ ID NO: 174778 - protein, 82 aa, Glycine max
  Coding DNA Sequence Number=SeqID_58000
MVIVTTYPSAGGQVRLKGCDFQRRKTCGSRHQRLFEENIRKTKKGNEGWRLCSSSPGRAGYFSLKPSSGPGEPGDSLDEPGA

SEQ ID NO: 174779 - protein, 131 aa, Glycine max
  Coding DNA Sequence Number=SeqID_58001
MFSTALLAVLYRASFLVTDYNNHKSLILLGEDLSLSLEKLDNETHKVYAVILDIVSHMAHEYDERNPQLVTQYCFQIPSPRNLGLTYPMFVEQVMELVLSKKFMELVELNPIRDSLVGIPGIISSCTRPFY

SEQ ID NO: 174780 - protein, 218 aa, Glycine max
  Coding DNA Sequence Number=SeqID_58002
LLNSVTDTKLFSLLPPSHSMQSCRPSEPKNLREGTQSGGDGSLSEVTLEEGWPLGLRFLNSRIGLMRNGSGSASFSTVLTTSHTPSTDSSSDLDTESTGSLFHDDSITLGSLIGISSFFELSRRSTRGRMVEPSKDNKRIHKLKPWLFSLCSRLSTDAVIGNDAPSLGHYLQAERRGASTYRRNQFPTTYGPNGFSPIQDSTSLLVGSQIDPNREMEE

SEQ ID NO: 174781 - protein, 243 aa, Glycine max
  Coding DNA Sequence Number=SeqID_58003
  Homolog annotation: Hit_ID=Q1T010; Match level="QueryCoverage=18%, HitCoverage=3%, E-value=4e-07, Identity=61%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MEYDVYVKRKTKGILLICLYADDLLVTGSNSEEIEKFKVEMMTESEILKFMNNWSNELEEHIGHSLWGPKWANMPRKYDTLLNKGSKDFLSNAHKFMLYYLMEGTPFDLPQILFNCFATEVMKDMIIRKDIYHSVVPMKVLKAHGVTRKFLYETPEEVQDRIYFDEVFFPEQKAFNQVNISKVRLFNDGSFPKTPQVDDSILSELYKKYGLKNGRDDQLDVVWEKAVAEENKEVSSFQSKKRT

SEQ ID NO: 174782 - protein, 194 aa, Glycine max
  Coding DNA Sequence Number=SeqID_58004
  Gene Ontology: Mol. function=nucleic acid binding; Biological process= DNA integration
  Homolog annotation: Hit_ID=Q1SHC9; Match level="QueryCoverage=81%, HitCoverage=43%, E-value=3e-22, Identity=34%"; Hit description=Zinc knuckle, putative
MCTLTQNFDHIVVAIEESKDVEIIRIEELQGFLEAQELKLIQSGKSSFASTECWHKKGKGKGKQKVKDQKINDAHEDFDSGPVLLMVTTNKGALSSEAWYLNTGLSNHMTRHKEWLIDLDTSRSRKVKLANSRTLNAEGVGNILIRRKDGKTTLIESVWFVHERLARTSYTPQHNGLAERRNRAVLDMARSLLK

SEQ ID NO: 174783 - protein, 304 aa, Glycine max
  Coding DNA Sequence Number=SeqID_58005
  Gene Ontology: Mol. function=phosphotransferase activity, alcohol group as acceptor; Cellular component=cytoplasm; Biological process =carbohydrate phosphorylation
  Homolog annotation: Hit_ID=Q1SWC0; Match level="QueryCoverage=96%, HitCoverage=73%, E-value=2e-90, Identity=54%"; Hit description =Mevalonate and galactokinase
  Pfam annotation: Domain name=GHMP_kinases_C; Domain location=179-273; Score=31.3; E_value=3.4e-06; Accession=PF08544.3; Description=GHMP kinases C terminal
MDVDHLLVYKGFYDYVKLKGVDVGQPLGLDVLVDGTVLTVESNICLLFIKGLDYRALQLVCSSTIAIMAAFGVNFPKAISVMAKTGCADLIDFNPICTQLPAGGTFVIAHSLAESQKAVTAATNYNNRAFECHLPSIVLGIKLGMKPREEILNLKTLSDVEGLCLSFASVHKSSDPVLAIKEFLKEEPYTAEEIEKIIDENLTSIFSNNPIYLNVIKAAEHYKLHQELVNICRKNGAIGARLTGAGWGGCVVALVKECIASQFILDLKERFYQFRVDKGDISKNDLDLYVFASKPSSGAAIFKL

SEQ ID NO: 174784 - protein, 908 aa, Glycine max
  Coding DNA Sequence Number=SeqID_58006
  Gene Ontology: Mol. function=protein binding
  Homolog annotation: Hit_ID=O80935; Match level="QueryCoverage=99%, HitCoverage=99%, E-value=0.0, Identity=48%"; Hit description =Putative WD-40 repeat protein
  Pfam annotation: Domain name=WD40; Domain location=389-427; Score =39.2; E_value=1.4e-08; Accession=PF00400.22; Description=WD domain, G-beta repeat
  Pfam annotation: Domain name=WD40; Domain location=467-504; Score =41.3; E_value=3.2e-09; Accession=PF00400.22; Description=WD domain, G-beta repeat
  Pfam annotation: Domain name=WD40; Domain location=507-546; Score =37.2; E_value=5.9e-08; Accession=PF00400.22; Description=WD domain, G-beta repeat
  Pfam annotation: Domain name=WD40; Domain location=550-587; Score =3.4; E_value=14; Accession=PF00400.22; Description=WD domain, G-beta repeat
  Pfam annotation: Domain name=WD40; Domain location=599-638; Score =6.5; E_value=6.4; Accession=PF00400.22; Description=WD domain, G -beta repeat
  Pfam annotation: Domain name=WD40; Domain location=640-680; Score =20.1; E_value=0.0079; Accession=PF00400.22; Description=WD domain, G- beta repeat
  Pfam module annotation: Pfam domain module=WD40::WD40::WD40::WD40::WD4 0::WD40; Domain location=389-427::467-504::507-546::550-587::599 -638::640-680
MATMERRKTMTMNWDGLGDDDDDDHFFETYNLLSAAVPQDLADDDNDFEDSRLSFASTISSTLSIKPRTSHFSANFTGKPNYEIWMAAPGSISERRRRLLGSMGLDENKELLQATSAAIARAITKKFENNNGIINNDNNNNNNNNNSSYAINSTAVDVGKQKPSNSPVYVLVRSRSEGDIGSFSMEKSRKEEIIGKVSKQRLTRTATEVAQRRHAGAENNRMVVKDVPAAGDSPVHQVNRQVVTAAMGMGDLGAFFLIKNLDTGKEFIVNEYGEDGTWNRLSDLQTGKQLTMEEFEKTVGHSAVVKEVMRRANVSRHSDKKLSSNSYISRSLRLSKRRGASLLRNIKGVASGFVGEREASVAAPQAAVGKNEWVRVRQSGKSQKELSALHLCQEFQAHEGCVWTIKFSLDGRYLASAGEDKVIHVWEVQECEVMSLKPDLKKKGKKGGASAIPEYVHVPETVFTLSEKPYCSFTGHLDEVLDLSWSRSQLLLSSSMDKTVRLWDLETKSCLKFFAHNDYVTCVQFNPMDEDYFLTGSLDAKVRMWNIPARLVVDWIDIHEMVTAVSYTPDGQGVLVGTQKGNCRTYSLEDYKLTQSGTVELRNKKKSQLKKVTGFQFAPNNPSEVLVTSADSRIRIVDGSQVVQKFKGFRNASSQMAASFTTSGRYIISASEDSQVYVWKNEEARTPSSGKARSLIVNQSHEHFPCKDVSVAIPWPCTIRGDPPSVPMQNPKKNSKRSQEDTPANSKRMLPPLPKKSNNHATESAPGSPEHDPAAISRTESGIGDSFGNSKRMLPPLPKKSNNHATESGDSPIDEELEAISRTDTGLGDSFASSYGDPASISASGTPSNASWSSNYSSYDGCNGASSIHPSAWGLVIVTAGFGGEIRCYQNFGLPRRMRQANIFLGPT

SEQ ID NO: 174785 - protein, 119 aa, Glycine max
  Coding DNA Sequence Number=SeqID_58007
MENKILENTDYTLISGHPYIKKSGWRKISCYFNISYEIRDKNIEFDENRNVQRAEFVIRAYMQGGRFSDGWGSCDRREKRFQKPNHDVPSTAETRAKNKACQDLLGIGDYRPGATSQFR

SEQ ID NO: 174786 - protein, 557 aa, Glycine max
  Coding DNA Sequence Number=SeqID_58008
  Gene Ontology: Mol. function=oxidoreductase activity; Cellular component=intracellular; Biological process=lignin catabolic process
  Homolog annotation: Hit_ID=Q9FJD5; Match level="QueryCoverage=98%, HitCoverage=95%, E-value=0.0, Identity=79%"; Hit description=Laccase
  Pfam annotation: Domain name=Cu-oxidase; Domain location=140-293; Score=220.5; E_value=3.8e-63; Accession=PF00394.12; Description =Multicopper oxidase
  Pfam annotation: Domain name=Cu-oxidase_2; Domain location=407-541; Score=189.2; E_value=1e-53; Accession=PF07731.4; Description =Multicopper oxidase
  Pfam annotation: Domain name=Cu-oxidase_3; Domain location=14-130; Score=238.1; E_value=1.9e-68; Accession=PF07732.5; Description =Multicopper oxidase
  Pfam module annotation: Pfam domain module=Cu-oxidase::Cu-oxidase _2::Cu-oxidase_3; Domain location=140-293::407-541::14-130
MAVCIVSNDGYVMQIKYQNVSRLCHTKSVVTVNGQFPGPRIVAREGDNLLIKVTNHVQNNISIHWHGIRQLRSGWADGPAYVTQCPIQTGQSYVYNYTVVGQRGTLWWHAHISWLRSTLYGPLIILPQYGVPYPFTKPYKEVPIIFGEWWNADPEAVITQALQTGGGPNVSDAYTINGLPGPLYNCSAKDTFKLKVKPGKTYLLRLINAALNDELFFSIANHTLTVVDVDAIYVKPFDTDTILISPGQTSNVLLKTKSHYPNATFLMSARPYATGQGTFDNSTVAAILEYEVSPHALHSTTSIKKLSLFKPILPALNDTSFATNFSNKLRSLASAQFPANVPQKIDKHFFFTVGLGTTPCSQNQTCQGPTNSTKFAASVNNVSFIQPTTALLQSHFFGQSNGVYSPYFPISPLIPFNYTGTPPNNTMVSNGTKVVVLPFNTSVELVMQDTSILGAESHPLHLHGFNFFVVGQGFGNFDPNKDPANFNLVDPVERNTVGVPSGGWVAIRFLADNPGVWFMHCHLEVHTSWGLKMAWIVLDGELPNQKLLPPPADLPKC

SEQ ID NO: 174787 - protein, 420 aa, Glycine max
  Coding DNA Sequence Number=SeqID_58009
  Gene Ontology: Mol. function=oxidoreductase activity; Cellular component=intracellular; Biological process=lignin catabolic process
  Homolog annotation: Hit_ID=O24044; Match level="QueryCoverage=94%, HitCoverage=70%, E-value=1e-160, Identity=68%"; Hit description =Laccase
  Pfam annotation: Domain name=Cu-oxidase; Domain location=148-301; Score=204.8; E_value=2e-58; Accession=PF00394.12; Description =Multicopper oxidase
  Pfam annotation: Domain name=Cu-oxidase_3; Domain location=35-128; Score=106.5; E_value=7.8e-29; Accession=PF07732.5; Description =Multicopper oxidase
  Pfam module annotation: Pfam domain module=Cu-oxidase::Cu-oxidase_3; Domain location=148-301::35-128
MGVSLVKIPVFLLSLIVFCIFEHALAGTTRHYHFEIRHQNVTRLCHTKSIVTVNGQFPGPRIVAREGDRLLIKVTNHVQNNISVHWHGIRQLQSGWADGPSYVTQCPIQTNRPNFCLQLHNCWSERHSLVSCSHFMLNAQYPFAKPHKEAPIIFGEWWNADPEAVITQALQTGGGPNVSDAYTINGLPGPFYNGSHKDTFKLKVKPGKPYLLHLINAALNDELFFSIANHTLTVVEADAVYVKPFATNTILIAPGQTTNVLLKTMSHYPNATFLMTARPYATGLGTFDNTTVAAILEYKTPPNTHHSSASLKTLPLLKHILPALNDTSFATKFTNKLRSLASSQFPANVPQKVDKHFFFTVGLGTTPCPQNQTCQGPTNATKFAASMNNVSFIQPTTALLQSHFFGQSNGFTPLTSQPNH

SEQ ID NO: 174788 - protein, 529 aa, Glycine max
  Coding DNA Sequence Number=SeqID_58010
  Gene Ontology: Mol. function=oxidoreductase activity; Cellular component=intracellular; Biological process=lignin catabolic process
  Homolog annotation: Hit_ID=O24043; Match level="QueryCoverage=99%, HitCoverage=90%, E-value=0.0, Identity=76%"; Hit description=Laccase
  Pfam annotation: Domain name=Cu-oxidase; Domain location=112-265; Score=218.8; E_value=1.2e-62; Accession=PF00394.12; Description =Multicopper oxidase
  Pfam annotation: Domain name=Cu-oxidase_2; Domain location=379-513; Score=188.6; E_value=1.5e-53; Accession=PF07731.4; Description =Multicopper oxidase
  Pfam annotation: Domain name=Cu-oxidase_3; Domain location=1-102; Score=188.4; E_value=1.7e-53; Accession=PF07732.5; Description =Multicopper oxidase
  Pfam module annotation: Pfam domain module=Cu-oxidase::Cu-oxidase _2::Cu-oxidase_3; Domain location=112-265::379-513::1-102
IVTVNGQFPGPRIVAREGDRLLIKVTNHVQNNITIHWHGIRQLQSGWADGPSYVTQCPIQTGQTFVYNYTIVGQRGTLWWHAHISWLRSTLYGPLIILPKLNAQYPFAKPHKEVPIIFGEWWNADPEAIITQALQTGGGPNVSDAYTINGLPGPLYNCSHKDTFKLKVKPGKIYLLRLINAALNDELFFSIANHTLTVVETDAVYVKPFATNTILITPGQTTNVILKTNSHYPNATFLMTARPYATGLGTFDNTTVAAILEYKTPSNTHHSAASLKNLPLLKPILPALNDTSFATKFTNKLRSLASAQFPANVPQKVDKHFFFTVGLGTTPCPQNQTCQGPTNSTKFSASVNNVSFIQPTTALLQTHFFGQSNRVYTPDFPTKPLVPFNYTGTPPNNTMVSNGTKVVVLPFNTSVELVMQDTSILGAESHPLHLHGFNFFVVGQGFGNYDPNKDPANFNLDDPIERNTVGVPSGGWVAIRFLADNPGVWFMHCHLEVHTSWGLKMAWVVLDGKLPNQKLFPPPADLPMC

SEQ ID NO: 174789 - protein, 97 aa, Glycine max
  Coding DNA Sequence Number=SeqID_58011
  Gene Ontology: Mol. function=acyltransferase activity; Cellular component=integral to membrane
  Homolog annotation: Hit_ID=Q9SIX1; Match level="QueryCoverage=93%, HitCoverage=17%, E-value=1e-28, Identity=83%"; Hit description =Probable 3-ketoacyl-CoA synthase 9
TFVGEKNRGPTNAEKAIGYEHGVVVPKVPILGYVLGTDDDGVGVGVSLKDVFCEVNGDDAPALQPMPPRLKLLALPRSLYLLTIMEEKEGVGLRGCS

SEQ ID NO: 174790 - protein, 193 aa, Glycine max
  Coding DNA Sequence Number=SeqID_58012
  Gene Ontology: Mol. function=oxidoreductase activity; Cellular component=intracellular; Biological process=lignin catabolic process
  Homolog annotation: Hit_ID=O24044; Match level="QueryCoverage=89%, HitCoverage=29%, E-value=2e-82, Identity=78%"; Hit description =Laccase
  Pfam annotation: Domain name=Cu-oxidase_3; Domain location=19-135; Score=191.5; E_value=2e-54; Accession=PF07732.5; Description =Multicopper oxidase
MRKKHLKILWRLCTFQQPHDKYKKVSRLYHTKSMVTVNGQFTGPRIVAREGDRLLIKVINHVQNNISIHWHGIQQLQSGWADGPAYVTQCPIQIGQSYVYNYTIGGQRGTLFWHAHISWLRSTLCDPIIILPKHGVPYPFTKPYKEVSIIFGEWWNADPEAVITQALQIGGGPNVSDAYTINGLPGPLYNCSA

SEQ ID NO: 174791 - protein, 216 aa, Glycine max
  Coding DNA Sequence Number=SeqID_58013
  Homolog annotation: Hit_ID=Q5P0C3; Match level="QueryCoverage=86%, HitCoverage=16%, E-value=1e-41, Identity=45%"; Hit description =Similar to bacteriophage tail tape meausure protein
MADLSTASTTVFQEWAYGAKSVGIEQDKLADIFKDTQDKVGEFLQTGGGPLKDFFDKVAPAVGLTAEEFRQLSGPEALGKYFGALEKANLNQAEMTFYLEALASDSSKLAPLLRNNAQGLNAMAAEAHSLGLVLEEDAVASAAEFNKTLDSLGQVAKGAFFELSSGAISALNTYTDHVKKAKAATDSWLSAMKSAAYYKVFGDKDPTRELAKAISM

SEQ ID NO: 174792 - protein, 67 aa, Glycine max
  Coding DNA Sequence Number=SeqID_58014
  Gene Ontology: Mol. function=oxidoreductase activity; Cellular component=intracellular; Biological process=lignin catabolic process
  Homolog annotation: Hit_ID=O24044; Match level="QueryCoverage=98%, HitCoverage=14%, E-value=7e-21, Identity=68%"; Hit description =Laccase
MVSNGTKVVVLPFNTSVELVMQDTSILGAERFGNFDPNKDPTNFNLVNPVERNTVGVPSGDGLLSDS

SEQ ID NO: 174793 - protein, 47 aa, Glycine max
  Coding DNA Sequence Number=SeqID_58015
MCNTFTIIKVTDYRDMCKKHQPRINFMGCLEDPVGDKAERVVGWDKI

SEQ ID NO: 174794 - protein, 464 aa, Glycine max
  Coding DNA Sequence Number=SeqID_58016
  Gene Ontology: Mol. function=serine-type endopeptidase activity; Biological process=carbohydrate metabolic process
  Homolog annotation: Hit_ID=Q1RW49; Match level="QueryCoverage=95%, HitCoverage=80%, E-value=1e-68, Identity=34%"; Hit description=IMP dehydrogenase/GMP reductase
  Pfam annotation: Domain name=Tweety; Domain location=55-427; Score= -192.4; E_value=0.029; Accession=PF04906.4; Description=Tweety
MPFCAIFRLSSLGEDNLGPWKNEVTQVAQAARPRTKGTLVLAANRTNRPDILQGFRRYHGGWDIANRHYWASVGFTGVAGFTLAVLWFISFGLALVIHLCCGWGINIKDKGSNRLQRIWLVLLLLFTCVVTTGCIVLSFGQDKFHGEAVDTLHYVVNQSDYTVQTLRNVTEYLALTKTIVVAEMFLPSNIMDDIDKLNADLDSAADTLSKQTNENSFKIRKVFNAARLALIMMAAVMILLAVIGLILSILGYQHAILIFVITGWLLVATTFIFCGVFTILNNAICDTCMAMGEWVENPHAESALSHILPCVDQRTTNKTLFQSKQVVTNIVSIVNRFIYDTADASPSQGSMNYYNQSGPAMPPLCYPFDSQFREHQCTPQEVSLANASLVWKRYECKTSEYGVCTTVGRVTPEIYLELVQVVNESYALEHYTPLLLSLQNCNFVRHAFKEITSRYCLPLNHYLK

SEQ ID NO: 174795 - protein, 818 aa, Glycine max
  Coding DNA Sequence Number=SeqID_58017
  Gene Ontology: Mol. function=protein binding; Cellular component =small nucleolar ribonucleoprotein complex; Biological process =response to stimulus
  Homolog annotation: Hit_ID=Q67WP2; Match level="QueryCoverage=100%, HitCoverage=94%, E-value=0.0, Identity=61%"; Hit description =Putative beta transducin
  Pfam annotation: Domain name=Utp21; Domain location=665-818; Score =91.4; E_value=2.8e-24; Accession=PF04192.3; Description=Utp21 specific WD40 associated putative domain
  Pfam annotation: Domain name=WD40; Domain location=171-209; Score =21.5; E_value=0.0031; Accession=PF00400.22; Description=WD domain, G- beta repeat
  Pfam annotation: Domain name=WD40; Domain location=214-253; Score =25.6; E_value=0.00018; Accession=PF00400.22; Description=WD domain, G-beta repeat
  Pfam annotation: Domain name=WD40; Domain location=258-296; Score =25.3; E_value=0.00022; Accession=PF00400.22; Description=WD domain, G-beta repeat
  Pfam annotation: Domain name=WD40; Domain location=304-342; Score =21.6; E_value=0.0029; Accession=PF00400.22; Description=WD domain, G- beta repeat
  Pfam annotation: Domain name=WD40; Domain location=464-502; Score =15.5; E_value=0.19; Accession=PF00400.22; Description=WD domain, G -beta repeat
  Pfam annotation: Domain name=WD40; Domain location=506-543; Score =5.2; E_value=9; Accession=PF00400.22; Description=WD domain, G-beta repeat
  Pfam annotation: Domain name=WD40; Domain location=547-585; Score =48.2; E_value=2.7e-11; Accession=PF00400.22; Description=WD domain, G-beta repeat
  Pfam module annotation: Pfam domain module=Utp21::WD40::WD40::WD40::WD 40::WD40::WD40::WD40; Domain location=665-818::171-209::214-253::258 -296::304-342::464-502::506-543::547-585
  Subcellular localization annotation: CTP_CleavageSite=62; ConfidenceScore=5.00e-01
MGIFEPYRAIGCITSSVPFSVQRLGTETFLTVSVGKAFQVFNCAKLNLVLVGPQLPKKISALASYREYTFAAYGNNIAVFKRAHQVATWSSHNAKVKLLLLFGDHIVSVDARGNMFLWPFKGIDENLFPFGHIMLDEKFSPSCIMHPDTYLNKVLVGSEQGPMQLWNISTKKKIFEFKGWNSPISCCVSSPALDVVAIGCTDGRIHVHNIRYDEELVTFTHSTRGSVTALSFSTDGQPLLASGGSSGVISIWNLEKKRLQSVVREAHDSVITSLHFFANEPVLMSSSADNSIKMWIFDTSDGDPRLLRFRSGHSAPPLCIKFYANGRHILSAGQDRAFRLFSVVQDQQSRELSQRHVSKRAKKLKLKEEEIKLKPVIAFDCAEIRERDWCNVVTCHMDTAQAYVWRLQNFVLGEHILNPCPENPTPVKACAISACGNFVFLGTAGGWIERFNLQSGIRRGAYIDISESRNCAHDGEVVGVACDSTNTLMISAGYKGDIKVWNFKERDLKTRWDVDCSIVKIVYHRYNGLLATVADDLTIQLFDVVALRLVRKFEGHTDRITDLCFSEDGKWLLSSSMDGSLRIWDVILARQIDAIHVDVPITALSLSPNMDILATAHVDQSGIYLWVNQAMFSSTSNVDSYASGKEVVSVKLPSISSAEHSRDEHYDEPMNASQPKDALYFSTQDKQIPELVTLSLLPKSQWLNLINLDIIKVRNKPIEPPKKPEKAPFFLPSVPSLSGEILFESDAAFTDYIKGLSPSTLDMELRMFQIIDDDDDQQEAEKRPELVSIEWLLDYFIHELSCRNNFEFLQAVIRLFLK

SEQ ID NO: 174796 - protein, 59 aa, Glycine max
  Coding DNA Sequence Number=SeqID_58018
  Gene Ontology: Mol. function=protein serine/threonine kinase activity; Cellular component=membrane; Biological process=protein amino acid phosphorylation
  Homolog annotation: Hit_ID=O81833; Match level="QueryCoverage=100%, HitCoverage=7%, E-value=3e-19, Identity=71%"; Hit description =Putative receptor protein kinase
MNPKISDFGLAPRLWGDQVDANTNKIAGTYGYVPPDYAVHGHFSMKSDVFSFGVMVLEI

SEQ ID NO: 174797 - protein, 240 aa, Glycine max
  Coding DNA Sequence Number=SeqID_58019
  Homolog annotation: Hit_ID=O24482; Match level="QueryCoverage=90%, HitCoverage=78%, E-value=1e-125, Identity=98%"; Hit description =Sali3-2
  Pfam annotation: Domain name=BURP; Domain location=20-209; Score =339.8; E_value=4.6e-99; Accession=PF03181.6; Description=BURP domain
MTGVEIDELPKQIDDTQYPKTFFYKEDLHPGKTMKVQFTKRPYAQPYGVYTWLTDIKDTSKEGYSFEEICIKKEAFEGEEKFCAKSLGTVIGFAISKLGKNIQVLSSSFVNKQEQYTVEGVQNLGDKAVMCHGLNFRTAVFYCHKVRETTAFMVPLVAGDGTKTQALAVCHSDTSGMNHHMLHELMGVDPGTNPVCHFLGSKAILWVPNLSMDTAYQTNTWNFTFLRTCAVRMQCALMML

SEQ ID NO: 174798 - protein, 120 aa, Glycine max
  Coding DNA Sequence Number=SeqID_58020
  Subcellular localization annotation: CTP_CleavageSite=54; ConfidenceScore=5.71e-01
MQFWRVKNRTSSLTTMHKSNTLSPTSNYASRLQNPQTLGFSFEQDLTVKILAPTSMNRSPKRSQILKQKENHLSLFGSGWRWWHVADLVVGCGVRVAACLGTELVLEVGREVERMREEML

SEQ ID NO: 174799 - protein, 60 aa, Glycine max
  Coding DNA Sequence Number=SeqID_58021
  Homolog annotation: Hit_ID=O24482; Match level="QueryCoverage=70%, HitCoverage=15%, E-value=1e-16, Identity=88%"; Hit description=Sali3- 2
MASESGSLMDSAVSPHFEGEALEALAVQWEWECLAKQLPNNLPQVAMHGHGSLLQEQAAT

SEQ ID NO: 174800 - protein, 81 aa, Glycine max
  Coding DNA Sequence Number=SeqID_58022
  Homolog annotation: Hit_ID=Q1RTN7; Match level="QueryCoverage=79%, HitCoverage=11%, E-value=6e-08, Identity=39%"; Hit description =Peptidase aspartic, catalytic
MAVTDFYMGLKVLWEELENLRPMPQCICPVRCTCEAMRNVKSLNLTDSKKSSMPINDNYFKLSGMLMNSYLFWPSRKLNHY

SEQ ID NO: 174801 - protein, 318 aa, Glycine max
  Coding DNA Sequence Number=SeqID_58023
  Homolog annotation: Hit_ID=Q2WGL6; Match level="QueryCoverage=18%, HitCoverage=16%, E-value=3e-09, Identity=93%"; Hit description =Cycloartenol synthase
MTTKFFWMWRIFIGQVKAGEIHQIKEHKLDHFRMTRAFNKVITLSITGALNAVLTEEHRKEICRYLYNHQVLGVYEWSGNNPLPPEIWLLPYMLPFHPVSYRIKISLRVLLYGDDDNGDDSNGDDRDIRDVCGGDDSGIGCVDGDDVVVVAVLVVTSNDYGVVVVSGDRGDVCDDCDDVDGDSNKCVTMVVTVTVVMVVVATSYGSDNNGDGVGGNKVGGGDSDTSGWQQSVIIKFSLNIGKSTYETVTVNSWFMSGVNRNMVCSILDETLQAVGAKAMVVGHTPQTIGVNCKYNCSIWLKDCGMCSGVLNSRPEVPL

SEQ ID NO: 174802 - protein, 180 aa, Glycine max
  Coding DNA Sequence Number=SeqID_58024
  Gene Ontology: Mol. function=nucleic acid binding; Biological process= DNA integration
  Homolog annotation: Hit_ID=Q1S1G2; Match level="QueryCoverage=99%, HitCoverage=94%, E-value=1e-15, Identity=50%"; Hit description =Integrase, catalytic region; Zinc finger, CCHC-type; Peptidase aspartic, catalytic
MMLCAMDGTTWFMIQEWIKLLHLSQTLKLGSNSSSGGYKSQSIIELEFVLRDQSLLHQLCPGMLIITIERRAHQCYIQIFCRTNIIRARWIRVLEGLVKLELELEVQVVKAGNQSKLLLPLPLQKKNNVPLPQALVTFSGLSFYLMIFMFTAPNKLFSAVTKTVHSTLPLFWFFTSEQNI

SEQ ID NO: 174803 - protein, 49 aa, Glycine max
  Coding DNA Sequence Number=SeqID_58025
MVDVEANNRAMLELIEARQEITRVFNKHCTMLIYPVDYKTASKGGKRSA

SEQ ID NO: 174804 - protein, 56 aa, Glycine max
  Coding DNA Sequence Number=SeqID_58026
MASRLVVGTNCTRGSPMHKQVARDRLLVVGLTLDGGLLSEVSNHKSSGDLDIHKEN

SEQ ID NO: 174805 - protein, 141 aa, Glycine max
  Coding DNA Sequence Number=SeqID_58027
  Homolog annotation: Hit_ID=Q9FGT3; Match level="QueryCoverage=99%, HitCoverage=48%, E-value=6e-19, Identity=39%"; Hit description =Arabidopsis thaliana genomic DNA, chromosome 5, TAC clone:K21L19
MVIVRNKKRVGYTYELTLKVKGEWIIQGEKKFIGGHIDVPEFSFGELDDLQKIEKGHMLFGIVHEYLLPLVIGFGGVGSLILGMDSVLVALLLTRKVVEVRLSEARDILHQDKTQMRNDLKLFLQPVREKLLQFEQELRDR

SEQ ID NO: 174806 - protein, 66 aa, Glycine max
  Coding DNA Sequence Number=SeqID_58028
  Homolog annotation: Hit_ID=Q1STT3; Match level="QueryCoverage=91%, HitCoverage=7%, E-value=4e-07, Identity=47%"; Hit description =Protein kinase; S-locus glycoprotein; Curculin-like (Mannose -binding) lectin; Apple-like
MELAAQNPEDRPGMSCVLLMPVSELELPEPKQPGFFGKYSGEADSSTGKQQLSSTDEIAITLLEAR

SEQ ID NO: 174807 - protein, 172 aa, Glycine max
  Coding DNA Sequence Number=SeqID_58029
  Gene Ontology: Mol. function=protein serine/threonine kinase activity; Cellular component=membrane; Biological process=protein amino acid phosphorylation
  Homolog annotation: Hit_ID=Q1STT5; Match level="QueryCoverage=95%, HitCoverage=25%, E-value=1e-48, Identity=54%"; Hit description =Protein kinase; S-locus glycoprotein; Curculin-like (Mannose -binding) lectin; Apple-like
  Pfam annotation: Domain name=Pkinase; Domain location=42-172; Score= -106.2; E_value=0.031; Accession=PF00069.15; Description=Protein kinase domain
  Pfam annotation: Domain name=Pkinase_Tyr; Domain location=42-170; Score=-137.6; E_value=0.0005; Accession=PF07714.7; Description =Protein tyrosine kinase
  Pfam module annotation: Pfam domain module=Pkinase::Pkinase_Tyr; Domain location=42-172::42-170
MKLTFLEKPENVAIVDHYNEQEEDMELPLFGLSTIASATDNFSISNKLGGGFGPGTLENGHEIAVKRLSSGSGQGLKEFRNEIKLIAKLQHCNLIKHRTLLDWPKRFNIICGIARVLLYLHQDSRLRIIHRDLKPSNILLDSEMNPKISDFGLVRILFGDQNAATTHRVAGN

SEQ ID NO: 174808 - protein, 101 aa, Glycine max
  Coding DNA Sequence Number=SeqID_58030
  Homolog annotation: Hit_ID=Q9FGT4; Match level="QueryCoverage=99%, HitCoverage=10%, E-value=3e-29, Identity=58%"; Hit description =Arabidopsis thaliana genomic DNA, chromosome 5, TAC clone:K21L19
MDKMRWHQLPVVSHINYNFSVHAIEMGEKVTSIIEHAINVFGRKDDPVGNRNNNGGGWQVDVDMLDGLLSSLVEYLQLENAYNIFILNPKRDERKPKYGYR

SEQ ID NO: 174809 - protein, 126 aa, Glycine max
  Coding DNA Sequence Number=SeqID_58031
  Gene Ontology: Mol. function=sequence-specific DNA binding; Cellular component=intracellular; Biological process=regulation of transcription, DNA-dependent
  Homolog annotation: Hit_ID=Q1STS2; Match level="QueryCoverage=83%, HitCoverage=86%, E-value=2e-38, Identity=79%"; Hit description =Transcription factor CBF/NF-Y/archaeal histone
  Pfam annotation: Domain name=CBFD_NFYB_HMF; Domain location=25-90; Score=79.3; E_value=1.2e-20; Accession=PF00808.13; Description =Histone-like transcription factor (CBFNF-Y) and archaeal histone
  Pfam annotation: Domain name=Histone; Domain location=19-93; Score =35.6; E_value=1.7e-07; Accession=PF00125.14; Description=Core histone H2AH2BH3H4
  Pfam module annotation: Pfam domain module=CBFD_NFYB_HMF::Histone; Domain location=25-90::19-93
MAYITLKLDTDATTQRPLKLKTGPHSLPLARIKKIMKNSGEGVKMISGEAPIIFSKACDLFIEELTRRSWIMAIQGKRRTLHKEDLASAVIATDIFDFLITLVSNSDSHAVGGATNVMEVETIDYS

SEQ ID NO: 174810 - protein, 373 aa, Glycine max
  Coding DNA Sequence Number=SeqID_58032
  Gene Ontology: Mol. function=RNA-directed DNA polymerase activity; Cellular component=nucleus; Biological process=RNA-dependent DNA replication
  Homolog annotation: Hit_ID=Q1SFJ7; Match level="QueryCoverage=94%, HitCoverage=40%, E-value=9e-44, Identity=33%"; Hit description=RNA -directed DNA polymerase
MDKLVRVQRRFLWGRAVDHNKIAWVKWDTVCLPKEEGGLGIKDINTFNLALLAKWKWSLFQQQGDLWARVLESKYGGWRSLDEGLPASGLRGGIIEEHSVEDRSLAVKYPRLYLISSQQNHTIQQMGACKDTGWEWELSWRRLLFDNEIDMAVAFLNDVESKQIQLHRKDEWVWTADPSGHYSARSAYIIMRESIAEGAEFSAFEELWKLKVPNKVLAFAWRLLRDRLPTRANLHRRQVEINDRKCLFCGNVEESASHLFFHCSKISPLWWESMSWVNSVGPLPQSPKHHFLQHIFGVVEAVKVNRWKCWWIALTWSIWQHRNKILFSNVTLNANKIMDDAVFLLWTWLRNLEKDFGTGYNHWSSNLRLGFMC

SEQ ID NO: 174811 - protein, 293 aa, Glycine max
  Coding DNA Sequence Number=SeqID_58033
  Homolog annotation: Hit_ID=Q9FGT4; Match level="QueryCoverage=98%, HitCoverage=30%, E-value=1e-105, Identity=64%"; Hit description =Arabidopsis thaliana genomic DNA, chromosome 5, TAC clone:K21L19
MQMEWYNMWLDSLDNFGRLYEGRDTAEIIEAKALQLLKGKDQDLKLHLEKVLKSGDFSGFQAECLTDTWIGKDRWAFIDLSAGPFSWGPAVGGEGVRTEASLPSVEKTIGSASEISEEEAEDRLQDAIQEKFAVFGDKEHQAIDILLAEIDIYELFAFKHCKGRKVKLALCEELDERMRDLRNELQSFEGEEYDESHKKKAIEALKRMESWNLFSDTYEEFQNYTVARDSFLAHLGATLWGSMRHIVSPSVVDGAFHYYEKISFQLFFMTQETNRRELEKQLDADSALTRLNN

SEQ ID NO: 174812 - protein, 79 aa, Glycine max
  Coding DNA Sequence Number=SeqID_58034
  Gene Ontology: Mol. function=RNA-directed DNA polymerase activity; Cellular component=nucleus; Biological process=RNA-dependent DNA replication
  Homolog annotation: Hit_ID=Q1SA52; Match level="QueryCoverage=98%, HitCoverage=47%, E-value=2e-13, Identity=37%"; Hit description=RNA -directed DNA polymerase
MEKKGVHMAYIRVIQDMYEGDVQKIIPNSMPFADDIVLIEESREAVHMKVEFWRQTLQTKSSHTSRRKTKYMHCNFSRR

SEQ ID NO: 174813 - protein, 345 aa, Glycine max
  Coding DNA Sequence Number=SeqID_58035
  Gene Ontology: Mol. function=RNA-directed DNA polymerase activity; Cellular component=extracellular region; Biological process=RNA -dependent DNA replication
  Homolog annotation: Hit_ID=Q1SP50; Match level="QueryCoverage=65%, HitCoverage=32%, E-value=9e-63, Identity=47%"; Hit description=RNA -directed DNA polymerase
MCVGSVKYMILVNNGKVGLITPGKGLHQGDPLFLDLFILCVEGFSALIRKAERVEDAHGVKICRESPSITNMLYTNDCFLFFRAFTQEGEAIRKILGIYRKTSIQKLNVQKSEIFFTCNVRQAERDAIKEGLRTGKYLGIPSMVGTSRKATFKHIKDRVWKSIYLLPSSLCDELEKMMNSFWWGAHGRENRGIKWLAWDKLSVSNEKGGMGFQSLQAFNLEMITYEGQQSYGMSSMKRGSKNWQSGKYSVASVYNLIMNKILDLSPIAKTSIRVMNQEEWLPPPQGFFKCNANASLNDREPCTRWGTVIRDEKEAFFIGNVEWSTRSCRVKFARRQTNVAAHTLA

SEQ ID NO: 174814 - protein, 185 aa, Glycine max
  Coding DNA Sequence Number=SeqID_58036
MEKKEEKVVVGVPVPVYYGGENEYQRGIIPPNAVFGDPKGIPIQQTIYRDTPAPFNCPYCAHTALTTVQFLPMNKKVKSITDCIKMAYSMLTDEILVDARLINVYQCEYEANQQDRSKPSLAAFVGCLMPMMLGVCFLCPSMDCLWHKYHYCPKCQEKVADFEKSDPCVVMDPPHWTQESFALSG

SEQ ID NO: 174815 - protein, 125 aa, Glycine max
  Coding DNA Sequence Number=SeqID_58037
  Homolog annotation: Hit_ID=Q9FGT4; Match level="QueryCoverage=91%, HitCoverage=15%, E-value=2e-42, Identity=61%"; Hit description =Arabidopsis thaliana genomic DNA, chromosome 5, TAC clone:K21L19
QPIKAAVAATAEHLAGLLPLHLVYGQAHETAIEDWLWSVGCNPFSITSQGWHISQFQSDSIARSYVITTLEESIQLEHELVNKYNYVVSLWKRVSTVTGELHYGDALRLLNNLEDASKRLATILP

SEQ ID NO: 174816 - protein, 64 aa, Glycine max
  Coding DNA Sequence Number=SeqID_58038
MGDFNVVLKVHEMEESSPTTSTSRSDYAFEKFVQDFNLMDVGFQGSYLLEREVGLKKDLSHLGS

SEQ ID NO: 174817 - protein, 84 aa, Glycine max
  Coding DNA Sequence Number=SeqID_58039
MAKSRRRSTSTVGRIFKFDVLLMILVLVKHVFLAATKGGDDVMEFIYGGGAIMMSCGRTRISQVQVQRMSNHAYPRLHYNHIEH

SEQ ID NO: 174818 - protein, 272 aa, Glycine max
  Coding DNA Sequence Number=SeqID_58040
  Gene Ontology: Mol. function=zinc ion binding; Cellular component =integral to membrane; Biological process=defense response to bacterium
  Homolog annotation: Hit_ID=P93332; Match level="QueryCoverage=98%, HitCoverage=97%, E-value=1e-100, Identity=70%"; Hit description=MtN3 protein precursor
  Pfam annotation: Domain name=MtN3_slv; Domain location=10-97; Score =142.3; E_value=1.3e-39; Accession=PF03083.6; Description=MtN3saliva family
  Pfam annotation: Domain name=MtN3_slv; Domain location=131-217; Score= 135.7; E_value=1.2e-37; Accession=PF03083.6; Description=MtN3saliva family
  Pfam module annotation: Pfam domain module=MtN3_slv::MtN3_slv; Domain location=10-97::131-217
  Subcellular localization annotation: CTP_CleavageSite=39; ConfidenceScore=5.08e-01
MVITHHTLAFTFGMLGNVISFLVFLAPVPTFYRIYKKKSTESFQSLPYLVALFSSMLWLYYALLKRDAVLLITINSFGCVIEIIYIVLYITYATRDARNLTIKLFSAMNMTSFAVILLVTHFGVHGPLRVQVLGWICVSISVSVFAAPLSIVAQVVRTKSVEFMPFNLSFTLTLSAIMWFGYGLFLKDICIALPNVLGFVLGLLQMLLYTIYRKGNKKTNTNEKSLSVKPLKNIAVVNPLGTGEVFPVEEDEQAAKKSQGDGEDKKAEDCLV

SEQ ID NO: 174819 - protein, 110 aa, Glycine max
  Coding DNA Sequence Number=SeqID_58041
MAFCCVSLHFKKSNTECNLGFPKSNEAQQETIVGVQEVLAYLKLSLTSTFIILGWCANYRSIYGLRLARSSVFVPEVVCCTKLPLQEMATRQILRKSEPSNSIWPKWLAV

SEQ ID NO: 174820 - protein, 315 aa, Glycine max
  Coding DNA Sequence Number=SeqID_58042
  Gene Ontology: Cellular component=integral to membrane; Biological process=defense response to bacterium
  Homolog annotation: Hit_ID=P93332; Match level="QueryCoverage=75%, HitCoverage=88%, E-value=9e-97, Identity=77%"; Hit description=MtN3 protein precursor
  Pfam annotation: Domain name=MtN3_slv; Domain location=173-259; Score= 136.2; E_value=8.7e-38; Accession=PF03083.6; Description=MtN3saliva family
  Pfam annotation: Domain name=MtN3_slv; Domain location=52-139; Score =128.9; E_value=1.4e-35; Accession=PF03083.6; Description=MtN3saliva family
  Pfam module annotation: Pfam domain module=MtN3_slv::MtN3_slv; Domain location=173-259::52-139
MTKTRISQVYTVSYGIEYCGKNGDPNLPYVLLVAQSQKEAKNMAISHSTLAFAFGMLGNVISFLVFLAPITTFYRIFKKKSTEGFQSLPYLVALFSSMLWLYYALLKKDAMLLLTINSFGCVIEIIYIILYITYATGDARNLTLKLFFAMNVGAFALILLVTHFAVHGSLRVQVLGWICVSLSISVFAAPLSIVAQVVRTKSVEFMPFNLSFTLTLSAIMWFGYGLFLKDICIALPNVLGFALGLLQMLLYAIYRNGNKKVDKILEKKAPLEPLKSVVIETGEVFLVEEKQQGKKSKESSEEKEKSDEPNNDCAV

SEQ ID NO: 174821 - protein, 39 aa, Glycine max
  Coding DNA Sequence Number=SeqID_58043
  Homolog annotation: Hit_ID=Q1T6I7; Match level="QueryCoverage=100%, HitCoverage=14%, E-value=9e-07, Identity=71%"; Hit description=No apical meristem (NAM) protein
MKETLVFCSGGASKGNMTIQVMHEYDLTLKELGGTNPGQ

SEQ ID NO: 174822 - protein, 127 aa, Glycine max
  Coding DNA Sequence Number=SeqID_58044
MNKGSYKGGSLFVYACVTLTGGGPVFEGYWIVETTPHTYCFLANLHNQSGYRATHGSVSIWSCQNQWSCISGSIGRRKGKWYWWGIWATVLWSLWCHRNDVTFNDPQASSEYVGDMILIRSYMNVAS

SEQ ID NO: 174823 - protein, 159 aa, Glycine max
  Coding DNA Sequence Number=SeqID_58045
  Homolog annotation: Hit_ID=Q6YXW3; Match level="QueryCoverage=52%, HitCoverage=56%, E-value=3e-12, Identity=42%"; Hit description=Auxin- induced protein-like
  Pfam annotation: Domain name=Auxin_inducible; Domain location=1-87; Score=80.7; E_value=4.6e-21; Accession=PF02519.5; Description=Auxin responsive protein
MRSKSWPRRDRENKNKNSTTIVAPEGCFSVYVGPQMQRFVIKTEYASHPLFKMLLEEAESEYGYNSQGPLALPCHVDVFYMVLMEMGSDETQTTPQGCACVKRSPSAYQPMKYQHSPSAYQPMNVDVVLDMDTNTCLTLGHGKRIGCSCFIVINFFLLP

SEQ ID NO: 174824 - protein, 324 aa, Glycine max
  Coding DNA Sequence Number=SeqID_58046
  Gene Ontology: Mol. function=D-alanyl-D-alanine endopeptidase activity; Cellular component=integral to membrane; Biological process=cytochrome complex assembly
  Homolog annotation: Hit_ID=Q53P98; Match level="QueryCoverage=86%, HitCoverage=52%, E-value=1e-120, Identity=71%"; Hit description =Signal peptide peptidase, putative
  Pfam annotation: Domain name=Peptidase_A22B; Domain location=29-311; Score=435.8; E_value=5.6e-128; Accession=PF04258.4; Description =Signal peptide peptidase
MADSQEFVIIFCLAFVSMESSNAETAKDDLDKEIVNIDSKGAVIFVIAASTFLVLLFFFMSSWFVWVLIVLFCIGGIEGMHNCIVSLTLRKCQNCGQKTVSLPLFGEISIFSLAVLLFCVAFAIFWAATRQESYSWIGQDILGICLMITVLQLARLPNIKVATVLLCCAFVYDIFWVFISPVIFHESVMIAVARGDKAGGEAIPMLLRFPRLFDPWGGYDMIGFGDILFPGLLISFAHRFDKDNRRGASNGYFLWLVVGYGIGLVLTYMGLYLMNGNGQPALLYLVPCTLGVTVILGCIRGELKSLWNYGTDSSLSTEPSGSEV

SEQ ID NO: 174825 - protein, 190 aa, Glycine max
  Coding DNA Sequence Number=SeqID_58047
  Homolog annotation: Hit_ID=Q9FLM4; Match level="QueryCoverage=68%, HitCoverage=94%, E-value=9e-16, Identity=41%"; Hit description =Arabidopsis thaliana genomic DNA, chromosome 5, P1 clone:MEE6
EGIGGSQVDGVGGYCGKGKGRDGIGGIDCKGGNGSVLLRWLVTEATQGVYTQGTLQVEVELLIKVAWQSDTIVEPSMQLTPSTDGMSNLYTPYWSVVLFTEKLICSLVFGEVALNLHLALFRESAGGAGITINSSHHTDVRDNWTWRLSNEHKWATEERCNKKKKENRKLIHENSEESWGGFGELIDFGT

SEQ ID NO: 174826 - protein, 83 aa, Glycine max
  Coding DNA Sequence Number=SeqID_58048
MEDMVELIKVRSSQWSKAKSKGFIFHSMSGLITLDQCYSRVRQYLQRNTCQDSLCVLPIGMQLLAIDERHNGINISSGDSILL

SEQ ID NO: 174827 - protein, 154 aa, Glycine max
  Coding DNA Sequence Number=SeqID_58049
MTSISQKTDERKPRHLKLATVLALGATAVLAGNALLIRNTEPALAASENVASASAFRILTPQAIDRLAGLSGPVAPGEDAATGVSAPANDETSCIAIRAARKTDRYEALEPKAFCQLQHRLFNAELIDRIAALQLASQPDDTGTSSQFAMNKEF

SEQ ID NO: 174828 - protein, 105 aa, Glycine max
  Coding DNA Sequence Number=SeqID_58050
  Gene Ontology: Mol. function=two-component response regulator activity; Cellular component=intracellular; Biological process=two -component signal transduction system (phosphorelay)
  Homolog annotation: Hit_ID=Q8U6N4; Match level="QueryCoverage=99%, HitCoverage=84%, E-value=1e-47, Identity=88%"; Hit description=Two component response regulator
  Pfam annotation: Domain name=Response_reg; Domain location=1-98; Score=50.5; E_value=5.7e-12; Accession=PF00072.14; Description =Response regulator receiver domain
MDDLIMSFGYQCRLFASAEQFLDAQQQADIDCIVVDVKMPGLSGIELQSELNRRGEHAPMIFVTSYEDDRTRNAALSGGALAFLRKPVNIGKLMGCLESVLGPQP

SEQ ID NO: 174829 - protein, 71 aa, Glycine max
  Coding DNA Sequence Number=SeqID_58051
MIVSSGPSGREAFDWDKATAGQRCGHLYRGLVGMAEGRGGMANAGRNSVNGNACPGGTGPGHKKQGSKEEA

SEQ ID NO: 174830 - protein, 36 aa, Glycine max
  Coding DNA Sequence Number=SeqID_58052
MAAAAIARVITDHLINLLNQQMRHSDIDALGFAQIA

SEQ ID NO: 174831 - protein, 215 aa, Glycine max
  Coding DNA Sequence Number=SeqID_58053
  Gene Ontology: Mol. function=steroid hormone receptor activity; Cellular component=membrane; Biological process=regulation of transcription, DNA-dependent
  Homolog annotation: Hit_ID=Q1GX83; Match level="QueryCoverage=70%, HitCoverage=36%, E-value=9e-26, Identity=36%"; Hit description=MscS Mechanosensitive ion channel
MNYLRDIQTFIEGNTVLSATFSLLLLLVAGMVTHLICKFFVVKVVRRVFFSTHKNQVPLDKDVRLSEKLSNFIPVITVYYLLQFMPDLPEHLLIAVKTICGILFFVYLSLFFNEVLEIVNNSYSRKSKRKNHSIKGYIQIGKILVHIISAIMILAIMSNKSPVIIISSLGAVAAVLMLVFQHTLLSLVANIQVSSNDVLQLGDWIEMPDNGISGE

SEQ ID NO: 174832 - protein, 46 aa, Glycine max
  Coding DNA Sequence Number=SeqID_58054
MKKNRVEVLPRRFREQNLPPFFTVLRSFFVVLQSSTVFFSSALTSF

SEQ ID NO: 174833 - protein, 110 aa, Glycine max
  Coding DNA Sequence Number=SeqID_58055
MGAYILCGTSRAYIYLGCYTENKRGYISCGSIQVERTSTWLFKENKGGYIPCGSLLVKDFTRLLEISRTDGCLGTGCRHGLSPNQNRMWINGYLWDIELKASFFVKYARD

SEQ ID NO: 174834 - protein, 219 aa, Glycine max
  Coding DNA Sequence Number=SeqID_58056
  Homolog annotation: Hit_ID=Q6ZQQ3; Match level="QueryCoverage=86%, HitCoverage=89%, E-value=9e-10, Identity=24%"; Hit description=CDNA FLJ46317 fis, clone TESTI4041832
MENCTRQSLRVAQTHWWRMHERQSIHGAPNKSGEWRIALGNHFVWLQTHWWRMHEQQSIHGAPNKSGEWRIALGNHFAWLQTHWWKMHERQSIHGAPNKSGECRIALGNHFVWLETHWWRMHEQQSIHGAPNKSGEWRIALGNHFAWLQTHWWRMHERQSMHWAPNKSGECIIALGNHFAWLQIHWWKMHERQSIHGAPNKSGEWRIALGNHYAWLQTH

SEQ ID NO: 174835 - protein, 138 aa, Glycine max
  Coding DNA Sequence Number=SeqID_58057
ESHPTKTPSGPREVQTGPWGFQLWLRASVVLQGARSPRQGHVIIGKDRACKTPSGLEEVQQGLGVVKALITGLCQFYGVPVTSSKGIRPPTNRAFIKKYCASRQAQGETPQHPGDGRQRATDTPPSPLEFTSAHPQKG

SEQ ID NO: 174836 - protein, 126 aa, Glycine max
  Coding DNA Sequence Number=SeqID_58058
  Homolog annotation: Hit_ID=Q0XC96; Match level="QueryCoverage=99%, HitCoverage=27%, E-value=2e-15, Identity=43%"; Hit description=ATP -binding region, ATPase-like:Histidine kinase, HAMP region:Histidine kinase A-like
VGHLVAAVLGHAHRQVALAKALDAALQVLQPLEQAADDGEHAHGHGHAHQAQQPKEAEGRAQPEGGGAVVRRAVTARRARRHVQHVGLAVRALDLEAQPLLGRAGQAPRTALGDHVALAVAHGHVA

SEQ ID NO: 174837 - protein, 82 aa, Glycine max
  Coding DNA Sequence Number=SeqID_58059
MTDEGCTNRGGRGMAGMTREEEDEEEAEEIDGLWKCCETFSEDIVEMVVEVVARSGRGRSGGAVSGVAEKEVFFYQYTRSLS

SEQ ID NO: 174838 - protein, 107 aa, Glycine max
  Coding DNA Sequence Number=SeqID_58060
  Subcellular localization annotation: CTP_CleavageSite=56; ConfidenceScore=5.18e-01
MCWYSFSNCNVRIASSSSEAVCYAVCVSGDANASSGGRASPHMVLSAKTPRREAVRPSQVQQFGLCEPNPRSSPQSQSPPRPLRRSQTHRRLLPLPPPRLRRQRLQP

SEQ ID NO: 174839 - protein, 451 aa, Glycine max
  Coding DNA Sequence Number=SeqID_58061
  Gene Ontology: Mol. function=saccharopine dehydrogenase (NAD+, L -glutamate-forming) activity; Cellular component=mitochondrion
  Homolog annotation: Hit_ID=Q8LGI2; Match level="QueryCoverage=96%, HitCoverage=96%, E-value=0.0, Identity=68%"; Hit description =Probable mitochondrial saccharopine dehydrogenase At5g39410
  Pfam annotation: Domain name=Saccharop_dh; Domain location=12-443; Score=73.0; E_value=9.5e-19; Accession=PF03435.8; Description =Saccharopine dehydrogenase
MEEEQNGGRFDLIILGASGFTGKYVLREALKFLNTPSSPLKSIAIAGRSPQKLTQALQWASRPNPPPSLPILTADTADPSSLRSLCARTGLLLNCVGPFRLHGEPVVAACAAAGCDYLDISGEPEFMERVEAAHHERAVETGALVVSACGFDSVPAELGVMFNSRQWMGPAAPNRVEAYVALESEKRIVGNFATYESAVLGVANAHQLQQLRRSRPRKPRPQIPGPPTSKGETIENNKKIGLWAVKLPSADSIVVRRTLGILTENLHGLPGLNESAETVEKREAFWSSVKPAHFGVKIGSKSFLGILRIIMVGVFIGLFGSIGFGRQLLLKFPEIFSLGWFRKNGPSEEEVESASFKMWFVGHGYSDGSIASQGNTKPDMEIVTRVMGPEVGYLTTPIILIQCALVLLCQRDNLPKGGVYPPGIIFGPTDLQERLQQNGISFDVISKSTIS

SEQ ID NO: 174840 - protein, 301 aa, Glycine max
  Coding DNA Sequence Number=SeqID_58062
  Homolog annotation: Hit_ID=Q00XE1; Match level="QueryCoverage=77%, HitCoverage=85%, E-value=8e-20, Identity=30%"; Hit description =Homology to unknown gene
  Pfam annotation: Domain name=DUF179; Domain location=116-300; Score =196.8; E_value=5e-56; Accession=PF02622.6; Description =Uncharacterized ACR, COG1678
MEACFLSHNSFTKTTDQLIPTIRNGSLPHHKRSSQHLQCRKARIPLPISCCHMSSPSPFGDDDKPTLSSDWRSFRAKLVAGEQLTRHVEEVNDLDTVVDHPPLITIGDKWAHVIHEPENGCLLIATEKLDGVHIFERTVILLLSTGPLGPSGIILNRPSLMSIKETRSTALDVEGTFSNSPLFFGGPLEEGIFLLSPKEGNGGDGVGKSGVFEEVMKGLYYGAKESVGCAAEMVKRNAIGLGDFRFFDGYCGWEKEQLRDEIRAGYWTVAACSPSVVGLGSVGSIGLWDEVLGLMSRRKVM

SEQ ID NO: 174841 - protein, 105 aa, Glycine max
  Coding DNA Sequence Number=SeqID_58063
MVYSGTLPSLIHSTHVSFLLLVALRSCLVTHKKCFFYDGDNNDNKNCDGDGGSADINNGGKNYTDNDNDVGNNIDGNDDSNAGDNSDVATVAMTMVVQWCWWWQR

SEQ ID NO: 174842 - protein, 134 aa, Glycine max
  Coding DNA Sequence Number=SeqID_58064
MDLEGKSREICFGIVINFCTSVCWLWKLSATPQGLGWWHSHFVETECCWWPFASSTPPRKVQNCYSAQAMQGRRRQTQEFYTGSATTRAYIQSPSDLRSLRFLFDLVKAFTSKDPQGMYPPLFSLNNQVDVPST

SEQ ID NO: 174843 - protein, 81 aa, Glycine max
  Coding DNA Sequence Number=SeqID_58065
  Homolog annotation: Hit_ID=Q1SZQ0; Match level="QueryCoverage=90%, HitCoverage=8%, E-value=3e-19, Identity=63%"; Hit description =Integrase, catalytic region; Zinc finger, CCHC-type; Peptidase aspartic, catalytic
MDETIIVFSIIDILFPSWKDFKRSLKHHKDDISLEQFGNHLHLEDEYPEQDDAKEVSIQAKVHVIDEGTTNVGSTPVQPAM

SEQ ID NO: 174844 - protein, 242 aa, Glycine max
  Coding DNA Sequence Number=SeqID_58066
  Gene Ontology: Mol. function=RNA methyltransferase activity; Biological process=RNA processing
  Homolog annotation: Hit_ID=Q9LXE4; Match level="QueryCoverage=81%, HitCoverage=59%, E-value=1e-54, Identity=57%"; Hit description=RRNA methylase-like protein
  Pfam annotation: Domain name=SpoU_methylase; Domain location=128-242; Score=-12.6; E_value=2.2e-05; Accession=PF00588.9; Description=SpoU rRNA Methylase family
  Subcellular localization annotation: CTP_CleavageSite=39; ConfidenceScore=5.69e-01
MSACKTLSCFSLSSSSSFFKPTLLHPRQRLTLTRRCSTSALLEEPEPQSPSVQHLLTSPDGVSTLMKMDRKPLLPHEPHVRWFPYLDAYRCRNGCVLSSAEVVQALAPCISDDRRQRFGSVVRNRSYSVCLVVEGLCDFGNVSATFRSADALGVQSVHVVSCDANKRYKDNRHVSMGAEKWLDIELWDSTKECFKMLKSRGYRIATTHVGMDACFVTNMYIGDQCLDKGEGCVRQLTPKAPT

SEQ ID NO: 174845 - protein, 511 aa, Glycine max
  Coding DNA Sequence Number=SeqID_58067
  Gene Ontology: Mol. function=protein tyrosine/serine/threonine phosphatase activity; Cellular component=integral to membrane; Biological process=protein amino acid dephosphorylation
  Homolog annotation: Hit_ID=Q9FLZ5; Match level="QueryCoverage=86%, HitCoverage=96%, E-value=1e-152, Identity=62%"; Hit description =Similarity to protein-tyrosine phosphatase
  Pfam annotation: Domain name=DSPc; Domain location=113-244; Score= -20.9; E_value=0.0071; Accession=PF00782.11; Description=Dual specificity phosphatase, catalytic domain
MGLKFTKQGPPKIEDPSLHNQMINYLTKNFIRNLVSKQRRRMLIAGYDLDMSYITDRVLAMSFPAQRMRAMYRNPLWQVKSVLDMRHYDHYKVHLQPMAMYSAYYLLVNLQCDIDNDYPYLCSSALMSMSIELVHGHFLIYNLCIEESYDPDNFYGRVEAYPFDDNHVPSLEMIKAFCESVDSWLSSDPKNIAVIHCMAGKGRTGLMVSAYLTYCGMSADEALQLYADRRTTNNEGVSIPSQRRYVAYWDSLLSNSVPRGTGNGPTKVNLPQPCGRELRRIRLYDTINIDTIFFVISELHEIPNEVYRPPVEAYRGCCRQIKKGYQRNNSPRYYISILEGDKDGNQSETEEPRIVVQMDTESPAIYQKSCLDHYFDKPIQVTGDVRLTFYEKMIGGRLFYCCFNTAFIRNSLLQLPIQELDKVGKKGTSICGPDFCLELLFGPANAGYSSSTYSCKMIPTMSPLWCDVVRAFIPPTALPSNFSLAKGMEKDEVESIIMQNFTSFLGFNFDV

SEQ ID NO: 174846 - protein, 586 aa, Glycine max
  Coding DNA Sequence Number=SeqID_58068
  Gene Ontology: Mol. function=ion channel activity; Cellular component= integral to membrane; Biological process=ion transport
  Homolog annotation: Hit_ID=Q5D6H2; Match level="QueryCoverage=94%, HitCoverage=91%, E-value=0.0, Identity=75%"; Hit description=CNGC2
  Pfam annotation: Domain name=cNMP_binding; Domain location=416-514; Score=34.2; E_value=4.5e-07; Accession=PF00027.19; Description =Cyclic nucleotide-binding domain
MEIAAATPFTTVPVLTPLLWMTIHLAAGWSLRQCLPSAAVGGFCWIVSGSNPEPAQKGPRLPDRVWFDTGAVRAGSGSAEQASAEVEPRAAAGAWGGAGDRPAVLLFAVDREGGVAVFVHGRRAGGDGDGGADVRGRGAPLARVAAVQAGVRVAGVAGGGGFWFDAFVILPVPQVAGGCWYVLAIQRVASCLRQQCERTNGCNLSVSCSEEICYQSLLPASAIADSCGGNSTVVRKPLCLDVQGPFKYGIYQWALPVISSNSLAVKILYPIFWGLMTLSTFGNDLEPTSNWLEVIFSICIVLSGLLLFTLLIGNIQVFLHAVMAKKRKMQLRCRDMEWWMRRRQLPSRLRQRVRHFERQRWAAMGGEDEMEMIKDLPEGLRRDIKRHLCLDLIRKVPLFHNMDDLILDNICDRVKPLVFSKDEKIIREGDPVPRMVFVVRGRIKRNQSLSKGMVASSILDPGGFLGDELLSWCLRRPFIDRLPASSATFVCLESAEAFGLDANNLRYITDHFRYKFANERLKRTARYYSSNWRTWAAVNIQFAWRRYRQRTKGPVIPVRDTNGGTERRLLQYAALFMSLRPHDHLE

SEQ ID NO: 174847 - protein, 309 aa, Glycine max
  Coding DNA Sequence Number=SeqID_58069
  Homolog annotation: Hit_ID=Q47522; Match level="QueryCoverage=18%, HitCoverage=77%, E-value=5e-19, Identity=74%"; Hit description=LacZ protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDQVKRVALHLLACVLHQQAVRHLQAVALQRIGHGAGDGGVVFEQQQAGGHGRSARNEESSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 174848 - protein, 96 aa, Glycine max
  Coding DNA Sequence Number=SeqID_58070
MEHRDYYACDTKAGSSMDETSAKIEIHGIKADIGEKDEIKPGIDIQCNYKEMHVNLSIDSVEKMDAAMLIIELLITSVIDLVVDPLYQFLGTTLMF

SEQ ID NO: 174849 - protein, 159 aa, Glycine max
  Coding DNA Sequence Number=SeqID_58071
  Gene Ontology: Mol. function=cobyrinic acid a,c-diamide synthase activity; Cellular component=chloroplast; Biological process =selection of site for barrier septum formation
  Homolog annotation: Hit_ID=Q45RR6; Match level="QueryCoverage=61%, HitCoverage=31%, E-value=2e-27, Identity=75%"; Hit description =Plastid division regulator MinD
MLANRSLPPKPRGSLERGLEMQRISKLDQHFTDKGLVEALVAIEDPDDDVDVILKAEEEVKVTEANIGVNGDHKEAQAGKGEAVVGGLAHAAFIEGNDGDRGMKSKSSGLWFHWRRGFRGEERRMGAKDECVVGGSGGAEEKVERGHWEEERGRKIRRR

SEQ ID NO: 174850 - protein, 182 aa, Glycine max
  Coding DNA Sequence Number=SeqID_58072
  Gene Ontology: Mol. function=drug transporter activity; Cellular component=membrane; Biological process=multidrug transport
  Homolog annotation: Hit_ID=Q6ZJI2; Match level="QueryCoverage=71%, HitCoverage=29%, E-value=3e-30, Identity=53%"; Hit description =Putative ripening regulated protein DDTFR18
  Subcellular localization annotation: CTP_CleavageSite=47; ConfidenceScore=5.33e-01
MILAKSSCVQHVAKTSLPLAIPSNGYSQSHRRFAQQARLTFYENCLQGNAKQGPLFCGMEICSVDDTSVVCIRHKLFNSKVPTGTAQRKVLLGWGLIGAAITLNTSWRVIVIAQLLYIFITKSDGAWSGFTWLAFSDMFGFVKLSLASAVMLCLEFWYLMILVVITGRLKNPLIPVDAISIW

SEQ ID NO: 174851 - protein, 131 aa, Glycine max
  Coding DNA Sequence Number=SeqID_58073
  Homolog annotation: Hit_ID=Q9FJ19; Match level="QueryCoverage=53%, HitCoverage=43%, E-value=6e-11, Identity=45%"; Hit description =Arabidopsis thaliana genomic DNA, chromosome 5, TAC clone:K21P3
MAQHSTKAILSMSLEKQLASYRHLYDGLYNSIYGVFVGLQIVAIVRVVQKTTVSSQMYSTEAETKLAQLQREHAEQVKGFRKEYIREMEVVKIEKECKAKNRREVLRVANEEHKKLEAQASQLRAQEHDLE

SEQ ID NO: 174852 - protein, 220 aa, Glycine max
  Coding DNA Sequence Number=SeqID_58074
  Gene Ontology: Mol. function=zinc ion binding; Cellular component =integral to membrane
  Homolog annotation: Hit_ID=Q10Q37; Match level="QueryCoverage=61%, HitCoverage=53%, E-value=5e-61, Identity=77%"; Hit description=RING zinc finger protein, putative, expressed
  Pfam annotation: Domain name=zf-C3HC4; Domain location=45-99; Score =5.3; E_value=0.045; Accession=PF00097.15; Description=Zinc finger, C3HC4 type (RING finger)
MWNFASSLIAGSVGLKNDSAKPTHPASECSDDETSMVTREERLECPICWESFNIVENVPYVLWCGHTLCKNCILGLQWAVVKFPTLPIQLPLFISCPWCNLLSLRLVYRGNLKFPRKNYFLLWMVESMNGDRVKSHSTVCGDHQPVWPIIKDSLTNGSQEGHGIPWRGQVCHTESSSSNQYHGNTTLVELGWLGGGISVFGINYLDNQGRGVNKSYFPGN

SEQ ID NO: 174853 - protein, 89 aa, Glycine max
  Coding DNA Sequence Number=SeqID_58075
  Gene Ontology: Mol. function=drug transporter activity; Cellular component=membrane; Biological process=multidrug transport
  Homolog annotation: Hit_ID=Q6ZJI2; Match level="QueryCoverage=80%, HitCoverage=13%, E-value=7e-15, Identity=54%"; Hit description =Putative ripening regulated protein DDTFR18
MDSPLLENIDNSTTYVEEKKTLNSVVKKFGFESKKLWKIAGPAILTSICQYSLGALTQTFAGLVGDLELAAVSVENSVVAGLAFGVMQC

SEQ ID NO: 174854 - protein, 91 aa, Glycine max
  Coding DNA Sequence Number=SeqID_58076
  Gene Ontology: Mol. function=inositol or phosphatidylinositol phosphatase activity
  Homolog annotation: Hit_ID=Q5EAF2; Match level="QueryCoverage=89%, HitCoverage=23%, E-value=4e-17, Identity=53%"; Hit description=Type I inositol-1,4,5-trisphosphate 5-phosphatase 11
MGFIHNQASPSHIGIRTVGVEKACSFSIDSDLCISIVTWNMNGQVTFEDFAEMVGSNREFDLLAVGLQEAPPCPRNKVATLLSAALDESHT

SEQ ID NO: 174855 - protein, 221 aa, Glycine max
  Coding DNA Sequence Number=SeqID_58077
  Gene Ontology: Mol. function=inositol or phosphatidylinositol phosphatase activity; Cellular component=integral to membrane; Biological process=signal transduction
  Homolog annotation: Hit_ID=Q75LV1; Match level="QueryCoverage=96%, HitCoverage=63%, E-value=3e-74, Identity=61%"; Hit description =Putative inositol polyphosphate 5-phosphatase
  Pfam annotation: Domain name=Exo_endo_phos; Domain location=2-211; Score=60.2; E_value=6.7e-15; Accession=PF03372.13; Description =EndonucleaseExonucleasephosphatase family
MLYLFGLKDAGSFINELKVDKQSVGGCGGIIGRKKGAVAIRINYKGIRMVFISCHLSAHARNVEERNSQCRHISHSLFSKFWNPYSRPSHITIWLGDLNYRLQGIDTYPARSLIEQNLHRRLHGKDQLLQEAGRGQIFNGFCEGTLNFKPTYKYNKGSSNYDTSHKIRVPAWTDRILFRIEDENKMEATLHSYESMDEIYGSDHKPVKAHLCLRLRQIPTN

SEQ ID NO: 174856 - protein, 125 aa, Glycine max
  Coding DNA Sequence Number=SeqID_58078
  Gene Ontology: Mol. function=zinc ion binding
  Homolog annotation: Hit_ID=Q2QMP4; Match level="QueryCoverage=92%, HitCoverage=24%, E-value=5e-17, Identity=47%"; Hit description=LIM domain-containing protein, putative, expressed
  Pfam annotation: Domain name=UIM; Domain location=44-61; Score=13.8; E_value=0.39; Accession=PF02809.10; Description=Ubiquitin interaction motif
  Pfam annotation: Domain name=UIM; Domain location=76-93; Score=12.9; E_value=0.51; Accession=PF02809.10; Description=Ubiquitin interaction motif
  Pfam module annotation: Pfam domain module=UIM::UIM; Domain location =44-61::76-93
MGWLSRIFKGSDHNKLSEGHYYKEDAGYYLPSTSGDAWNQSQNQNENEDIDRAIALSLVEETQKANNNVNDYRSQLEEDEQLARAIEQSLNLESPPRYGNENMYQPPIQYFPMGSRYEMLGDDNV

SEQ ID NO: 174857 - protein, 97 aa, Glycine max
  Coding DNA Sequence Number=SeqID_58079
  Gene Ontology: Mol. function=zinc ion binding
  Homolog annotation: Hit_ID=Q5SMM0; Match level="QueryCoverage=69%, HitCoverage=14%, E-value=2e-15, Identity=55%"; Hit description=LIM domain containing protein-like
MTIHLLYLPNIAYTPCSNHLTAHHHHKAAFNLNSQLNNTSPFTIPTNPAGLIEYRAHPFWIQKYCPTHEHDGTTRCCSCERMEGKVDELVQCKVNRM

SEQ ID NO: 174858 - protein, 282 aa, Glycine max
  Coding DNA Sequence Number=SeqID_58080
  Homolog annotation: Hit_ID=Q47522; Match level="QueryCoverage=20%, HitCoverage=77%, E-value=5e-19, Identity=74%"; Hit description=LacZ protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPEFDGGLYALIAVGYTMVYGILRLINFAFGDVMVMGIYFAFYGATLIRFSFPLAVAFSLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPEDT

SEQ ID NO: 174859 - protein, 101 aa, Glycine max
  Coding DNA Sequence Number=SeqID_58081
MEQFLDKVAWLEAQFPLGRAPEVVPPSPIPTRTEPALAESQPPVVNPLASPEVEILSPPPAPPAPPLILIPDDSDAEVVAPPDSPTHYLEDGSDFSDWMDY

SEQ ID NO: 174860 - protein, 94 aa, Glycine max
  Coding DNA Sequence Number=SeqID_58082
  Homolog annotation: Hit_ID=Q6ZH90; Match level="QueryCoverage=45%, HitCoverage=28%, E-value=7e-14, Identity=76%"; Hit description =Putative P18
  Pfam annotation: Domain name=SAP18; Domain location=53-94; Score= -36.3; E_value=0.003; Accession=PF06487.3; Description=Sin3 associated polypeptide p18 (SAP18)
MGSEIYPEVHENPRAFFSSSSPIFLEPLAHGSSDWSLPREDCITFILPYFFQTCPLLLRVFTKIGSHHSMEDFVARGKKPKDKVQIYTWKDATL

SEQ ID NO: 174861 - protein, 353 aa, Glycine max
  Coding DNA Sequence Number=SeqID_58083
  Gene Ontology: Mol. function=protein dimerization activity
  Homolog annotation: Hit_ID=Q9ZV05; Match level="QueryCoverage=18%, HitCoverage=28%, E-value=2e-16, Identity=56%"; Hit description =Expressed protein
  Pfam annotation: Domain name=Acetyltransf_1; Domain location=173-268; Score=30.4; E_value=6.1e-06; Accession=PF00583.14; Description =Acetyltransferase (GNAT) family
  Pfam annotation: Domain name=FR47; Domain location=191-276; Score= -5.4; E_value=0.043; Accession=PF08445.1; Description=FR47-like protein
  Pfam annotation: Domain name=zf-C2HC_plant; Domain location=16-57; Score=7.8; E_value=0.0049; Accession=PF07567.3; Description=Protein of unknown function, DUF1544
  Pfam module annotation: Pfam domain module=Acetyltransf_1::FR47::zf -C2HC_plant; Domain location=173-268::191-276::16-57
MAKPSSNVTTRKNKTDPGWKYGHPLVEGDTNTIASKEHLVGKSGNIASCKKTPLDVVEELKGYMVNKKSETTYSSTGSGNVPNIRDFEFGEPVGCDESEDEFEDSCNATALATKTNWFVIKLIKLKSFENMVATIGQYGPHFPISSYHDIRVPLLKKEVEYAENLMKGHREQWVKYGCTIMSYAWIDRKKNLKVEKKSQGSQIAWGLDRGFYMENLFLRECYKTKGLGRMLLSAVAKQALKMGCKRVKWVMLDWNVLTIKFYEKMGANFIEEYRRWGKQGRKELPPPLRGPLPPPLSGPRLEPIDCEKLVGLGSSSSMDSFASWKMNGSGMKKEEREEMSLQGEDESRRSSPP

SEQ ID NO: 174862 - protein, 222 aa, Glycine max
  Coding DNA Sequence Number=SeqID_58084
MEVKLENLTLYVNDNSHAKLVTFDFIGIAHYDPKVSGARWPERAWKLIWACEDSSGSLKSNCGSIMRCSSCWSSSSSAMRRKNLEEHLFPQLNFSSQLKGSPFSRWIAISSGDRRLSGNGGGFEGEGSSWGCHTMTKQSGPLRLERDLAMKRSDHCWSSIGTSGVIFKQLGDLKDAQGVRPIKVGYLQLHMMRIGGHVVVGGCKGQLVRGELGDCILYTFHM

SEQ ID NO: 174863 - protein, 86 aa, Glycine max
  Coding DNA Sequence Number=SeqID_58085
MRNVPIGVGRRKNKSSASHWCKGGSVRVGELVEENKVVLDFWQAYQLLSQVATEEAEDEDDQAKEEGRRRWRERARFFEGREITLK

SEQ ID NO: 174864 - protein, 381 aa, Glycine max
  Coding DNA Sequence Number=SeqID_58086
  Gene Ontology: Mol. function=cysteine-type peptidase activity; Cellular component=nucleus; Biological process=proteolysis
  Homolog annotation: Hit_ID=Q1S6A6; Match level="QueryCoverage=83%, HitCoverage=62%, E-value=3e-78, Identity=44%"; Hit description=FAR1
  Pfam annotation: Domain name=FAR1; Domain location=113-282; Score= -20.4; E_value=3.8e-05; Accession=PF03101.5; Description=FAR1 family
MEERTRHHRVTVGSSSSLLSVVVATANGRTRNFEERGTLFTAIPHPNKRYCVFIFDFGLIRFDDNKSENDSDVGCEDGAEEQHGSLHEEKRISYLTGDEIKGLHWESEDSVFQFYTRYARCHGKHFMRVDRKRDRRLITRTNCEAKLRVYLDYKTSRWKVYSLRETHNHELTPPTDIRHIPKYNVMTDLDKSQVDDSLHKFGVRTCHIMGCLMAQKDRYDGQRDMIKDKDVCVALSYLASKFANDPLSYSTFLTTIDDRLKHLFWGNGSSKVDYECFSDVRAFDTTYKKTKYNNPLVIFSGCNHHSQITIFGASLLANETTNMYKWVLWTFLKTMNKQPKSIVTDGDGAMREAIKEVFPNAIHHLCGWHLSKNVFENVKKK

SEQ ID NO: 174865 - protein, 94 aa, Glycine max
  Coding DNA Sequence Number=SeqID_58087
  Subcellular localization annotation: CTP_CleavageSite=63; ConfidenceScore=5.31e-01
MRDKPLLDRMDLSRQSKSNFENHHTPPNSTSNSSTIGIRKQSFTIIMCRNLPFGGRATRGLAGASYKKGKCAESPPMFIRGKCQKNRKGVVYEF

SEQ ID NO: 174866 - protein, 41 aa, Glycine max
  Coding DNA Sequence Number=SeqID_58088
MHMRIKRSLKVVMGPRTSTKLKIKARTRQYTDTSSMAKIKH

SEQ ID NO: 174867 - protein, 66 aa, Glycine max
  Coding DNA Sequence Number=SeqID_58089
MGHRVGEEQLDVGDFLINVVIKGIKGDEYDRIESEVAVKKKLKMMVEFAEVLLTIALLHNCEGAKD

SEQ ID NO: 174868 - protein, 119 aa, Glycine max
  Coding DNA Sequence Number=SeqID_58090
  Gene Ontology: Mol. function=chromatin binding; Cellular component =chromatin; Biological process=chromatin assembly or disassembly
MATIPTRSPFHHSYRSPEPQGMNDSSGADPRATNVYFSRHQFLLDLGRIYPWTSLWDYRGHIVILVAVENFSKGFHLGMLQPHYFAHAVALLFMDIVKKIHGMPRSLVSDHDPLFINRF

SEQ ID NO: 174869 - protein, 59 aa, Glycine max
  Coding DNA Sequence Number=SeqID_58091
  Homolog annotation: Hit_ID=Q32YB5; Match level="QueryCoverage=53%, HitCoverage=2%, E-value=8e-07, Identity=84%"; Hit description=Nodule- specific IRE-like protein
MVAIRVMFEKLKEEVDSDLGGFAGDLVGILEKNLVSDRALLQPELPAPGSKIVRYWKFF

SEQ ID NO: 174870 - protein, 85 aa, Glycine max
  Coding DNA Sequence Number=SeqID_58092
MMYIDRNNNQKLQIARPKRQNNTPAHLKDYVLNGCSGRQRRRGERRCHPLGNKPWKKELHHQDEPWIRSLERMLQWRKRKMERKR

SEQ ID NO: 174871 - protein, 66 aa, Glycine max
  Coding DNA Sequence Number=SeqID_58093
MGAHKASCANDEDGHAALTVDLGREEGEVEARELEGEEFGGDDGAEEGGEGLEEVRVRVRESVWRK

SEQ ID NO: 174872 - protein, 155 aa, Glycine max
  Coding DNA Sequence Number=SeqID_58094
  Gene Ontology: Mol. function=sequence-specific DNA binding; Cellular component=nucleus; Biological process=regulation of transcription
  Homolog annotation: Hit_ID=Q2HTS9; Match level="QueryCoverage=66%, HitCoverage=40%, E-value=2e-11, Identity=41%"; Hit description=DNA -binding WRKY; VQ
MTMMRELSRRSICGEWKGSPLSESKEEGKALYTPPKQQQGFKLYDRRNNTLKNSLMLNTLMPNFAHNHNNNNSPSFSSSNIPEILSPGLLDFPSLALSPVTQFNDDPFDKSSPSLGNSSEEDKPIAERASTCIPLPSLIQETQNHSSCLFSQLLT

SEQ ID NO: 174873 - protein, 122 aa, Glycine max
  Coding DNA Sequence Number=SeqID_58095
MRSFNGDFPPWRCSGRQRRRGERRRHPLGNKPWKKELHHQDEPWIRSLERMLQWRKRKRERKREGEHEIERIKEVEKWNFELKKPTQPIRGVPTAINCIATLLKEPVVRSSFVSFISLASTQ

SEQ ID NO: 174874 - protein, 293 aa, Glycine max
  Coding DNA Sequence Number=SeqID_58096
  Gene Ontology: Mol. function=transition metal ion binding; Cellular component=nucleus; Biological process=DNA integration
MDRSWMKSSCISDEYQNEVDELLQFTKRNTPYLRGKFFCPCVNYGNGRHQSINDIRSHLICEGIIPTYTKWIWYGELPDMPQVPHIKSVDEDVGHRIEDMIRDLGQDGFQQAHSALYDKIENDSKKPLYSGCTTFTRLSAVLALVNLKARFGWSDKSFTKLLVLFKNMIHEDNTLPKNHYEAKKILCPVGMEYQKIRACPNDCILYRNQFAEMPYCPTWGNHDTSSGRHALGKAFMHVMHLAAQTVLMMQGGRSLWLGMFSFHELVIEIKPPSSTHYTCKPNCWFCNAPPFTE

SEQ ID NO: 174875 - protein, 142 aa, Glycine max
  Coding DNA Sequence Number=SeqID_58097
  Pfam annotation: Domain name=zf-CCHC; Domain location=95-112; Score =24.4; E_value=9.4e-05; Accession=PF00098.13; Description=Zinc knuckle
MSLDTLFGKLHEHEMELMRLYQHEENDKKKKGIALKASSSSIQEESDEEDLNEIEEDDDFKFFVKRFNKFMRNKRNQRKSNINPKKKGEDSSLAPKCYECDQPGHLRFNCPVLKRRMEKSNKRNLKKERKKIKHTSLGKIMT

SEQ ID NO: 174876 - protein, 57 aa, Glycine max
  Coding DNA Sequence Number=SeqID_58098
MCEASGDWEARYSVVFQIGSFAKRKKEEVEMRVVIAKRAGRTKSVSYLCFPLISDER

SEQ ID NO: 174877 - protein, 140 aa, Glycine max
  Coding DNA Sequence Number=SeqID_58099
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=99%, E-value=8e-18, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MPSPSEDYMSSSSEDYTSSPVEDYMSSPLESCTPSLADDYTSPPSEGCTPSPSEDYTFSPLEGCTPSPSKDNTFLPSEGCTPSTSEDFTSSPSEGCMPSPSENYTSSPSEGCTPSPSEDYKSSQSEGSKPSPSEDYTSSP

SEQ ID NO: 174878 - protein, 234 aa, Glycine max
  Coding DNA Sequence Number=SeqID_58100
  Gene Ontology: Mol. function=transporter activity; Cellular component= integral to membrane; Biological process=transport
  Homolog annotation: Hit_ID=Q1GY01; Match level="QueryCoverage=78%, HitCoverage=44%, E-value=3e-66, Identity=66%"; Hit description=Major facilitator superfamily MFS_1
MRVFASIGEGLRFVRRTEVVLGAQLLDMFAVLFGGAVAMLPAFVHDIYQMGPEGLGVLRAAPALGAIVTGLWLAKHPIHEHSGRWLLFAVAGFGVCMIAFGLCRTYWLGIVILAVSGMMDAVSVILRQTILQLATPDGMRGRVSAINGIFIGSSNELGAFESGLTSRLMGLVPSVILAAQKGLPVILDHAEQFIAERLAPAEIANDGRALTLEEQAYIVVVIERWLQRYLSAPE

SEQ ID NO: 174879 - protein, 88 aa, Glycine max
  Coding DNA Sequence Number=SeqID_58101
MLVFPSGMLQNFTDYATVLVFPLEMLRNFTDYATILVLRVPKGANKVQGPTASVEERNPKFEEPLDLRLNPFQGGGNDAILPTTKGIG

SEQ ID NO: 174880 - protein, 127 aa, Glycine max
  Coding DNA Sequence Number=SeqID_58102
MKAITLAALLMACQIAPAWSESEFQITCPGRPTMTVSRAAYGLSTLMWPTRHFQIAAGQQRTRLQDGDKVAITRFRNGDQLIVNKNSGETFFVYADSDKLLPCNRTEKRDADILSLERYDDRQHPSS

SEQ ID NO: 174881 - protein, 135 aa, Glycine max
  Coding DNA Sequence Number=SeqID_58103
MVTRTFRQPGANELVDAQRLTLSSAPLSSRDGESDDIRGLPYGYPHLSSTRGKTSPLMRRDRHRLLYLLSSKDNESGFYSRCPETFKPSDARGSSLLGRDDRVQWRREVSWLSNFVVFKTPKFVDAFDAFSFLSE

SEQ ID NO: 174882 - protein, 67 aa, Glycine max
  Coding DNA Sequence Number=SeqID_58104
  Gene Ontology: Mol. function=electron carrier activity; Biological process=electron transport
  Homolog annotation: Hit_ID=Q1SCC8; Match level="QueryCoverage=95%, HitCoverage=10%, E-value=2e-10, Identity=47%"; Hit description=DIRP; Cytochrome c region
MPTSLIQHNISSAQINQDFIELKPNGKLKQRKVAGHTILSPSENLDTIKNLHIPPTMHGSSTLSKQV

SEQ ID NO: 174883 - protein, 59 aa, Glycine max
  Coding DNA Sequence Number=SeqID_58105
MCLSGKERLTFSPWDKVYDKLGFWLKACRTAGHDICQGLASGSGIKGMSYIISMIHMQQ

SEQ ID NO: 174884 - protein, 116 aa, Glycine max
  Coding DNA Sequence Number=SeqID_58106
MATTPPVLLKNGIPGLPGHPTFFEAGLLLAACLGELASPGRAGRQPPPPFSYKKAEGGCSKDPLAPWLCISAVLGEKNCFREENPSRGASVTLPRCFRKQIREGFRPFFIRSSFFN

SEQ ID NO: 174885 - protein, 75 aa, Glycine max
  Coding DNA Sequence Number=SeqID_58107
  Homolog annotation: Hit_ID=Q1SEE1; Match level="QueryCoverage=50%, HitCoverage=2%, E-value=1e-07, Identity=65%"; Hit description =Integrase, catalytic region; Zinc finger, CCHC-type; Peptidase aspartic, catalytic
MELPRSTDYWRDQIDISQERHVQHCKREDYYRLNESVISQATLSLLMWRLVVYRSPYVLARGPQVYSSDKIGSTD

SEQ ID NO: 174886 - protein, 206 aa, Glycine max
  Coding DNA Sequence Number=SeqID_58108
  Gene Ontology: Mol. function=protein-tyrosine kinase activity; Cellular component=integral to membrane; Biological process=protein amino acid phosphorylation
  Homolog annotation: Hit_ID=Q9AXB6; Match level="QueryCoverage=97%, HitCoverage=38%, E-value=9e-27, Identity=37%"; Hit description =Phytochrome / protein kinase-like
  Pfam annotation: Domain name=DUF1221; Domain location=1-123; Score= -65.7; E_value=5.5e-06; Accession=PF06760.2; Description=Protein of unknown function (DUF1221)
CIADEITQNLKFEEKNGKWKVLEHPFREIHKIFGEEEAYIRHCMETKDWRNIRVGSRGDAKEETYQLQQVQEGIWRHESFPLEIWEAVPHHSLSATDMIRNLERSESLVGRLLPSSTLVGSKDYQVRRKKGNASQYKEITWLGESFVIRHFSCDIEALEPEIIELLSLSHPNIMDSLFGFTDEEKKECFLVMELKSKTLSIHIDNC

SEQ ID NO: 174887 - protein, 141 aa, Glycine max
  Coding DNA Sequence Number=SeqID_58109
  Gene Ontology: Mol. function=protein-tyrosine kinase activity; Cellular component=integral to membrane; Biological process=protein amino acid phosphorylation
  Homolog annotation: Hit_ID=Q9AXB6; Match level="QueryCoverage=55%, HitCoverage=11%, E-value=3e-11, Identity=46%"; Hit description =Phytochrome / protein kinase-like
MEYLHSKKVYHGELNPSSILVKPRGTSPEGYLHAKVTGFGLTSVKDLNQKGNTNQNGTPPFIWYSPEVLEEQDHSGGAANSKFLVLNPGYSSQPEPPVPPVVDYCHIESVLPRKFPSWVTENGNKQTLINEKSKQLLCLIN

SEQ ID NO: 174888 - protein, 189 aa, Glycine max
  Coding DNA Sequence Number=SeqID_58110
  Subcellular localization annotation: CTP_CleavageSite=48; ConfidenceScore=5.33e-01
MGLDICICKGSLSLFFFFFSKINLNPRSLRFGVGDQRRPFSSPFGVVWLSHGRVCGGLVIVGKHSSWTQSPLYFPFLPLKDCFLIYKERCVSTSFSIIFLKAVHLVNLLPRTQSSRSSQDPNTNNKSGGDQSGSRCFARMLQPYGINIGLKEHSNPVTPKAYTPKSPSGPLPPDSGPTPKIILAHRHCS

SEQ ID NO: 174889 - protein, 83 aa, Glycine max
  Coding DNA Sequence Number=SeqID_58111
MSRLTRDSPQISASPHQLDLAPYASGPHNAQWIAPGLLHDKHTLLSCRILREMEVEEPWLGLWLPLNYRVDMGASQHRTPELG

SEQ ID NO: 174890 - protein, 144 aa, Glycine max
  Coding DNA Sequence Number=SeqID_58112
  Homolog annotation: Hit_ID=Q2SX32; Match level="QueryCoverage=93%, HitCoverage=97%, E-value=1e-13, Identity=33%"; Hit description =Uncharacterised protein family (UPF0131) superfamily
MSIYVFVYGTLRAGEINDLAQAAARRALPPARHLGAATVPGALVDFGDWPGLVPVRDGRRVRGDIYAVCPALLALMDEIEEYAPGRPGCFVRRPVLARPLAPPGAAAVACQYYPIDPAWRGAAPDVAADDWIAYRQARGHPLSP

SEQ ID NO: 174891 - protein, 87 aa, Glycine max
  Coding DNA Sequence Number=SeqID_58113
  Gene Ontology: Mol. function=transcription factor activity; Cellular component=intracellular; Biological process=regulation of transcription, DNA-dependent
  Homolog annotation: Hit_ID=Q08530; Match level="QueryCoverage=80%, HitCoverage=28%, E-value=2e-10, Identity=50%"; Hit description =Transcriptional regulatory protein btr
VAEAHAVDGRPGGDPANTASCLVRGSTRSFTQLVQLFPIRASFHPDRDTHVAQHPRGTVGGIRGNGNPFLHTMTFIVPGPGGWPGRA

SEQ ID NO: 174892 - protein, 174 aa, Glycine max
  Coding DNA Sequence Number=SeqID_58114
  Subcellular localization annotation: CTP_CleavageSite=38; ConfidenceScore=5.20e-01
MGEIDASVGPLMSYNWSIPLACPNSQKNLPLRFMRRLRNEKRKPSSITEKLPGEKEPTALSFQPTAIEKSREIGGLSLFRFPTALRQVPPLLSNGEAYQSIRLLQELSSFEWTETGASGRHNGATSSFRGDNSNQPHPALVLYLLIRNPENMPIRYCLPRLCDRNSKVTPKLRK

SEQ ID NO: 174893 - protein, 203 aa, Glycine max
  Coding DNA Sequence Number=SeqID_58115
  Gene Ontology: Mol. function=ATP binding; Cellular component =chloroplast
  Homolog annotation: Hit_ID=Q2PMM5; Match level="QueryCoverage=100%, HitCoverage=8%, E-value=1e-116, Identity=99%"; Hit description =Protein ycf2
MVERKNPYLTRLLTIPMNSIGPKNDTLEESSESSNINRLIVPLLYLPKGKKISESYFLDPKESTRVLPITKKYIMPESNWGSRWWRNWIGKKSDSSCKISNETIAGIEISFKEKDIKYLEFLFVYYMDDPIRKDHDWEFFDRLSPRKRRNIINLNSGQLFEILVKDWIYYLMFAFRENIPKEVEGFFKQQGTGSIIQSNDIEH

SEQ ID NO: 174894 - protein, 92 aa, Glycine max
  Coding DNA Sequence Number=SeqID_58116
MAGSGQQTHGHHLQSPSAHLQRLECCLRPVADQQVHDQQVIMRPAQDVKEALLGGNLELATKKLPAKQSRKGTIEEDSNVAPQADIGFDRGS

SEQ ID NO: 174895 - protein, 266 aa, Glycine max
  Coding DNA Sequence Number=SeqID_58117
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=100%, E-value=1e-29, Identity=27%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
RGLHVLAFRGLHVLTFRGLHAFAFVGLHVLNFTGLHALTFRGLHVLIFRGLHVLTLRGLHALTFRGLHAFAFIGLHALSFKGLHVLTFSGLHALTFRGLHILTFRGLHVLTFKGLYVLTFRGLHVLTFRGLHTLAFKGLHVLAFRGLHILTFRGLHGYTPSPSEDCTSSPSEDYTSSPLKDCTSSPSEDCTSSPLEGYTSSPSEDYTSSPSESCTFSPSEDYAPSPLEGCTPSPSKGDTSSTSVGCTPSPIDGYASSLSMGSTSAL

SEQ ID NO: 174896 - protein, 110 aa, Glycine max
  Coding DNA Sequence Number=SeqID_58118
MGHLSDQGFLMDLKRIKVIPEWSIPPTPLIELVRNHVTFWEDAQERGVEGRSLEFQEPLDLRSNPFQGGGNDAILPPWALDRILQEDWARDAGEGPRVLMSLKVDFGTMG

SEQ ID NO: 174897 - protein, 177 aa, Glycine max
  Coding DNA Sequence Number=SeqID_58119
  Homolog annotation: Hit_ID=Q1EP77; Match level="QueryCoverage=34%, HitCoverage=12%, E-value=2e-16, Identity=70%"; Hit description =Serine carboxypeptidase (Carboxypeptidase D), putative
EILAEQEVDRVHGLPAQPPVKFKNMVVISLSMKLKEEHCSIGFSRPLTNQNKNPFSYGSMECQNLLLELADYSVYQCGGCGAILRAKHKGYVSGSLSDEGKVGLGGDSEDTGEKGVIDDDVDVGRNKDELGKTIGREQEKPPKSQIGCENGSKFSNWPNEREVRWKGFGESHELIWK

SEQ ID NO: 174898 - protein, 94 aa, Glycine max
  Coding DNA Sequence Number=SeqID_58120
  Subcellular localization annotation: CTP_CleavageSite=67; ConfidenceScore=5.37e-01
MYIMYAPHLHYSLCIVGSSDNGAHKMLSNHVSFSAAFLRALSGGTSPSNSLHNSSQCLHRSTNAVINARSIMHCSIRAICWYPVDDNNGVICGT

SEQ ID NO: 174899 - protein, 99 aa, Glycine max
  Coding DNA Sequence Number=SeqID_58121
MSILDKLTGYESKPDFSAHTHIIIIICVHYEKILPTPYVRWNVLKIMTRPYLLQGIEKKTAKLRGIEKALVARHEAGHAVVGNAVANILAGQPRVEICR

SEQ ID NO: 174900 - protein, 117 aa, Glycine max
  Coding DNA Sequence Number=SeqID_58122
  Subcellular localization annotation: CTP_CleavageSite=25; ConfidenceScore=5.37e-01
MKLQVTQGKLAATAHERTSGVALCSSSSVPSRVNKLWVFWGLGFFAVPPEERVFCSPREKVEKGKHSSGVVTENDPLLVQFQKVRSLHEASLTMESHVLHEASRLPILTLVCIEKTN

SEQ ID NO: 174901 - protein, 102 aa, Glycine max
  Coding DNA Sequence Number=SeqID_58123
MVQQYRGSCVYCKQEVSYPSEIPSTISPTTPLQHTSPFLMVTRKTNKGKSMVEEDSSVFVKNLDVSKGKTQSVEEKNASMVEAEGEGMGPCSHGRVSEHENN

SEQ ID NO: 174902 - protein, 69 aa, Glycine max
  Coding DNA Sequence Number=SeqID_58124
MAKFKKYMEMLQGKKEEPPTEKLTWDVLHQGCFTIPITLENLSIDDALLDLGASCKLMPHSFLEKIWSP

SEQ ID NO: 174903 - protein, 182 aa, Glycine max
  Coding DNA Sequence Number=SeqID_58125
  Homolog annotation: Hit_ID=Q7XJE6; Match level="QueryCoverage=43%, HitCoverage=22%, E-value=2e-31, Identity=80%"; Hit description =Metacaspase 1
MREPEVVWSGQYVWEDHRPRSGVWKGSSGGEVICFSGCDDHQTSADTSALSKITSTGAMTFCFIQAIERGHGATYGSILTAMRTSIRNVGGGGGGTGGGDVVTSLLSMLLTGGSLSGVGGLGQRGFFFRKSLRMCLDEFMSALENVTCSCNNDFGCCCNPWMKMLIRLRFEFHIRGEHLNPG

SEQ ID NO: 174904 - protein, 242 aa, Glycine max
  Coding DNA Sequence Number=SeqID_58126
  Homolog annotation: Hit_ID=UPI000044783B; Match level="QueryCoverage =81%, HitCoverage=78%, E-value=1e-12, Identity=27%"; Hit description =UPI000044783B related cluster
MEQKNWNLLDEALGLNNNNAKPWPLCGRFVLVEDCVDTSAAFVLHQILKRSFSSHPSSAVVFLAFSHPFSHYDRVLRKLGCNLAAQRDNGRLFFLDMLMLQCPDEGKANHDGLASVFEQIERVITALHQDKKFISIMIDDISFLEVAANGSSNDVLNLVHYCHTLTSDSEYGCAFIALDHKDIYLNGDRTAVMLEMEFLADILVKAEPLATGLAKDVHGQNRKNLQGKRLLVTKHSHCLRDL

SEQ ID NO: 174905 - protein, 491 aa, Glycine max
  Coding DNA Sequence Number=SeqID_58127
  Gene Ontology: Mol. function=kinase activity; Biological process =proteolysis
  Homolog annotation: Hit_ID=Q9AY37; Match level="QueryCoverage=64%, HitCoverage=62%, E-value=1e-105, Identity=60%"; Hit description =Putative phosphatidylinositol-4-phosphate 5-kinase
  Pfam annotation: Domain name=MORN; Domain location=197-219; Score =18.9; E_value=0.018; Accession=PF02493.10; Description=MORN repeat
  Pfam annotation: Domain name=MORN; Domain location=220-242; Score =35.6; E_value=1.7e-07; Accession=PF02493.10; Description=MORN repeat
  Pfam annotation: Domain name=MORN; Domain location=243-265; Score =26.8; E_value=7.6e-05; Accession=PF02493.10; Description=MORN repeat
  Pfam annotation: Domain name=MORN; Domain location=266-288; Score =34.1; E_value=5e-07; Accession=PF02493.10; Description=MORN repeat
  Pfam annotation: Domain name=MORN; Domain location=289-311; Score =19.8; E_value=0.0098; Accession=PF02493.10; Description=MORN repeat
  Pfam annotation: Domain name=MORN; Domain location=335-354; Score =12.9; E_value=0.12; Accession=PF02493.10; Description=MORN repeat
  Pfam annotation: Domain name=MORN; Domain location=355-377; Score =32.1; E_value=2e-06; Accession=PF02493.10; Description=MORN repeat
  Pfam module annotation: Pfam domain module=MORN::MORN::MORN::MORN::MOR N::MORN::MORN; Domain location=197-219::220-242::243-265::266 -288::289-311::335-354::355-377
MHQKKSEVQIGKESVGVSSDFNPQFQKHPYHRHQQFYPQIEIDISPQSPPQPTTPPPPPPPPSLSKQKHIFKPQNAAFFSVSVAAKSAAFRALRRVRRQRALLLLAVPFLYLYFLISRSFLLDLLSAIAFSAALVFSLNLAFPLPLRSVRLKAAKNSASRPAPALPVFWTIGSRPKTEKRAAASGCWVQVFGNGDVYEGEFHRGKCSVSGVYYYSRSGRYEGDWVDGKYDGYGVETWARGSRYRGCYWQGLRHGFGVYRFYTGDVYAGEWSNGQSHGSGVHTCEDGSRYVGEFKWGVKHGLGHYHFSLKDDSIDRNRMSQFCCNSIDSQLGSEKQKLQDKMHGFGIYHFANGHRYEGAWHEGRRQGLGMYTFRNGETQSGHWQNGVLDIPSTRNTTSPVSPVGVYYSKVLNAVQEARRAAEKAYDMAKVDEGVNRAVAASNRAANAARVAAVKAVQKQNYHKKAASLGGYTSLSSFMPTATFAFGIMLSLI

SEQ ID NO: 174906 - protein, 132 aa, Glycine max
  Coding DNA Sequence Number=SeqID_58128
  Gene Ontology: Mol. function=caspase activity; Cellular component =cytoplasm; Biological process=proteolysis
  Homolog annotation: Hit_ID=Q108Y0; Match level="QueryCoverage=83%, HitCoverage=14%, E-value=5e-52, Identity=85%"; Hit description=ICE -like protease p20 domain containing protein, expressed
  Pfam annotation: Domain name=Peptidase_C14; Domain location=3-132; Score=-10.7; E_value=0.0002; Accession=PF00656.12; Description =Caspase domain
MTGNFSYHTLEIEEEDPHGPKFPTKHNIRMAMYWLAQGCQPGDSLVFHYSGHGSQQRNYSGDEADGYDETLCPLDFETQGMIVDDEINAALVRPIPHGAKLHALIDACHSGTVLDLPFLCRMNRLPSKESLL

SEQ ID NO: 174907 - protein, 158 aa, Glycine max
  Coding DNA Sequence Number=SeqID_58129
  Gene Ontology: Mol. function=caspase activity; Biological process =proteolysis
  Homolog annotation: Hit_ID=Q7XJE6; Match level="QueryCoverage=71%, HitCoverage=30%, E-value=3e-29, Identity=60%"; Hit description =Metacaspase 1
MQKSCKIEQKYTSKLEWMDTNTKTKRSKRKKDEGDVRTGEHDDGRFWKAELVDEEVLHALGVVDASLELVSREAVGDADDDGLLAAVGVGRGRRVAVGRGRRRRRVGGGRWLRREGAWIADESDSAAEGAADGSRARWQLQRGAAVGAVDQHVAVHRR

SEQ ID NO: 174908 - protein, 330 aa, Glycine max
  Coding DNA Sequence Number=SeqID_58130
  Gene Ontology: Mol. function=oxidoreductase activity, acting on single donors with incorporation of molecular oxygen, incorporation of two atoms of oxygen; Biological process=electron transport
  Homolog annotation: Hit_ID=Q0JZ15; Match level="QueryCoverage=58%, HitCoverage=58%, E-value=4e-58, Identity=59%"; Hit description =Probable taurine catabolism dioxygenase
RLLRLDGLAREHLAVAGAACGLGLAGRVLAEVLGVVVVVAMHGPQLLGQLPERLGQALIGGHGIGPDGVAAMAGQRDGAQHADLGKGRLEGDVGMPGIGAAAMLGIELQKGRAVRGRHGGVRFDLAEQPPEGLVRCIRQMVLAPEEQHAVAQQGRMDLRELFGRQLARQPGAVDHGAYAAGQGLDLQRLLPVLLQVLGHGAQVAGFGSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPEDT

SEQ ID NO: 174909 - protein, 99 aa, Glycine max
  Coding DNA Sequence Number=SeqID_58131
MAKFDPDIVLEFYANAWPTEEGVRDMRSWVRGQWIPFDADALSQFLGYPLVLEEGQECEYGQRRNRADGFDEEAIAQLLCIPGNIQPNDHNSDLPLPKC

SEQ ID NO: 174910 - protein, 846 aa, Glycine max
  Coding DNA Sequence Number=SeqID_58132
  Gene Ontology: Mol. function=protein serine/threonine kinase activity; Cellular component=cell surface; Biological process =protein amino acid phosphorylation
  Homolog annotation: Hit_ID=Q53KU9; Match level="QueryCoverage=99%, HitCoverage=99%, E-value=0.0, Identity=52%"; Hit description =Probable protein kinase [imported]-Arabidopsis thaliana
  Pfam annotation: Domain name=Pkinase; Domain location=119-419; Score =155.4; E_value=1.5e-43; Accession=PF00069.15; Description=Protein kinase domain
  Pfam annotation: Domain name=Pkinase; Domain location=527-808; Score =16.6; E_value=1.5e-09; Accession=PF00069.15; Description=Protein kinase domain
  Pfam annotation: Domain name=Pkinase_Tyr; Domain location=119-416; Score=84.9; E_value=2.5e-22; Accession=PF07714.7; Description =Protein tyrosine kinase
  Pfam module annotation: Pfam domain module=Pkinase::Pkinase::Pkinase _Tyr; Domain location=119-419::527-808::119-416
MHFNRLCIVLPPNSGEMVVPLEKGVLQEEPFQTPKKQQVEAKKPHRACGGQVLDLLRDSFTKLYDSRWWRICQHGEHKEKNNSGVFFHDMDGVQVSVNIGRDNPRIFSYAELFIGSNGFSEDQVLGSGGFGRVYKAVLPSDGTEVAVKCCLAEKGKQFEKSFAAELTAVADLRHKNLVRLRGWCVNEDQLHLVYDYMPNRSLDRVLFRRHENSKAEPLQWGQRGKILKGLAAALYYLHEQLETQIIHRDVKTSNVMLDSHYNARLGDFGMARWLEHELEYEYKYNNRKTIATKSGHFRLGETSRIGGTIGYLPPESLQKPSNATSKSDVFSFGIVVLEVVSGRRAIDLTHPDEQIILLDWIRRLSDEGKLLEAADSRLLDGSYKLSEMQHFIHIGLLCTLHDPQLRPSMKWVVEALSDISFKLPSLPSFLSHPLYISLSSPSNTNNSPSSTSVTSSSTTDNASSIITNHTSSNYVTAAGETVYVTAEYKNSEIISSKSMSHHQQPFPVVETPREISFKEIVSATDNFSDSRRVAELDFGTAYHGILDDKCHVLVKRLGLKTCPALRDRFSNELRNLGRLRHRNLVQLRGWCTEQGEMLVLYDYSASRILSQRLQHHSNGSRRGSSVLQWHHRYNIVKALASAVLYLHEEWDEQVIHRNITSSAVILEPDMNPRLTSFALAEFLSRNENGHHVVIDTKKSVRGIFGYMAPEYVESGEATTEADVYSFGVVVLEVVSGQMAVDFRQPEVLLVKKVHEFEMRKRPLKELADIRLNGEYNDQELMRLVRLGIACTRCNPQLRPSMRQIVSILDGNDKLLIQNNKESREEWRERNDCSLSMIKRIQALGIQ

SEQ ID NO: 174911 - protein, 1698 aa, Glycine max
  Coding DNA Sequence Number=SeqID_58133
  Gene Ontology: Mol. function=translation initiation factor activity; Biological process=regulation of translation
  Homolog annotation: Hit_ID=Q76E23; Match level="QueryCoverage=98%, HitCoverage=90%, E-value=0.0, Identity=41%"; Hit description =Eukaryotic translation initiation factor 4G
  Pfam annotation: Domain name=MIF4G; Domain location=1213-1435; Score =210.9; E_value=2.9e-60; Accession=PF02854.9; Description=MIF4G domain
  Subcellular localization annotation: CTP_CleavageSite=91; ConfidenceScore=5.54e-01
MSFNQSKSDKSDAVYRKSGRPGSFNQQRGPSGGAYGKGGGGGAGPSPSLSSNRSFNKKSNNNAQGGQSRVNPTPVNSTESNSTYAARTVPNGSHVQPHIHGGSDAPITNATAKPSESLAAQRSTRTVPKAPTSQPPAMSSYPAAPTTPAKADASKAFPFQFGSISPGFMNGMAIPARTSSAPPNIDEQRREQARHDSFRPAPSMPTPPVPKQQAVKKDTSVADQSNTGETYTGTRAKKDTQVSPLPPASQMQKPSVISLSGMSMPMPYHQSQASVHFGGPNPQIQSQGMSSAPLQMPLPMPLPIGSAAQVQQQVFVPGLQPHPIHPQGIMHQGQSMGFNPQIGPQLPHQLGNMGIGISPQYPPQQGGKFAAPRKTTPVKITHPETHEELRLDKRTDAYSDGGSSGARPHSGMPSQSQPAQQFAASHPINYYPSSSYSTNPLFYPTPSSLPLTSSQITPNSQPPRFNYAVNHGPQNVSFVNSSSHSSLPVNKAGTSIPGNAEPPNPEFSWDVHNTFLSAPSGVTSVSIKPSGGSGVVDSSFSNSSNQKSGSPSSSLTSGDAFSSVPLKGSETTEISSQQSKVSSDSSALNSLPNLSAACTVKPTSASLLLPTSAVSEESVSVLPNNEGRKKESLSRSNSLKDNQKKIHKKGQSQHQVAVQSPSVANVPSQAVDGDIPVGEVSETVGTKTNHSAAVTSEDLSAAASDMLSATSESITSAVETKTNDSTQVSACASAEGPVTQVADNLNNHKNAEIDELLQQDKPLQPDILEMVRKTENLSLQGSKQSVSDGGTELKQPKQGAAKLSTEVVTLRTVQQGQGQDESTSCSAECDRTADDKGISISTTLDSKDVCLNRNDSVVSNEAVSSNSGTSDQQSADLLETTSKQCKDDSAENAGSGSVSLPASGTKDKPISESSKVKPTSKGKKKRKEILQKADAAGSTSDLYNAYKGPEEKKETVLSSEKTESGSTSENLEQLPTDTAQPDAVAEQSKQSKAELDDWEDAADMSTPKLEVSDETGQVSDGSAITAKKYSRDFLLKFAEQCTDLPGGFEITADIAEALMGANVSSHVIEHSSTGRIIDRSGGMSRRGSGVIEEDKWNKVSNAFHSGMRLDGVGGNAGFRPGQGGNFGVLRNPRTQTPLQYAGGILSGPMQSMVNQGGMQRNSPDGERWQRTNSFQQRGLIPSPSTPQTPLQMMHKAEKKYEVGKVTDEEQAKQRQLKGILNKLTPQNFEKLFDQVRAVNIDNVVTLNGVISQIFEKALMEPTFCEMYANFCFHLAAVLPDLSQDNEKITFKRLLLNKCQEEFERGEREQEEANKADEGEVKLSNEEREEKRTKARRRMLGNIRLIGELYKKKMLTERIMHECIKKLLGQYQDPDEEDIEALCKLMSTIGEMIDHPKAKEHMDAYFEMMRSLSNNMNLSSRLRFMLKDVIDLRKNKWQQRRKVEGPKKIEEVHRDASQERLAQASRLGRGPGNNPPRRIPMDFGPRGSSMLSPNAQMGGLRGLPTQVRGYGSQDARMEDRQTYEARTLSVPLPQRPLGDESITLGPMGGLARGMSIRGPPAVSSSTGLNNGYNNLSERTSYSSREDPASRYTPDRFAGSTAYDQSIVQDRNMNYGNRDLRNANRILDKPVVTSPPARTQGTAASQSISPERLQDMSMAAIREYYSKRIAFKAYYNTDPIGDTVGSGISKCEGNMHIVRM

SEQ ID NO: 174912 - protein, 321 aa, Glycine max
  Coding DNA Sequence Number=SeqID_58134
  Gene Ontology: Mol. function=GTP binding; Cellular component =intracellular; Biological process=small GTPase mediated signal transduction
  Homolog annotation: Hit_ID=Q8L7Q9; Match level="QueryCoverage=81%, HitCoverage=71%, E-value=2e-93, Identity=57%"; Hit description=GTP -binding protein, putative
  Pfam annotation: Domain name=MMR_HSR1; Domain location=131-229; Score= -21.1; E_value=0.086; Accession=PF01926.13; Description=GTPase of unknown function
  Pfam annotation: Domain name=NOG1; Domain location=160-217; Score =84.9; E_value=2.5e-22; Accession=PF06858.4; Description=Nucleolar GTP-binding protein 1 (NOG1)
  Pfam module annotation: Pfam domain module=MMR_HSR1::NOG1; Domain location=131-229::160-217
MPSIDIIGSALRKARKVSPTKGIANIAKREKNKGAKQLDALMKEIAVPLRTYVENFPNKMHLHPYERSLIELTLGDGYYEMSSSKREAEERLNEGLKKIEEIFAQERKVVDDLLGIAKTLRAMPVINLETPTLCLVGAPNVGKSSLVHVLSTGKPEDRNNLEKLTLAVLSHLPTAVLYVHDLSGECGTSPSDQFSIYKELRERFNGHLWLDVVSKSDLLKTSPVVYATDEPHPSQLELEKYRKSGPNGAINVSVKTQGGLHEQQPGEVKGVTPLRVDIKLVKKLPDQIGKSETFMSQKLIFVKYVSSSVASLQAGKEAKAS

SEQ ID NO: 174913 - protein, 873 aa, Glycine max
  Coding DNA Sequence Number=SeqID_58135
  Gene Ontology: Mol. function=GTPase activity; Cellular component =mitochondrion; Biological process=defense response to fungus
  Homolog annotation: Hit_ID=Q8S7E5; Match level="QueryCoverage=79%, HitCoverage=99%, E-value=0.0, Identity=69%"; Hit description =Putative phragmoplastin
  Pfam annotation: Domain name=Dynamin_M; Domain location=378-713; Score=199.9; E_value=6.1e-57; Accession=PF01031.10; Description =Dynamin central region
  Pfam annotation: Domain name=Dynamin_N; Domain location=174-350; Score=307.7; E_value=2.2e-89; Accession=PF00350.13; Description =Dynamin family
  Pfam annotation: Domain name=GED; Domain location=718-827; Score =102.1; E_value=1.6e-27; Accession=PF02212.8; Description=Dynamin GTPase effector domain
  Pfam annotation: Domain name=MMR_HSR1; Domain location=172-351; Score= 5.5; E_value=0.00031; Accession=PF01926.13; Description=GTPase of unknown function
  Pfam module annotation: Pfam domain module=Dynamin_M::Dynamin _N::GED::MMR_HSR1; Domain location=378-713::174-350::718-827::172-351
  Subcellular localization annotation: CTP_CleavageSite=31; ConfidenceScore=5.34e-01
MGSSLWVHPAHHGFEPARAQKSTKGAIRPSRCFSVTSATTAPPQFEDFDVSNVISPNNCISEIIITNFLSFNKITLLNHILTVEHGKKIADIENEVAWWANPFNPQPVMPRTGPLFAGKSYKVSRKKKKKKMTTTMESLIGLVNRIQRACTVLGDYGGADNNTFSSLWEALPSVAVVGGQSSGKSSVLESIVGRDFLPRGSGIVTRRPLVLQLHKLESGSQEYAEFLHLPRRKFTDFALVRQEIQDETDRVTGKTKQISPIPIHLSIYSPNVVNLTLIDLPGLTKVAIEGQPENIVQEIETMVRSYVEKPNCIILAISPANQDIATSDAIKLAKEVDPTGERTFGVLTKLDLMDKGTNALDCACKIILLYPLSRFYSLKVLEGRSYRLQHPWVGIVNRSQADINRNVDMIVARRKEREYFATSSDYGHLANKMGSEYLAKLLSQHLESVIRARIPSITSLINKSIEELESEMDHLGRPIALDAGAQLYTILELCRAFERIFKEHLDGGIYSSLSSVLHKLIEHRGRRPFGWAEKGSLQPNGHSILIPQKQLQIVRGRMRPGGDRIYNVFDNQLPAALRKLPLDRHLSLQNVRKVVSEADGYQPHLIAPEQGYRRLIEGALGYFRGPAEASVDAVNFVLKELVRKSIAETKELKRFPTFQAELAAAANEALERFREESKKTTVRLVDMESSYLTVDFFRRLPQEVEKSGTPAATNIDRYAEGHFRRIASNVSSYIGLVADTLRNTIPKAVVYCQVRQAKQSLLNHFYTQIGKKELYHGKITQLLPKLYLGGKQLSQMLDEDPALMERRQQCAKRLELYKAARDEIDSVSWAGSFTTDLVQVARLKVIQKIVEKFQGLKEIMEKCQRKLHVEEDA

SEQ ID NO: 174914 - protein, 1168 aa, Glycine max
  Coding DNA Sequence Number=SeqID_58136
  Gene Ontology: Mol. function=nucleic acid binding; Cellular component= nucleus; Biological process=regulation of transcription, DNA-dependent
  Homolog annotation: Hit_ID=Q9LK10; Match level="QueryCoverage=61%, HitCoverage=61%, E-value=1e-178, Identity=47%"; Hit description =Similarity to DNA repair protein
  Pfam annotation: Domain name=DEAD; Domain location=587-813; Score= -41.5; E_value=0.018; Accession=PF00270.19; Description=DEADDEAH box helicase
  Pfam annotation: Domain name=Helicase_C; Domain location=1003-1082; Score=68.5; E_value=2.2e-17; Accession=PF00271.21; Description =Helicase conserved C-terminal domain
  Pfam annotation: Domain name=ResIII; Domain location=583-807; Score =0.1; E_value=4.6e-05; Accession=PF04851.6; Description=Type III restriction enzyme, res subunit
  Pfam annotation: Domain name=SNF2_N; Domain location=589-962; Score =14.9; E_value=6.4e-09; Accession=PF00176.13; Description=SNF2 family N-terminal domain
  Pfam module annotation: Pfam domain module=DEAD::Helicase _C::ResIII::SNF2_N; Domain location=587-813::1003-1082::583-807::589 -962
MNEYTGPARRTRSKGVEVRGGLIRSRKRRRVVDYDDDELVFVKELKGGGEGASAKIEKSMERGFEFLGESEDDGPFEVVEIDEDDDEAEEEVYGECEQKKKRVEVKVEEKDEGPEVLCYVAAEKVASFGGGDDDECGSRPENPVVMLCVSDDGGGQSEEDHGRDRSSVSSDDGFGSSSSSSSEDDDSSDDDFKVGVEDERADDEEDYSSIEEESESDDDSSCDDERGELYKKFVKERVRNLVSKSGSSGVSRRKANRVLARDETRQAEVIDDAAERGESVNAAADELFANQVPRPSLPLAARETVPLNGNCQKKKPVEAESAKEIDMLWNELDIALQETEAGDSTMLKKKRLPSGVRSVSPLPKRQEKMGDSAKVVMKEDDGNAAKNGLHEVLRMSNRSKNIGFKFFTECFWGKPDSDKDDPMELEEKDGVVVQGQTQPLACGVGIPLTWDFLKKNPVEKSEAEKELDMLWAEMEMLLRAGEIGIQVDEARAKEENPALQCKHDTIFNEEIGVYCRLCGWIATEIKYIMPPFVDSKRSGREAFPGAWKTSQFDGATFDDCGDDSGAAWSHNEGTVWDIISDIKKGLFPHQQEGFEFIWTSLAGTTNLAELKRVDPGTEGGCIISHAPGTGKTKLTMVFLQTYLQLFPKCLPVIIAPANILLTWEDELRKWNIGIPFHNLNNAELSGKENVINEFGYQELNKDAIRMLKLCSWYKEKSILLISYNLYEKLAGGKSEDDGEKEKKNRKIRKEKKRASIETAMGKVLRDYPGLLVLDEGHTPRNQRSCIWKVLSESRSQKRILLSGTPFQNNFLELFNIFCLMKPSFSDNIPQELKKFCQSKLIQERKASKDVSWESINSGNPADEKIKQLKLLMNPFVHVHKGSILQKNLLGLQDCVLILKPEILQQKILDSIECSQNGLNFEHKLALVSVHPSLFLNCSLSKKEESVIDMDQLKKCRLDSYEGVKTKFLMEFVNLCDAVDEKVLVFSQFIDTLILIKDQLESAFNWSEGREVLFMHGRVDQKQKQSLIHSFNDANSQAKVLLASIKASSEGINLVGASRVVLLDVVWNPSVERQAICRAYRLGQKKVVYTYHLLAQGTPECTKYCKQAEKNRLSELVFSNRNAESDKLKRSGVIEDKVLDAMVQHEKLKDIFGECLVQPKEGDQETLCP

SEQ ID NO: 174915 - protein, 505 aa, Glycine max
  Coding DNA Sequence Number=SeqID_58137
  Homolog annotation: Hit_ID=Q1S136; Match level="QueryCoverage=19%, HitCoverage=8%, E-value=1e-08, Identity=35%"; Hit description=SNF2 -related; ATP-requiring DNA helicase RecQ
MYVADRTRSKRGGVVGSGLIMGEKKKRVHDYHEEIVLEDNEEGASVKVEPGPGASSSSSSSGARALKRERVSEHGFQNLGGRADDPIKISDSEDDDGEEGLSDFEKKRFLGEEEKERKSEEGKGCGGEKKHAVAESGSNDEGYDSLLSSLSESENAVTSDEDFQVDDDGNESHYYSSSDSSSYDDGERGGCRKMVKERVRKVESETESSVVYKRKGERKDIELVEEEEPRIGADCSSATSNKSEIYKEEPGHGAQKHKVKRVESVNADAFGDHSESSDHSMQSEAEALEHMKKRDRDHQNVSLENKAGDSAVVKMSEKNDNVDAGKVGEHKYEFNSNKREKPEKVRVVDDETDDKHELYEVLRMPSRTKNRCLKFFTECFWGENDSVKDDSNQLEEKDDDIDQGQTQPLASRETVLVNWNFTKKELIEKSEFEKELDNLWGEMDMLLRVEEIGSQIDKVGENEENSASQCKHDTIFNEEIGIYCRWCGWIHTEIKYITPPFVSTV

SEQ ID NO: 174916 - protein, 647 aa, Glycine max
  Coding DNA Sequence Number=SeqID_58138
  Gene Ontology: Mol. function=nucleic acid binding; Cellular component= nucleus; Biological process=regulation of transcription, DNA-dependent
  Homolog annotation: Hit_ID=Q9LK10; Match level="QueryCoverage=92%, HitCoverage=49%, E-value=1e-161, Identity=50%"; Hit description =Similarity to DNA repair protein
  Pfam annotation: Domain name=DEAD; Domain location=55-288; Score= -42.5; E_value=0.022; Accession=PF00270.19; Description=DEADDEAH box helicase
  Pfam annotation: Domain name=Helicase_C; Domain location=478-557; Score=65.3; E_value=1.9e-16; Accession=PF00271.21; Description =Helicase conserved C-terminal domain
  Pfam annotation: Domain name=ResIII; Domain location=51-282; Score= -15.6; E_value=0.00095; Accession=PF04851.6; Description=Type III restriction enzyme, res subunit
  Pfam annotation: Domain name=SNF2_N; Domain location=57-437; Score =10.4; E_value=1.1e-08; Accession=PF00176.13; Description=SNF2 family N-terminal domain
  Pfam module annotation: Pfam domain module=DEAD::Helicase _C::ResIII::SNF2_N; Domain location=55-288::478-557::51-282::57-437
VDNERSGREALSGGGKTSQFDGVLFNDSVDDSEAVWSHNEGTVWDLIPDIKESLFPHQQEGFEFIWTSLAGTIDLAELKRVDMHTEGGCIISHAPGTGKTKLTMVFLQTYLQLFPKCLPIIIAPANILLTWEDELRKWNLGIPFHNLNNAELSGNEQDINEVDLSGNQRQNKDAIRMVKLCSWYKEKSILLISYHLYERLARGLCEDDGKKEKKNKKMKKGKKRARTREYIETAMGKVLRDYPGLLILDEGHTPRNQRSYIWKVLSESRSQKRVLLSGTPFQNNFLELYNILCLMKPSFPDSIPQELKKFCQSRLRKERKASKYASYEPIYSGNSADEKIKQLKSLMNPFVHVHKGSILQKNLPGLRDCVLVLKPDRLQQETLDIIDSSQNILNFEHKLALVSVHPSLFLNCSLSKKEESVLDKDQLEKLRLNPYVGVKTNFLLELVRLCDAVNEKVLVFSQFIDTLCLIKDQLESAFHWSVGTEVLYMYGKLDQKQKQSLIHSFNDTNSKAKVLLASIKASSEGINLIGASRVVLLDVVWNPSVERQAICRAYRLGQKKVVYTYHLLAQDTPECIKFCKQAEKDRLSELVFSNKNAKSDKLNSCGAALEDAVLDIMVQHEKLKDMFGELLVQPKERDFGDFGPLML

SEQ ID NO: 174917 - protein, 57 aa, Glycine max
  Coding DNA Sequence Number=SeqID_58139
  Gene Ontology: Cellular component=membrane
  Homolog annotation: Hit_ID=Q8L9I2; Match level="QueryCoverage=92%, HitCoverage=22%, E-value=2e-08, Identity=61%"; Hit description =Nodulin MtN21-like protein
MAGGRYCEKEVLPFTAMVAVECTNVGVNVLFKAATEKGQGGFLHSICLSSSEFSSLE

SEQ ID NO: 174918 - protein, 82 aa, Glycine max
  Coding DNA Sequence Number=SeqID_58140
MDSTSQTNWVLGGSLLAIEFLLVPICVVGAVILSFGFYAVLWGKAKEEELTVVDFDDIRPPSNTKSPLLQSYKVKDEDNQNI

SEQ ID NO: 174919 - protein, 118 aa, Glycine max
  Coding DNA Sequence Number=SeqID_58141
MCYYAEAVTIPIGPGNPPFIRCDPTNNGYRRCGGLKQSPPPSKPSLCSTVGGYKKCSPAQPPPPPCETYKLVIILSFCETKGRPFGQSNKSAAAETFETANPLNPVMTRVYCIKILKD

SEQ ID NO: 174920 - protein, 102 aa, Glycine max
  Coding DNA Sequence Number=SeqID_58142
  Pfam annotation: Domain name=zf-CCHC; Domain location=30-47; Score =17.3; E_value=0.0014; Accession=PF00098.13; Description=Zinc knuckle
EIQQVSKVQRKSKKKNFNPKKKGEDSPSVPKCYECNQLGHLRLDWPSFNKRMEKSDKKNFKDKKAKKAYITWEDNDIYSSGVSENEVVNLSLMAKNNDSEEE

SEQ ID NO: 174921 - protein, 75 aa, Glycine max
  Coding DNA Sequence Number=SeqID_58143
MSDLGIKYIEMLEIEQRKPSTNSKRHNFSLGCPIQAHNISRRSKLNIGSSREIQMVITFHSDVRFRRITYRDAEN

SEQ ID NO: 174922 - protein, 214 aa, Glycine max
  Coding DNA Sequence Number=SeqID_58144
  Gene Ontology: Mol. function=protein binding; Cellular component =integral to membrane; Biological process=defense response to fungus
  Homolog annotation: Hit_ID=Q1T2W5; Match level="QueryCoverage=99%, HitCoverage=42%, E-value=1e-36, Identity=37%"; Hit description =Leucine-rich repeat
  Pfam annotation: Domain name=LRR_1; Domain location=105-128; Score =8.4; E_value=7.5; Accession=PF00560.23; Description=Leucine Rich Repeat
  Pfam annotation: Domain name=LRR_1; Domain location=129-151; Score =6.7; E_value=16; Accession=PF00560.23; Description=Leucine Rich Repeat
  Pfam annotation: Domain name=LRR_1; Domain location=153-176; Score =15.4; E_value=0.2; Accession=PF00560.23; Description=Leucine Rich Repeat
  Pfam annotation: Domain name=LRR_1; Domain location=178-201; Score =3.6; E_value=60; Accession=PF00560.23; Description=Leucine Rich Repeat
  Pfam annotation: Domain name=LRR_1; Domain location=27-49; Score =10.7; E_value=2.8; Accession=PF00560.23; Description=Leucine Rich Repeat
  Pfam annotation: Domain name=LRR_1; Domain location=3-25; Score=17.4; E_value=0.053; Accession=PF00560.23; Description=Leucine Rich Repeat
  Pfam annotation: Domain name=LRR_1; Domain location=56-78; Score=7.6; E_value=11; Accession=PF00560.23; Description=Leucine Rich Repeat
  Pfam annotation: Domain name=LRR_1; Domain location=80-103; Score =12.9; E_value=1.1; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=105-128::129-151::153- 176::178-201::27-49::3-25::56-78::80-103
MNSLEVLHLTGNKLQGEIPSFFGNMCTLQGLHLSNNKLNGEISSFFQNSSWCNRHIFKRLYLSYNRLTGKLPKSIGLLSELEVLTLVGNSLEGDVTESHLSNFSKLKRLYLSENSLSLKLVPSWVPPFQLKYLRIRSCKLGPTFPSWLKTQSSLYELDISDNGINDSVPDWFWNNLQYMTDLNMSFNYLIGAIPDISLKLPNRPSIILNSNQFE

SEQ ID NO: 174923 - protein, 115 aa, Glycine max
  Coding DNA Sequence Number=SeqID_58145
  Gene Ontology: Mol. function=actin binding; Cellular component =cytoplasm; Biological process=cytoskeleton organization and biogenesis
MLPEDNTLLNNHHEAKKILCPLGMKYQKIHACPTDCILYKNEFAEMRNCPTCGVSRYRVNDGECSVDAIANNSRPIKIIYNLPLWLCIKRKYIMLWMMISGPRQPGNDIDVYLTP

SEQ ID NO: 174924 - protein, 95 aa, Glycine max
  Coding DNA Sequence Number=SeqID_58146
MNSTLLFSRFGKPENFRKLLAKEEEEEIQEDVQRDSKDIRNYDNKFVSIPVMNKRSTTTPLPRTREINNLYIIMNEGCTILNSFTQLSSTHFIES

SEQ ID NO: 174925 - protein, 164 aa, Glycine max
  Coding DNA Sequence Number=SeqID_58147
MADAKFAELLGLGKPLVEILPPGQLRGFCPLLAWLGSAVLGYGPVLSFGLVGPLLPPVISFVARILPTLACAPLAKSVPRQNEREPTNGSLFWPNIVEEERDTGLIGEGRIKATRAESQWIVAARPLCHLQYPVAYLSRLQRILPAARWELRFKASRRANPPHE

SEQ ID NO: 174926 - protein, 208 aa, Glycine max
  Coding DNA Sequence Number=SeqID_58148
  Gene Ontology: Mol. function=protein binding; Cellular component =integral to membrane; Biological process=xylan catabolic process
  Homolog annotation: Hit_ID=Q1SWI7; Match level="QueryCoverage=94%, HitCoverage=94%, E-value=8e-64, Identity=47%"; Hit description =Leucine-rich repeat
  Pfam annotation: Domain name=LRR_1; Domain location=120-144; Score =5.7; E_value=25; Accession=PF00560.23; Description=Leucine Rich Repeat
  Pfam annotation: Domain name=LRR_1; Domain location=48-70; Score=7.6; E_value=11; Accession=PF00560.23; Description=Leucine Rich Repeat
  Pfam annotation: Domain name=LRR_1; Domain location=72-94; Score =13.6; E_value=0.72; Accession=PF00560.23; Description=Leucine Rich Repeat
  Pfam annotation: Domain name=LRR_1; Domain location=96-118; Score =14.8; E_value=0.32; Accession=PF00560.23; Description=Leucine Rich Repeat
  Pfam module annotation: Pfam domain module=LRR_1::LRR_1::LRR_1::LRR _1; Domain location=120-144::48-70::72-94::96-118
MTLMNQSSDPRIYSVAQNSTHYSSGYSIVIVLLWLKGREDEYRNILGLVTSIDLSSNKLLGEIPREITSLNGLNFLNLSHNQVIGHIPQGIGNMGSLQSIDFSRNQLSGEIPPTISNSSFLSMLDLSYNHLKGKIPTRKQLQTFDASSFIGNNLCGPPLPINCSSNGKTHSYEGSDEHGVNWLFVSAAIGFIVGFWIVIAPLLICRSW

SEQ ID NO: 174927 - protein, 66 aa, Glycine max
  Coding DNA Sequence Number=SeqID_58149
MTSGSKRSELGAEQNSGKAASPTAVSKGQNDAKTPGIVVKLAWLAVLIPISYGIWMTVQKAWSLFA

SEQ ID NO: 174928 - protein, 135 aa, Glycine max
  Coding DNA Sequence Number=SeqID_58150
MTRSKRFVEAEDEDRVIMPKKKAAEKKGTDDKKDDVRGESNQEKEKQIMNEERSRSEQAREKKREKVVNEGAEVPYPMVPSEKEKDRHLDMLTRKHKYIHQENIVVEGNCSVVIQKILPPKHKDPGSVTIPCSIG

SEQ ID NO: 174929 - protein, 206 aa, Glycine max
  Coding DNA Sequence Number=SeqID_58151
  Homolog annotation: Hit_ID=UPI0000503967; Match level="QueryCoverage =92%, HitCoverage=89%, E-value=2e-08, Identity=30%"; Hit description =UPI0000503967 related cluster
  Subcellular localization annotation: CTP_CleavageSite=74; ConfidenceScore=5.29e-01
GLMNCVFVHVSSTFELGAMRSDCLVQFSILTFFQSPMNCVFVLVSSTFEFGAMLSDCLVQFSILTLFRRPMNCVFVHVSSTFEFGAMRSDCLVQFPIHNLFRSPMNCIFVHVSSTFEFGAMRSDCLVKFSILTLLQSPMNCVFVHVSSTFELGAMRSDCLVQFSILTFFRSPMNCVLVLVSSTFEFGAMLSDCLVQFSILNLFGAP

SEQ ID NO: 174930 - protein, 111 aa, Glycine max
  Coding DNA Sequence Number=SeqID_58152
  Subcellular localization annotation: CTP_CleavageSite=32; ConfidenceScore=5.22e-01
MPISPCGSISWSVSSRHRDRDHKAPSGPGGVRQGLGVSSSGYGPLSVLQDARPPSKGSRPQDILWTRRSPTGPWGFQLWLRASVSPTGCPFPPARSCHRDIGKYALLSTDF

SEQ ID NO: 174931 - protein, 95 aa, Glycine max
  Coding DNA Sequence Number=SeqID_58153
MVKLVRMIRTRVFAVAWVKSCPGMHSRCVIASLSCCIHTVGALQYQGVAQELIKGNYWPLNRECKSQLSILGQRTLNSLKVQMWSPLKARTLSLL

SEQ ID NO: 174932 - protein, 179 aa, Glycine max
  Coding DNA Sequence Number=SeqID_58154
MVGAGLKKDLRVSRVVPGGSLNAFLFLLIGVISQRLAMESIDSLPIGWTVGAMIYFTGEVSAQLVELRSCNWVVAITGWMSNCPGGNDSILYLNRSSMDRTWTVVGVGGSPRVSFIWDPGEEDQAGPCEQLDALSPFNPLSEMWQKEKESMDRPHRLHPVGTTRSPQGRLRHPGVADRP

SEQ ID NO: 174933 - protein, 97 aa, Glycine max
  Coding DNA Sequence Number=SeqID_58155
DRELRGSSNGIIGGYHKWLRVRTQGLDWLPNLKTVRDNEVKASEESDEVQALKAKLERTWVVKEKFKAAIVSSNSEEVKGIIMGQRHDLEGRAKGLP

SEQ ID NO: 174934 - protein, 128 aa, Glycine max
  Coding DNA Sequence Number=SeqID_58156
MPFIFGYKEDYPWHKHIALLRHGALANDLFFFAKGMFAFLGGKYPVDNSVLLSFFRRPMNCVLVHAFSTHEFGAMRSDCFVQFSVLYPFFRSHMNCVFVHAPSTHEFEAMRSDCLVQFSILYTFFRAP

SEQ ID NO: 174935 - protein, 266 aa, Glycine max
  Coding DNA Sequence Number=SeqID_58157
  Gene Ontology: Mol. function=transcription factor activity; Biological process=regulation of transcription, DNA-dependent
  Homolog annotation: Hit_ID=Q8Y0F2; Match level="QueryCoverage=53%, HitCoverage=47%, E-value=8e-50, Identity=65%"; Hit description =Probable transcriptional regulatory dna-binding transcription regulator protein
  Subcellular localization annotation: CTP_CleavageSite=30; ConfidenceScore=5.36e-01
ARFLPAPAVPPALCVHLSRGSSAGAHRRVGAAVPRRRACRHRVGGHRPRGGGPGDRAGRHPPAPAPDGAAFHGGGAGAAGHRHDRGGAAALRRLRLQALRPGHRGLSGEDPRVRHQRVLARPQPPRAGQPVVAAGGGGAVRGLGDRVLTARRGGIQGVGQPDLVGRVQVGQGQHAFADVAGIEQFGALHAGQAAAVDRWRVPVAIQAQVDVAAAAFAQLAAFVQVDQVEDVRMGRQPFDGLGVPRAGKWSCSATAARTSAAPRAPA

SEQ ID NO: 174936 - protein, 83 aa, Glycine max
  Coding DNA Sequence Number=SeqID_58158
MESDPTSHHKHLAIFNGDDATRVYQNSDGVKPGVCSNGWGINISWENVPIPKYMVEELGLLDIPLCPQMNEDHLDAVTLSFDP

SEQ ID NO: 174937 - protein, 173 aa, Glycine max
  Coding DNA Sequence Number=SeqID_58159
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=5e-13, Identity=36%"; Hit description= UPI00006A17C9 related cluster
LPSLLRGLHVLALRGLRVLTFRGLLTLTIERTPRPHLERTTRPHLEVLHVLALRGLHVLTIRGLHALTSRGLHVLALRGLPALALGLHVLALRGLHVLTIRGLHALTSRGLHVLALRGLHALTLGTSYPHRQRTTRPRLERTTRPHHQRAARPHLQRTISPRLERATRPRLGY

SEQ ID NO: 174938 - protein, 50 aa, Glycine max
  Coding DNA Sequence Number=SeqID_58160
MEVEEPWQGLWLPLHYQVVFGHWACGKQAGLVADLGMTFVDDWVRGTVIG

SEQ ID NO: 174939 - protein, 153 aa, Glycine max
  Coding DNA Sequence Number=SeqID_58161
MLLGFFIEEGFWCPNPFLSCSLISFSHSLTLLLVALQLSFFLCDSHFRSLTITQLLAALRAHRARTMLLIASLHARHIPLSRCAIAFASLTPFLFLSLKTSKVISSTSLKATYKSLNVQKNSTSVPLADTQKDKSSIQQPVTIVELDHQKNPL

SEQ ID NO: 174940 - protein, 105 aa, Glycine max
  Coding DNA Sequence Number=SeqID_58162
MGSRPQVAQWARRSPIGPWGFQLWDRAYKTPSGPEEVQQGLGVVKLWLWVSVSFTEYLSPLARASGPLLIELSSRSTASPGRRRAKHHSSLGMASSGQQTHRHHL

SEQ ID NO: 174941 - protein, 57 aa, Glycine max
  Coding DNA Sequence Number=SeqID_58163
VKKRLSQEVLKVTVELSSSVGLSMHPSLSAASACLARQQNLAEHQYQGRTLSARSVR

SEQ ID NO: 174942 - protein, 72 aa, Glycine max
  Coding DNA Sequence Number=SeqID_58164
MAARKRLTRLLEKRINVALVREFYAYVYDPEDGSPIYYRVRGQVIQFDVETLNDFLETLIVILEGEEYPTCS

SEQ ID NO: 174943 - protein, 133 aa, Glycine max
  Coding DNA Sequence Number=SeqID_58165
  Gene Ontology: Mol. function=ubiquitin-protein ligase activity; Cellular component=ubiquitin ligase complex; Biological process =protein ubiquitination
  Homolog annotation: Hit_ID=Q84QD7; Match level="QueryCoverage=75%, HitCoverage=13%, E-value=1e-27, Identity=61%"; Hit description =Avr9/Cf-9 rapidly elicited protein 276
MKDDALRLQFFPFLNDFENGRIPDSVELRSFHVEKLQIVDATSCRTKIEGLKEQIVNHEGDIKPTIYVLNGLVAMTRYYRFFLFGFKEDELGFESGSQKKPKTPMGTNNVRGGLKLNKAVWSQGIWSVSRKIK

SEQ ID NO: 174944 - protein, 117 aa, Glycine max
  Coding DNA Sequence Number=SeqID_58166
  Gene Ontology: Mol. function=oxidoreductase activity, acting on single donors with incorporation of molecular oxygen, incorporation of two atoms of oxygen; Cellular component=plastoglobule; Biological process=abscisic ...
  Gene Ontology: Biological process=acid biosynthetic process
  Homolog annotation: Hit_ID=Q8LP14; Match level="QueryCoverage=98%, HitCoverage=20%, E-value=5e-45, Identity=72%"; Hit description=Nine -cis-epoxycarotenoid dioxygenase4
  Subcellular localization annotation: CTP_CleavageSite=69; ConfidenceScore=5.46e-01
MENDTGFPLIPNVFSGFNSLVASAACGSLSVARVLTGQFNPANGIGLANTSLVFFGNRLFALAESDLPYAVNVTPDGDIDRLGRHDFDEKLTFSMTAHPKIDLDTVECFAFCYGPVP

SEQ ID NO: 174945 - protein, 74 aa, Glycine max
  Coding DNA Sequence Number=SeqID_58167
  Homolog annotation: Hit_ID=Q9FNQ1; Match level="QueryCoverage=65%, HitCoverage=2%, E-value=4e-16, Identity=83%"; Hit description=RNA helicase
MRERGFRRSFGTIFVSAIPMIVTTPEKWDAITRKSSDMSLSMVVKLLIIDEVHLLNDDKALVARTLRQTLAYDS

SEQ ID NO: 174946 - protein, 192 aa, Glycine max
  Coding DNA Sequence Number=SeqID_58168
  Homolog annotation: Hit_ID=Q9SCU2; Match level="QueryCoverage=52%, HitCoverage=76%, E-value=9e-32, Identity=65%"; Hit description=LS1 -like protein
  Pfam annotation: Domain name=MIF; Domain location=2-121; Score=-7.6; E_value=0.00037; Accession=PF01187.8; Description=Macrophage migration inhibitory factor (MIF)
MPCLYITTNLNLDGVDTNPVFSEATTAVSTIIGKPEKFVMVILKSSVPISFEGNKEPAAYAEIVSMGGINTEVKRKLIATIGTILQSNLSIPRTRFFLKVFDDFLGCGGDKGYCYIDSTQAIFVSFKSSPNTTINNNNHFTWRRSPTLESFLAPVDLSDFALVHTLISVANEIVSCFLKCVDELASAPMRPK

SEQ ID NO: 174947 - protein, 75 aa, Glycine max
  Coding DNA Sequence Number=SeqID_58169
MEALAGTTRRRHRTAEEVFFWWWAASNRARLPVQPCPVTAEATDTASHRSHTRMHVRCESDMGHAGDEPRPCFLD

SEQ ID NO: 174948 - protein, 65 aa, Glycine max
  Coding DNA Sequence Number=SeqID_58170
MAKTARVGLFKHEGRSRKPTKLTKTRGWGERHGDHDGLSVAMRDSASGVRDNASDNDGLRMPLRE

SEQ ID NO: 174949 - protein, 136 aa, Glycine max
  Coding DNA Sequence Number=SeqID_58171
MEVLLRFSEDGARASQGWITRCKGEGGLHKASGELFRVGEGRCSHQRKQQSSIRLERCQNEPKKGPLISVYLYTTRKGRQWFCWVVGAMVFGSMVLRGGGASLGEGGIFVFVHVFWGAGSKNGYEEVKSPKFHGLF

SEQ ID NO: 174950 - protein, 217 aa, Glycine max
  Coding DNA Sequence Number=SeqID_58172
MRQGNVESAADAGGGWRGRGRNGDSSAEDGQEPGGLVRAALVEEEILGDPEGSVGGDEGDGDAEGGDEEGAEGGEEQKDEGGGEEEGERRKGGEGAAEKLEGAVGGAEEGEEEPRGEEAEEEDEGEGAGEEGHGEDEGHNDVIVDAKVGDVVADAEGGSGMRIAAVAVAVAVRWFEGLRRGELVVDVVVGKEREREKPCCWEISERMEKVLNFDMGF

SEQ ID NO: 174951 - protein, 93 aa, Glycine max
  Coding DNA Sequence Number=SeqID_58173
MEGSMINVTRQDNRARLLNFHWVLLARTTDEFGLREGLATVNGNMSMQGRNRHSNWRYAQRIGNRQSNWRVPIAEGAGLALLLAGNGSAAVQT

SEQ ID NO: 174952 - protein, 42 aa, Glycine max
  Coding DNA Sequence Number=SeqID_58174
MPFSPGDPVLLSASLPSSVHISVNSSLCVRMTEKLLIITTTQ

SEQ ID NO: 174953 - protein, 349 aa, Glycine max
  Coding DNA Sequence Number=SeqID_58175
  Homolog annotation: Hit_ID=Q7XB90; Match level="QueryCoverage=48%, HitCoverage=24%, E-value=2e-35, Identity=44%"; Hit description=KEAP1
  Subcellular localization annotation: CTP_CleavageSite=46; ConfidenceScore=5.60e-01
MVPLVGARKKTQTSQFSVTQTFSPNSSCGRNLRKNQLGGIIFGCKNATMKECLSKQLFGLPAHHFCYVKNIDPGLPLFLFNYTDRKLHGIFEAASSGRMFIDPYGWTTDGSERTQYPAQVQICVRLKCHPLPEDKFKEVIADNYYTHNRFYFELDHAQTSKLISLLSAGAIASDNSAPQNTQKWITVSRPLASNETLREGETSKMLELETEHSTHSSTRSYWIENDFSFDGYIRPLDTNEVEKEVNEDEQNSIFMKLKELTLDSESQDLSLANNANDTPGMNNTEEGYMEALDGLDEKEQTSNPPFDYQYNIAQCILVGARGQELTNFQKIQTERNCYLEQKLVHFSML

SEQ ID NO: 174954 - protein, 93 aa, Glycine max
  Coding DNA Sequence Number=SeqID_58176
MNLSLSLGSRLHRQSCMVTLKVINIESLRRLVRASTSQLVEPTPFDLDNLIFVELNDDAQSEEDLDDDDGDGDDDESDDIHGDDPIRGLDMLL

SEQ ID NO: 174955 - protein, 140 aa, Glycine max
  Coding DNA Sequence Number=SeqID_58177
MEEKEAEMNRLKHNAKGTPSPTFYRGQKVVKSHSEKLLQILFFFCLVRVSSRATQGKNSKIEDTIIGALKSMLLFILFIIGFYFQETKFLKFVVFKWNHLSWVMEAATIMAIALANGGNNDFQNNDFHPLIQICLLNQVL

SEQ ID NO: 174956 - protein, 190 aa, Glycine max
  Coding DNA Sequence Number=SeqID_58178
MWAWERCPTLAPKRTPSQVENTSLGHRWLRRGNQHIGNDDVRVFRRKLDIMKRHEFVWEHPSTVISLLPPVCLVGSLAWQKTKMFVDPQNAKTATLAGVAETLQYMVSPQGRNTWTVDDLVPYVEKITILSEEQERVIEPMSHGPASERQFPAQQFHILQSSVETQGIDRQRETVEGEEYSQKMSERGHG

SEQ ID NO: 174957 - protein, 55 aa, Glycine max
  Coding DNA Sequence Number=SeqID_58179
MRIWATWEYVSSVGGGQQGMSGTWRYVTGVRRPWGRQVGCYCPKPSLTNPDPTRA

SEQ ID NO: 174958 - protein, 70 aa, Glycine max
  Coding DNA Sequence Number=SeqID_58180
  Subcellular localization annotation: CTP_CleavageSite=43; ConfidenceScore=5.19e-01
MVKHLHKIKWPNSLKTVPSGVANYRNLPFGGRATHDSRVRLPRKEYARSRHQRLFEENVGKTGKDVIYEL

SEQ ID NO: 174959 - protein, 98 aa, Glycine max
  Coding DNA Sequence Number=SeqID_58181
  Homolog annotation: Hit_ID=Q8S198; Match level="QueryCoverage=65%, HitCoverage=9%, E-value=1e-13, Identity=56%"; Hit description =Glyoxal oxidase-like
MTVSTTYKDFYLDGGTTLFAAVEFYRKDGGHAGSRVVPGTAGEDGEGADNFVGVRVEEEGTVVGEDEERWTKGKITDMLIGLRIFLDTRYKYLSELLY

SEQ ID NO: 174960 - protein, 101 aa, Glycine max
  Coding DNA Sequence Number=SeqID_58182
  Homolog annotation: Hit_ID=Q8S198; Match level="QueryCoverage=76%, HitCoverage=12%, E-value=9e-14, Identity=42%"; Hit description =Glyoxal oxidase-like
  Pfam annotation: Domain name=Glyoxal_oxid_N; Domain location=1-100; Score=-117.2; E_value=6.4e-05; Accession=PF07250.2; Description =Glyoxal oxidase N-terminus
MPCIQWHDDNLKLDQEDCFAHSMEYDIETNQVRPLTVKTDPWCSCGGLTPDGTLVVAGGFADGGKTSRYYGGQLDCQDCDWREYPDKLKEPRCFIPLSSRY

SEQ ID NO: 174961 - protein, 119 aa, Glycine max
  Coding DNA Sequence Number=SeqID_58183
  Gene Ontology: Mol. function=galactose oxidase activity; Biological process=cell wall catabolic process
  Homolog annotation: Hit_ID=Q8S198; Match level="QueryCoverage=89%, HitCoverage=19%, E-value=4e-25, Identity=50%"; Hit description =Glyoxal oxidase-like
MVITDPNPQSDSEEMPSGRTMGDSLILPTGQILFINGAQKVLYLAEKPKGKRFKVLKPSKIARMYHSTSAVLPSGKIWVGGSNTHDTYKDKDKFPTETRIEAFSAPYLDPKLDKHRPQI

SEQ ID NO: 174962 - protein, 71 aa, Glycine max
  Coding DNA Sequence Number=SeqID_58184
  Subcellular localization annotation: CTP_CleavageSite=26; ConfidenceScore=5.20e-01
MSMTTTTILINSGGVTTTTTIKVKLMVMIAMKIVVIMLTMVVTTIVVMKVMIMVMKILGRVFVKYKKCELS

SEQ ID NO: 174963 - protein, 303 aa, Glycine max
  Coding DNA Sequence Number=SeqID_58185
  Gene Ontology: Mol. function=serine O-acetyltransferase activity; Cellular component=cytoplasm; Biological process=cysteine biosynthetic process from serine
  Homolog annotation: Hit_ID=Q8W199; Match level="QueryCoverage=99%, HitCoverage=100%, E-value=1e-121, Identity=76%"; Hit description =Serine acetyltransferase
  Pfam annotation: Domain name=Hexapep; Domain location=195-212; Score =19.7; E_value=0.01; Accession=PF00132.14; Description=Bacterial transferase hexapeptide (three rep
  Pfam annotation: Domain name=Hexapep; Domain location=221-238; Score =14.9; E_value=0.3; Accession=PF00132.14; Description=Bacterial transferase hexapeptide (three rep
  Pfam annotation: Domain name=Hexapep; Domain location=239-256; Score =5.7; E_value=29; Accession=PF00132.14; Description=Bacterial transferase hexapeptide (three rep
  Pfam annotation: Domain name=SATase_N; Domain location=20-124; Score =201.7; E_value=1.7e-57; Accession=PF06426.4; Description=Serine acetyltransferase, N-terminal
  Pfam module annotation: Pfam domain module=Hexapep::Hexapep::Hexapep:: SATase_N; Domain location=195-212::221-238::239-256::20-124
MPTGLPKANSSVAPDDQGWLWTQIKAEARRDAELEPALASYLYSTILSHSSLVRSLSFHLGNKLCSSTLLSTLLYDLFLNAFSFDPSLCSAAVADLRAARERDPACVSYSHCLLNYKGFLACQVQFPKPPLFQGFLLLARAHRVAHLLWRQSRQPLALALHSRIADVFAVDIHPAARIGKGILFDHATGVVVGETAVIGNNVSILHHVTLGGTGKVGGDRHPKIGDGVLIGAGATILGNIKIGEGAKVGAGSVVLIDVPPQTTAVGNPARLVGGKEKPSKHEDVPGESMDHTSFISEWSDYII

SEQ ID NO: 174964 - protein, 437 aa, Glycine max
  Coding DNA Sequence Number=SeqID_58186
  Gene Ontology: Mol. function=transporter activity; Cellular component= integral to membrane; Biological process=iron ion transport
  Homolog annotation: Hit_ID=Q9C6B2; Match level="QueryCoverage=86%, HitCoverage=70%, E-value=1e-155, Identity=72%"; Hit description =Metal transporter Nramp2
  Pfam annotation: Domain name=Nramp; Domain location=116-437; Score =528.3; E_value=8.1e-156; Accession=PF01566.9; Description=Natural resistance-associated macrophage protein
MSTQSQQHNKREFKGEEEEEEEEENHLLHSECETIPFSSPNTSPSEWEHGNKEEEEEEEKDTVYAAKDKVQIFDLESAGGVREGSTAVPPFSWRKLWLFTGPGLLMSVAFLDPGNLEGDLQAGAIAGYTLLWLLMWSTIMGLVIQLLSARLGVATGRHLAELCREEYSNWARLVLWILAELALIAADIQEVIGSAIALKILSHGLLPIWAGVIITAMDCFFFLFLENYGVRKLEGVFAVFIGTMGFSFAWMFFNTNPSEEELLMGLLIPRVNSKTLRQAVEIVGCVITPHNVFLHSALVQSRDIDIRNKGQVQEAINYYSIESSVALLVTLVINLFVITVFARVFYGTEQAKGIGLVNAGQYLQERYGGGLFPILYIWGIGLLAAGQSSTITGTYAGQFITEGFLKLNIKKWLRALITRSCAIVPTMICAIVFNTSE

SEQ ID NO: 174965 - protein, 221 aa, Glycine max
  Coding DNA Sequence Number=SeqID_58187
  Gene Ontology: Mol. function=pyridoxal phosphate binding; Cellular component=cellular_component; Biological process=amino acid and derivative metabolic process
  Homolog annotation: Hit_ID=Q000T5; Match level="QueryCoverage=93%, HitCoverage=40%, E-value=7e-87, Identity=73%"; Hit description =Tyrosine decarboxylase
  Pfam annotation: Domain name=Pyridoxal_deC; Domain location=55-221; Score=-22.6; E_value=8.3e-13; Accession=PF00282.9; Description =Pyridoxal-dependent decarboxylase con
MEMKNTMNRNPQSDAPIIKPLDPEEFKRQGYMMVDFLADYIRNVSHYPVLSKVEPGYLKQRLPTSAPCGPEPIESILKDVQDHIIPGLTHWQSPNFYGYFPSSGSIAGFMGEMLSAGLNVVGFNWVSSPSATELESIVMDWLGQVLNLPKSFLFCGDHGGGVVLGTTCEAILCTLVAAREKKLSQVGKENIGKLVVYGSDQTHSALQKAAQIAGIHPANFS

SEQ ID NO: 174966 - protein, 305 aa, Glycine max
  Coding DNA Sequence Number=SeqID_58188
  Gene Ontology: Mol. function=tyrosine decarboxylase activity; Cellular component=cellular_component; Biological process=amino acid and derivative metabolic process
  Homolog annotation: Hit_ID=Q9AXN7; Match level="QueryCoverage=98%, HitCoverage=58%, E-value=1e-115, Identity=64%"; Hit description =Tyrosine/dopa decarboxylase
  Pfam annotation: Domain name=Pyridoxal_deC; Domain location=1-216; Score=149.7; E_value=7.5e-42; Accession=PF00282.9; Description =Pyridoxal-dependent decarboxylase con
IHPANFRVIKTKRSNSFALSPDSLLSTILLDVERGLIPCFLCATVGTTAIATIDPIGPLCNVAKDYGIWVHVDAAYAGSACICPEFRHCIDGVEEVNSFSLNAHKWFLTNLTCCCLWVKDHIALTKSLTVNPQFLRNKASESKRVIDYKDWQIPLSRKFNALKLWLVLRSYGVENIRNFLRNHVQMAKTFEGLVRLDKRFEIVVPPKFSLVCFRIAPSAIIANGLSKGVEACYNGKLVNDEYMVNEVNRKLLDSVNSSGDAFMTHGEVEGAFMIRCAIGGTLTEEHHVIMAWKLVQEHANSLLGL

SEQ ID NO: 174967 - protein, 56 aa, Glycine max
  Coding DNA Sequence Number=SeqID_58189
MRPRRYQIMTVIDFYTVLRLVFFIRHLNYVGLSSSSYLRIHRSKGNTLVDPKNKET

SEQ ID NO: 174968 - protein, 174 aa, Glycine max
  Coding DNA Sequence Number=SeqID_58190
  Gene Ontology: Mol. function=dopamine beta-monooxygenase activity; Cellular component=integral to membrane; Biological process =histidine catabolic process
  Homolog annotation: Hit_ID=Q8S0J6; Match level="QueryCoverage=85%, HitCoverage=40%, E-value=1e-17, Identity=32%"; Hit description =Membrane protein-like
  Pfam annotation: Domain name=DOMON; Domain location=53-153; Score =5.2; E_value=0.017; Accession=PF03351.8; Description=DOMON domain
MKPSPRFLFILTFLGSFFLASPEADSCTSNLNLNVSIPFDTTNLHCLSVWDAQSFILRYAQTSANTWSFILSTPDTNSYIAMGFSVGGGMVGSSAMVGWVASRGASGGIKQYYLGGVTPNQVVPDKGNLQLETTEPLSSLIFATGSTGLFPAPPSFALTIHLDKVSTRIDYSEG

SEQ ID NO: 174969 - protein, 43 aa, Glycine max
  Coding DNA Sequence Number=SeqID_58191
VKKRLSFEVQKVEIGAKLSSWAKRTSTAKHRRCLRPGLAQDWH

SEQ ID NO: 174970 - protein, 278 aa, Glycine max
  Coding DNA Sequence Number=SeqID_58192
  Gene Ontology: Mol. function=protein binding; Cellular component =integral to membrane; Biological process=defense response to fungus
  Homolog annotation: Hit_ID=Q949G9; Match level="QueryCoverage=94%, HitCoverage=86%, E-value=1e-34, Identity=30%"; Hit description =HcrVf1 protein
  Pfam annotation: Domain name=LRR_1; Domain location=120-145; Score =5.8; E_value=23; Accession=PF00560.23; Description=Leucine Rich Repeat
  Pfam annotation: Domain name=LRR_1; Domain location=147-169; Score =14.8; E_value=0.32; Accession=PF00560.23; Description=Leucine Rich Repeat
  Pfam annotation: Domain name=LRR_1; Domain location=171-193; Score =8.1; E_value=8.7; Accession=PF00560.23; Description=Leucine Rich Repeat
  Pfam annotation: Domain name=LRR_1; Domain location=195-217; Score =13.5; E_value=0.79; Accession=PF00560.23; Description=Leucine Rich Repeat
  Pfam annotation: Domain name=LRR_1; Domain location=219-241; Score =16.5; E_value=0.098; Accession=PF00560.23; Description=Leucine Rich Repeat
  Pfam annotation: Domain name=LRR_1; Domain location=248-270; Score =7.8; E_value=9.8; Accession=PF00560.23; Description=Leucine Rich Repeat
  Pfam annotation: Domain name=LRR_1; Domain location=48-69; Score=2.7; E_value=90; Accession=PF00560.23; Description=Leucine Rich Repeat
  Pfam annotation: Domain name=LRR_1; Domain location=70-91; Score =12.8; E_value=1.1; Accession=PF00560.23; Description=Leucine Rich Repeat
  Pfam annotation: Domain name=LRR_1; Domain location=96-118; Score =6.9; E_value=14; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1; Domain location=120-145::147 -169::171-193::195-217::219-241::248-270::48-69::70-91::96-118
MILQIGFGLGIIIIPTVATDSLINDDWEAYRTWSFGGEISPCLADLKHLNYLDLSGNRFLGEEWVSSMWKLEYLDLSNANLSKAFHWLHTLQSLPSLTHLYLSYCTLPHYNEPSLLNFSSLQTLDLSRTRYSPAISFVPKWIFKLKKLVSLQLQGNEIQGPIPGGIRNLSLLQNIDLSFNSFSSSIPNCLYGLHRLKFLNLVHNNLHGTISDALGNLTSLVELVLSYNQLEGTIPTFLGNLRNSREIDLTYLDLSMNKFSGNPFESLGSLSKLSSLYI

SEQ ID NO: 174971 - protein, 212 aa, Glycine max
  Coding DNA Sequence Number=SeqID_58193
  Subcellular localization annotation: CTP_CleavageSite=62; ConfidenceScore=5.77e-01
MAILLRGGALGDSSFRLCSLTSTSSLHVSQNVAIPTSSSSSSSLVLPLIASKFKTVSRIRITCSAVQESSPSTAATAETKEEVKEAPKAEPAKKPPAKAPAKPLPQMMEEDVIPSLKSIFEAQEDFSNIELVFKDNKLEGSFLKKGNPYSFWAFFPTGNLIGPKGFSLSSYNSGASTVEPFLIDEKKITARHIIFWVKKRLAAQGIIPVWED

SEQ ID NO: 174972 - protein, 150 aa, Glycine max
  Coding DNA Sequence Number=SeqID_58194
  Gene Ontology: Mol. function=phosphogluconate dehydrogenase (decarboxylating) activity; Cellular component=mitochondrion; Biological process=valine metabolic process
  Homolog annotation: Hit_ID=Q84VC8; Match level="QueryCoverage=92%, HitCoverage=47%, E-value=6e-59, Identity=83%"; Hit description=Gamma hydroxybutyrate dehydrogenase-like protein
  Pfam annotation: Domain name=NAD_binding_2; Domain location=1-150; Score=146.0; E_value=9.8e-41; Accession=PF03446.5; Description=NAD binding domain of 6-phosphogluconate dehydrogenase
MEFGFLGLGIMGKAMAINLLRHGFKVTIWNRTLSKCDELVQHGASVGETPATVVKKCKYTIAMLSDPSAALSVVFDKDGVLEHINGKCYIDMSTVDADTSSKISETIKAKGGYFLEAPVSGSKKPAEDGQLIILAAGDKSSFLYASLLRL

SEQ ID NO: 174973 - protein, 388 aa, Glycine max
  Coding DNA Sequence Number=SeqID_58195
  Gene Ontology: Mol. function=sequence-specific DNA binding; Cellular component=intracellular; Biological process=base-excision repair
  Homolog annotation: Hit_ID=Q9SU12; Match level="QueryCoverage=84%, HitCoverage=55%, E-value=1e-108, Identity=58%"; Hit description =Adenine DNA glycosylase like protein
  Pfam annotation: Domain name=HHH; Domain location=147-176; Score =13.7; E_value=0.058; Accession=PF00633.13; Description=Helix-hairpin- helix motif
  Pfam annotation: Domain name=HhH-GPD; Domain location=84-222; Score =51.0; E_value=4.1e-12; Accession=PF00730.15; Description=HhH-GPD superfamily base excision DNA repair protein
  Pfam module annotation: Pfam domain module=HHH::HhH-GPD; Domain location=147-176::84-222
MSEKKKKKNSTRRSVVVVGESKKPQPLVEVEDIEDSLSFSKDETHKLRVALLDWYDLNRRDLPWRTTFKQEDEEVERRAYGVWVSEVMLQQTRVQTVIAYYNRWMQKWPTIHHLAQASLEEVNEMWAGLGYYRRARFLLEGAKKIVAEGGQIPKVASMLRNIPGIGEYTSGAIASIAFKEVGSFCVLVPEKLRKLAAQLVDPVRPGDFNQALMELGATVCTPLNPSCSSCPASEFCHALSNAKHDSTVAVTDYPVKGVKVKQRCDFSAVCVVELVGAETLNKNQSSSKFILVKRPEEGLLAGLWEFPSVLLDGEAVPLARREAMDRFLEKNLKIDIRKTCNIVLREDIGEFVHIFSHIRLKLYVELLVLQLKGASLTFYIGITTCYYD

SEQ ID NO: 174974 - protein, 53 aa, Glycine max
  Coding DNA Sequence Number=SeqID_58196
MYAVLPPHEDGHKVVPSDLVAIGNSHLMGECICSIDTRSMKDEVKGLRNNRHT

SEQ ID NO: 174975 - protein, 282 aa, Glycine max
  Coding DNA Sequence Number=SeqID_58197
  Gene Ontology: Mol. function=structural constituent of ribosome; Cellular component=ribonucleoprotein complex; Biological process =translation
  Homolog annotation: Hit_ID=Q6UNT2; Match level="QueryCoverage=94%, HitCoverage=94%, E-value=1e-119, Identity=76%"; Hit description=60S ribosomal protein L5
  Pfam annotation: Domain name=Ribosomal_L18p; Domain location=26-172; Score=252.3; E_value=9.9e-73; Accession=PF00861.12; Description =Ribosomal L18pL5e family
MVYVKAQKSKAYFKRYQVKFKRRREGKTDYRARIRLINQDKNKYNTPKYRFVVRFSNKDIVAQIISASIAGDIVLAAAYAHELPQYGLEVGLTNYAAAYCTGLLLARRVLNTLEMDEEYEGNVEATGEDYSVEPAESRRPFRALLDVGLIRTTTGNRVFGALKGALDGGLDIPHSDKRFAGFDKEKKELDAEILAEDEPEKYQSHFSEYIKRGIEADGIEALYKKVHAAIRADPTLKKSDKQPPKEHKRYNLKKLTYEERKAKLIARVASLNSAADNDEDDE

SEQ ID NO: 174976 - protein, 388 aa, Glycine max
  Coding DNA Sequence Number=SeqID_58198
  Gene Ontology: Mol. function=protein binding; Cellular component =cytoplasm; Biological process=protein modification process
  Homolog annotation: Hit_ID=Q53LU3; Match level="QueryCoverage=95%, HitCoverage=95%, E-value=9e-92, Identity=45%"; Hit description=F-box protein family, AtFBL12, putative
  Pfam annotation: Domain name=LRR_1; Domain location=115-142; Score =6.7; E_value=16; Accession=PF00560.23; Description=Leucine Rich Repeat
  Pfam annotation: Domain name=LRR_1; Domain location=167-190; Score =2.6; E_value=92; Accession=PF00560.23; Description=Leucine Rich Repeat
  Pfam annotation: Domain name=LRR_1; Domain location=193-216; Score =4.3; E_value=44; Accession=PF00560.23; Description=Leucine Rich Repeat
  Pfam annotation: Domain name=LRR_1; Domain location=266-293; Score =0.3; E_value=2.5e+02; Accession=PF00560.23; Description=Leucine Rich Repeat
  Pfam annotation: Domain name=LRR_1; Domain location=318-341; Score =1.3; E_value=1.6e+02; Accession=PF00560.23; Description=Leucine Rich Repeat
  Pfam annotation: Domain name=LRR_1; Domain location=344-366; Score =10.1; E_value=3.7; Accession=PF00560.23; Description=Leucine Rich Repeat
  Pfam annotation: Domain name=LRR_1; Domain location=89-110; Score =6.3; E_value=19; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=115-142::167-190::193 -216::266-293::318-341::344-366::89-110
MGDLSRNDCTSIMHLPDDCLVIIFHGLDSRIDRDSFGLTCRRWLHVQDFNRQSLQFECSSTALRPLSSSTKGFDIHTFHLHRLLRRFQHLKSLSLSNCSELSDSGLTRLLSYGSNLQKLNLDCCLKVTDYGLSLVASGCPSLMSISLYRCPGITDKGLDTLASACLSMKYVNLSYCSQISDNGLKAITHWCRQLQAINISHCEGLSGVGFEGCSKTLAYVEAESCKLKQEGVMGIVSGGGIEYLDVSCLSWSVLGDPLPGIGFASCLKILNFRLCRTVSDTSIVAIAKGCPLLEEWNLALCHEVREPGWRTVGLYCRNLKRLHVNRCRNLCDNGLQALREGCKNLSILYLNGCVRLTSVALELFKCQRANVCIKDIEIMCIKPYWEFR

SEQ ID NO: 174977 - protein, 282 aa, Glycine max
  Coding DNA Sequence Number=SeqID_58199
  Gene Ontology: Mol. function=structural constituent of ribosome; Cellular component=ribonucleoprotein complex; Biological process =translation
  Homolog annotation: Hit_ID=Q6UNT2; Match level="QueryCoverage=94%, HitCoverage=94%, E-value=1e-118, Identity=76%"; Hit description=60S ribosomal protein L5
  Pfam annotation: Domain name=Ribosomal_L18p; Domain location=26-172; Score=253.8; E_value=3.5e-73; Accession=PF00861.12; Description =Ribosomal L18pL5e family
MVYVKAQKSKAYFKRYQVKFKRRREGKTDYRARIRLINQDKNKYNTPKYRFVVRFSNKDIVAQIISASIAGDIVLAAAYAHELPRYGLEVGLTNYAAAYCTGLLLARRVLKTLEMDEEYEGNVEATGEDYSVEPAESRRPFRALLDVGLIRTTTGNRVFGALKGALDGGLDIPHSDKRFAGFDKEKKELDAEILAEDEPEKYQSHFSEYIKRGIEADGIEALYKNVHAAIRADPTLKKSDKQTPKEHKRYNLKKLTYEERKAKLISRVAALNSAADNDEDDE

SEQ ID NO: 174978 - protein, 100 aa, Glycine max
  Coding DNA Sequence Number=SeqID_58200
MDDAKYMKTPMHLTNVLGLDEKSKKVGKKSKKVEEKTYREMIRSILYLTTSRLDIMFSVCFCAIFQKELGKFIYLLSNTYLEIEWNEKALVQDVTLLVDV

SEQ ID NO: 174979 - protein, 144 aa, Glycine max
  Coding DNA Sequence Number=SeqID_58201
  Gene Ontology: Mol. function=DNA binding; Biological process=DNA integration
MKKAFVFLQSEVIARESLKMISLKIFVKRMCFILNTKDNLGKFDSKCDFGLLHGYFESSKAYKVYNSRILTVEGAIHVKFYDNKSNTTMSELDESFAEMKIENMAKSSIASCQDKPASNTLVDDHPEEVREPTGCLLRKHHSES

SEQ ID NO: 174980 - protein, 166 aa, Glycine max
  Coding DNA Sequence Number=SeqID_58202
MADAKFAGLLGLGKPLVEILPPGQLRGFCPLLAWLGSAVLGYGPVLSFGLVGPLLPPVISFVARILPTLACAPLAKSGRIKATRAESQWIVAARPLCHLQYPVAYLSRLQRILPAARWELRFKASRRANPPHEGHQRHVPFGGAEALLLLVGKRTAGARVASSPEF

SEQ ID NO: 174981 - protein, 271 aa, Glycine max
  Coding DNA Sequence Number=SeqID_58203
  Gene Ontology: Mol. function=nucleic acid binding; Cellular component= intracellular
  Homolog annotation: Hit_ID=Q9SHG6; Match level="QueryCoverage=94%, HitCoverage=30%, E-value=1e-50, Identity=46%"; Hit description =Similar to tuftelin-interacting protein
  Pfam annotation: Domain name=G-patch; Domain location=197-240; Score =71.2; E_value=3.3e-18; Accession=PF01585.13; Description=G-patch domain
MDEDQEMERFGTENDYEGGQWIGGEFYYKNRKEKRTQTKDDVLYGVFADSDDNDDDDYPSRKRRKDFSKKPDLTKPVNFVSTGTFMPNQEIDNKSKEQDEKDGYVSEDRPGLGLGFGMGSGLGFNSGNAVKGSNRNDDSDENDDDGFLPTAFGKKIKEGAMRREKERERERLEKKRGKHQSVGQDVSGDVGKFEKHTKGIGLKLLEKMGYKGGGLGKNEQGIVAPIEAKLRAKNSGIGFNESKETMLLPVLQQEKKNVPEITQPVVGRTKE

SEQ ID NO: 174982 - protein, 107 aa, Glycine max
  Coding DNA Sequence Number=SeqID_58204
  Subcellular localization annotation: CTP_CleavageSite=38; ConfidenceScore=5.09e-01
MALNISSRFFTIVALAFLVIMQGTLGFTGSRKCLRNIRLRQEGGLRTIGRFELVYGRVEVKAARFLDLAQFLTKLHKISSTSSNVDNRSKEQLCACKVYVAGHLALG

SEQ ID NO: 174983 - protein, 149 aa, Glycine max
  Coding DNA Sequence Number=SeqID_58205
  Homolog annotation: Hit_ID=O04892; Match level="QueryCoverage=34%, HitCoverage=14%, E-value=1e-09, Identity=69%"; Hit description =Cytochrome P450 like_TBP
DRVKFLNRDVAADGNVRESGDVGGGPGKSYLFCLTACPPWKRLSRRTECLPRPVVLITASGLQGEQPLVDGTIPEPVGCRWTARAASAARAGRRVPVGGRIGNGPFGASSPGVEQSTQNCETTAKGTGLAESAGKEDPVELDSSSDFVK

SEQ ID NO: 174984 - protein, 150 aa, Glycine max
  Coding DNA Sequence Number=SeqID_58206
  Homolog annotation: Hit_ID=Q1STZ2; Match level="QueryCoverage=57%, HitCoverage=19%, E-value=6e-08, Identity=37%"; Hit description=IMP dehydrogenase/GMP reductase
MANHEEWVPFVDVLALLIFGVVLFPNMDGGRTSGDYPKIPLIGTRGCIIYNPALAIRQLGYPMRGAPAEESLSPFLVRDFGAQSFKVIQRVHMVWESLLRKDKELRGIRNGIIGGYHEWLKVRTRGLDWLSKLKIINGENFEAPEEDEEV

SEQ ID NO: 174985 - protein, 234 aa, Glycine max
  Coding DNA Sequence Number=SeqID_58207
AIKNLDSMTLKELLGILKVYEQELAQDEGTKKGQSLALTIQRPKRNSASKKLSSKALSINDALEKEFDDDDSDSEDDELSLTTRKIRKMWKNKNSSKFSGLSKRSFHKKEKSPIICYNLMSTWEDLDDSSSDEDSEKETNLCLMAYASTSKVELALDASLDDEDPLPNDIVNFDGEEDLKKAHQVHLVDFVLETKMPGSAQDAFVCEEFKAPLDEKVSSGCKNLLKDIQDLEET

SEQ ID NO: 174986 - protein, 81 aa, Glycine max
  Coding DNA Sequence Number=SeqID_58208
DRARRTPSGPEEVQQGLEFYGVSVAPSKIIRPPTNRAFIKKYYVPRQAQGKTPQQPGDGRQRSTEAPQSPLEFTSAHRQKG

SEQ ID NO: 174987 - protein, 110 aa, Glycine max
  Coding DNA Sequence Number=SeqID_58209
MEWFFQISHPFMIPIQASDQPRHAPAPDHEDYMQPDIPQVPVAFDPPQHAVDDYEGYEAIAERLERVLNLRMVTAGTKLHDIMQDCLRIVRGGASTDGSVRARQRRHTKL

SEQ ID NO: 174988 - protein, 353 aa, Glycine max
  Coding DNA Sequence Number=SeqID_58210
  Homolog annotation: Hit_ID=UPI00005F7F94; Match level="QueryCoverage =96%, HitCoverage=34%, E-value=1e-126, Identity=65%"; Hit description= COG4457: Uncharacterized protein conserved in bacteria, putative virulence factor
MPALSAWFGADWAVVIAFIVGAGSQGIEFQLQMVRRDGAAVGQQRLRDPDAFRALFGTGGNGQSQGDHRVAGQFARQLGVIDGQRIERRGRPAFVVQLAEAQAQRAAQLEAAGGVEREVGAIQIDVAVIDVIVRQHVVAVQHAQVANGGVRLEIADVEVKALQPQVDRQQAQHGAHRGGGFRVVDAAAFVERVPAAGVVALERQNAAGGQRLQVAQQRLHAGETRRAAGQQQHVAGIQRHHLGQQAQAAADADAIGQEGGVQIGQADHQRGVQNLEGVAVGFALHLAVDKRQHLRRRRLRQQIAQAGGDFRPAVQRVVFFIGAEQRAPGGHENLQRGLLTQGGKPVHTPFVAE

SEQ ID NO: 174989 - protein, 124 aa, Glycine max
  Coding DNA Sequence Number=SeqID_58211
MHKALRANAPLPYPQLVTLFLHHFQIPLDDEPFVQVKRSFAIGAGAVTSFGYRKDRNGQWLKKDALPPQDERTPSPPPQRDDSALMTEVLSELRGLRTYVGERFDSWIIALPEWISVSHSLKKM

SEQ ID NO: 174990 - protein, 100 aa, Glycine max
  Coding DNA Sequence Number=SeqID_58212
MPDRRKEAIPLFWVLSFYGENNRSGQDLGTRIRSSEAKKEWSSRNTKEVLGGEGGNCGKPRRVGVIHRRISMTSVWDNTISKCRRAGGSSSDRCLSCLSP

SEQ ID NO: 174991 - protein, 77 aa, Glycine max
  Coding DNA Sequence Number=SeqID_58213
  Gene Ontology: Mol. function=transporter activity; Cellular component= outer membrane-bounded periplasmic space; Biological process=transport
  Homolog annotation: Hit_ID=Q13Q42; Match level="QueryCoverage=88%, HitCoverage=26%, E-value=8e-16, Identity=58%"; Hit description=ABC lysine/arginine/ornithine transporter, periplasmic ligand binding protein
MASSRFTARLRQTLALAVLAGCAFGAQAKIDQVRFAVDPTYPPFESKTPQGKLVGFDIDLGNALCAQMQAKCVWVES

SEQ ID NO: 174992 - protein, 162 aa, Glycine max
  Coding DNA Sequence Number=SeqID_58214
  Gene Ontology: Mol. function=aminoacyl-tRNA ligase activity
  Homolog annotation: Hit_ID=Q5PHE2; Match level="QueryCoverage=88%, HitCoverage=82%, E-value=3e-58, Identity=74%"; Hit description =Hypothetical protein yeaK
  Pfam annotation: Domain name=YbaK; Domain location=17-160; Score =152.8; E_value=9e-43; Accession=PF04073.5; Description=YbaK  prolyl -tRNA synthetases associated domain
METSMTTHEKLLALLDQHNARYRLMEHEATGKCEAVAAIRGTEVGQGAKALVCHVKGNGIKQHVLAVLPADQQADLSKVAAAVGGRRASLASPAEVDALTGCVFGAIPPFSFHADLQLVVDPLLFERYDEIAFNAGLLEKSVVLQVEDYRALHNGNVMKIIL

SEQ ID NO: 174993 - protein, 88 aa, Glycine max
  Coding DNA Sequence Number=SeqID_58215
MKSADKREYHIVIRTFHQPGANESVDAQRLISSSAPSVILTHEVRFTLVVRRYSSPTTHEILLCWAGTIKFDSAWKHRGYPILSLSRH

SEQ ID NO: 174994 - protein, 108 aa, Glycine max
  Coding DNA Sequence Number=SeqID_58216
MNEKVKVILWMNALLTPKLWNPRKTMNCWQPNPITSLESPSDEYLSVHWCMIGDEMQRTFPLDLMMKSVHFQVKRRLSFEMQKVEIGLSSAIRLSAYPPLSVASPRLA

SEQ ID NO: 174995 - protein, 52 aa, Glycine max
  Coding DNA Sequence Number=SeqID_58217
MEDAPISPRVSLSPKVIIISKKQNHQEFKIPETDPGYPESEHPPHLSSEVLE

SEQ ID NO: 174996 - protein, 106 aa, Glycine max
  Coding DNA Sequence Number=SeqID_58218
  Homolog annotation: Hit_ID=Q5PCZ5; Match level="QueryCoverage=70%, HitCoverage=19%, E-value=3e-07, Identity=39%"; Hit description =Hypothetical protein yciW
ADRIGQQGMAQVACRLKHWLKALQQRLQGAGFLLQAEQKTVINMSGFGNQGSSSGRMRASLAFIKPVVMAGRTAVFHGHSFRKKRTECTTGKSEKRIATQGLAYRR

SEQ ID NO: 174997 - protein, 70 aa, Glycine max
  Coding DNA Sequence Number=SeqID_58219
MTRNSPKKHNEEHWRYTCVAIPYGEKHTDLEGATIINGEKHADLEGAAIANGETVDVDAVSLLPLTRSIT

SEQ ID NO: 174998 - protein, 656 aa, Glycine max
  Coding DNA Sequence Number=SeqID_58220
  Gene Ontology: Mol. function=4 iron, 4 sulfur cluster binding; Cellular component=formate dehydrogenase complex; Biological process= electron transport
  Homolog annotation: Hit_ID=Q6D5S6; Match level="QueryCoverage=98%, HitCoverage=83%, E-value=0.0, Identity=74%"; Hit description =Putative molybdopterin oxidoreductase
  Pfam annotation: Domain name=Molybdopterin; Domain location=1-449; Score=-11.0; E_value=6e-10; Accession=PF00384.12; Description =Molybdopterin oxidoreductase
  Pfam annotation: Domain name=Molydop_binding; Domain location=533 -641; Score=52.3; E_value=1.6e-12; Accession=PF01568.11; Description =Molydopterin dinucleotide binding domain
  Pfam module annotation: Pfam domain module=Molybdopterin::Molydop _binding; Domain location=1-449::533-641
MRYNSATDHYEPISWDDAFALIAQHLQAMDHPDQLELYTSGRASNEASWLYQLFGRVLGTNNFPDCSNMCHEASGTGLKRSIGVGKGTIRLDDFDHADAIFVFGQNPGTNHPRMLHSLRHAADHGARIVTFNTLRERGLERFADPQKPLEVVTSMAGNISSAYYQPNLGGDMAAVRGMVKALLEEQRKRLAAGEKGIFDQAFIDANTQGVEQYLAAVDDTRWEQIVQQSGLSEAQIREAAAIYQSAERVIITWAMGITQHKHSVDTVREIVNLQLLFGQLGKQGAGLCPVRGHSNVQGNRTMGIDEKPSKAFLDALGAHFAFEPPREHGHNTVEALNAMLRDEVKVLIALGGNLAAAAPDSPVTEEALQHCGLTVHISTKLNRSHLVPGHEGLILPTLGRTERDRQASGNQFITVEDSFSMVHASEGVGIPLAETQRSETAIVAGIAHATLGSDHIDWLGMAADYNVIRDHIAATIPGFADFNRQCDIPGGFYLGNAAAELRFNTPSRQAEFSAAALPTSLFPQLGNDVEVPFTLQTLRSHDQYNTTIYGLDDRYRGVYGQREVVFIHPDDMASLGFSEGQLVDIETLWNDGLTRRVSGFKLVPYNIPRGNLAAYYPETNPLVPLSSYGDGSGTPTSKSVPVKLALTAAAPTQRIA

SEQ ID NO: 174999 - protein, 70 aa, Glycine max
  Coding DNA Sequence Number=SeqID_58221
MECGFHVGDSSSHLSIGFFENEGGVDGRRRKVVWRRSVGLMQWLVKTCSWWHMNEFGNCRAVNASSEDWT

SEQ ID NO: 175000 - protein, 47 aa, Glycine max
  Coding DNA Sequence Number=SeqID_58222
MSRSAPSSSRLFILNEELEMLFATVPKLTNEEHEEWCEMAKMILKVA

SEQ ID NO: 175001 - protein, 44 aa, Glycine max
  Coding DNA Sequence Number=SeqID_58223
MVCSLWPMFVDYVKDTWIISQKEKFVTVWTNKVMHLGSNLLTGL

SEQ ID NO: 175002 - protein, 251 aa, Glycine max
  Coding DNA Sequence Number=SeqID_58224
  Gene Ontology: Mol. function=nucleic acid binding; Biological process= DNA integration
  Homolog annotation: Hit_ID=Q1T010; Match level="QueryCoverage=94%, HitCoverage=29%, E-value=1e-28, Identity=43%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=128-251; Score =13.5; E_value=0.00044; Accession=PF00665.16; Description=Integrase core domain
  Pfam annotation: Domain name=zf-CCHC; Domain location=55-72; Score =20.1; E_value=0.00048; Accession=PF00098.13; Description=Zinc knuckle
  Pfam module annotation: Pfam domain module=rve::zf-CCHC; Domain location=128-251::55-72
MVERTRRRDQRKENTQKETGKISKRRKKNQNPLTRDLGRIQMVKMGKNGYDKRKVQCFNCEKYGHYADECWFKKGKSSRNNNEEANVSQEHESDFDPIFLMMTTSEGKSHSENWDWLIEFDPSKKTQIKLADSKSLMVEGIGKIVIQRKDGKASMIEEVLFVPDEYIRMMWLYKIKHKSDVFEIPQKFKTMAERQSEKKLKILRTDRGGEYISRKVESFCKKMSIQHEVTAPYTLQHNGLVERRNRRILNM

SEQ ID NO: 175003 - protein, 305 aa, Glycine max
  Coding DNA Sequence Number=SeqID_58225
  Gene Ontology: Mol. function=nucleic acid binding; Cellular component= beta-galactosidase complex; Biological process=DNA integration
  Homolog annotation: Hit_ID=Q1T010; Match level="QueryCoverage=99%, HitCoverage=22%, E-value=2e-94, Identity=53%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MKSEFEMSNQELMKSEFEMYDLGTLTYFLGLEFLYTNKGILMHQRKYTTNMLKWFKIMDCNHTITPSKLYSRNEDIEDEERVDPTHYKKLIGSLRYLCNSRPDLSFTIGVASRHMHERRKSYLIVAKRILRYLKGTKDLGIQFPKNTNEKMDELIGYCDSDWCGDKFDRRSTTGYLFMLAGAPISWCSKKQLVVALSSCEAKYIVGTNASCQAVWLDSLLKGIKVKVKRPLHLMIDNQSTINLAKNPIAYGRSKHTETKFHFLREQVKKGIIEVTYCPTQDQPADVLTKPVKVYWFLKKRDELGV

SEQ ID NO: 175004 - protein, 103 aa, Glycine max
  Coding DNA Sequence Number=SeqID_58226
MCWFRIGSKIPLAIYTLGMIAKYLDVLEIPRCAHVQFLAPQNALSMHVCKFSQGDVCDVVCHFCFKSSVPLVKLTFQMFAFAGNGPKEACLKEVQEGQGSRRN

SEQ ID NO: 175005 - protein, 174 aa, Glycine max
  Coding DNA Sequence Number=SeqID_58227
  Gene Ontology: Mol. function=oxidoreductase activity, acting on the aldehyde or oxo group of donors, disulfide as acceptor; Biological process=metabolic process
  Homolog annotation: Hit_ID=UPI000066CBFB; Match level="QueryCoverage =99%, HitCoverage=21%, E-value=7e-71, Identity=75%"; Hit description =(pyruvate) Oxoisovalerate Dehydrogenase Alpha and Beta Fusion
MSYLGRREVLTGKAKFGIFGDGKELPQLAMAKVFRNGDFRSGYYRDQTFALSVNALTVESFFAQLYADTSVEREPASAGRQMNGHFATRSLHEDGSWKNLMAQKNISSDISPTAGQMPRLLGLAQASKIYKSVQFEGSEKFSNNGNEIAFGTIGDASTAEGHFWETLNAACALQ

SEQ ID NO: 175006 - protein, 76 aa, Glycine max
  Coding DNA Sequence Number=SeqID_58228
MGGAVTLLDIPGGGNKVVMWDATLFGLFNEDFPLYIKHEDLSEIALGGQCQSISITQLWIRAHWQMVVILPNGGIL

SEQ ID NO: 175007 - protein, 80 aa, Glycine max
  Coding DNA Sequence Number=SeqID_58229
MANEELKLQDPRCRIQCPDILPENTGVAVQCKIKIFQKKIDLLQHQGVAAQNRTRLYNHGGCTSSVPSPGLKSYFVSFGT

SEQ ID NO: 175008 - protein, 133 aa, Glycine max
  Coding DNA Sequence Number=SeqID_58230
MSDESSMERSVWMEMLSMTTTGLINVFVLLLLLEKLYQFIVVFNPKGLYWYCMLPCTSQVSYSSLNRESPYDLLVQVVCWSKDIWADGVFETLEGFILLNSYITRKNISSNILSSFYMFKIYLYSVMINIFWE

SEQ ID NO: 175009 - protein, 915 aa, Glycine max
  Coding DNA Sequence Number=SeqID_58231
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=95%, HitCoverage=64%, E-value=0.0, Identity=44%"; Hit description=Chromo
  Pfam annotation: Domain name=Chromo; Domain location=816-870; Score =31.2; E_value=3.6e-06; Accession=PF00385.14; Description='chromo' (CHRromatin Organisation MOdifier
  Pfam annotation: Domain name=rve; Domain location=513-669; Score =124.1; E_value=3.9e-34; Accession=PF00665.16; Description=Integrase core domain
  Pfam annotation: Domain name=zf-H2C2; Domain location=454-495; Score =7.8; E_value=0.033; Accession=PF09337.1; Description=His(2)-Cys(2) zinc finger
  Pfam module annotation: Pfam domain module=Chromo::rve::zf-H2C2; Domain location=816-870::513-669::454-495
  Subcellular localization annotation: CTP_CleavageSite=33; ConfidenceScore=5.45e-01
MQFYHNGVLVTLPGTTSPSLSLATLPQLNRMIHTASVATLHTITMLPVDSSPPPSTPQTHSLSRDEQPTLASFHPDITQVLHRYSPIFSIPHGLPPNRPHDHHIHLKPHSNPINIKPYRYPHFQKESMTSMIADMLQQGIIRPSTSPYSSPVLLVKKKDGPTWSAHQIHLQQVLRLLLDNHFYAKLSKCNFGVCSVDYLGHIISGNGVHADPTKVQDILAWPTPKSLTALRAFLGLTGFYRRFVQHYATIAGPLTDLLKAPTLMWTSKAEEAFTKLKHAMTNLPVLALLDFNLPFEVTTDASSVAVGVVLSQQGHPIAYFSRKMCPRLCSSSAYFRIYTDHKSLKTLLTQTIQTPKQQKWLTKLIGYNFEIHYKPGKENLVADALSRVLEASTGLCATQFYATHPAGKQLITKLCESSTMQRNFSYRAGILYFQERIFIPREAAIIPSLLEEYHSSPLGGHSGIKATISRLSAVFYWPGMYADVKNFINSCSICHYNKYSTQPLYGLLQPLPVPQQVWEDISMDFITNLPASSNKTVIWVVVDRLTKYAHFIALPTHFTTSYLASMFLSEIHRLHGTLKTIVSDRDRIFISKFWKELFKSLGTTLAFSSSYHPQTDGQIEVLNRCLETYLRCFFSEEPQQWTRFLSLAEFWYNTSHHSAIGMTPFEALYGRAPPSLTSYVAGSSKIAAIDENFAKRSDILQLLKNNLHRAQHRMIQQVNSKRKDKEFAEGDWVYLKLQPYRQVSVHRRSSQKLAKRFYGPFRILHRIGPVAYELELPSTVRIHPVFHVSLLKPCIKTPDTQILPLPVTVVVAPSGTKPQAIIGRRTIPQEHDSREEVLVHWEGQMPAEATWESRAAIVRSFPDFDLKGKIYFGDMGNDTNRPEIEHEPISNSGPSIAANRPKRIVKPPAHHKYYV

SEQ ID NO: 175010 - protein, 129 aa, Glycine max
  Coding DNA Sequence Number=SeqID_58232
  Gene Ontology: Mol. function=DNA binding; Cellular component =nucleosome; Biological process=chromosome organization and biogenesis (sensu Eukaryota)
  Homolog annotation: Hit_ID=UPI000065E2E5; Match level="QueryCoverage =63%, HitCoverage=53%, E-value=1e-38, Identity=97%"; Hit description =Homolog of Homo sapiens "Histone 1, H2ai
  Pfam annotation: Domain name=CBFD_NFYB_HMF; Domain location=28-91; Score=5.0; E_value=0.053; Accession=PF00808.13; Description=Histone -like transcription factor (CBFNF-Y) and archaeal histone
  Pfam annotation: Domain name=Histone; Domain location=25-94; Score =67.1; E_value=5.7e-17; Accession=PF00125.14; Description=Core histone H2AH2BH3H4
  Pfam annotation: Domain name=TAF; Domain location=28-92; Score=-6.7; E_value=0.023; Accession=PF02969.8; Description=TATA box binding protein associated factor (TAF)
  Pfam module annotation: Pfam domain module=CBFD_NFYB_HMF::Histone::TAF ; Domain location=28-91::25-94::28-92
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGVWNRWFECAGTKIEPGRHFNERDVIRF

SEQ ID NO: 175011 - protein, 396 aa, Glycine max
  Coding DNA Sequence Number=SeqID_58233
  Gene Ontology: Mol. function=RNA-directed DNA polymerase activity; Cellular component=chromatin; Biological process=chromatin assembly or disassembly
MNTRSQDLQQLQESIAALTTAFQEFKVHQDQRHESYLSNFEHLQTKSDSSSSSSTQPTDQTIKLPKLILQPFDGSNPMEWLFQAEQFFNHYSITPTQRLSRISCYMTGDALGWYQWMHNNHLISTWEEFTRAMELRFGPSAYENHQQALFKLQQTATVPEYQRDFERLCNRVTSLPHHSILDCFISGLRPEIQHELAILQPVTISQAIGLAKLVESKLLASKTSFTYSPRPTQPKSIPPLLPNPPPQPRLIQHPSQSLLALPAPPSPKPTTPQIRLLSKTEMDDRQAKGLCFNCDERYHRGHRCKNKGMLQLLSPDDPPDPHSDPISADVPPLTNSETTPPTPSAFLLHSETPPTYTNPEQFHLSLQAVSGQPSPRTLRFYARINGHYVSVLVDIG

SEQ ID NO: 175012 - protein, 71 aa, Glycine max
  Coding DNA Sequence Number=SeqID_58234
MVLLQTLRGSILKFKKSYSLGLSNSWWKERICCITCFLLVSLCQQKSREETFKCFEGKLRQKVKEKALKKN

SEQ ID NO: 175013 - protein, 49 aa, Glycine max
  Coding DNA Sequence Number=SeqID_58235
  Gene Ontology: Mol. function=hydrolase activity; Cellular component =mitochondrion; Biological process=metabolic process
  Homolog annotation: Hit_ID=Q1STY4; Match level="QueryCoverage=90%, HitCoverage=14%, E-value=5e-16, Identity=88%"; Hit description=HAD -superfamily hydrolase subfamily IA, variant 3; Epoxide hydrolase N -terminal domain-like phosphatase
MHHVVLGDDPEVKQGKPSPDGFLAAAKRFEDGPVDPFNILVFENAHVKP

SEQ ID NO: 175014 - protein, 218 aa, Glycine max
  Coding DNA Sequence Number=SeqID_58236
  Gene Ontology: Mol. function=phosphoinositide phospholipase C activity; Biological process=intracellular signaling cascade
  Homolog annotation: Hit_ID=Q1SP02; Match level="QueryCoverage=64%, HitCoverage=29%, E-value=3e-23, Identity=42%"; Hit description=IMP dehydrogenase/GMP reductase
MRGATNHEPPSTVEGASSASTVEVSTTVLSAIDVGVGKLGGAYGSDIEVCLGSATNVHVVYLEALRDLSITERYARGVAALVHMYDQLNDASMSHSRQLGGYITLLQCWIYEHFPSVAESTADQDYDEASPRACRWIATKKTMKSIRTPAYRERLDRLRIPDVCWIPYGEHWEVWDFHVRSCYSGLLRWGPVAVYYRPERVVRQFGYTQTIPAPPVDS

SEQ ID NO: 175015 - protein, 78 aa, Glycine max
  Coding DNA Sequence Number=SeqID_58237
  Homolog annotation: Hit_ID=Q1T1H4; Match level="QueryCoverage=91%, HitCoverage=54%, E-value=2e-10, Identity=45%"; Hit description =Ankyrin
MVGNNGIPGNLPVLEGIKNWDKWCSQMRVLFSFQGLVDVVEKGIRALSESETKAQIAAYREELKIDGRALFLIHQCMD

SEQ ID NO: 175016 - protein, 80 aa, Glycine max
  Coding DNA Sequence Number=SeqID_58238
  Gene Ontology: Mol. function=ribonuclease H activity; Biological process=DNA integration
IKNAFNKNVRPCKFNEGDLVLKKISHAAKDNRGKAFSRGALVLTNMDGEELPSPVNSDVGQNHLRQWSDVGTKLKAETNQ

SEQ ID NO: 175017 - protein, 116 aa, Glycine max
  Coding DNA Sequence Number=SeqID_58239
MALTIPQLFLKPLQVMWDATIFGVFNENFPLYIKHEDLSEITHGGQCLNISVIQFWILGHWQMVVILPKENLVVWFCSLHNRPDNYLKGIINSALKGLDDTPQPKSKVAARWIVVK

SEQ ID NO: 175018 - protein, 159 aa, Glycine max
  Coding DNA Sequence Number=SeqID_58240
MDIGIGLAKSQAIISLAGLQDAPHPKAFGKCVFRATKLSSGRNIIYIDENLEASWPTAKGNDSTLSYKLRERFSTTFPKFTEQYDPTSLINYSDLCLIVESSIAEEKVNEEFDYFLNYLRNNWETPINLVFSYLEKYIDGGDLVGYNDGGIAIITDLHA

SEQ ID NO: 175019 - protein, 101 aa, Glycine max
  Coding DNA Sequence Number=SeqID_58241
  Gene Ontology: Mol. function=transition metal ion binding; Cellular component=cytoplasm; Biological process=fucose metabolic process
MDIEYQKIHACPNDCILYRHEFEELSKCPRCGVPRYKVKDDEDCSSDENPKKGPPVKVLWYLPIVPRFKCLFANGDDAKDLTWHAKGTNYDGMVLHLADCS

SEQ ID NO: 175020 - protein, 88 aa, Glycine max
  Coding DNA Sequence Number=SeqID_58242
  Gene Ontology: Mol. function=solute:hydrogen antiporter activity; Cellular component=integral to membrane; Biological process =regulation of pH
  Homolog annotation: Hit_ID=Q2HVU5; Match level="QueryCoverage=92%, HitCoverage=11%, E-value=2e-13, Identity=45%"; Hit description =Na+/H+ antiporter-like protein
  Subcellular localization annotation: CTP_CleavageSite=53; ConfidenceScore=5.28e-01
MARVRRIHLSTSLNTMAIMAVPSMMRARTGKVVKEITTHMKIRNRAKSTSLVPATILQRIRARPMPKTKGRDIPPTVMFKALFCSGET

SEQ ID NO: 175021 - protein, 93 aa, Glycine max
  Coding DNA Sequence Number=SeqID_58243
  Homolog annotation: Hit_ID=O64438; Match level="QueryCoverage=44%, HitCoverage=17%, E-value=2e-13, Identity=80%"; Hit description=ARG10
MFCLFQHITRCFYSTAVGGLRCYENPKNKITAVPAEEEQIWGAFFRNRESVISPNSNIRLMSVETALGTNGKCEVRDNRIGVHKKPTHTAKFH

SEQ ID NO: 175022 - protein, 175 aa, Glycine max
  Coding DNA Sequence Number=SeqID_58244
MEDEGDWLYSSEWWGSDSDDGHSVLRSTSGKGNGVVAVVAYPSSRPSKMHWSGMERWLQQRCEEVHPGYKDGGKLRILGYQWRVLRFNEVTRQSTAKVMAAYRENTPGVVYLMQQPHCLAVPLIAIMRCGKIVKIKAAASLLGVILGIFFGGSCLPFDDDYFVGCLELLPDFLSP

SEQ ID NO: 175023 - protein, 364 aa, Glycine max
  Coding DNA Sequence Number=SeqID_58245
  Gene Ontology: Mol. function=magnesium ion binding; Biological process=GTP metabolic process
  Homolog annotation: Hit_ID=Q8ZBM5; Match level="QueryCoverage=99%, HitCoverage=72%, E-value=1e-161, Identity=77%"; Hit description =Deoxyguanosinetriphosphate triphosphohydrolase
MLHPLYRLRIRQPMLGGQLVEQARFDRVSAAAVLAHQLAEVRQRHRQQRAVNVQQAADHPVALQLELLDLRVVEHVLERHIFKYFQQPVRRAGILQQRLIETALIDRVQIVDKALRRMRHQPRHGKHPQIHEELIFRAAPRAAAIDLAKRAGDGLVEQIARRHLAPLLNQVLIQLLDGENALLHRVFQIGHAVRDIVGGLHDIGQRETIELAHVQLAPQPIDEGLFRQIVAGLFHQIAVAGGDVARPVGRAGVFQNAADLRVGQVELQQAVHHADRLGVALEVAEILTDPAAQPVQVALPFMQAQRRHLAAIVAARLAAAAGGIEPLGEPVVDRRLAEVTERRVADVVHQTGHFHDAFKRIEQP

SEQ ID NO: 175024 - protein, 197 aa, Glycine max
  Coding DNA Sequence Number=SeqID_58246
  Homolog annotation: Hit_ID=UPI0000612705; Match level="QueryCoverage =49%, HitCoverage=92%, E-value=2e-12, Identity=31%"; Hit description =UPI0000612705 related cluster
  Subcellular localization annotation: CTP_CleavageSite=56; ConfidenceScore=5.66e-01
VRACSPTKARTCSPLMARTCSPLMAMTCSPLMARTCSPLKVRTCSPLKVRTCSPLKARTGSPLKVRVRDPLMARTCSPLKARACSPLKARTCSPLKIDCPFERGDNSCNLILLSQHALLRTREARLTGAFSKGGKCAESPPMFICGKRRKNRRKPVIKNIPSSGVVFTFKEGISTSHVDKSRALAPTYPPSKRKSDL

SEQ ID NO: 175025 - protein, 140 aa, Glycine max
  Coding DNA Sequence Number=SeqID_58247
  Gene Ontology: Mol. function=peptidase activity
MASSNPLFPEANSIRRPPIFNGEGYHYWKTHMQIFIEAIYLNIWAAIEIGPYIPTVVDVSTSTVEARLHDECDEQKAQRSKNNSRESRTIQEFKNQEEFKTQEESLESRIKIQGSSSQESRSRFKTQDSRMKKILNQHKY

SEQ ID NO: 175026 - protein, 213 aa, Glycine max
  Coding DNA Sequence Number=SeqID_58248
MYNYHEKGRAPNLESVLADFMTYQASSKVDSMQQAFKRAETQIGKLVDDMIKVVVRREKEYVEIETHQESILQVNTIHHQLITKEEKDEVSIILEYPCIATTGYVVGKDKGRLELSAEDQKISFDLFEAMKHPDMSDACFEEEEVEHEITLSASTMLDDPKDNFVGHVVLEELEKIRPTEKPKAELKILPAHLKYVSLEDNETKPVNKLVAPL

SEQ ID NO: 175027 - protein, 76 aa, Glycine max
  Coding DNA Sequence Number=SeqID_58249
MKMQIKHIFSYPKHMRRLKSIPKMDVLDKILYTQGIIIEFNKPIMEYGNSGNESPEMNVERGELLAAIGLATGKRN

SEQ ID NO: 175028 - protein, 137 aa, Glycine max
  Coding DNA Sequence Number=SeqID_58250
MGFRSTSTCPTFEQWTSMKPLRVSPYPEILLQLATSTVGDYPTFCVVEDKCFYQSSLFSLFICTTRELNTYSRCHIHIVPSMNSPSENKPSSSSSSYSPNLVLKLFGFPMTATSSDEDHGKTIECPFCDRKFQNMQA

SEQ ID NO: 175029 - protein, 37 aa, Glycine max
  Coding DNA Sequence Number=SeqID_58251
MSEVTDAVDEEEIIQLEPWVQVIAGLDYVQGRPSIQT

SEQ ID NO: 175030 - protein, 470 aa, Glycine max
  Coding DNA Sequence Number=SeqID_58252
  Gene Ontology: Mol. function=ATP binding; Cellular component =ubiquitin ligase complex; Biological process=electron transport
  Homolog annotation: Hit_ID=Q1S771; Match level="QueryCoverage=73%, HitCoverage=83%, E-value=1e-103, Identity=56%"; Hit description=WD40- like
  Pfam annotation: Domain name=WD40; Domain location=119-155; Score =15.6; E_value=0.18; Accession=PF00400.22; Description=WD domain, G -beta repeat
  Pfam annotation: Domain name=WD40; Domain location=197-235; Score =37.3; E_value=5.2e-08; Accession=PF00400.22; Description=WD domain, G-beta repeat
  Pfam annotation: Domain name=WD40; Domain location=240-277; Score =27.0; E_value=6.7e-05; Accession=PF00400.22; Description=WD domain, G-beta repeat
  Pfam annotation: Domain name=WD40; Domain location=285-323; Score =34.1; E_value=5e-07; Accession=PF00400.22; Description=WD domain, G -beta repeat
  Pfam annotation: Domain name=WD40; Domain location=332-368; Score =36.0; E_value=1.3e-07; Accession=PF00400.22; Description=WD domain, G-beta repeat
  Pfam annotation: Domain name=WD40; Domain location=379-451; Score =3.0; E_value=16; Accession=PF00400.22; Description=WD domain, G-beta repeat
  Pfam annotation: Domain name=WD40; Domain location=66-102; Score =16.7; E_value=0.087; Accession=PF00400.22; Description=WD domain, G -beta repeat
  Pfam module annotation: Pfam domain module=WD40::WD40::WD40::WD40::WD4 0::WD40::WD40; Domain location=119-155::197-235::240-277::285 -323::332-368::379-451::66-102
MGLLQRPLCCHSQQDQQQQPPQSHDHLHFESSTSSSLSSQASLPSIPSLTPQKLHHPEEQPQTTHHKLVTTVKGHTSTIFSLALHGKSLYSASSNGEIRACSRDPTSTELKYISGEQPLPNTTIVVNSNAPIKSLIVSHDKLFTAHQDHKIRVWKTTDQPGNNNNNPNYYKCVASLPTLHDRFSKLFSSENYVEIRRHKKRTWVHHVDTVSALALSQDGSLLYSASWDRTFKIWRTSDFKCLESVKNAHEDAINSLILSNNGIVYTGSADTKIKMWKKLEGDKKHSLIGTLEKHKSAVNALALNSDGSVLYSGACDRSILVWEGDEDNNNNMVVVGALRGHTKAILCLVVESDLVCSGSADNSVRIWRRSVENEKKSYYSCLAVLESHRRPVKCLAMAVDSNSGGGGGGPHEDDDSRRKNDQERENEGRGGEEGGAIVRRSVSSRDGCVINEGISSWEGGGVKVERRENG

SEQ ID NO: 175031 - protein, 77 aa, Glycine max
  Coding DNA Sequence Number=SeqID_58253
  Gene Ontology: Mol. function=carboxypeptidase activity
  Pfam annotation: Domain name=Transposase_21; Domain location=1-75; Score=-123.0; E_value=0.00041; Accession=PF02992.5; Description =Transposase family tnp2
MDVYLSPLIEDLTKLWDEGVAVFDGCRNETFKLCAMLFCTINDFLAYGNLSGYNVLCELAMCDLLDVDVELCGLLLA

SEQ ID NO: 175032 - protein, 60 aa, Glycine max
  Coding DNA Sequence Number=SeqID_58254
MGIVTRDKVDATYYNWKQVPIAQKDLIGEDIQAEFDIPESSDLRTRKKNTLDHKRVVEAV

SEQ ID NO: 175033 - protein, 87 aa, Glycine max
  Coding DNA Sequence Number=SeqID_58255
MSVKNLIRRLEGDQSGSQCFAIMLQPYGINIGVKEHSNRVTPKAYTSKSPPGPLPPDSGPTQKTFQHTDSIYELYKTHDSSIVLKYF

SEQ ID NO: 175034 - protein, 59 aa, Glycine max
  Coding DNA Sequence Number=SeqID_58256
LFASRDEVLHWARLVACDIGFVAVLAKGVVSIGDVNLSRSGSFDTGYGDFDDATSSEGR

SEQ ID NO: 175035 - protein, 68 aa, Glycine max
  Coding DNA Sequence Number=SeqID_58257
  Subcellular localization annotation: CTP_CleavageSite=32; ConfidenceScore=5.51e-01
MSSPLFLPSSLDPRFHHHHRIFYLPPTAPKPSSSSASNITTTTTRTRRKRSKEREKVRALSLCAFFYL

SEQ ID NO: 175036 - protein, 309 aa, Glycine max
  Coding DNA Sequence Number=SeqID_58258
  Subcellular localization annotation: CTP_CleavageSite=37; ConfidenceScore=5.00e-01
MSDPSRGRVTITLGRSGHVVKRDVSAADVSSFSSLHSAGTKRSVRDRIGSNADNSGWYGNGHSGNKRHRGDVSMQNGLDGNDLRLKLMRKSASRQTDSNGNKRHMDLREKLSKASHPLTNSYNSKQHGPESRETSLLRQIPSARSSDDLLRMKSMRSSYSPWTLDHIRRRSPDGFPSTSRGISPQRDVQDLHRRPVSRTYDGVSSVSYVGRDVLETSRPPVSAPQSFMSRSTMSTLPPVTAKPVASHPGQLPPSGSVAQRSSYVRNISHYHLMDIQVDSVVPFWLYHMPVGYENITYSHDCSYSQEDKL

SEQ ID NO: 175037 - protein, 108 aa, Glycine max
  Coding DNA Sequence Number=SeqID_58259
MADEHQQRVTLEDYSNNSVPQFFTSIARPEEKPRGSSTHLRVTGCTIYGEAHEIGQCIPIEENTQEVNYMGNQQRQGYTQGGFSGFQQSPYNQQGQWRSHPGNQFIKD

SEQ ID NO: 175038 - protein, 246 aa, Glycine max
  Coding DNA Sequence Number=SeqID_58260
  Gene Ontology: Mol. function=nucleic acid binding; Cellular component= intracellular; Biological process=regulation of transcription
  Homolog annotation: Hit_ID=Q39264; Match level="QueryCoverage=74%, HitCoverage=85%, E-value=2e-16, Identity=33%"; Hit description=Zinc finger protein 5
  Pfam annotation: Domain name=zf-C2H2; Domain location=78-100; Score =22.0; E_value=0.0022; Accession=PF00096.16; Description=Zinc finger, C2H2 type
MEKDIIDLSPTWDCDNGNSTEKRLRLFGFELNPSSKEGCAKESGEGDESVNSSNSASSGGDKTVQEKTSANDPDERKFECQYCYKEFANSQALGGHQNAHKKERMKKKRLQLQSINRYLQHPFQSNHGFAYPSDTPWFYDPSTYNNNSEFTLCEEPQISFNSNSVLDSNFSNDQKTSWYSLASHPSNIQQDTCMFTFSSNASNNNNSPFIFKPCHFPASNQNHNKTLDLQLGLNLESNTRSSLRRM

SEQ ID NO: 175039 - protein, 322 aa, Glycine max
  Coding DNA Sequence Number=SeqID_58261
  Gene Ontology: Mol. function=metalloendopeptidase activity; Cellular component=proteinaceous extracellular matrix; Biological process =peptidoglycan metabolic process
  Homolog annotation: Hit_ID=Q93Z89; Match level="QueryCoverage=79%, HitCoverage=70%, E-value=1e-101, Identity=73%"; Hit description =Matrix metalloproteinase MMP2
  Pfam annotation: Domain name=PG_binding_1; Domain location=70-132; Score=32.1; E_value=1.9e-06; Accession=PF01471.9; Description =Putative peptidoglycan binding domain
  Pfam annotation: Domain name=Peptidase_M10; Domain location=157-319; Score=58.9; E_value=1.6e-14; Accession=PF00413.14; Description =Matrixin
  Pfam module annotation: Pfam domain module=PG_binding_1::Peptidase _M10; Domain location=70-132::157-319
MVFAESDPVENLAEQRGLTIPSGQLVNDELKTLQTESRSQKPKHPPPPPDYRVQLKSDPPAPNAPPKQINIKGLSVVKDYLSDYGYIESSGPFTDSFDQEIISAIKTYQNFSNLQVTGGLNKQLIQQMLSIRCGVPDVNFDYNFTDDNISYPKAGHRWFPNRNLTYGFLPENQIPDNMTKVFRDSFARWAQASGTLSLRETTYDNADIQVGFYNFTNSRIEVYGGSTIFLQPDSSKKGVVLLDGNMGWLLPSENATLSKDDGVLDLETVAMHQIGHLLGLDHSHKEDSVMYPYILSSQSEQRKVQLSNSDKANIHLQFAKHD

SEQ ID NO: 175040 - protein, 79 aa, Glycine max
  Coding DNA Sequence Number=SeqID_58262
MSEFSNLAHKVENIVNGTMFKEGTSIIVSLTSVDNTTGYKDKGNKERKLLFLNTWENMVEVMEINRTLYDSEEVKNQSP

SEQ ID NO: 175041 - protein, 126 aa, Glycine max
  Coding DNA Sequence Number=SeqID_58263
MRLLLHLPLVKVKKQKGEESREEIYPQKEGQPLMVKEECKEVTVSSKRLAKKEIHFEIKKNIKETSPLRQPPHLFLCKKTLVRTATHLGLEVIPKVKELLDEGLVRKSLNPCALLVRKIGIINMKI

SEQ ID NO: 175042 - protein, 51 aa, Glycine max
  Coding DNA Sequence Number=SeqID_58264
MYGHIVANLRKGGLFLWVTPGAVIEDDEKAWYVEGAARATGGTHPRRMCRQ

SEQ ID NO: 175043 - protein, 43 aa, Glycine max
  Coding DNA Sequence Number=SeqID_58265
MDSQAMKLYKIMDMDEEQGSSVLQQELNGHKLAFVPADIDFII

SEQ ID NO: 175044 - protein, 146 aa, Glycine max
  Coding DNA Sequence Number=SeqID_58266
  Gene Ontology: Mol. function=isomerase activity
  Homolog annotation: Hit_ID=Q3KC63; Match level="QueryCoverage=95%, HitCoverage=55%, E-value=2e-23, Identity=44%"; Hit description =Xylose isomerase-like TIM barrel
MAGDGGQVVADQREFNTARRVGGQVIEQRQPASVRLVRWDGAILLMMRLRRLHMNIADSGGEMARGFFRRIANPQPVSHVESQRHRHLMDPAGGFEALHWRQLAAIGLVIFHHQRHAAGAQNVAQRLQLLVMDEMTEGELQPQGVE

SEQ ID NO: 175045 - protein, 172 aa, Glycine max
  Coding DNA Sequence Number=SeqID_58267
  Gene Ontology: Mol. function=2-dehydro-3-deoxygluconokinase activity; Biological process=D-ribose metabolic process
  Homolog annotation: Hit_ID=Q13Y53; Match level="QueryCoverage=98%, HitCoverage=52%, E-value=1e-56, Identity=63%"; Hit description =Putative sugar (2-ketogluconate) kinase, PfkB family
MAMFVATETGELAEVERFIKRVAGAELNVATGLARLGLKVGWVSRVGNDSFGRFVLNSLAKEGIDARGVAVDERYATGFQMKSKVENGTDPIVEYFRKGSAASHLSTEDFRADYFTSARHLHLSGVAAALSDSSYALLEHAARVMKAEGKTLSFDPNLRPVLWKSEAEMVEN

SEQ ID NO: 175046 - protein, 56 aa, Glycine max
  Coding DNA Sequence Number=SeqID_58268
MNDAIKEQARGLPATMPYQKRKTLDEASLLLSESKTQYDHKSTSTPYGSHRPGYRA

SEQ ID NO: 175047 - protein, 113 aa, Glycine max
  Coding DNA Sequence Number=SeqID_58269
MVLRASHVDLIITFVMHSIVKRKEFALQCPYRTRAKARVMSEIEEAQEHMKADMCGSNAFQDYFDDAKESRVKQVSRIKIKIQDSSKESRLKIQESREDSIKIRIKRVFQNIA

SEQ ID NO: 175048 - protein, 420 aa, Glycine max
  Coding DNA Sequence Number=SeqID_58270
  Gene Ontology: Mol. function=protein serine/threonine kinase activity; Cellular component=cell cortex; Biological process=protein amino acid phosphorylation
  Homolog annotation: Hit_ID=Q10MW9; Match level="QueryCoverage=68%, HitCoverage=58%, E-value=2e-55, Identity=43%"; Hit description =Protein kinase domain containing protein, expressed
  Pfam annotation: Domain name=Pkinase; Domain location=4-261; Score =202.4; E_value=1.1e-57; Accession=PF00069.15; Description=Protein kinase domain
  Pfam annotation: Domain name=Pkinase_Tyr; Domain location=4-261; Score=12.8; E_value=3e-13; Accession=PF07714.7; Description=Protein tyrosine kinase
  Pfam module annotation: Pfam domain module=Pkinase::Pkinase_Tyr; Domain location=4-261::4-261
MVSWVRGKCVGNGAFGVVNVAISKRDNRVFAVKSVDCGRGLSGHQVEALENEIGILKRVASPHVVAYLGDDVTCEGTASFRNLHLEYMPGGTVADLDRADVDERLVRRFAWCLVSALRDVHAQGFVHCDVKGRNVLLSGDGEIVKLADFGTAVEIESSPAEMLLLSRGSPMWMAPEVVRRQRQGPESDVWSLGCTVIEIVTGKPAWEDRGVDTLTRIGYSDELPEFPKQLSELGKDFLEKCLRREHSERWSCDQLLQHPFLLPYYAVAESSPRCVLDWVDSELNSESDCNDRDHQEDVFIKFTNSEEKSVIKNRISKFATESRVNWETQGWIVVREIESNGKPTTTGTETEIEEGACTCECDGVGSSKEGVNWEFHNVAGTGMEYSDSVGVNRGIGKLGGSNTAGGGGGWSCRSTFDALL

SEQ ID NO: 175049 - protein, 78 aa, Glycine max
  Coding DNA Sequence Number=SeqID_58271
MARRGGQASSGVRGGPPFNGLEGVGKREAPGVAPVAGAPPIALSPRVLADAPASGALPATPSCAAPVPRVMCTVEAPV

SEQ ID NO: 175050 - protein, 97 aa, Glycine max
  Coding DNA Sequence Number=SeqID_58272
MVSRGIIPFEEHTAAVGTTSNNRFSKRKTLDEGSRKANKGVSHGKTLHKIKWPNSLKTIPSGVANCRNLPFDGRATRDSRDACSTKGIRAESPPTFI

SEQ ID NO: 175051 - protein, 1231 aa, Glycine max
  Coding DNA Sequence Number=SeqID_58273
  Gene Ontology: Mol. function=binding; Cellular component=clathrin vesicle coat; Biological process=intracellular protein transport
  Homolog annotation: Hit_ID=Q2RBN7; Match level="QueryCoverage=95%, HitCoverage=69%, E-value=0.0, Identity=89%"; Hit description =Clathrin heavy chain, putative, expressed
  Pfam annotation: Domain name=Clathrin; Domain location=224-366; Score= 98.3; E_value=2.2e-26; Accession=PF00637.10; Description=Region in Clathrin and VPS
  Pfam annotation: Domain name=Clathrin; Domain location=371-510; Score= 127.6; E_value=3.5e-35; Accession=PF00637.10; Description=Region in Clathrin and VPS
  Pfam annotation: Domain name=Clathrin; Domain location=517-662; Score= 132.7; E_value=1e-36; Accession=PF00637.10; Description=Region in Clathrin and VPS
  Pfam annotation: Domain name=Clathrin; Domain location=666-807; Score= 134.2; E_value=3.5e-37; Accession=PF00637.10; Description=Region in Clathrin and VPS
  Pfam annotation: Domain name=Clathrin; Domain location=75-217; Score =70.7; E_value=4.6e-18; Accession=PF00637.10; Description=Region in Clathrin and VPS
  Pfam annotation: Domain name=Clathrin; Domain location=812-958; Score= 124.0; E_value=4.2e-34; Accession=PF00637.10; Description=Region in Clathrin and VPS
  Pfam annotation: Domain name=Clathrin; Domain location=961-1120; Score=87.6; E_value=3.7e-23; Accession=PF00637.10; Description =Region in Clathrin and VPS
  Pfam module annotation: Pfam domain module=Clathrin::Clathrin::Clathri n::Clathrin::Clathrin::Clathrin::Clathrin; Domain location=224 -366::371-510::517-662::666-807::75-217::812-958::961-1120
MHITQTVDNDLALKIFIKARATPKVVAAFAERREFDKILIYSKQVGYTPDYMFLLQTILRADAQGAVNFALMMSQMEGGCPVDYNTITDLFLQRNLIREATAFLLDVLKSNLPEHGYLQTKVLEINLVTFPNVADAILANGMFSHYDRPRIAQLCEKAGLFIRALQHYSELPDIKRVIVNTHAIEPQALVEFFGTLSKEWALECMKDLLLVNLRGNLQIIVQTAKEYCEQLGVDACIKLFEQFKSYEGLYFFLGAYLSSSEDPDIHFKYIEAAAKTGQIKEVERVTRESNFYDAEKTKNFLMETKLPDARPLINVCDRFGFVPDLTHYLYTSNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELVNVSNKNSLFKLQARYVVERMNADLWEKVLNPENEFRRQLIDQVVSTALPESQSPDQVSAAVKAFMTADLPHELIELLEKIVLQNSAFSGNFNLQNLLILTAIKADPSRVMDYINRLDNFDGPAVGEVAVEANLYEEAFAIFKKFNLNVQAVNVLLDNLRTIDRAVEFAFRVEEDAVWSQVAKAQLREGLVSDAIESFIRADDSTHFLEVIKASEDAEVYHDLVRYLLMVRQNTKEPKVDSELIYAYAKIDRLGEIEEFILMPNVANLPNVGDRLYDEALYEAAKIIFAFISNWAKLAVTLVKLKQFQGAVDAARKANSSKTWKEVCFACVDAEEFRLAQICGLNVIIQVDDLEEVSEFYQNRGCFNELISLMESGLGLERAHMGIFTELGVLYARYRPEKLMEHIKLFSTRLNIPKLIRACDEQQHWMELTYLYIQYDEFDNAATTVMNHSPEAWDHMQFKDIIVKVASVELYYKAVHFYLQEHPDILNDLLNVLALRVDHTRVVDIMRKAGHIRLVKPYLIAVQSNNVSAVNEALNEIYVEEEDYDRLHESIDLHDNFDQIGLAQKIEKHELLEMRRVAAYIYKKAGRWKQSIALSKKDNLYKDCMETCSQSGDRELSEDLLVYFIEQGKKECFASCLFVCYDIIRPDVALELAWMNNMIDFAFPYLLQFIREYTGKVDELIKDKIEAQKEEKAKEKEEKDVIAQQNMYAQLLPLALPAPPMPGMGGGGYAPLTTPPMGGMGMPPMPPFGMPPMGGSSGSY

SEQ ID NO: 175052 - protein, 212 aa, Glycine max
  Coding DNA Sequence Number=SeqID_58274
  Gene Ontology: Mol. function=binding; Cellular component=clathrin vesicle coat; Biological process=anatomical structure morphogenesis
  Homolog annotation: Hit_ID=Q2RBN7; Match level="QueryCoverage=84%, HitCoverage=10%, E-value=2e-86, Identity=83%"; Hit description =Clathrin heavy chain, putative, expressed
  Pfam annotation: Domain name=Clathrin_propel; Domain location=107 -138; Score=21.7; E_value=0.0025; Accession=PF01394.10; Description =Clathrin propeller repeat
  Pfam annotation: Domain name=Clathrin_propel; Domain location=153 -186; Score=5.9; E_value=14; Accession=PF01394.10; Description =Clathrin propeller repeat
  Pfam annotation: Domain name=Clathrin_propel; Domain location=19-55; Score=22.6; E_value=0.0014; Accession=PF01394.10; Description =Clathrin propeller repeat
  Pfam annotation: Domain name=Clathrin_propel; Domain location=59-99; Score=18.0; E_value=0.034; Accession=PF01394.10; Description =Clathrin propeller repeat
  Pfam module annotation: Pfam domain module=Clathrin_propel::Clathrin _propel::Clathrin_propel::Clathrin_propel; Domain location=107 -138::153-186::19-55::59-99
MAANAPITMKETLTLGSVGINQQFITFTHVTMESDKYICVRETGPQNSVVIIDMSMPMQPLRRPITADSALMNPNSRILALKAQVPGTTQDHLQVFNIETKAKMKSHQMKEQVVFWKWITPNTLGIVTQTSVYHWSVEGDGEPMKMFDRTANLANNQIINYRCDPNEKWLVLIGIAPGSAEVLETFPISILIGCKFLAILWGSLWPFFAVPI

SEQ ID NO: 175053 - protein, 63 aa, Glycine max
  Coding DNA Sequence Number=SeqID_58275
  Homolog annotation: Hit_ID=Q1SAL1; Match level="QueryCoverage=45%, HitCoverage=6%, E-value=3e-08, Identity=96%"; Hit description =Protein phosphatase 2C-like
MVAIQLTVDLKPDLPREAERIKKCKGRVFYKTPVFKREVFYIGQITIVVGRVTFNIVCYDDAL

SEQ ID NO: 175054 - protein, 734 aa, Glycine max
  Coding DNA Sequence Number=SeqID_58276
  Gene Ontology: Mol. function=potassium ion transporter activity; Cellular component=integral to membrane; Biological process =potassium ion transport
  Homolog annotation: Hit_ID=O22397; Match level="QueryCoverage=99%, HitCoverage=100%, E-value=0.0, Identity=62%"; Hit description =Potassium transporter 1
  Pfam annotation: Domain name=K_trans; Domain location=27-734; Score =1212.2; E_value=0; Accession=PF02705.7; Description=K+ potassium transporter
MNPSEQFVEHGMSQQNLKRTSCATVLTLAYQSLGIVYGDLSTSPLYVYKTTFSGKLRLKEDEEEIFGVLSFIFWTFTIIALFKYVFIVMSADDNGEGGTFALYSLLCRHARLSILPNQQATDEKLSAYTTQDSADTWLSANLKLFFEKHPRFQKGLLIFVLLGTCMTIGDGVITPAISVFSAVSGVQVKIKGLHENYVVIISCVILLVLFSIQHHGTHRVAFMFAPVVAAWLLCISGIGVYNIFYWNRQIYRALSPLYMLKFLRATGIEGWMSLGGVVLSITARIVELIFLWYFLRSGGNVCCLGSFFCTLNKETVFWPVFIVATLAAIVGSQAVISATFSIVSQCCALNCFPPVKIVHTSSRIYGQIYVPEVNWILMCLCLAVTIGLRDIDMMGHAYGLATTTVMFVTTCLMTLVMVIVWKQGIIKAIICLVLFGSIELLYISASICKVPEGGWIPLVLSFIFMSIMFTWNYGTMKKHEFDVENKVSMSKILSLGPCLGMVRVPGIGVIFSNLASGVPAIFGHFVTNLPAFHQVLVFVCVKSVQVPCVSDNERLVISRIGPKEYRMFCCIVRYGYKDLQQENYNFENKLVSAIIQFVEIEESDPAPTPEEFSMDDGNLNMEHLGVSPHTLSSSCYIEKNFPFSCVLRVKKNDNDHLQETPYKDESMQILKAKESGVTYILGHSYAEAKKSSTILKKFAINVVYAFLSKNCRDPDGFLNVAHTSLLEVGMVYHV

SEQ ID NO: 175055 - protein, 238 aa, Glycine max
  Coding DNA Sequence Number=SeqID_58277
  Gene Ontology: Mol. function=metal ion binding; Cellular component =integral to membrane; Biological process=ubiquitin cycle
  Homolog annotation: Hit_ID=Q9LUZ9; Match level="QueryCoverage=75%, HitCoverage=65%, E-value=1e-20, Identity=34%"; Hit description=RING -H2 finger protein ATL5O
  Pfam annotation: Domain name=zf-C3HC4; Domain location=118-159; Score= 13.0; E_value=0.0071; Accession=PF00097.15; Description=Zinc finger, C3HC4 type (RING finger)
  Subcellular localization annotation: CTP_CleavageSite=59; ConfidenceScore=5.15e-01
MPSQSESPSNSLSQLSRNMFSDNNSNIMLAAIVSLLLVILFVLLLHVYAKWFLFQAQTRSQTRWRRTPVTVSGVLEPSHFHSINIESSPTCNKGLDSASLSAIPMFVQGTEKTEESECVICLSVIEEGEIGRGLPKCCHAFHMECIDMWLSSHCNCPICRAPIVVSGDSQLGSVDGDSDGVVEIVVVTPSYENSENEHGEVSDSVPETSSSSLGFSLKRLLSKVFLSPDHVTELDASQ

SEQ ID NO: 175056 - protein, 129 aa, Glycine max
  Coding DNA Sequence Number=SeqID_58278
MTTETPDAEDLVGVPPELLLIAAAVDVVLLRLRAVPRHHAPPSNQTTSYTCFMLSIPKTLELGYREKSVRENGDRNGRDGEQVISSRACESRGRRNNEEGALGRRRGCGGDSEIQKVDHIKHEIGIRIA

SEQ ID NO: 175057 - protein, 174 aa, Glycine max
  Coding DNA Sequence Number=SeqID_58279
MYQIHGHHGLPEQAFLGNKEDQKSINSGNRVYNQKHWKTVYFASKGIVEMLPLSWLAAMIMAAQKVAAKATNLTTRWRILRVLAMNFKKKNGWCTMNPQWKYDNSGDSDNNSHDMTMVTVDDDNNHGDGCNGDHDDDNDKGHCDKGDDSDNGEVYDSVALMFMMKVATIMIVMS

SEQ ID NO: 175058 - protein, 46 aa, Glycine max
  Coding DNA Sequence Number=SeqID_58280
MESFVVLHANQCRIVGGVQWEIKQLGMGVSSDMSGGPNDVGGEEVI

SEQ ID NO: 175059 - protein, 250 aa, Glycine max
  Coding DNA Sequence Number=SeqID_58281
MATIDMVERLRTDMGGVVLVEGAEDSWALCERIEDSNINDTLVDMWKVKLPPKGKNPKAGFEGSNLQQKKEEDTEALPLFSWSLLLSAPLMLVLPVFPAFYHASLSLPTPSKTPCPQVSQEELQEIQQYGSAKHPCCSDRGGGIGVGEEDAKWWRSRPAIPRSVRDGGTSHVMGFGPIPGVGFGSGPSDTGVASFGSGCAVLRPNGTTRAHGAWLTPPGEPKGLTVELPAVEFAAAVEADEGPTASAPRS

SEQ ID NO: 175060 - protein, 174 aa, Glycine max
  Coding DNA Sequence Number=SeqID_58282
  Subcellular localization annotation: CTP_CleavageSite=57; ConfidenceScore=5.63e-01
MAFTSTLSIYSHPQVRLLNQRLQSLPFTAAGVAQFAPLPPLNRRRTCSPRSFVFRVSSSVEGSRARSGGSRRVYRQSQASAPLSSAPVKQIANVVAPVAAFFALTFEGCLREEATLFTHCSFRLHRQLQPGTRAAFAGSSLDRCHHRFTSAWRLAERVVVFARGGGSQEANAKD

SEQ ID NO: 175061 - protein, 40 aa, Glycine max
  Coding DNA Sequence Number=SeqID_58283
MAVPPLKMARKLDTWRVPLVLLAGHIHVGCAANSSSGMGS

SEQ ID NO: 175062 - protein, 122 aa, Glycine max
  Coding DNA Sequence Number=SeqID_58284
MLVFKGVVLGRWIVGGWGVAEGEVSKIVPDFSTTTSIYPANGDNITYRLGMAVPVEEVLHGGGLTVHEQQQAMWRWEGDSRGRYTVGSAYVLLNSNSPMENQDEVFKALWKIKIPSKASSFA

SEQ ID NO: 175063 - protein, 194 aa, Glycine max
  Coding DNA Sequence Number=SeqID_58285
  Gene Ontology: Mol. function=protein binding; Cellular component =chloroplast envelope; Biological process=carbohydrate metabolic process
  Homolog annotation: Hit_ID=Q67VC5; Match level="QueryCoverage=98%, HitCoverage=64%, E-value=7e-59, Identity=40%"; Hit description =DeliriumA-like
  Pfam annotation: Domain name=LRR_1; Domain location=110-137; Score =9.0; E_value=5.9; Accession=PF00560.23; Description=Leucine Rich Repeat
  Pfam annotation: Domain name=LRR_1; Domain location=166-189; Score =10.4; E_value=3.3; Accession=PF00560.23; Description=Leucine Rich Repeat
  Pfam annotation: Domain name=LRR_1; Domain location=54-80; Score=8.1; E_value=8.8; Accession=PF00560.23; Description=Leucine Rich Repeat
  Pfam module annotation: Pfam domain module=LRR_1::LRR_1::LRR_1; Domain location=110-137::166-189::54-80
MLSVQGRNFGDEGLFFLAESLAFNQTAEEVSFAANGITAAGLRAFDGVLQSNITLKTLDLSGNLVGDEGAKCLCDILVNNSSIEKLQLNSADLGDEGAKAIAEMLKKNSSLRVLELNNNMIEYSGFSSLAGALLENNSIRNIHLNGNYGGALGANALAKALESNKSLRELHLHGNSIGDEGIRSLMTGLSSHKG

SEQ ID NO: 175064 - protein, 192 aa, Glycine max
  Coding DNA Sequence Number=SeqID_58286
  Gene Ontology: Mol. function=protein binding; Cellular component =chloroplast envelope; Biological process=carbohydrate metabolic process
  Homolog annotation: Hit_ID=Q67VC5; Match level="QueryCoverage=90%, HitCoverage=69%, E-value=2e-66, Identity=38%"; Hit description =DeliriumA-like
  Pfam annotation: Domain name=LRR_1; Domain location=124-150; Score =6.1; E_value=21; Accession=PF00560.23; Description=Leucine Rich Repeat
  Pfam annotation: Domain name=LRR_1; Domain location=154-176; Score =5.0; E_value=33; Accession=PF00560.23; Description=Leucine Rich Repeat
  Pfam annotation: Domain name=LRR_1; Domain location=43-69; Score=4.3; E_value=44; Accession=PF00560.23; Description=Leucine Rich Repeat
  Pfam annotation: Domain name=LRR_1; Domain location=71-94; Score=3.0; E_value=77; Accession=PF00560.23; Description=Leucine Rich Repeat
  Pfam module annotation: Pfam domain module=LRR_1::LRR_1::LRR_1::LRR _1; Domain location=124-150::154-176::43-69::71-94
KGAFHVAEYIKKSKSLLWLNLYMNDIGDEGAEKIAVALKENRSISTLDLGGNNIHVDGVNAIAQVLKDNLVITTLELSYNPIGPDGAKALAEVLKFHGNIKTLKLGWCQGAQSLARSLKVVNEALTSLDLGFNEIRDDGAFAIAQALKSNDDVAVTSLNIGSNFLTKFGQGALADARDHVLEMTEKEINIFL

SEQ ID NO: 175065 - protein, 390 aa, Glycine max
  Coding DNA Sequence Number=SeqID_58287
  Gene Ontology: Mol. function=metalloendopeptidase activity; Cellular component=proteinaceous extracellular matrix; Biological process =peptidoglycan metabolic process
  Homolog annotation: Hit_ID=Q93Z89; Match level="QueryCoverage=71%, HitCoverage=76%, E-value=1e-111, Identity=72%"; Hit description =Matrix metalloproteinase MMP2
  Pfam annotation: Domain name=PG_binding_1; Domain location=99-161; Score=32.0; E_value=2.1e-06; Accession=PF01471.9; Description =Putative peptidoglycan binding domain
  Pfam annotation: Domain name=Peptidase_M10; Domain location=186-348; Score=52.7; E_value=1.2e-12; Accession=PF00413.14; Description =Matrixin
  Pfam module annotation: Pfam domain module=PG_binding_1::Peptidase _M10; Domain location=99-161::186-348
MKPYLRAIFLLFLILPSARWGEAKIDRKTITMFWGKVKDATIKNFPSRDERKKLREYYEKFREFMDRVEQKTTPPPPPMYRLQPKSPPPPPNAPPKQINIKGLSVVKDYLSDYGYIESSGPFNDSFDQEIISAIKTYQNFSNLNVTGDLNKQLIQQILSIRCGVPDVNFDYNFTDDNTSYPKAGHRWFPNRNLTYGFLPENQIPDNMTKVFRDSFARWAQASGTLSLTETTYDNADIQVGFYNFTALRIEVEVYGGSLIFLQPDSSKKGVVLMDGNMGWLLPSENATLSKDDGVLDLETVAMHQIGHLLGLDHSHKEDSVMYPYILSSQQRKVQLSNSDKANIHLQFAKHDSDLTSLPNSHDSASHGGRLDVLLVTTFSLGFAYLLLLLY

SEQ ID NO: 175066 - protein, 181 aa, Glycine max
  Coding DNA Sequence Number=SeqID_58288
  Gene Ontology: Mol. function=transition metal ion binding; Cellular component=chromatin; Biological process=electron transport
MGIRAQFHPRSDDKKIYLPPACHTLSRWEKMSFCQCLRRVKVPHGYSSNIKSLVQLKDIKLVGLKSHNCHVLMQQLLVVAIRDIFPNKVRHAITRLCFFFNAICSKVLDPIKLDKLENEAAIILCQLEMEIKCCGPIYLRWMYPAERYMKILKGYTKNLHHLEASIVERYIAEEAIEFCSE

SEQ ID NO: 175067 - protein, 375 aa, Glycine max
  Coding DNA Sequence Number=SeqID_58289
  Gene Ontology: Mol. function=metalloendopeptidase activity; Cellular component=proteinaceous extracellular matrix; Biological process =peptidoglycan metabolic process
  Homolog annotation: Hit_ID=Q93Z89; Match level="QueryCoverage=79%, HitCoverage=78%, E-value=1e-111, Identity=70%"; Hit description =Matrix metalloproteinase MMP2
  Pfam annotation: Domain name=PG_binding_1; Domain location=73-135; Score=46.6; E_value=8.6e-11; Accession=PF01471.9; Description =Putative peptidoglycan binding domain
  Pfam annotation: Domain name=Peptidase_M10; Domain location=160-324; Score=48.6; E_value=2.1e-11; Accession=PF00413.14; Description =Matrixin
  Pfam module annotation: Pfam domain module=PG_binding_1::Peptidase _M10; Domain location=73-135::160-324
MKPYLRPVFLLFLILLDQSISASAALAKIPSKKEDLKKAEKVKEWVEKVKDGVELAIENAPPSPPNEAPKQINIKGLSVVKDYLSEYGYIESSRPFNNSFDQETMSAIKTYQKFSNLPVTGVPNKQLIQQMLSLRCGVPDVNFDYNFTDDNTSYPKAGHRWFPNRNLTYGFLPENQIPDNMTKVFRDSFARWAQASGTLSLTETTYDNADIQVGFYNFTDLSIKMEVYGGSLIFLQPDSSKKGVVLLDGNMGWLLPSENASLSKDDGVLDLETAAMHQIGHLLGLDHSHKEDSVMYPYILSSQSQQRKVQLSNSDKANIHLQFAKHDSDLTSPNSHDSDLTSPNSHDSASHGGRLDVLLVTTFSLGFAYLLLLSY

SEQ ID NO: 175068 - protein, 165 aa, Glycine max
  Coding DNA Sequence Number=SeqID_58290
  Gene Ontology: Mol. function=metalloendopeptidase activity; Cellular component=proteinaceous extracellular matrix; Biological process =peptidoglycan metabolic process
  Homolog annotation: Hit_ID=Q93Z89; Match level="QueryCoverage=99%, HitCoverage=48%, E-value=7e-44, Identity=63%"; Hit description =Matrix metalloproteinase MMP2
  Pfam annotation: Domain name=Peptidase_M10; Domain location=1-138; Score=-13.4; E_value=4.6e-06; Accession=PF00413.14; Description =Matrixin
MKKVFRDSFKRWAQATTGVLRLTETTYDNADIKVGFRIFNNIWDQVFSLSFIILQPGSNVTTGDIRLKGAILWSLPSEKESLSWENGVLDLESAAMHLLGLDHSNKEDSVMYPNVLPWQQRKVELSVSDMENIQRHYTNGISGHSGRWGVLLITILSLGFAYELL

SEQ ID NO: 175069 - protein, 203 aa, Glycine max
  Coding DNA Sequence Number=SeqID_58291
  Homolog annotation: Hit_ID=Q6YUB0; Match level="QueryCoverage=29%, HitCoverage=20%, E-value=2e-08, Identity=50%"; Hit description =Putative zinc finger protein
  Subcellular localization annotation: CTP_CleavageSite=28; ConfidenceScore=5.34e-01
MSSSSEKKPSSSSSSSSPSVLKVFGSPLTAMRSDEALRDGWVKKIECPFCHREFQSLQALGGHQNAHRRERQMARFAQFEYMCLNQSNQMFQSVTPLVVEHGAAPTSVFGGATRLWTAPESSQLPVAEPPGMLIPIVQAPVVGDDDNIDLELRLVNPNRVETDERCAPECLREQQAIRTNQILVLNIKIWHILNDDRQHEEFS

SEQ ID NO: 175070 - protein, 293 aa, Glycine max
  Coding DNA Sequence Number=SeqID_58292
  Gene Ontology: Cellular component=membrane; Biological process =transport
  Homolog annotation: Hit_ID=UPI00005F8E48; Match level="QueryCoverage =55%, HitCoverage=55%, E-value=5e-62, Identity=72%"; Hit description =COG0697: Permeases of the drug/metabolite transporter (DMT) superfamily
LTILAQPGGTAPCADARHPDWRPAVVCRAGVAGERRQPGTAAEPAPRQRRADDAGGLNFLRAVRRTDEALGNPAANVAKPVRANLLRRAFAAARLLARAGGGAECRQYSAGAVRRAVCLDCGAVPVDPWRAAPRRQHHQYFHERGAGVYRPHCRAVPARTVACLSLDWRRSDAGRGHPAAGCGPAAAGRRARRRYPAPAPVQCPPRAGWRDRAGQTAAAPAAADPPRCPARCLQSPAPFCRSRAVTVPPCGVYLIALSSRLAHSSASNSASPCTWLAACSSNPRSICLRRAAA

SEQ ID NO: 175071 - protein, 383 aa, Glycine max
  Coding DNA Sequence Number=SeqID_58293
  Gene Ontology: Mol. function=N-acetyltransferase activity; Biological process=metabolic process
  Homolog annotation: Hit_ID=O64737; Match level="QueryCoverage=98%, HitCoverage=97%, E-value=6e-99, Identity=50%"; Hit description =Hookless1-like protein
  Pfam annotation: Domain name=Acetyltransf_1; Domain location=55-147; Score=59.3; E_value=1.3e-14; Accession=PF00583.14; Description =Acetyltransferase (GNAT) family
MVLKEFKIRSYECQFDRAQVEDLERRCKVGPSESVLDTMGDPMCRIRNCPMYIMLVAEMDNELVGVIQGSIKTVTLHNHHPNKDMAKVGYVLGLRVSPHNRKKGIGSSLVQKLEEWFTSNDVDYAYMATEKENHASINLFMNKFGYIKFRTPSILINPVNHHPFGISSNIEIARIKVEKAESLYRGFMGASTEFFPSDIENILTNNLSLGTWVAYFKGDSGFGNLEGKVPNSWAMLSVWNCGEIFKLRLGKTPLSCMLFTKSLSLMNRIFPCLKLPTLPNFFSPFGFYFIYGVYQEGPFSGKLVRALCKFVHNMASKTEHCKIIVTEVGETDHELIHHVPHWKLFSCPDLWCIKALKKNGRTNRFHELTNTPPRGLFVDPREV

SEQ ID NO: 175072 - protein, 61 aa, Glycine max
  Coding DNA Sequence Number=SeqID_58294
MEKLKAKENVPNTCGRLIQPKGSNNTSTIRGIMVGGRLRAGFGPFQLFRIPKLSIISRNKN

SEQ ID NO: 175073 - protein, 47 aa, Glycine max
  Coding DNA Sequence Number=SeqID_58295
MGTITIEKWTSTDNRRHTRVTMLGAGGKDEDCVNRKRERRTEEAAEE

SEQ ID NO: 175074 - protein, 101 aa, Glycine max
  Coding DNA Sequence Number=SeqID_58296
MARWMAMENLMLEDAGTQCSERKGCHTKDNPWSAPGESSIAKGSSNQRSTLGESRFAKGSSSPRFALGESFFSKGSSKPRSALGESLFSNGSTNPRFALGE

SEQ ID NO: 175075 - protein, 61 aa, Glycine max
  Coding DNA Sequence Number=SeqID_58297
  Subcellular localization annotation: CTP_CleavageSite=40; ConfidenceScore=5.29e-01
MAGVGHYMAPTDIFQPTLRNFFYKRWPIMFFYLRTARFFRASSTEGSFRSTLACCSSHLGG

SEQ ID NO: 175076 - protein, 64 aa, Glycine max
  Coding DNA Sequence Number=SeqID_58298
  Homolog annotation: Hit_ID=UPI00005F712D; Match level="QueryCoverage =64%, HitCoverage=63%, E-value=9e-09, Identity=56%"; Hit description =COG2960: Uncharacterized protein conserved in bacteria
  Pfam annotation: Domain name=DUF526; Domain location=1-47; Score =13.6; E_value=0.001; Accession=PF04380.3; Description=Protein of unknown function (DUF526)
MPKGIRDFGDDVEKKIRQTQVLLRTREKLAALEQRLAKLESESPAAPAPAVITPDPAGKIDTPQ

SEQ ID NO: 175077 - protein, 96 aa, Glycine max
  Coding DNA Sequence Number=SeqID_58299
MGRNVSTLIGKSVPRIPEKCKDPAGVAAHDVQRYVKESDRAAQCTRQDKMSKEELKLQDPRCRIQCPGHPARKYWTHKSVISLTDCAGSTMSDTMS

SEQ ID NO: 175078 - protein, 221 aa, Glycine max
  Coding DNA Sequence Number=SeqID_58300
  Pfam annotation: Domain name=Extensin_2; Domain location=1-220; Score= -56.6; E_value=3.5e-05; Accession=PF04554.4; Description=Extensin -like region
  Subcellular localization annotation: CTP_CleavageSite=34; ConfidenceScore=5.18e-01
PPPSPSPPPPYYYKSPPPPSPSPPPPYYYKSPPPPSPVPKPPYYYHSPPPPSPSPPPPYYYKSPPPPSPSPPPPYYYKSPPPPSPSPPPPYYYHSPPPPKEHVHPPYYYHSPPPPSPSPPPPYYYKSPPPPSPSPPPPYYYHSPPPPSPSPPPPYYYHSPPPPSPSPPSPYYYKSPPPPSPSPPPPYYYQSPPPPSPTSHPPYYYKSPPPPTSYPPPPYHY

SEQ ID NO: 175079 - protein, 105 aa, Glycine max
  Coding DNA Sequence Number=SeqID_58301
  Gene Ontology: Mol. function=nucleic acid binding; Biological process= DNA integration
MVLSTLDFDDFETCVVCIKDKDESSPRYFNTFIDDYSRYMHLYLLCSKDEALDAFRFFKVEVEKQCGKQIKIVRLDRGGKYYARVLTKTASKTPFELFKGWKPSL

SEQ ID NO: 175080 - protein, 90 aa, Glycine max
  Coding DNA Sequence Number=SeqID_58302
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=92%, HitCoverage=18%, E-value=6e-26, Identity=53%"; Hit description =Photosystem I P700 chlorophyll a apoprotein A1
  Subcellular localization annotation: CTP_CleavageSite=55; ConfidenceScore=5.11e-01
FWENGSSDVWGSISDQGIVNHITGGNFAQSSITIMGGSVIFMGTGIPVAPATQPRALSIVQGRAVGVTHYLLGGIATTWAFFLARIIAVG

SEQ ID NO: 175081 - protein, 234 aa, Glycine max
  Coding DNA Sequence Number=SeqID_58303
  Homolog annotation: Hit_ID=Q1SFC5; Match level="QueryCoverage=62%, HitCoverage=19%, E-value=2e-20, Identity=39%"; Hit description =Asp/Glu racemase
MRIFLSFDKFLPQHALFISREVGPAWFTDYFPTVDPDNEEEVNEIWSFYLNPQILSCRTGVQSNYLGLVGYQPNLVSRQFGLSQIRPKSLFEDPQDVIRGANLSEKTFKKFLKISLDENYDLHPFEFNHSHFCTMGFITWWEKYYSTRSVGDTTTMISRLESGFAQPTVENIRSSLQARGKTPMTKRSAETSRADVRPKKPTGVKIQEGKQEEKEEEERPLIRKRKLPTTQPIC

SEQ ID NO: 175082 - protein, 124 aa, Glycine max
  Coding DNA Sequence Number=SeqID_58304
MDFEICQIVHQKAVKFVQQNCSTCAENACALLVMGKLGRVDGDPMLTGMRIKATELICAIARSPPSTTYDGVVPGDMSRGSGDLGDVRRAPGSQPIKEQKPQSKEPCVVAGQLWILSGIWNLAS

SEQ ID NO: 175083 - protein, 76 aa, Glycine max
  Coding DNA Sequence Number=SeqID_58305
  Subcellular localization annotation: CTP_CleavageSite=25; ConfidenceScore=5.67e-01
MYNPPENPSQGASVTFPWVISRRFSAVLRSSLFVLRRSSVFNRETKAKIDSQNQALSAKITEKNVLRSNASAFLTK

SEQ ID NO: 175084 - protein, 129 aa, Glycine max
  Coding DNA Sequence Number=SeqID_58306
  Gene Ontology: Mol. function=DNA binding; Cellular component =mitochondrion; Biological process=DNA integration
  Homolog annotation: Hit_ID=Q8RUQ2; Match level="QueryCoverage=56%, HitCoverage=5%, E-value=1e-17, Identity=56%"; Hit description =Putative retroelement
MNKTLLERVGCMLSNSRLNRSFRAKAINTTCYLLNRSASTAIDFRTVIKVWSNKPAKYLMLKVFGCLAYYHVNEEYSGKAKDVIKQVEFESPTIRNFCEEKQFEAPDETDQDLQIQPQHQNLAQVEEFE

SEQ ID NO: 175085 - protein, 121 aa, Glycine max
  Coding DNA Sequence Number=SeqID_58307
  Gene Ontology: Mol. function=DNA binding; Cellular component =mitochondrion; Biological process=DNA integration
MWIFKKKSGSSSDKVIRYKARLVAKGSSQKEGMDYNEVFSPVVRHTSIRVLLALVATLDMELEQLDVQTTYLHGRLEEDILMQQSKGFEVQGKKNFVYMLKRSLYRLKQLHINLTKLTQRI

SEQ ID NO: 175086 - protein, 356 aa, Glycine max
  Coding DNA Sequence Number=SeqID_58308
  Gene Ontology: Mol. function=RNA-directed DNA polymerase activity; Biological process=RNA-dependent DNA replication
MMLDTVQNFSDATGVIKRTTNFEEGQFPIRYLGVPLTSKKLTITHYLPLVEKIVCRTRHWTARLLSHAGRIQLVKSISFSITQYWMLCFPIPKFVLKKIEAICRSFIWTGCSEVKKKSPVAWETVCRPKCQGGLDIINLTVWNQVDSRSHWSWMFNNILDQREKVRLKQEWNNQMQRDKFSMKTMYNLLMDKSDRVPWRFLLNHNIARPRAIVNLWLTCHGRMATKDRLKRFGMIKENQCSLCKESEESIAHLFFYCKITKSIWDQILKWIEVTHEPKTWDVELKWAIRETGKKGWKAKLLKLALTETLYEVWLYRNDEVFKNNVNRNIVDNIIDNIVYRGWYNNKLRKHIVTLML

SEQ ID NO: 175087 - protein, 115 aa, Glycine max
  Coding DNA Sequence Number=SeqID_58309
MPWNEKPRRPKRKNTCQQSFEGLYRAAIAIIDKCKEKLNLAATHEQRLEDEYAKISAERGSKGKDRFALTLNKSQELPRFLAKAKAMADTYSAPQGDPQTSQLLSTYDRLNGPYD

SEQ ID NO: 175088 - protein, 322 aa, Glycine max
  Coding DNA Sequence Number=SeqID_58310
  Gene Ontology: Mol. function=NADH dehydrogenase (ubiquinone) activity; Cellular component=integral to membrane; Biological process=ATP synthesis coupled electron transport
  Homolog annotation: Hit_ID=Q1GZM2; Match level="QueryCoverage=99%, HitCoverage=67%, E-value=1e-103, Identity=57%"; Hit description =Proton-translocating NADH-quinone oxidoreductase, chain N
  Pfam annotation: Domain name=Oxidored_q1; Domain location=1-241; Score=148.9; E_value=1.3e-41; Accession=PF00361.10; Description=NADH- Ubiquinoneplastoquinone (comple
MKYFVLGALASGMLLYGMSMLYGMTGSLDVSDIANNIVQQPKSPVLIMGLVFVVAGIAFKFGAVPFQMWVPDVYQGSPTPMTLLIGSVPKLAAYAMTVRLLVQGLHPLALDWQDMLVLMAVLSIIIGNFSAIVQTNLKRMLAYSTISHVGFIMFGMMSANANGFASSFFYISAYVLMSIAGFGIILLLSRQGFEAEEINDLKGLNQRHPWFAFLMLVIMFSMAGIPPTIGFYAKFTVLQAAWQAGFTWQVVLAVLMATIGAFYYLNIVRKMYFDAPEDHTPLTAPVDMRFILSVHALALLGLGLFPEVLLSVCGHSLLISLQ

SEQ ID NO: 175089 - protein, 213 aa, Glycine max
  Coding DNA Sequence Number=SeqID_58311
  Gene Ontology: Mol. function=hydrolase activity
  Homolog annotation: Hit_ID=Q1Z5W0; Match level="QueryCoverage=95%, HitCoverage=60%, E-value=6e-62, Identity=56%"; Hit description =Putative hydrolase
  Pfam annotation: Domain name=ADP_ribosyl_GH; Domain location=10-212; Score=48.7; E_value=2e-11; Accession=PF03747.4; Description=ADP -ribosylglycohydrolase
MKQLTQAERIAGALYGQMLGDALGMPSELWPRERVKRHFGWIDGFLDGPAENTAACYFKAGQYTDDTAMALALADALVEAQGEVVPELIARNVIRWVDGFDAFNKNILGPSSKLALSEQKAGTPIAELENNGITNGAAMRISPLGCVLPSAPLEDFCRQVWLACSPTHKSDIAVAGAVAIAWAVARAVEGADWASIRLALPGVAEYAQRRQET

SEQ ID NO: 175090 - protein, 58 aa, Glycine max
  Coding DNA Sequence Number=SeqID_58312
MCLPGKGKETLGSTKIEENHSKCINLTQGKVYGELGLRLKACRTNGHDICQGVGLVQG

SEQ ID NO: 175091 - protein, 82 aa, Glycine max
  Coding DNA Sequence Number=SeqID_58313
MSRNFTYCATKGAKYLEAVNQRLHAIKQWSPDEIRAILVSTPVITAPDWGQEFELMCDASDYAVGCSVGAAEGQNVSYHQLC

SEQ ID NO: 175092 - protein, 88 aa, Glycine max
  Coding DNA Sequence Number=SeqID_58314
MSYRMLRHHASEHGYRPTLDARVPSRWLTNDSSPKNSQTNSSIPDLVQNSCSLHDYIAVYDSGLQLLDAGGDLSSSEKSAVKELKDNF

SEQ ID NO: 175093 - protein, 70 aa, Glycine max
  Coding DNA Sequence Number=SeqID_58315
  Subcellular localization annotation: CTP_CleavageSite=28; ConfidenceScore=5.27e-01
MDWSGVLSGITLHSTQMHSSSFFQILPRAQSRSVALSGWLAKPEDWLNERMKISSSHTCLINLKLRGNGY

SEQ ID NO: 175094 - protein, 148 aa, Glycine max
  Coding DNA Sequence Number=SeqID_58316
METTKSTKGALQIVEIQVGELAEAVTQFMFRREKYFVEVEAQEKSPVKEHESREKDEEKAQQQWEKYSTVEKQQENILQINNFPHQLIIKKVRQGEHEETLSAILSLITNTFLEMIWNVLPDYMKFMEFLAKRRNFKEDVFYVTFMPP

SEQ ID NO: 175095 - protein, 91 aa, Glycine max
  Coding DNA Sequence Number=SeqID_58317
MTNQKDQQFLQLGKQGVNSTSSDDALEMTIRGGDGGTASSSGEEGEFTPGDCGSAGSGLPAQMWAQAEQPLWVSPKEVDLQPRLLSQENAP

SEQ ID NO: 175096 - protein, 106 aa, Glycine max
  Coding DNA Sequence Number=SeqID_58318
  Gene Ontology: Mol. function=peptidase activity; Biological process =aromatic compound metabolic process
  Homolog annotation: Hit_ID=Q6YUU0; Match level="QueryCoverage=76%, HitCoverage=21%, E-value=1e-32, Identity=82%"; Hit description =Putative Cgi67 serine protease
MIIFYNFVFAIHVPDHDIRATHAWYDYSGYGQSSGKPSEHNTYLDIEAANKCLEEIYGAKKEDIILYGQSVGSIPTLDLATRLPQLRVVVLHSPILSGLRVLYPVK

SEQ ID NO: 175097 - protein, 249 aa, Glycine max
  Coding DNA Sequence Number=SeqID_58319
  Gene Ontology: Mol. function=protein serine/threonine kinase activity; Cellular component=integral to membrane; Biological process=protein amino acid phosphorylation
  Homolog annotation: Hit_ID=Q8GZ99; Match level="QueryCoverage=94%, HitCoverage=24%, E-value=1e-83, Identity=66%"; Hit description =Putative receptor protein kinase
  Pfam annotation: Domain name=Pkinase; Domain location=2-196; Score= -29.6; E_value=8.5e-07; Accession=PF00069.15; Description=Protein kinase domain
  Pfam annotation: Domain name=Pkinase_Tyr; Domain location=1-196; Score=-74.5; E_value=6.7e-08; Accession=PF07714.7; Description =Protein tyrosine kinase
  Pfam module annotation: Pfam domain module=Pkinase::Pkinase_Tyr; Domain location=2-196::1-196
MASSSLPILRLEIRKSGIWMDWIRRLKVALGAARGLAYLHELADPPIIHRDIKSSNILLDHHLNAKVADFGLSKLLVDSERGHVTTQVKGTMGYLDPEYYMTQQLTEKSDVYSFGVLMLELATARRPIEQGKYIVREVMRVMDTSKDLYNLHSILDPTIMKATRPKGLEKFVMLAMRCVKEYAAERPTMAEVVKEIESMIELVGLNPNSESATTSETYVEAGVGNAQHPYREEDFSYSGIFPSTRVEPQ

SEQ ID NO: 175098 - protein, 576 aa, Glycine max
  Coding DNA Sequence Number=SeqID_58320
  Gene Ontology: Mol. function=protein serine/threonine kinase activity; Cellular component=integral to membrane; Biological process=protein amino acid phosphorylation
  Homolog annotation: Hit_ID=Q1SW54; Match level="QueryCoverage=94%, HitCoverage=60%, E-value=1e-118, Identity=40%"; Hit description =Protein kinase
  Pfam annotation: Domain name=LRRNT_2; Domain location=25-62; Score =18.5; E_value=0.01; Accession=PF08263.3; Description=Leucine rich repeat N-terminal domain
  Pfam annotation: Domain name=LRR_1; Domain location=158-180; Score =13.7; E_value=0.69; Accession=PF00560.23; Description=Leucine Rich Repeat
  Pfam annotation: Domain name=LRR_1; Domain location=182-205; Score =7.5; E_value=11; Accession=PF00560.23; Description=Leucine Rich Repeat
  Pfam annotation: Domain name=LRR_1; Domain location=213-236; Score =4.6; E_value=39; Accession=PF00560.23; Description=Leucine Rich Repeat
  Pfam annotation: Domain name=LRR_1; Domain location=238-260; Score =2.8; E_value=85; Accession=PF00560.23; Description=Leucine Rich Repeat
  Pfam annotation: Domain name=LRR_1; Domain location=262-284; Score =8.3; E_value=7.9; Accession=PF00560.23; Description=Leucine Rich Repeat
  Pfam annotation: Domain name=LRR_1; Domain location=286-309; Score =8.1; E_value=8.7; Accession=PF00560.23; Description=Leucine Rich Repeat
  Pfam annotation: Domain name=LRR_1; Domain location=334-353; Score =6.1; E_value=21; Accession=PF00560.23; Description=Leucine Rich Repeat
  Pfam annotation: Domain name=LRR_1; Domain location=65-87; Score=0.5; E_value=2.3e+02; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1; Domain location=25-62::158 -180::182-205::213-236::238-260::262-284::286-309::334-353::65-87
MDQQHKVIPLLLLLFQVLLVASQTDSQDYSGLNSLTESWSYKPQNWVGPDPCGSGWDGIRCSNSRITQLRLPGLNLGGQLSSAIQSLSELDTLKIKTDGVMCNLIKVQENNHPKGHFILTRLIVDGMQYSVEAHLITRSLVGCGFSGRIPDSIGSLKQLTFLALNSNNFSGTIPRSLGNLSNVDWLDLAENQLEGTIPVSDDQGRPGLDLLLKAHHFHMGSNKLTGTIPEKLFNSNMILEHVLFDHNQLEGGIPRSLSTVSTLEVVRFDKNGLTGGVPANLNKLGKLSEMDLSDNDFNASDIPSWVTTLPGLTTVILGQNRLGGALNLSRYSSSLQLMNLEDNEITELDPENNSPTFELRLANNPLCRESGASERSYCKVPVPNPSFYSTPTNNCLPSPCGSDQVSSPNCKCAFPYSGLLISRALSFSNFSNASYYRELEQSLMDTFRNQSIPVDSVSLSNPFRNTIDNFELTLDVFPSQTDRFNTTGVLTIAFLLSNQIYKPPEFFSPYIFKGANYEYYGGEPKGSKSSSHVGVIVGAVVAVVVFVVLAFFAGMYALRQKRRARRSAELNPFGKK

SEQ ID NO: 175099 - protein, 305 aa, Glycine max
  Coding DNA Sequence Number=SeqID_58321
  Homolog annotation: Hit_ID=Q10QS2; Match level="QueryCoverage=40%, HitCoverage=10%, E-value=6e-27, Identity=59%"; Hit description =Expressed protein
  Pfam annotation: Domain name=Tfb2; Domain location=30-270; Score= -230.9; E_value=0.014; Accession=PF03849.5; Description=Transcription factor Tfb2
MVFENRFEILQNKDDEPQKTWNRVRSPKNRRRHVRVRNQIRQRPRVLRLGVAAATDSSSQSTTAPPPSPLIVALRAEFAVAMSARSAVTRISKSERTSWFTEDSTERNDCQSTAAATPVCFAWWKIRSKEFAALRTARSAPSCRGFVPLSLRYNFLMCQYRDKEAPKLTESGFQFLLMDTNAQLWYIIREYISNSEIEVLMQLTLSHSCWNQFSWHRMAYSSPPISFFPSNKIYSLKKRVEYQLPNLIVGAITKESLYSAFENVIVAEQIDGNDLFLPMLLLGIRGLLVKFLLKQASVDKRASKC

SEQ ID NO: 175100 - protein, 191 aa, Glycine max
  Coding DNA Sequence Number=SeqID_58322
  Homolog annotation: Hit_ID=Q10QS2; Match level="QueryCoverage=67%, HitCoverage=10%, E-value=7e-27, Identity=59%"; Hit description =Expressed protein
  Subcellular localization annotation: CTP_CleavageSite=63; ConfidenceScore=5.17e-01
MAGGSPKAHHLLQATQPNPPLLGREDEPQKTRNRVRSPKNGRRHVRVRNKIRQRPRVLRLGVAAATDSSSQSTTAPPPSPLIVALRAEFTVAMSARSAVTRISKSERTSWFTEDSTERNNCQSTVAATPVCFAWWKIRSKEFAALRTTRPHLMDTNAQLWYIIREYISNFEDRGVDAADLISFMLESVFMA

SEQ ID NO: 175101 - protein, 367 aa, Glycine max
  Coding DNA Sequence Number=SeqID_58323
  Homolog annotation: Hit_ID=Q9LJZ4; Match level="QueryCoverage=85%, HitCoverage=98%, E-value=7e-33, Identity=34%"; Hit description =Genomic DNA, chromosome 3, P1 clone:MAL21
MEVLYTKLYDKYTRLKSNKLSDLDHLNEEQQLKFRNFSSAAEELIEHLMTEKEELLGQVHHLRTELASLRAAKDNQVADYQRLLAEETRKNEALAEEVEKLLKLRQEGACHDLNYNSKIMTVDGQFKANSNSSSIRMTRKRTRQNTLEKEARFISFENDQGNSVERESMENICKDTTSGKALIYRKVVMMVVGQDRISKIKVEKETNMISSYPIKCDTDRDHRCSMSLKTQCEKIERRGVDALQFAHYLYLKQINGYSFSISWISKSPEEEAELLYHVSSLGTFERVAPEWMREDIMFSPSMYPIFFERPLRIKDASLWSRKLGSLWLLEIMFIAIILEGKQTRKMIKDNDETKVGLAGNKNEGWHV

SEQ ID NO: 175102 - protein, 603 aa, Glycine max
  Coding DNA Sequence Number=SeqID_58324
  Subcellular localization annotation: CTP_CleavageSite=34; ConfidenceScore=5.54e-01
MAASSLFSPVLPYTKFSSSTLRFTNSKNSIFALSCSSPKSIPVTEKEVLQAIADSDGKNLPCVRTYDNDLSQLTLVGTVDFNQALTAAAADGGEVASDHIDAGLDAMVVETVFPAPSSDHATVSTRLFLPARKVKEKATKLRKSFPKDAFSGSASKNVLAMTFRQVVLQQIWSFDLTVFQPGEERKMDDLETPREVHASFALSSSDEYLISVLAEAICISALQSTQIQFLDKAKGGNRGGFFRWFQKPESVQSKDSAIILSKLFEDEIVENARSLLDNYNLMKDGFKPVKIKSGHHWWKPSCYEKLEKIGGSDFSAWASEYVPAYRLEIDTKIVGDSKIEGWKKSAENRWEVLLTHSQMVQLAETLDIYYVDPYSLPYKQLSCGVAAKFANVYNKKGNSFPKLLSFALASGIFLVAISALGQFCLPWLCKERKHSVEHRSLPSSEVNVAMNDFFDTKKLEECCVLAIAKVKDTFGWLGEIKVEDGIGVWIGELPAYLRGEGVDTLSTSENIDADAKVPIQDIASYQVVFSSERKIVGFQPLSRVAVNHWAANPLARELYRGKKLSPSLIEPGLKVPLPEKVIVVELLMSINPDAYFALARRFR

SEQ ID NO: 175103 - protein, 48 aa, Glycine max
  Coding DNA Sequence Number=SeqID_58325
MERKMTKFSRPAPEIEGLVAASGLSPLIACSLNTGDREFYVCFCGTLT

SEQ ID NO: 175104 - protein, 222 aa, Glycine max
  Coding DNA Sequence Number=SeqID_58326
  Homolog annotation: Hit_ID=Q5JMX2; Match level="QueryCoverage=95%, HitCoverage=40%, E-value=1e-70, Identity=61%"; Hit description =Putative vascular plant one zinc finger protein
MTPVLRPGGIGLKDNLLFAALSAKAQGKVVGIPECEGAATAKSPWNAPELFDICVLEGETIREWLFFDKPRRAFESGNRKQRSLPDYSGRGWHESRKQVMNEFGGLKRSYYMDPQPLNLFEWHLYEYEISKCDVCALYRLELKLVDGKKSSKAKIVTGDSVADLQKHMGSLSAKGSRTKLGIGGGVYSASNRVALLNAPYQYGLTSPYDDYVVHNTLDYYVT

SEQ ID NO: 175105 - protein, 69 aa, Glycine max
  Coding DNA Sequence Number=SeqID_58327
  Gene Ontology: Mol. function=metal ion binding; Cellular component =nucleus; Biological process=regulation of transcription, DNA -dependent
  Homolog annotation: Hit_ID=Q8LHP0; Match level="QueryCoverage=71%, HitCoverage=57%, E-value=3e-16, Identity=80%"; Hit description =Transcription elongation factor 1 homolog
MAAVSNAASHFWGSFGSDMKNLIGEAICGICQESFSTTITALSEPIDIYSEWIDECELVNHPDDDGAEH

SEQ ID NO: 175106 - protein, 160 aa, Glycine max
  Coding DNA Sequence Number=SeqID_58328
  Homolog annotation: Hit_ID=Q5XQF4; Match level="QueryCoverage=57%, HitCoverage=14%, E-value=7e-16, Identity=49%"; Hit description =Expressed protein DH12
MKKISKSSCKLASHRLFKDKARNHVDDLQESRTIDAALLEEQVHQMLREWKAELNEPSPASSLQQGGSLGSFSTDVYRLLQLCEEEDDATSPLVAPKPEPNDQIMQAGAKVIVQEGQHQQELLLLKECKPFTVGFPNLDGTALEYHQFDINKDMDDSFYA

SEQ ID NO: 175107 - protein, 71 aa, Glycine max
  Coding DNA Sequence Number=SeqID_58329
MAQCYRQFVKGGLSWCRHEAVKQKNENLAEEVELLKHIIQELEQMARGRGLTGILNFRHGNTEIGKAEKTA

SEQ ID NO: 175108 - protein, 101 aa, Glycine max
  Coding DNA Sequence Number=SeqID_58330
MKKRTNASQNQKAKVGKNHPNHHWTCTNEAAWCTPYACCCNSASRPVPLATIAFCHQPPLMTSTTTPYWMRIGIRIKYALEIEGRDSFGFCNRSIRGGEAK

SEQ ID NO: 175109 - protein, 474 aa, Glycine max
  Coding DNA Sequence Number=SeqID_58331
  Gene Ontology: Mol. function=nucleic acid binding; Biological process= metabolic process
  Homolog annotation: Hit_ID=Q2QXN6; Match level="QueryCoverage=90%, HitCoverage=92%, E-value=1e-144, Identity=58%"; Hit description =Calmodulin-binding family protein, putative, expressed
  Pfam annotation: Domain name=IQ; Domain location=48-68; Score=19.4; E_ value=0.013; Accession=PF00612.17; Description=IQ calmodulin-binding motif
MEVQTHTLDIHQPQFRSSEYPNPTFPHSLHDPPIQTLTHAPGRACPQTNAALKVQKVYRSYRTRRRLADSAVVAEELWWQVIDFARLNHSTISFFNLPESAASRWSRVKLNASKVGKGLSLDAKAQKLAFQHWIEAIDPRHRYGHNLHYYYEEWCKTDSGQPFFYWLDLGNGKNIDLEQCPRSKLRKQCIKYLGPQEREHYEYIVCEGNIIHKQSGDFLHTREDSKDAKWIFVMSTSKKLYAGKKKKGLFHHSSFLAGGATVAAGRLEAEHGILKSISAYSGHYRPTNDALNSFISYLKENGVDIDEVEIRNPKDDTDIYEDGKLSEIATAPEDSSNGNIPELGVSEEADNTTSSNTEEPQLGSVGSYKRTLSGGLQSPRADVPKKAILQRINSKKATKSYQLGHQLSHRWSTGAGPRIGCVADYPVELRLQALEMLNLSPKVPPSPSSYRLVGGLVPPTTNGTRIDTDENSVH

SEQ ID NO: 175110 - protein, 408 aa, Glycine max
  Coding DNA Sequence Number=SeqID_58332
  Gene Ontology: Mol. function=sequence-specific DNA binding; Cellular component=nucleus; Biological process=regulation of transcription, DNA-dependent
  Homolog annotation: Hit_ID=Q6X7J4; Match level="QueryCoverage=97%, HitCoverage=100%, E-value=2e-49, Identity=74%"; Hit description =WUSCHEL-related homeobox 9
  Pfam annotation: Domain name=Homeobox; Domain location=56-117; Score =56.7; E_value=7.8e-14; Accession=PF00046.19; Description=Homeobox domain
  Subcellular localization annotation: CTP_CleavageSite=41; ConfidenceScore=5.04e-01
MASSNRHWPSMFKSKPCNPHHQWQHDINSSLISTSCHRSPYSSGGGGGCEERSPEPKPRWNPKPEQIRILEAIFNSGMVNPPRDEIRKIRAQLQEYGQVGDANVFYWFQNRKSRSKHKLRHLQNSSSKNLNHHHHLVDQNHHTPTSLPQTATTAPSSSSSSSSEKSSPKELIIPTTKVFSIGFSDVMPNSPTASVNQTYFQTRINESIMLPSPPPPVEAFFFPVQQQHHGVTSSSQGFCFSELSNVVHQHNSVGPCTSLLLSEIVGHGVASASASKKDKSQVKIMHQPSLLNFCVTTPTTTAPSTTTTVVVPPITTTSSTTVPSPLMHQLQGIGDPGGAARSMVFINDVAFEVALGPFNVREAFGDDAVLIHASTGQPVLTNQWGLTLHSLQHGACYYLVRKIALSLV

SEQ ID NO: 175111 - protein, 280 aa, Glycine max
  Coding DNA Sequence Number=SeqID_58333
  Gene Ontology: Mol. function=aconitate hydratase activity; Cellular component=integral to membrane; Biological process=tricarboxylic acid cycle
  Homolog annotation: Hit_ID=Q8PLB7; Match level="QueryCoverage=100%, HitCoverage=32%, E-value=1e-134, Identity=83%"; Hit description =Aconitate hydratase 2
FVEQHVGLHFEFGDDFAVLDGLAFIGAQLDHVAHFHLGNVEFDRQGAGVFHGVVEDRGDLVAQAHAAETLVRHEGDVFAGEPQHRVGGRLARGAGADHVADVGDQVALFLQRFDELHGTALAVFFRLEGGAVALVLEHRQGVHRDVGAGGGVRGRRQVVGVGFAGHLEDRDGQAFGQFGAAGEPLGVGPALHHGLGVGVALVGLFLDVVEGVEHQQGLFQGVGGDRADFLVVEQLDQRANVVAAQHGAEQFGRLGAADQGTSFGAQGHGGQIRGLDLGGI

SEQ ID NO: 175112 - protein, 202 aa, Glycine max
  Coding DNA Sequence Number=SeqID_58334
  Homolog annotation: Hit_ID=Q1T493; Match level="QueryCoverage=85%, HitCoverage=32%, E-value=1e-19, Identity=31%"; Hit description =Nucleic acid-binding, OB-fold, subgroup
MEMDLKENCTYVMHNFKVLRDNGQYRVCDHQFKLVFIGVTVVRECVLGDIPFRKYRFAGFADVVDDQFERGLLVDVIGVVEEVVFRQVSGKGRRVVFKLKDLSQQLLSCTLWDDYCLQFLKFLDDYEGDDPIIVLLSHCRIKEAQGSCPASINNSFKASKLIINQPVMELQEFNERYFLLVELGIEARSGFKSHGEGSTQLS

SEQ ID NO: 175113 - protein, 303 aa, Glycine max
  Coding DNA Sequence Number=SeqID_58335
  Gene Ontology: Mol. function=catalytic activity; Cellular component =cAMP-dependent protein kinase complex; Biological process=intein -mediated protein splicing
  Homolog annotation: Hit_ID=Q4IYX0; Match level="QueryCoverage=63%, HitCoverage=74%, E-value=1e-30, Identity=39%"; Hit description =Protein phosphatase 2C-like:Protein phosphatase 2C-like
  Pfam annotation: Domain name=PP2C; Domain location=87-299; Score= -64.7; E_value=0.034; Accession=PF00481.12; Description=Protein phosphatase 2C
MPGFMPPKKSVRDALIDLQAHQLGMISGIRAIIAAMLQSFNPEQLEEEAKRDGHTSRLALPASRKAALWDYFVRTYGETAGEIEDDFHTLFGEAFLYAYDMEGTRASNQDQTGECVGERSACFVVCDGIAGLPGGEVAAELARNAILDQFDGDNHLNAQTIRQYVQQANGAILQQQQATPDYRRMGTTLVSLFIDRDYKLAYWAHAGDSRLYLFRRGWLYHVTTDHSLVQQMKDAGHQTDDINSNLLYRALGMASDGAEASYSDVVPVEDGDAFLLCTDGFWHGVGEEQMKSSLQMVNTPQSG

SEQ ID NO: 175114 - protein, 239 aa, Glycine max
  Coding DNA Sequence Number=SeqID_58336
  Gene Ontology: Mol. function=protein serine/threonine kinase activity; Cellular component=cytoplasm; Biological process=protein amino acid phosphorylation
  Homolog annotation: Hit_ID=Q53VM3; Match level="QueryCoverage=85%, HitCoverage=43%, E-value=1e-78, Identity=73%"; Hit description =Ser/Thr protein kinase
  Pfam annotation: Domain name=NAF; Domain location=116-176; Score =110.8; E_value=3.9e-30; Accession=PF03822.5; Description=NAF domain
MSCSFLVNYAQIHSFVHCLQISAAEFTFPPWLSFSARKLITKILDPNPMTRITVPEILRDEWFKKDYKPPAFEETKETNVDDVEAVFKDYKYCPHSSFILRIFPKNAAAQCKREEQPTPMDAFELISLSKGLNLQNLFDIDQGFKREIRFTSKCPANEIIKKIEEAAKPLGFDVQKKNFKMKLENVKAGRKGNLNVATAIFQGTPSLHVVKGHKAKGDTLEFLKASFVGKRLFNKHIAE

SEQ ID NO: 175115 - protein, 133 aa, Glycine max
  Coding DNA Sequence Number=SeqID_58337
ETKFGHSAPLYHPEAAGPMIRGDTLRLSAPFCHPEAAGPMTSRDKIWSFCTLVSSRGGGPDDTRRYLTVICTLVSSRGGGPDDTRKYPSGYPNDKSWSPETLVNREERNECRTLIFVQGPLLDDMRPFFGPCE

SEQ ID NO: 175116 - protein, 104 aa, Glycine max
  Coding DNA Sequence Number=SeqID_58338
MGSEIYPKVQENPRAFFSSSSPILLEPLTHGSSDWSLPREDCISLVIHEGSADETQFKRSLDIQPDEGSRLSAHCYAKPNIFTVSCTLSNGLNVDDVLSATSSL

SEQ ID NO: 175117 - protein, 195 aa, Glycine max
  Coding DNA Sequence Number=SeqID_58339
MASRKRKAPSTPTQARIDRSRFTFQEAWVRYTDIIVPRKLLLERNVVVYTTKFDEFLDELDRRHWREELTDFLDSNIDVAIVKEFYANLYAPEDKSPKQVRVRGHLIKFDEDTLNTFLKTPVVMEEGETLCAYSRFALLRPDPQELAAKFCIPGRFELNADGQSLKILRKNMTTLAHTWSILSISNLIPTSHTSD

SEQ ID NO: 175118 - protein, 93 aa, Glycine max
  Coding DNA Sequence Number=SeqID_58340
  Gene Ontology: Mol. function=serine-type endopeptidase activity; Cellular component=chloroplast; Biological process=proteolysis
  Homolog annotation: Hit_ID=P56772; Match level="QueryCoverage=79%, HitCoverage=38%, E-value=3e-30, Identity=88%"; Hit description=ATP -dependent Clp protease proteolytic subunit
  Pfam annotation: Domain name=CLP_protease; Domain location=3-93; Score=-19.3; E_value=4.2e-07; Accession=PF00574.13; Description=Clp protease
MNCRDGKAVCINTQKMLVRVMIHQPASSFYEALTGEFILEAEELLNMRDTITRVYVLRTGIPLWVISEDMERDVFMSAAEAQAHGIVDLVAVE

SEQ ID NO: 175119 - protein, 152 aa, Glycine max
  Coding DNA Sequence Number=SeqID_58341
  Homolog annotation: Hit_ID=Q1SFS3; Match level="QueryCoverage=54%, HitCoverage=16%, E-value=3e-08, Identity=32%"; Hit description =Lambda repressor-like, DNA-binding
MGLSQAPSLKKRFYQVKVKSLGVAGLKELGQLMGQLQQQAFHKAYGKIWDLAMVEVSTEAIASLAQYYDQPLRCFTFGDFQLSPTVEEFEEILGCPLGGRKPYLFSRFYPSLARISKIVQVSTQELDRGKQVEMGWLEYQGNVKKQKQESWQ

SEQ ID NO: 175120 - protein, 131 aa, Glycine max
  Coding DNA Sequence Number=SeqID_58342
  Subcellular localization annotation: CTP_CleavageSite=18; ConfidenceScore=5.36e-01
MATPPSSPPPHPESAKPSSSTSKKTRKETRLKSLATRLVGAERPMVHVDPAIGKVDDLTFKWALADDKEDEDDKVCEKYDISYDYLEEKLMEDKKKKRLEEATRSGSTHTIVDPPSLIRQHVKWMARTKKS

SEQ ID NO: 175121 - protein, 116 aa, Glycine max
  Coding DNA Sequence Number=SeqID_58343
MYPCMSNSSRTSSSSTVVEVGDELLAVSNEFDKLLGVTSVGTCSLCEHNQYNQKSGSSLQPISFHPKPPRDSKSSVMRILKLTKYRLKAQVEKDEGPSGEGQSPQVEKDEGPSGER

SEQ ID NO: 175122 - protein, 183 aa, Glycine max
  Coding DNA Sequence Number=SeqID_58344
  Gene Ontology: Mol. function=transcription regulator activity; Cellular component=nucleus; Biological process=regulation of transcription
  Homolog annotation: Hit_ID=Q1S0Z7; Match level="QueryCoverage=85%, HitCoverage=60%, E-value=2e-25, Identity=41%"; Hit description=Helix- loop-helix DNA-binding
  Pfam annotation: Domain name=HLH; Domain location=33-85; Score=40.7; E_value=4.9e-09; Accession=PF00010.16; Description=Helix-loop-helix DNA-binding domain
MAVIFVQVKGQGKSSKHLHVEEKEDFIAMDENKKWMHKETERQRRQEMGKLCATLRSLLPLEYIKGKRSTSDYVNEAMNYINHLQNKVKQLQAKRDELVKVSNLKSNICSENESSSSSTTHLPPLVSVHPFPGGLEIMCGYSFGKSVFPMSRVLDILLKEGINVVSTTSIRRDGRFIHTIRSE

SEQ ID NO: 175123 - protein, 215 aa, Glycine max
  Coding DNA Sequence Number=SeqID_58345
  Gene Ontology: Mol. function=nucleic acid binding; Cellular component= chromatin; Biological process=DNA integration
MDDEINSIEKNDIWEMCDLLKGQNTIGVKWVFKKKLNKDGDVDKYKARLVAKGYKQHYMNDYTKVFSPVARHDSIRLVVALAAHAKSFPIFQLDIKWTFLHGYLEEHVFIDQPPNYVKVGYENKVYRLKRALYWLKQVPRVWFQMKNCNAVSTIVECGIKLHKDHDGKKVGNILYKQIVGSLMYLTTTRLDIMYFVSFCGHLKSNQLSPCQAKYG

SEQ ID NO: 175124 - protein, 273 aa, Glycine max
  Coding DNA Sequence Number=SeqID_58346
  Gene Ontology: Mol. function=transcription regulator activity; Cellular component=nucleus; Biological process=regulation of transcription
  Homolog annotation: Hit_ID=Q1S0Z7; Match level="QueryCoverage=90%, HitCoverage=100%, E-value=4e-57, Identity=51%"; Hit description =Helix-loop-helix DNA-binding
  Pfam annotation: Domain name=HLH; Domain location=101-153; Score =50.2; E_value=7.1e-12; Accession=PF00010.16; Description=Helix-loop -helix DNA-binding domain
MNLLPSAPISKVDDSLEHSLSFESTMFPLQRGNELVIQFSNSPHHHLQHKMSQDLILDDYASLDVNDSNQKFSTSSISQPTKKLFYGANKKNHDYSNEHKKKMIHKEIERQRRQEMATFYASLRSLLPLEFIKGKRSISDHMNEAVNYIKHMQKHIKELGAKRDELKKLSNHSNNMENNHEGLHTSCNFTVHEKNGIMGIEITSVFREEKPKISKLLQFLTEEGLEVVSFFSTEVNGRLLHSVQCEVNHSNSVDPSELRKKVSKAFSTFRCSD

SEQ ID NO: 175125 - protein, 398 aa, Glycine max
  Coding DNA Sequence Number=SeqID_58347
  Homolog annotation: Hit_ID=P27323; Match level="QueryCoverage=17%, HitCoverage=10%, E-value=2e-22, Identity=78%"; Hit description=Heat shock protein 81-1
  Subcellular localization annotation: CTP_CleavageSite=37; ConfidenceScore=5.35e-01
MTVPLCILALKRSPVGKFSRLLLLSIPTARKPTLSSRLDNKTSRNRGEFRKQKGYLSTSLQCLHERLGPGTCNGTTVVHQICFGHSNVAVNNGKSLVGFVGHKTNEEIWLSIELALVRMILHNFYCNNDIIPLRRWLRRWWWMWRWASTPVRNKTKLSHSSRENPNPTRMNLVRDDGVPEQDDVVVIEDLVVMVVVGAERQRQQLVGLDVAVDVETVVLPQSNGEVGGARIDSGSRTISLSIHGKRSRDGCGVLLPGCGAWNRRRHRKGRRNMGVRYRKWHWAVWVSPFLRIKLRRRHVRLRRRRVLAGVFSAKEIEFEEHGGVEHIKMKLRSMESEIHGSLGCGEVGHGGLEAVQAGGERIGICHGKATKKGQVGLIDTNNATLMLPLYYQETKKEH

SEQ ID NO: 175126 - protein, 690 aa, Glycine max
  Coding DNA Sequence Number=SeqID_58348
  Gene Ontology: Mol. function=protein serine/threonine kinase activity; Cellular component=membrane; Biological process=protein amino acid phosphorylation
  Homolog annotation: Hit_ID=Q9STJ8; Match level="QueryCoverage=90%, HitCoverage=90%, E-value=1e-122, Identity=44%"; Hit description =Receptor kinase-like protein
  Pfam annotation: Domain name=Pkinase; Domain location=77-644; Score =17.7; E_value=1.3e-09; Accession=PF00069.15; Description=Protein kinase domain
  Pfam annotation: Domain name=Pkinase_Tyr; Domain location=78-644; Score=-35.9; E_value=2.9e-10; Accession=PF07714.7; Description =Protein tyrosine kinase
  Pfam module annotation: Pfam domain module=Pkinase::Pkinase_Tyr; Domain location=77-644::78-644
  Subcellular localization annotation: CTP_CleavageSite=25; ConfidenceScore=5.11e-01
IPDPYPFPQQPPRHHHHHHFLTPLLAATVSTCSLLLLLILFCHRTLTRKRATTHLPSPAATSPPHRLSFSVLRRATNSFSTRLGHGGFGPVFAGTLAGAPVAVKLMDSNTNHQQGEREFHNELFFASKLLSRHVITATHFSSDPKRRHFLLVYELMQNGNLQDALLHRKCPELLNWNTRFSIILNVGKGIHFLHSYDPPVIHGDIKPSNVLLDRDFWPRIGDFGLARLSSDTPRFEVEVLECGSVDNDEEKMKTKKKEEEEEVVVVDDCGSVESAHSVFMEEGDMGVEQSPSPEMAAMTSPETNLAVAEASPGFEKGSAQSEKEGVKKINEKGLKSNSVRDWWWKHEDEVGVGEGKKVKDYVMEWIGRDVNKERVKSGIELENVEIGKEEKNKKEKKRRKKELEWWESMEEEKFDGVVKGKRRTVREWWKEECFEENVNAKTTKKKKKEKKKRKGGSVKSDDDENCGDDWWMSDDAMDKRKGKSRSRNNRGNMDCWMDGLSGELWRGRRNNSFDSASGEIPKSGGVSSTPSIRGTVCYVAPECGYGGEVSEKCDVYSFGVLLLVIISGRRPLQVSGSPLSEFQRANLLSWARHCARNGKLVELVDESIELLDKEQALLCIRVALLCLLKSPARRPSMKEVVGMLSGELEPPQLPVEYSPSTPSRFPFKSSRKGRKKCIGILGGESYALTI

SEQ ID NO: 175127 - protein, 135 aa, Glycine max
  Coding DNA Sequence Number=SeqID_58349
LTYNSKPQETQHKDAQAKVEYVKRLYDQVKVQIAKKNESYAKQANKKRKEVVLEPGDDPGHLRANIFQEGGNDENPETGQIQTYQGNPCGVYPDLSSFTGSGIIQFSVACIKRSAPSQDHITMGIIFKQMPLAFN

SEQ ID NO: 175128 - protein, 760 aa, Glycine max
  Coding DNA Sequence Number=SeqID_58350
  Gene Ontology: Mol. function=identical protein binding; Cellular component=cytoplasm; Biological process=negative regulation of enzyme activity
  Homolog annotation: Hit_ID=Q1S0Z4; Match level="QueryCoverage=99%, HitCoverage=96%, E-value=0.0, Identity=70%"; Hit description =Orn/DAP/Arg decarboxylase 2; Protease-associated PA; Proteinase inhibitor I9, subtilisin propeptide
  Pfam annotation: Domain name=PA; Domain location=356-456; Score =103.4; E_value=6.7e-28; Accession=PF02225.12; Description=PA domain
  Pfam annotation: Domain name=Peptidase_S8; Domain location=105-595; Score=87.1; E_value=5.5e-23; Accession=PF00082.12; Description =Subtilase family
  Pfam annotation: Domain name=Subtilisin_N; Domain location=12-97; Score=91.5; E_value=2.6e-24; Accession=PF05922.7; Description =Subtilisin N-terminal Region
  Pfam module annotation: Pfam domain module=PA::Peptidase _S8::Subtilisin_N; Domain location=356-456::105-595::12-97
MLFPANAQFAKKTYLIQMDKSAMPKAFPNHLEWYSSKVKSALSTSPEADMDNEERIIYTYQNAFHGVAAKLTEEEAEKLEAEEGVVTIFPEKKYELHTTRSPTFLGLEPEKSTNMWSEKLAGHDVIVGVLDTGIWPESESFKDVGLRPVPSHWKGTCEIGTGFTNSHCNKKVVGARVFYHGYEAAIGRINEQKEYKSPRDQDGHGTHTAATVGGSPVHGANLLGYANGTARGMAPGTRIAAYKVCWIGGCFSSDIVSAIDKAVADGVNVLSISLGGGVSSYYRDSLSVAAFGAMERGVFVSCSAGNSGPDPASLTNVSPWITTVGASTMDRDFPSDVKLGNGKKIIGVSLYKGKNVLSIKKQYPLVYLGSNSSRVDPRSMCLEGTLDPKVVSGKIVICDRGLSPRVLKGHVVRSAGGVGMILTNTEANGEELVADSHLLPAVAIGEKEGKELKSYVLSSKTATAALAFKGTILGIKPSPVVAAFSSRGPNFLSLEILKPDLVAPGVNILAAWSEAIGPSGLKIDNRRVKFNIVSGTSMSCPHVSGVAALVKSRHPEWSPAAIKSALMTTSYVLDNTKKTLRDSSTAKPSSPYDHGAGHIDPIRALDPGLVYDMVPQDYFEFLCTQNLTPTQLKVFAKYSNRSCRHSLASSGDLNYPAISSVFTQKTTTSFPSPVILHRIVTNVGPPDSKYHVVVSPFKGASIKVEPETLNFTRKHQKLSYKITFKPKVRQTSPEFGTLVWKDGFHTVRSPIVITWLPPPM

SEQ ID NO: 175129 - protein, 129 aa, Glycine max
  Coding DNA Sequence Number=SeqID_58351
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1SBL9; Match level="QueryCoverage=81%, HitCoverage=26%, E-value=1e-27, Identity=56%"; Hit description=Beta -glucosidase, putative
MDLAKSIRQELIINYNKLINALLAKGIESYVTLSLGPTSNLGKQKFGDRVKHWITFNEPHTFSTQGYDVGLQAPGRSPFSFTCSASKPYIVAHNVLLSHATVAYIFIGKIYKYRCSPSEIIGRITRGSF

SEQ ID NO: 175130 - protein, 79 aa, Glycine max
  Coding DNA Sequence Number=SeqID_58352
MTILNQNRTNHHKRGISLQDKNREAIFNSNNIERAVNIHVGIETLALDMISIAYHHRKWRDRGGGKFEMTSYLRLNDVV

SEQ ID NO: 175131 - protein, 62 aa, Glycine max
  Coding DNA Sequence Number=SeqID_58353
MEVSHDAQEFIVTPMRFDARVFVAKFWKKNLRCYKGGRHEKRYGSVTPEEGEAHRRLCQYAA

SEQ ID NO: 175132 - protein, 70 aa, Glycine max
  Coding DNA Sequence Number=SeqID_58354
MDDGLGGDEDWMGYVFSCLFMREALGVGEGVGKHADGEMGECVLVGLHFGELSEERWWACREGFEVVQFE

SEQ ID NO: 175133 - protein, 165 aa, Glycine max
  Coding DNA Sequence Number=SeqID_58355
  Gene Ontology: Mol. function=transcription factor activity; Cellular component=nucleus; Biological process=regulation of transcription, DNA-dependent
  Homolog annotation: Hit_ID=Q1T072; Match level="QueryCoverage=71%, HitCoverage=33%, E-value=2e-45, Identity=74%"; Hit description =Pathogenesis-related transcriptional factor and ERF
  Pfam annotation: Domain name=AP2; Domain location=43-113; Score =121.2; E_value=3e-33; Accession=PF00847.10; Description=AP2 domain
  Subcellular localization annotation: CTP_CleavageSite=31; ConfidenceScore=5.70e-01
MAKQQTHEINASTNNNINTTKTVTTKVKRTRRSVPRNSPPQRSSIYRGVTRHRWTGRYEAHLWDKNCWNESQNKKGRQGAYDDEEAAAHAYDLAALKYWGQDTILNFPLSTYQNELKEMEGQSREEYIGSLRRKAAVFLVEFLNTEVLQGTIIIHLFYNLKIRPK

SEQ ID NO: 175134 - protein, 322 aa, Glycine max
  Coding DNA Sequence Number=SeqID_58356
  Gene Ontology: Mol. function=protein serine/threonine kinase activity; Cellular component=mitochondrion; Biological process =protein amino acid phosphorylation
  Homolog annotation: Hit_ID=Q1SDW8; Match level="QueryCoverage=89%, HitCoverage=80%, E-value=3e-82, Identity=72%"; Hit description =Protein kinase
  Pfam annotation: Domain name=Pkinase; Domain location=50-272; Score =86.1; E_value=1.1e-22; Accession=PF00069.15; Description=Protein kinase domain
  Pfam annotation: Domain name=Pkinase_Tyr; Domain location=50-272; Score=4.9; E_value=9e-13; Accession=PF07714.7; Description=Protein tyrosine kinase
  Pfam module annotation: Pfam domain module=Pkinase::Pkinase_Tyr; Domain location=50-272::50-272
MVFSVGYYLLRRQARKSFRTILKENFGHESAILEPLQFDLAVIEAATNNFSNENCIGKGGFGEVYKGILPDGQQIAVKRLSRSSKQDSKRQKLLSWCERYNIIGGIAQGILYLHEHSRLKVIHRDLKPSNILLDENMIPKISDFGLARIVEINQDKGNTNKIVGTLGYMSPEYAMLGQFSEKSDVFSFGVMILEIITGKKNVNSYESQRIGHSLLSYVWKQWRDHAPLSILDPNMKGSFPEIEVIRCVHIGLLCVQQYPDARPTMATIVSYMSNHLINLPTPQEHAFLLQMDPKAIVQESSSSQSSTLLSNNEISITEFLPR

SEQ ID NO: 175135 - protein, 238 aa, Glycine max
  Coding DNA Sequence Number=SeqID_58357
MVVKPFNGDSPKIKLRDKSSQIDDGVGKDEAPRNILADVGAHIRPEEIVLKMMKRLIGRPGGRQIGLSAIESLEVAIWLHIDGVGIGKKMDVVSNGTMTAKTRPKHAGLGSSVLSYWVEAESRRISSYKAQVFEPLDLENFVCAIEGKVEEVVIAHHNLHCRCGRSRQIEELCNAYLNEIVSVIPIDKDNDAVVRDMVVDAEGFCHRHPEHCVGAFRGDRQKFVREKGQWWVGHIQRK

SEQ ID NO: 175136 - protein, 202 aa, Glycine max
  Coding DNA Sequence Number=SeqID_58358
  Homolog annotation: Hit_ID=Q1SAV4; Match level="QueryCoverage=82%, HitCoverage=64%, E-value=2e-08, Identity=35%"; Hit description =Integrase, catalytic region
MDGLIEVLNCILEQYLRAFVHDKSVTYGKSPSSIPSYLLGSSPVEAIDSLLATQATIHETLQCHLSKAQATMKRHKVTHRCDVQLSVNDWPYQGPSPPSPDPLPPMATDNHPIIEHMSILDWKWDTTTNPLTKLPLVHWFGLPSEDTTSEHWEDLWASHNLLDKVNFPEKGSEDCLSSNSVIILLFSALLRILLDKVNFPEK

SEQ ID NO: 175137 - protein, 509 aa, Glycine max
  Coding DNA Sequence Number=SeqID_58359
  Gene Ontology: Mol. function=protein serine/threonine kinase activity; Cellular component=anchored to membrane; Biological process=protein amino acid phosphorylation
  Homolog annotation: Hit_ID=Q9M0X5; Match level="QueryCoverage=98%, HitCoverage=37%, E-value=6e-44, Identity=38%"; Hit description =Receptor protein kinase-like protein
  Pfam annotation: Domain name=DUF26; Domain location=192-246; Score =86.4; E_value=9e-23; Accession=PF01657.8; Description=Domain of unknown function DUF26
  Pfam annotation: Domain name=DUF26; Domain location=322-376; Score =81.2; E_value=3.2e-21; Accession=PF01657.8; Description=Domain of unknown function DUF26
  Pfam annotation: Domain name=DUF26; Domain location=437-492; Score =56.7; E_value=7.6e-14; Accession=PF01657.8; Description=Domain of unknown function DUF26
  Pfam annotation: Domain name=DUF26; Domain location=81-135; Score =64.4; E_value=3.6e-16; Accession=PF01657.8; Description=Domain of unknown function DUF26
  Pfam module annotation: Pfam domain module=DUF26::DUF26::DUF26::DUF26; Domain location=192-246::322-376::437-492::81-135
MAYFKLPFLIIILVTLLNFSTSHAQDDPFYLYQYCSSNRTTANTSFQINLRTLLSSLSSHATGDTQFYNTTFTGTNPSDTIYAMFMCRGDVPSQLCQACVINATQRLSSECSLSKESVFWYDECMVWYSTNPIFTTVATTPSFHLLNTGNVSNPQTFMRLLFQTMNQTGEEAAGNPKKFATREVLVSELQSLYCLVQCTPNLSPHDCKTCLDEIIGELPSCCQGKIGGRVLNPSCNIRYEMYPFFLSTLNTQTPKLVPETKFSEEDTKFSEDPVYLSHNCLSSKTFTVSSTFQKSLNTLFSYLSSNATNGKSFHDANINNQVYGLFMCRGDVPSPNCEQCVLNATHRMLSECGSFQEAIIWYSHCLLRYSHRNFFNMVEKSPVFSRLNITRFSSPDQGQKFFIFVLSNALSKVAIEAGDSDERFGTKSLKLNDLQTLYTLGQCTRDLTSDDCKGCLGDVIGPGIPWSRLGSVGGRVMYPSCNLRFELVQFYKDGDQAATPSSSGEVLPQ

SEQ ID NO: 175138 - protein, 68 aa, Glycine max
  Coding DNA Sequence Number=SeqID_58360
MPLVSSLVVEERAGEGSTSKAGQGITEGGVGGAFGVARALTRLGPGKTLEGTVGFTTGLTHLLLETHI

SEQ ID NO: 175139 - protein, 87 aa, Glycine max
  Coding DNA Sequence Number=SeqID_58361
MEVKLGDVRVGTNMGQGLELELEEEGWGELNDSEGNGKNPKGNERVGLVVGMRKFIENPKEVDGVVAGITGWVVGSVLGGCGHNRNR

SEQ ID NO: 175140 - protein, 82 aa, Glycine max
  Coding DNA Sequence Number=SeqID_58362
MTGVGLVQSSEVFVLINCLVLGLDLTADSGKPGDSDSSVLRSSEEEMDDEGFLGRVPDSSWIVPHIPSPPTSIIKKILPLGW

SEQ ID NO: 175141 - protein, 99 aa, Glycine max
  Coding DNA Sequence Number=SeqID_58363
MELIASNKRSCSLVRVLIWLSSSSSEVSMSKLLIFSSMADSSVEAKLHGESKNNSRVQDKNQEEFKTQEESLESRIKIQGSRSQESRSRFKTQEKAQSR

SEQ ID NO: 175142 - protein, 192 aa, Glycine max
  Coding DNA Sequence Number=SeqID_58364
  Subcellular localization annotation: CTP_CleavageSite=65; ConfidenceScore=5.69e-01
MPPKATGSSDRGGKSFGNGSLLTLPEPTVKKSSSISSGSPTQAGSLTQKTKFEGSSTQIATIKPKSSTQDSPKPAAPDQVKNWFQAHPEFLKPADLETSLFLNQKSQLAAFLANSKSKESLAKNLKEVLQLLQQEEEEGSSSKKEENKSSKENDDPFYQNEDDCFGISLEDALTPEISGGSNGQIGSKNDAV

SEQ ID NO: 175143 - protein, 133 aa, Glycine max
  Coding DNA Sequence Number=SeqID_58365
  Homolog annotation: Hit_ID=Q8H6Q8; Match level="QueryCoverage=55%, HitCoverage=2%, E-value=3e-11, Identity=45%"; Hit description=CTV.20
MDDWNIPKIPQDTLYVPETIKDKHNFDYIIIIVENNIPLGQDIGEEFHLLSKNSIVNIVPLIDMGIDAAVLMCLRDIRHNKFEDSFIGTVETSLGQGLIYFNCYPNKIVSLMDKNILDSLFLNIHFHGLDMKE

SEQ ID NO: 175144 - protein, 103 aa, Glycine max
  Coding DNA Sequence Number=SeqID_58366
MTYMYDDLRRAFHGQTARGRNKAHEHKPQVFLLDKKSKITSNTKKGFRDQDKLTFQILKPQASCPSSGLVMMGHKFLFQHLVKTGDAGEDERGCWVKSGKGWL

SEQ ID NO: 175145 - protein, 208 aa, Glycine max
  Coding DNA Sequence Number=SeqID_58367
MVRCNTGEQGWFDGTVEGGDDTVLCARVKKVFVVDKDAPTQQNQLTKAGVVILLRGLTAGGGGAYVLLLSFPDPSKTPCPQVRELEVESAWAAEVAWVAESAWVMESAWAAELWQGAGSRGGVDMGGGGGGGDDTEEEGLAKAALRRSSRAAESSTFAIRVEAGMPAMEDSHKSFVWRVVWIAVVEAGMAAIEGSHGQVVVVPMCYCY

SEQ ID NO: 175146 - protein, 66 aa, Glycine max
  Coding DNA Sequence Number=SeqID_58368
MARGVDANKAKVRPDEGVVRRYHNNGKEEDRKVLRDKDVAVVVGGVDDSEGGGDAITTTGRKKIER

SEQ ID NO: 175147 - protein, 92 aa, Glycine max
  Coding DNA Sequence Number=SeqID_58369
  Subcellular localization annotation: CTP_CleavageSite=30; ConfidenceScore=5.37e-01
LTTTTSHSLSLSLLSLVVGVRVYRGFGFVPSSLLQQWRNLGEVVALPPVLFLTPPLAPLPPLPPLPPEALAVATLPRRGVESTANFLDRSAI

SEQ ID NO: 175148 - protein, 69 aa, Glycine max
  Coding DNA Sequence Number=SeqID_58370
MISEVDSDDGGHINLTEFTELNTKKLEDSFSIFDSSSNSTISAKELCMVAASLISECSVEECLKNNWQH

SEQ ID NO: 175149 - protein, 807 aa, Glycine max
  Coding DNA Sequence Number=SeqID_58371
  Gene Ontology: Mol. function=RNA-directed DNA polymerase activity; Biological process=RNA-dependent DNA replication
MSVPGEVNGTALDRQPTSEMETWTSHKAGIIDFMHDQGTQYDCGVGNIQLAPSNDTCVLQADVSGHIIKNKETIHTPVTNNHKEACDLSADVTGPLIVGLISPTPVELVTQQNLNPTVNTETPGMLKMYMRSKGCRKQKAHTSANVCQMDESTKINTLKQIKVDITKNNWSSKEAELPPNEALMSSACQVQIVEEPPSTSANSSQYLQEAEHQWMMAGQMGVLWDTDHKSIIDKIWAMENKDRKEAEKLGNKSCGGLLCIWSEKSFKVERKVSGRGFILLEEVWIGEDHKLIIANIYALCDPSSKRALWESLKQLKNLNPTGLWCLLGDFNNVRNPAERVGLSQRGAEDKIVSEFNEWIEDLEVVEPPWVGRNYTWFRPNGTAKSKLDRALVSPDWFTKWPARYLTAGSRIAHSRRQFLNVGHSHNKRGGEQFRDTFKKVWNIEAELNKLENDTADRQLTSQEIMYQKRLQQDLWTVANSHESLMRNNALNEVYINGSWVEEPARVKEEILKPDFLRFLDKFHANGIFPKGAGRQLLHCVIIINEAVEEARRSQMPCLVFKVDYKRAYDSISWDFLFYLLRRLGFCNKWIQCLGLGVVEALTVLMREAVNKQLFTEFPVGKNKIPVSILQYVDDTIFFGEATLQNVKVINAILRVFELASGLKINYAKSSFGAVGKSEQWCKEAAEYLNCRILPIPFIYLGIPIGVNPRRSELWDPIIRKFERKLAKWKQRHLSFEGRDILMGRRIGTKEDCLGQMGNNLSPKRKGRAGHKRYYDIQQSITWKMEVKESTKNHFGDRTSWQSSMNNS

SEQ ID NO: 175150 - protein, 241 aa, Glycine max
  Coding DNA Sequence Number=SeqID_58372
  Homolog annotation: Hit_ID=Q42669; Match level="QueryCoverage=32%, HitCoverage=10%, E-value=1e-33, Identity=89%"; Hit description =Aconitase
MDRTVNLPKGYGYVQFKTRGDAERHYSTWVAQIDGNVMKARYTLPPRQKVSPPPKAFAVAPKRDTPRTDNASADVNKDGPKRQRECIYVEVSSMLLEKLVAAGIGNRPVVFVTHSASRPCSCASDEFLRIIRHYNVAYRFMIVRLGLIVAASIAALTVEQLNVNNTRSATDLVLTVTQILRKHGVVGKFVEFYGDGMGELSLADRATIANMSPEYGATMGFFPVDHVTLQYLKLTGRSDET

SEQ ID NO: 175151 - protein, 996 aa, Glycine max
  Coding DNA Sequence Number=SeqID_58373
  Gene Ontology: Mol. function=protein serine/threonine kinase activity
  Homolog annotation: Hit_ID=Q2M405; Match level="QueryCoverage=32%, HitCoverage=53%, E-value=2e-33, Identity=29%"; Hit description=CRN -like CRN8
  Pfam annotation: Domain name=Pkinase; Domain location=788-990; Score=- 94.9; E_value=0.0066; Accession=PF00069.15; Description=Protein kinase domain
MGDKGGTTKKQQLQQPQPKQPQSHHHHQQQQQQAQQISSSPKASHEEPITEVIRPIHHHHQQQLSPVVVATGAPPFIPSPLYVSSGASCSPFEPQFETLNPKRPRYSGQWKQLLPSPPAQQQQSQMAMFPTSESSPSPTTHTSSNPLQQQPQTQTASSSDTSSSPTHSLPLLSGEGTNQEGEQVHQQLRKGKYVSPVWKPNEMLWLARAWKEQYQGGGGGSDSSSRAEQQQQAELGITRGKTRADKDKEVAEFLKRHGVNRDAKTAGTKWDNMLGEFRKVYEWERGGEREQIGKSYFRLSPYERKLHRLPASFDEDVFDELAQFMGSRMRSSHGRAVSTFVSRDEARTALASTRALPPPPRPFKDDETPLSARTKQLTLASGGEPFFHGSRGGLLGLDSLLDVSGSSSSSKELRRIGKIRMTWEESVTLWAEEGEVHRGRVKLQSSSLLNADELTCFDDAMVPCPMEYFEDGPLKGFSVDRFVSGQQVKVFGRRKSSPASDSSSSAGFAERVQLPSKALPIRCIGTLNFRDPTDYYMECLLRASPQTLPSLLELKRHLKEPPPEDLRFPLRRDMYEDLPQGKELFFTTTPEPLDCRNIMYDVVGPIIRPTTISLATSSSRDSFIPLWDDCINRIIQKFCPEQLTLIRKPTSPPPQSESESTNNSQLQDQWPNVTGFVNNYCLWRGEETHQLKDSQPNPSTTLVAKLLWTYMDIPYILGYYAVANTVTFCAMSRSQDGIINRTDLLDLNLSTPTERLKVLVPCFRIALLLPLLSKRCMSNISNCKGFTYSDFERVCYGNGVVTEVTPNTCTRVFSEKRKWMAVKEVYEILDHRIPHAEVLVGVSERELGLSFKPRGCRVRPGNWEELVEALKYVTKALVALHDLSFMHRDLKWEKVMRRMDREEEWFVCGFDEAAGAPELKGWRVVGAREGHAPEMERGLHGVKVDVWGVGNLIRTCGLGGVPKMLRELQSRCMEQNPEQRPTAADCYHHLLQLQSS

SEQ ID NO: 175152 - protein, 84 aa, Glycine max
  Coding DNA Sequence Number=SeqID_58374
MGDANSKFEILNWAFQTVFQRWIASGGSNPVRLGELGGNLLPLFPIKRQNGVVLRVPDSPGYAFQLFWVKKIVFEKKIQAEVFP

SEQ ID NO: 175153 - protein, 305 aa, Glycine max
  Coding DNA Sequence Number=SeqID_58375
  Gene Ontology: Mol. function=protein transporter activity; Cellular component=integral to membrane; Biological process=intracellular protein transport
  Homolog annotation: Hit_ID=Q2HSW7; Match level="QueryCoverage=90%, HitCoverage=99%, E-value=2e-88, Identity=65%"; Hit description =Target SNARE coiled-coil region
  Pfam annotation: Domain name=SNARE; Domain location=190-252; Score =58.4; E_value=2.4e-14; Accession=PF05739.9; Description=SNARE domain
MSVIDILFRVDDICQKYDKYDIDKQRELNAYGDDLFARLYAAVESSIQSALNKSEVASTEKNRASAAALNAEVRRTKGRLMDELPKLRKLVHKKALPPYPTHFLTQQQVKGLTKEDMAIRQDLVLALPERIQAIPDGISGAAVQTAGWTATSSQPHIKFDSSEGHLDSDYFQQSEESSQFRQEYEMRRTKQDEGLDIISEGLETLKDLAQDMNEEIDRQVPLMDEIDRKVDRAAADVRNTNVRLKKTLTEIRSSRNFCIDIVLLCVLLGIVLYLYNCLISYMKYHCSFVYFTRLLIVTAFWHTTK

SEQ ID NO: 175154 - protein, 124 aa, Glycine max
  Coding DNA Sequence Number=SeqID_58376
MINQWNNRTDFRVDVYPRQEGLLSFNSDYMVWYRRKTKMFVDPKNSNMATLERIIEPLSHGPATEREFLTQQLNILQSSIETKGIVKRREIVEAEPYVYPQMAERGHGMYYAPLAFSQYPTQMY

SEQ ID NO: 175155 - protein, 114 aa, Glycine max
  Coding DNA Sequence Number=SeqID_58377
  Subcellular localization annotation: CTP_CleavageSite=22; ConfidenceScore=5.09e-01
MTVLMMRSTLATMTAPYAVFMPCSMLHQYPTTHRHADTCTMTYPASTTSGFFMHGVSPLPLARYPMPSAQDHHLHASIMSMQPSSIAISASQSGGIAAARGIRQCHLWDSLRLV

SEQ ID NO: 175156 - protein, 89 aa, Glycine max
  Coding DNA Sequence Number=SeqID_58378
MTFASGLVQHKAPKGSASGISDIPHAIHPPTIHQHAIHPCIFSANQTGAFAAAPSSVQFRTSSASRLGDIALQISPAVLARNPWCSANV

SEQ ID NO: 175157 - protein, 258 aa, Glycine max
  Coding DNA Sequence Number=SeqID_58379
  Gene Ontology: Mol. function=ATP binding
  Homolog annotation: Hit_ID=Q05202; Match level="QueryCoverage=41%, HitCoverage=13%, E-value=3e-24, Identity=50%"; Hit description =Ferrichrome receptor fcuA precursor
MTGLHYSEQTQRVYAANGSGEILVINPRSNRIEKRWKPLGDQPALLLNMAEDEATGRLFVTDNSKAKTTLVLDIHTGKLLKRLDVGDSLAVVFNPRRNEIYISQRESGNVLSLDATTYAVKQRWPLPPNPNSLLLSADGQTLFVTVKQPFNKDHSTQGPDSVGALAADGGAKKNQEDTLVVRAEKHGDFNSGGNDLVPAYLDGQVAHGGRLGMLGEQKAMDVPFNVIGYTAKLVQDQQAKTIADVVSNDAGVQAVQGY

SEQ ID NO: 175158 - protein, 166 aa, Glycine max
  Coding DNA Sequence Number=SeqID_58380
  Gene Ontology: Mol. function=isopentenyl-diphosphate delta-isomerase activity; Biological process=isoprenoid biosynthetic process
  Homolog annotation: Hit_ID=Q5PL31; Match level="QueryCoverage=94%, HitCoverage=87%, E-value=2e-63, Identity=69%"; Hit description =Isopentenyl-diphosphate Delta-isomerase
  Pfam annotation: Domain name=NUDIX; Domain location=18-152; Score =54.3; E_value=4.1e-13; Accession=PF00293.18; Description=NUDIX domain
MVIGTQEKYAAHTLHTPLHLAFSSWLFNANGECLITRRALTKKAWPGVWTNSVCGHPQSGEETIQAIIRRCRFEVGAELTDITAVAPEFRYRETDPSGIVENEICPVFAARITNDVTINEDEVMDYQWVELDALFRALDATPWAFSPWMVMEATTAREKLKAFAAQ

SEQ ID NO: 175159 - protein, 128 aa, Glycine max
  Coding DNA Sequence Number=SeqID_58381
MQKVYTDNHSGISARQRDSKVSMTDLVSAEDNPRLTKGEEDDVSLCVLSGFSSYRQQKVYTDNHSGISARQRDSKTANLYTDNHSGISARQRDSKVSMTDLVNAEDDVNLHVSTSLSAAIDEGRRRRR

SEQ ID NO: 175160 - protein, 159 aa, Glycine max
  Coding DNA Sequence Number=SeqID_58382
  Homolog annotation: Hit_ID=Q47522; Match level="QueryCoverage=33%, HitCoverage=66%, E-value=3e-25, Identity=100%"; Hit description=LacZ protein
  Subcellular localization annotation: CTP_CleavageSite=38; ConfidenceScore=5.40e-01
MGKGSRQNGSVTSGKGLALRAGHGGPSPEPVGCRWTARAASAARAGRRVPVGGRIGNGPFGASSPGVEQSTQNCESYYNSLAVVLQRRDWENPGVTQLNRLAAHPPFASWRNSEEARTDRPSQQLRSLNGEWDAPCSGALSAAGVVVTRSVTATLASAD

SEQ ID NO: 175161 - protein, 146 aa, Glycine max
  Coding DNA Sequence Number=SeqID_58383
MAARALGVPRHLRAPGVGLWAPHSARLETRTKESDMCASQRASKPVRRKEADWWDPPVAGRSQRKLWWRPAAILTIAGARGRVLSGRCGCSVEPRHGIESSKWAIFGKQNWRCGMNRKLGYGAQLRANLDPTKGVGRLRQQDGGHG

SEQ ID NO: 175162 - protein, 227 aa, Glycine max
  Coding DNA Sequence Number=SeqID_58384
SLNTFLETPVVLAEGESLPAYSRYYRMPTDIREIEAALCIPGGGCVLNAEGHPGNILRKDLTTLAQVWSVLSYSNLAPTSHTSDLTVDRARLIFSLVSQIDMNVGALISGQITSMAQSNSSRLGFPAVITTLCRSRGVASDNLVFERLSPVINLAYIRKNYWNPDDLTVIIRGARRARARPAEAPSTFAAPPPARTSATPSTPPSARTFHLKFVDHVFSSFSEVFLK

SEQ ID NO: 175163 - protein, 92 aa, Glycine max
  Coding DNA Sequence Number=SeqID_58385
  Gene Ontology: Mol. function=DNA binding; Cellular component=cytosol; Biological process=regulation of transcription, DNA-dependent
  Homolog annotation: Hit_ID=Q8S8I2; Match level="QueryCoverage=91%, HitCoverage=36%, E-value=4e-17, Identity=50%"; Hit description =Protein ULTRAPETALA2
MILDFKRGEDYIEVLCGATNKNYGDYVGRLKINNEGQYFITCECCLECPLVNVTLEEFEKHALREGSGRWKRNIWVHCEDEDKVPLWKTPLI

SEQ ID NO: 175164 - protein, 101 aa, Glycine max
  Coding DNA Sequence Number=SeqID_58386
  Subcellular localization annotation: CTP_CleavageSite=54; ConfidenceScore=5.51e-01
MAPPLTFSPLSSAASPCCPYSPYISSIYFCSSFTISSSSSSRSLHLELKAFHVYAAELASGLAPDHAEFAGYGPAVASYEPGGVCLESDLARSPAFSFGRG

SEQ ID NO: 175165 - protein, 104 aa, Glycine max
  Coding DNA Sequence Number=SeqID_58387
  Gene Ontology: Mol. function=steroid hormone receptor activity; Cellular component=nucleus; Biological process=regulation of transcription, DNA-dependent
  Homolog annotation: Hit_ID=Q1SFD4; Match level="QueryCoverage=69%, HitCoverage=13%, E-value=2e-15, Identity=56%"; Hit description =Steroid nuclear receptor, ligand-binding
MNGPKDGVFEWFIGPLLIIKEQLKNLELEETEETCLKELVMKCKNELPEEWDSTGFPSDDTVRRAQLQAIIRRHSLKHYSMYEPFSINGLTKGKENGQDSSFKF

SEQ ID NO: 175166 - protein, 108 aa, Glycine max
  Coding DNA Sequence Number=SeqID_58388
MTNFARCFQIIIVTHALWNNMEVRPEIDTLTPKFVSPQISRLGSHVGSMKEREWKIFRPDKFSARLPFSTGDIPPHMNKEEKTETPSFLSKNTTLEKILLVRDRTFDL

SEQ ID NO: 175167 - protein, 132 aa, Glycine max
  Coding DNA Sequence Number=SeqID_58389
MSRNFTDCLTMGVKYLEVVKRRSHPNKQMVPGRNYGISTHHRTRCPWMTKGAEDDVSLYALSGIESYRKQKRADDYNLSPRAIGLDCLWIVKKRCKTIWFLRMSSDLPSLDDKKCRMTIICLCVPSDSIISG

SEQ ID NO: 175168 - protein, 55 aa, Glycine max
  Coding DNA Sequence Number=SeqID_58390
IHRKGIPAMGASEKRSQANVVSPSRQELDDHSLIIAMQREMHSLKQRNVQEMKDL

SEQ ID NO: 175169 - protein, 78 aa, Glycine max
  Coding DNA Sequence Number=SeqID_58391
MYIVVVKQGQDHLGLPSGVKTKHERQKPIKVLKDERKRGWGHDRPIVALLCAKQAGNVAARQPRILCILQLSFTICLF

SEQ ID NO: 175170 - protein, 223 aa, Glycine max
  Coding DNA Sequence Number=SeqID_58392
MVWRTLSVRNTSSARKNWPSFARLTETLLGSNLKDYCFIFTGFVQKGTGHPEAEHCPHVLSHEGYDYLEQKLLAEKTKKKLEEVAQSGSVDGVIDPPSPVRRHVKWKMARTKKTGEMAIEAAKEIAEKILMASFSQMQSQMQSQGLALPPEPLVGPSDPRISTKGSCVDPSGNDPETGDSDRCGLYIEADPTRLVALGRVYEGSIVVYNTPLLLGQVKVGVEE

SEQ ID NO: 175171 - protein, 281 aa, Glycine max
  Coding DNA Sequence Number=SeqID_58393
  Homolog annotation: Hit_ID=Q2K9X1; Match level="QueryCoverage=95%, HitCoverage=72%, E-value=3e-27, Identity=30%"; Hit description =Hypothetical conserved protein
MTASSDPRWSEQLIEKIRKARPDIDALSLTRQLSELQGVTNPLLTLRKAPNPNPVLAASLGGGFDAVLDRANRKRKLKKHRQHSRRYEESGGWRIAEPQNQAEANTVLDLYFAMKAQRFRKMGIRDPFADENVRNFFKAFFGEGLVKGRNLHELRFLEVGGTLRSIIGKLFGDAGPTVEFAAIAEDELTSASPGEFLFFEDISRSCDEGRSIYSFGIGDEPYKREWCDIELTIYDTLVPLSAKGKLFTALQSARNAVAGSLKRNPRLWGMAKALRSRFAKR

SEQ ID NO: 175172 - protein, 186 aa, Glycine max
  Coding DNA Sequence Number=SeqID_58394
  Gene Ontology: Mol. function=sugar efflux transporter activity; Cellular component=membrane; Biological process=lipopolysaccharide biosynthetic process
  Homolog annotation: Hit_ID=Q8G1D3; Match level="QueryCoverage=98%, HitCoverage=83%, E-value=5e-69, Identity=68%"; Hit description =Conserved domain protein
HNPNGVEAVADLIASGKEKRIVVVSPEGDKASAGTVRLLREFADRGKRAILVDMTAQGTVGLAMLNGTHLPGITELLSGERRFNEVIHSDRFSQAHVVPLGEADPEIAMRSADRLPLILDALETVYDFVVVECGPSSSEQIGRIADGPASVVMSIVDPDDKGVALAALDLDQGGYEDVVILMDEPA

SEQ ID NO: 175173 - protein, 92 aa, Glycine max
  Coding DNA Sequence Number=SeqID_58395
MKEQMTTMMEAMMSMRKIMEVNTTTVVAARIAIEVHPTHPPGFNQVNHPALDMVGDVAPCGACRPWMFFINGALCFLKIMVGEWRRNKDDWR

SEQ ID NO: 175174 - protein, 98 aa, Glycine max
  Coding DNA Sequence Number=SeqID_58396
MGPVLPNLQRPFLGGCAEKGKEHKLLAEKTRKKLEEAAQSGSVDGVNDPPSPVRRHDSFEEQASQGSFVPHGHQDVLTAVIGRPEHPGCVTWDAIVFG

SEQ ID NO: 175175 - protein, 227 aa, Glycine max
  Coding DNA Sequence Number=SeqID_58397
MLAIISKYQEELNLVTTHEHKVADEYARVYAEKEARGRVIDSLHQEATMWMDRKDAITKRAPRHPYCTRSKSRTMGDQEEVQEQMRADMSALKEQMASMMDAMLGMRQLMEKNAAITAIVSSAAEADPTLPAIAHHPDVVGQERSILGNISNPHLGYNRVAYPYGLPLNYTPTVIRDDAGRVPPPILEGEPPRQSDKVHEDCWELAQGDIDSHSMFPAKGPAPNALP

SEQ ID NO: 175176 - protein, 53 aa, Glycine max
  Coding DNA Sequence Number=SeqID_58398
MAFQPPVTKDVTNIQRMRDDMMQMRKSATGGLFKRARSVFALCPYFRDLNGRN

SEQ ID NO: 175177 - protein, 247 aa, Glycine max
  Coding DNA Sequence Number=SeqID_58399
  Gene Ontology: Mol. function=protein binding; Cellular component =integral to membrane; Biological process=defense response to fungus
  Homolog annotation: Hit_ID=Q1SWI7; Match level="QueryCoverage=97%, HitCoverage=87%, E-value=7e-66, Identity=36%"; Hit description =Leucine-rich repeat
  Pfam annotation: Domain name=LRR_1; Domain location=118-140; Score =9.6; E_value=4.6; Accession=PF00560.23; Description=Leucine Rich Repeat
  Pfam annotation: Domain name=LRR_1; Domain location=142-165; Score =10.5; E_value=3; Accession=PF00560.23; Description=Leucine Rich Repeat
  Pfam annotation: Domain name=LRR_1; Domain location=167-190; Score =8.7; E_value=6.7; Accession=PF00560.23; Description=Leucine Rich Repeat
  Pfam annotation: Domain name=LRR_1; Domain location=17-39; Score=9.3; E_value=5.2; Accession=PF00560.23; Description=Leucine Rich Repeat
  Pfam annotation: Domain name=LRR_1; Domain location=215-238; Score =6.1; E_value=21; Accession=PF00560.23; Description=Leucine Rich Repeat
  Pfam annotation: Domain name=LRR_1; Domain location=41-63; Score =11.7; E_value=1.8; Accession=PF00560.23; Description=Leucine Rich Repeat
  Pfam annotation: Domain name=LRR_1; Domain location=65-87; Score =18.3; E_value=0.027; Accession=PF00560.23; Description=Leucine Rich Repeat
  Pfam annotation: Domain name=LRR_1; Domain location=89-111; Score =18.5; E_value=0.024; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=118-140::142-165::167- 190::17-39::215-238::41-63::65-87::89-111
GNEIQGPIPGGIRNLSLLQNLDLSENSFSSSIPNCLYGLHRLKFLDLRLNNLHGTISDALGNLTSLVELHLSSNQLEGTIPTSLGNLTSLVELDLSRNQLEGTIPTFLGNLRNLREIDLKYLYLSINKFSGNPFESLGSLSKLSTLLIDGNNFQGVVNEDDLANLTSLKEFDASGNNFTLKVGPNWIPNFQLIYLDVTSWQIGPNFPSWILSQNKLQYVGLSNTGILDSIPTQMWEALSQEKYLIAG

SEQ ID NO: 175178 - protein, 111 aa, Glycine max
  Coding DNA Sequence Number=SeqID_58400
  Gene Ontology: Mol. function=calcium ion binding; Cellular component =membrane; Biological process=homophilic cell adhesion
  Homolog annotation: Hit_ID=Q2N2B2; Match level="QueryCoverage=96%, HitCoverage=44%, E-value=7e-15, Identity=47%"; Hit description=RPGR ORF15 isoform
  Subcellular localization annotation: CTP_CleavageSite=50; ConfidenceScore=5.65e-01
MKARTLSPVKVRTLSPLKARTLSPMKAETLSPVKMRTLSPLKARTLSPMKAETLSPVKMRTLSPLKARTLSPMKVRTLSPVKARTLSPVKERTLSPLKARTLSPLKEANRY

SEQ ID NO: 175179 - protein, 98 aa, Glycine max
  Coding DNA Sequence Number=SeqID_58401
MESTKEVVMILHEIRRPNSLKTVPSGVTNCRNLPFDGRATWGSRVRLPREEGARSRHQCLFEENVGKIGKVWSTNFECERVFPSLLRILNCDKEIRPT

SEQ ID NO: 175180 - protein, 212 aa, Glycine max
  Coding DNA Sequence Number=SeqID_58402
MANQEEWVPFMDILALLIFGVVLFPNMDGLVDLAAIDDFLEYHHSKESPVVAILADLFDTFDRRCEKSSARIIFCLPALCGRGVVLTTIPHPMRGAPAEESLSPFLVRDFGAQSFKIIRRVHKAWESPLRKDKELRGIRNGIIGGYHEWLKVRTRGLDWLSKLKIINEENFEAPEEDEDVRALKTELGKARLAKEKFKLVTIDIRKECAELR

SEQ ID NO: 175181 - protein, 134 aa, Glycine max
  Coding DNA Sequence Number=SeqID_58403
  Gene Ontology: Mol. function=helicase activity
  Homolog annotation: Hit_ID=Q1SM26; Match level="QueryCoverage=52%, HitCoverage=17%, E-value=2e-21, Identity=69%"; Hit description =Nucleic acid-binding, OB-fold
MAKHVIAAEIILGKNIGLAVYIPRMSMSPSQSPWPFKLLRRQFPIMLSYAMTINKSQGQSLSMVGLYLPKPFVATYPSAGGRRETRGMRVPRKEYARSRHQRLFEENVGKTGKDAIYELLSERFGSCIYARGRY

SEQ ID NO: 175182 - protein, 189 aa, Glycine max
  Coding DNA Sequence Number=SeqID_58404
  Gene Ontology: Mol. function=helicase activity; Biological process =viral genome replication
  Homolog annotation: Hit_ID=Q1SN45; Match level="QueryCoverage=99%, HitCoverage=11%, E-value=2e-34, Identity=44%"; Hit description=AAA ATPase
MDRPEYVWQQTWQWMADDIIFNHRKEGIRLTEKETIHLCLTEIENMLQANRRSLRYFPSMPYPIGYARNQHHNNLIHNEMTYDKEMLAEQYNTTYQLLTDEQKTIVDTIMSVVNTQSAAVYFLYGYGGTGKTFVWTTLSSGIRSNGGIVCTVASSGVASLLLPWSDHTFQICYTSPCNRKFNMQYSSRQ

SEQ ID NO: 175183 - protein, 315 aa, Glycine max
  Coding DNA Sequence Number=SeqID_58405
MASRKRKAPSTPTQARFDRSRFISQEAWERYTDVIVPRKLLPERNVVVYYTEYDEFKEELERRHWDEELTDFGDDNIDVAIVKEFYANLYDPEDKSPKQELAAKLCIPGRGFGLNADGQPLKILRNNMTTLAQTWSVLSFSNLIPTSYTSDVTLDRAKLIYGIIIKIDMNMGYLISHQISLTAQHDTSRLGFPTLITTLCKARGVQSNSRSLESLNPTINLAYIKKNCWNLDDPTVTFRGPRKARGNRSEAPSTSAPSEAPTPSSSTLPPSSSTKIRLIPPAPSQIPLPAPVSVGPADFIFTPQMIHSMLQSIHR

SEQ ID NO: 175184 - protein, 422 aa, Glycine max
  Coding DNA Sequence Number=SeqID_58406
  Gene Ontology: Mol. function=nucleoside-triphosphatase activity; Cellular component=chloroplast
  Homolog annotation: Hit_ID=Q2PMM5; Match level="QueryCoverage=99%, HitCoverage=19%, E-value=0.0, Identity=86%"; Hit description=Protein ycf2
MPESNWGSRWWRNWIGKKSDSSCKISNETIAGIEISFKEKDIKYLEFLFVYYMDDPIRKDHDWEFFDRLSPRKRRNIINLNSGQLFEILVKDWIYYLMFAFREKIPKEVEGFFKQQGTGSIIQSNDIEHVSHLFLRNKRAISLQNCAQFHMWQFRQDLFDRFFSKVRNVSSNIQYDSTRSSFIQVTGSSQLKGSSDQSKDYFDSIRNEDSKYHTLINQREIQQLKERSILCWDPSFLQTERTEIESERFPKILSGYSSMCRLFMEREKQMNNHLLPQEIEEFLGNPARATRSFFSDRWSELHLSSNPTERSTRDQKLLKKEQKKHLVLSRRSENKEIVNLFKIIMYLQNTVSIHPISSYPGCDMVPKGELDSSNKISFLNKNPFWGLFHLFHDRNSGRYIGHHDFRIRRDISRPAHLYSLYQ

SEQ ID NO: 175185 - protein, 111 aa, Glycine max
  Coding DNA Sequence Number=SeqID_58407
  Gene Ontology: Mol. function=ribulose-bisphosphate carboxylase activity; Cellular component=chloroplast ribulose bisphosphate carboxylase complex; Biological process=carbon utilization by fixation of carbon dioxide
  Homolog annotation: Hit_ID=Q05990; Match level="QueryCoverage=86%, HitCoverage=21%, E-value=3e-52, Identity=100%"; Hit description =Ribulose bisphosphate carboxylase large chain
  Pfam annotation: Domain name=RuBisCO_large; Domain location=1-98; Score=-87.2; E_value=9.8e-05; Accession=PF00016.10; Description =Ribulose bisphosphate carboxylase large chain, catalytic domain
MQYMQYWQTKRIMLSGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 175186 - protein, 42 aa, Glycine max
  Coding DNA Sequence Number=SeqID_58408
MAEEQPRRVKPKSIHLKKYFLESKTTEGKAAISSFHQFLDES

SEQ ID NO: 175187 - protein, 113 aa, Glycine max
  Coding DNA Sequence Number=SeqID_58409
MVRTKYRTLNKKGPVTRAMSKRLQEDWARAAEEGPRVLMNLRSTKFRALLSLSLHSSPSSSKLLSMASYGEAKKFIDEEDPRPTSSNEAYIKEDGQCVGVPTGRMMLLKMFST

SEQ ID NO: 175188 - protein, 165 aa, Glycine max
  Coding DNA Sequence Number=SeqID_58410
MMITKDDDKGDDKKLKDQSKNNSSESKINQRTTQHPGHVCAIGVGVTIGHYFGHASRGCSSSTSINPQQLAKLIGSLKEEWMKKVDEKNKHREDKLLENMKVFCECFDDAKTKATQVLFQVQIKTKKKKRSRRKLSLSLSLLKESLSDFKGLASQHSFQIDNKKV

SEQ ID NO: 175189 - protein, 72 aa, Glycine max
  Coding DNA Sequence Number=SeqID_58411
MNSFPSTVHVSSVIKRGASGDWEICVSVIFWIGSFAKHVYKKGVETRVVITGRAGRTKSVSYLCFPLISDER

SEQ ID NO: 175190 - protein, 80 aa, Glycine max
  Coding DNA Sequence Number=SeqID_58412
MTSKLQMLITFATVVRLRPTIYQNAQNSEENLDKGIWIEPVSRAKALIPDDANLSRSGSFDTGYGGFWMTPLPVKEDKSG

SEQ ID NO: 175191 - protein, 374 aa, Glycine max
  Coding DNA Sequence Number=SeqID_58413
  Gene Ontology: Mol. function=peptidase activity; Biological process =proteolysis
  Homolog annotation: Hit_ID=P45475; Match level="QueryCoverage=68%, HitCoverage=86%, E-value=1e-117, Identity=78%"; Hit description =Hypothetical protein yhbV
MSTIRELTSDEMKLIGGCGDGNNGGDRDRPSRGTPNSCANQVGMGIIIGAFTGFSGGPPGMIGMAVAGGLMGAVSCADNSPAGNNKNNGGALGGNKNANSVNGQCRCAPPALTSLRHQLQSRHAAPVAVAVGVIGQGQRLFAAFVGAEVIDLRQRLGALRRQPHDVHQPLHARQLVAEVVAVAAHGLNAVEHEHLLLLLRAHHAALRILDAAGFALVLAAVLRAGGEAARRIGQRQVAVAQHLHLEIMAEAQLVALRQQVGQPVARQLDRHAPAHHALAAQQAQGIGVVAVQRVAGDERQAALRRHVHRAQIVGFKQELAVLHIAFQLIQLGRRLQQRQRRDHHLLAAAGDFARQRQPIADLHLAPLGADALAE

SEQ ID NO: 175192 - protein, 125 aa, Glycine max
  Coding DNA Sequence Number=SeqID_58414
  Homolog annotation: Hit_ID=Q06FM3; Match level="QueryCoverage=38%, HitCoverage=17%, E-value=1e-19, Identity=91%"; Hit description =Ribosomal protein L2
MKYRTSGYIGIQICRITHVMIFYILGLPVPSSGLCSSCFAVNLVGYFQLRKSIVQTALKGRAFPIFIGTSVPETMTLMTSPSMPCGNDSSGITAFTTTMLSIDQMISWIGFYLTVYGSIACGGIL

SEQ ID NO: 175193 - protein, 48 aa, Glycine max
  Coding DNA Sequence Number=SeqID_58415
MTNKAKGKGKEVAGKGSAGKRKGAFDDDKTGGGRKRNKPFSNELALFE

SEQ ID NO: 175194 - protein, 74 aa, Glycine max
  Coding DNA Sequence Number=SeqID_58416
MNRCCGCSGWAVAAMGSNISGGGGSLPLLRWLCHLMKFLWILSVEGLVIDYRTNKPTGNRLQDVVIDYRLPVHV

SEQ ID NO: 175195 - protein, 97 aa, Glycine max
  Coding DNA Sequence Number=SeqID_58417
MSRGSGDLGDVRRAPGSQQIKGTKTTKQGGLCGGWPAVNFECYMGYGLWFHVLRLCNSSLASGNRLPRLCNRFPEMKSLEIPFLLTCSGYETHCVAL

SEQ ID NO: 175196 - protein, 62 aa, Glycine max
  Coding DNA Sequence Number=SeqID_58418
MVVILPKENLVVWFCSLHNRPDNYLKGIINSILMKLDHWKAERFKALRIQWAQYYLKVRNQT

SEQ ID NO: 175197 - protein, 225 aa, Glycine max
  Coding DNA Sequence Number=SeqID_58419
  Gene Ontology: Mol. function=exodeoxyribonuclease V activity; Cellular component=exodeoxyribonuclease V complex; Biological process=response to DNA damage stimulus
  Homolog annotation: Hit_ID=Q2XDN3; Match level="QueryCoverage=100%, HitCoverage=19%, E-value=1e-123, Identity=93%"; Hit description =Exodeoxyribonuclease V, RecC subunit
MRLLPGLLERPEFRTLQRFLTDDSDLRKRYQLAERLADLFDQYQVYRADWLKDWAAGEHVLNTARAERKALPPGNRWQAELWRALLEDVGEQGMAQSRAGVHQRFIERINSLEQAPAGLPARVIVFGISSLPAQALEALAGLARFSQVLLCVHNPCRHHWADIVADKDLLRHQYKRQQRKQGMPLQLDDQSLHQHAHPLLAAWGKQGRDYINLLDSYDDPSSYQG

SEQ ID NO: 175198 - protein, 275 aa, Glycine max
  Coding DNA Sequence Number=SeqID_58420
  Homolog annotation: Hit_ID=Q1SAS4; Match level="QueryCoverage=31%, HitCoverage=3%, E-value=7e-20, Identity=46%"; Hit description=RNase H, putative
MGFSPELERIVTQEDREIKLHQQETEIVNLGVGDERKEVKVGTDMTAPVRDELVVLLQNYQDIFAWSYQDMPGLNPDIMQHHLPLNLECSPEMASKKLPAKRERQVQLRDDEFPDLQEEIARRHLAPLVTPMAKFDLEMVLEFYANAWPTEEGDALSQFLGHPLVLVEGGHRLAIVYTGARFRPDRHGETGANHAHQHDHPYPDIDDVSVHAAQLISDAIYQFAGMVPMRHPVDLEKSNRAQGFPTLIMGLYQFYRVPVAPNKVIRPAITRAFIE

SEQ ID NO: 175199 - protein, 189 aa, Glycine max
  Coding DNA Sequence Number=SeqID_58421
  Gene Ontology: Mol. function=aminoacyl-tRNA ligase activity; Cellular component=mitochondrion; Biological process=tRNA aminoacylation for protein translation
  Homolog annotation: Hit_ID=O23627; Match level="QueryCoverage=91%, HitCoverage=22%, E-value=7e-61, Identity=70%"; Hit description =Glycyl-tRNA synthetase 1, mitochondrial precursor
  Pfam annotation: Domain name=HGTP_anticodon; Domain location=64-163; Score=50.3; E_value=6.3e-12; Accession=PF03129.10; Description =Anticodon binding domain
MVTIQKKKNIEHERVFTRSVIESSFGIGRIIYCLFEHTFYTRQSKAGDQQLNVFRFSSLVAPIKCTVFPLVQNQKYEEVAKLTSKSLTAAGISHKIDTSTMWIKYKFSLICTSIGKRYARTDELDVPFAITVDSTSSVTIRERDSKGQVRVDVDKAASVVREVTEGQRTWEDVWSTSPHHSSTSASADD

SEQ ID NO: 175200 - protein, 375 aa, Glycine max
  Coding DNA Sequence Number=SeqID_58422
  Gene Ontology: Mol. function=protein domain specific binding; Cellular component=nucleus; Biological process=oocyte microtubule cytoskeleton polarization (sensu Insecta)
  Homolog annotation: Hit_ID=Q96300; Match level="QueryCoverage=55%, HitCoverage=79%, E-value=1e-101, Identity=89%"; Hit description=14-3- 3-like protein GF14 nu
  Pfam annotation: Domain name=14-3-3; Domain location=1-195; Score =378.3; E_value=1.1e-110; Accession=PF00244.10; Description=14-3-3 protein
LSVAYKNVIGARRASWRIISSIEQKEESRGNEDHVAIIKEYRGKIEAELSKICDGILNLLESNLIPSAASPESKVFYLKMKGDYHRYLAEFKTGAERKEAAESTLLAYKSAQDIALADLAPTHPIRLGLALNFSVFYYEILNSPDRACNLAKQAFDEAISELDTLGEESYKDSTLIMQLLRDNLTLWTSDITDDAGDEIKETSKQQPVFGFQITCRERKAKHLSSSSLVFQFHSPCLLLRWSLSGATLDDFSAEELGARIKEYGIVSPETKNELSDPYPFNLVFQTSIGPWLHEASDCAGHFSQFQGFFSKSHSRIRDSSLMLMILFFKKHRLSLWNVDLCERRGTRRTAPVRGAAVTTVEVLADTEDLGHALCR

SEQ ID NO: 175201 - protein, 107 aa, Glycine max
  Coding DNA Sequence Number=SeqID_58423
MHERQSIHGAPNKSGEWRIALGNHFAWLQPYWWRMHEPQSMHGAPNKSGEWTISLGNHYAWLQTHWWRMHERQSMHGAPNKSGEWRIALGNHFAWRQTHWWKMHERK

SEQ ID NO: 175202 - protein, 190 aa, Glycine max
  Coding DNA Sequence Number=SeqID_58424
  Homolog annotation: Hit_ID=Q2R3B9; Match level="QueryCoverage=99%, HitCoverage=13%, E-value=5e-26, Identity=49%"; Hit description =Expressed protein
MAIPGLALLPLKLNFLSEAGLISHALLLCYIENRFFNYSSIYYYGFEDEVMYPSYMVVMTTLLGLALVRRLSVDHRIGGKAVWILTCLFSSKLAMLFISSKSVVWVSAVLLLAVSPPLLLYRDRSKTTSRMKPWQGYAHACVVALSVWFCRETIFEALQWWNGRSPSDATSSCVIVLPVRPNQDCPSLCR

SEQ ID NO: 175203 - protein, 290 aa, Glycine max
  Coding DNA Sequence Number=SeqID_58425
  Gene Ontology: Mol. function=transcription factor activity; Cellular component=mitochondrion; Biological process=regulation of transcription, DNA-dependent
  Homolog annotation: Hit_ID=Q2R3B9; Match level="QueryCoverage=92%, HitCoverage=25%, E-value=1e-95, Identity=62%"; Hit description =Expressed protein
MVCASVFVVFTHLPSATSTKLLPWVFALLVALFPVTYLLEGQLRIKNILEDSEIGNLGEEEKKLTTLLAIEGARTSLLGLYAAIFMLIALEIKYKLASILREKVIDSGGIRQNHSSQSASASFLPRMRFMQHRRATTAPSFTVKRMAADGAWMPAVGNVATVMCFAICLVLNVNLTGGSNRSIFFLAPILLLLNQDSDFVAGFGDKHRYFPVTVIISAYFVITALYSIWEDVWQGNSGWGLQIGGPDWIFVVKNLALLILTFPSHILFNSLTLVTCLKLLLKSIELICNN

SEQ ID NO: 175204 - protein, 206 aa, Glycine max
  Coding DNA Sequence Number=SeqID_58426
  Homolog annotation: Hit_ID=UPI0000503967; Match level="QueryCoverage =94%, HitCoverage=61%, E-value=7e-07, Identity=27%"; Hit description =UPI0000503967 related cluster
VEKWRIALSNQYAWLQKSGWRMHERKRNSWGSEKGKEWRIALSINYAWLILVGGGCKNKNVIHGAPKKGREWRIALSNHYAWLQTRGCKMHKRKRNSWGSEKWGREWRIAISNHCVWLQTRGLRMHERKRNSWGSEKAGRDWRIALSNHYAWLQTRGWRMNENAIHGAPKQGREWRIALSNHYAWLQTRGWRMHERKCNSWGSEKA

SEQ ID NO: 175205 - protein, 236 aa, Glycine max
  Coding DNA Sequence Number=SeqID_58427
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=1e-43, Identity=35%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
RGLHILAFTGLHFLAFRGQHVLAFRGLHVLVFRGLHALAFRGLHVLAFRGLHALTFRGLHVLAFRGLHALAFKGLHIFAFRGLHVLAFTGLHVLAYRGQHALAFRGLHVLVFRGLHALTFRGLHVLAFRGLHVLAFTGLHVLTFRGQHVLVFRGLHALAFRGLHVLAFRGLHALALRGLQVLAFRRLHAPRLQRTTCPRLQRVARLRLQRTTRPRLQRATRPLLQRTTRPCLQRTT

SEQ ID NO: 175206 - protein, 68 aa, Glycine max
  Coding DNA Sequence Number=SeqID_58428
  Subcellular localization annotation: CTP_CleavageSite=47; ConfidenceScore=5.03e-01
MSYRMSRHHASEHAVHDRMSRHHASVQPHLHLGASKPGRKSTLNSVSSRSNSPYLQPSHLTTTRAIST

SEQ ID NO: 175207 - protein, 61 aa, Glycine max
  Coding DNA Sequence Number=SeqID_58429
MVLLCDRGGFVGDGDGAIRLMGLIGEEWSEKTKMQQRRFDDNFLSEPMPLNINNLTSVREL

SEQ ID NO: 175208 - protein, 45 aa, Glycine max
  Coding DNA Sequence Number=SeqID_58430
MWMDRFALTLNGSQELPRLLAQAKAMVDTYSTLEEIHGLLIYYLD

SEQ ID NO: 175209 - protein, 50 aa, Glycine max
  Coding DNA Sequence Number=SeqID_58431
AFVYGVQEFLNPVVCGVKSEDNTLPKTYYKAKKILCPMGMEYKKIHSCPQ

SEQ ID NO: 175210 - protein, 76 aa, Glycine max
  Coding DNA Sequence Number=SeqID_58432
MDNPKVSPHATGPLSLRTTMRLFCGLGRKMLTSSGKSWPKDANIFKKEDADISGKGADDDSRLEDVDISGKDADDD

SEQ ID NO: 175211 - protein, 152 aa, Glycine max
  Coding DNA Sequence Number=SeqID_58433
  Homolog annotation: Hit_ID=Q1PF03; Match level="QueryCoverage=22%, HitCoverage=4%, E-value=6e-08, Identity=80%"; Hit description =Protein kinase family protein
MEVIGSNGRRKLTSMKNGRMELAEEEEALQGRRRKTKRLAGESSTSTSSSQEKEEGGRRKALRKRRKESIGKGGGGVNGLVAVAIDKDKGSQYALKWAVDCLLTRGQTVILIHVLHGTSSPVLCLLHETPCLHKNIITVLHIPNFTAMVLDC

SEQ ID NO: 175212 - protein, 588 aa, Glycine max
  Coding DNA Sequence Number=SeqID_58434
  Homolog annotation: Hit_ID=Q1STP5; Match level="QueryCoverage=69%, HitCoverage=73%, E-value=7e-30, Identity=28%"; Hit description=IMP dehydrogenase/GMP reductase
  Pfam annotation: Domain name=DUF1723; Domain location=139-188; Score =39.4; E_value=1.3e-08; Accession=PF08330.1; Description=Protein of unknown function (DUF1723)
MVKTRGLGRALGRVVARVIIDDVVHVVPADSPAVPEAKAVVVGDEPMVDAAAPNTGAEIDSQDIGDEPEGFPGGPRDLSVLTEYADHVAASVWSGQERPELKLSSHGRKVHHLGRLGPTIEDMVAGTGLSPLIACSIDTGDRGLISSFVERWHWETSSFHLPEGEISIMLDDIAALLHLLIVGALHDFQPLCTDEAVLLLVELLMVSPEVAMVETGQCGRPYVLLQWLQDIYQGRCQKQHWTAATRAYLLHLLGCTLFANKSSTHVHVVHIQVLRDLTLAGRYAWGAAGLVHMYDQLNDAIAECNVDPDYDEVSPRACRWIVTKKTVKKVSTATYRQRLDRLRIPDGPVVVRYRLERVMCQFGYVQCIPAHPVHPWVSYDDVDDTWTHYSDHLAAACDPCVVLGQCAPDYIDWFFRISHPFMIAAQLSNPPVDAPQEACDAIAERLERHLSLRVVTPGTLTHEVIKKCLKIVRSVTQDRIVYINLIRKLHADQVDLQVCADPRAFLAFVRNAGFLLHLHSLRFFFFTFPSISNTYKPKSTSEDFFFFVEEVAAIVAEVAAIVLDNVLLGFDHQKPGTELLPPSPFHLK

SEQ ID NO: 175213 - protein, 223 aa, Glycine max
  Coding DNA Sequence Number=SeqID_58435
  Gene Ontology: Mol. function=protein serine/threonine kinase activity; Cellular component=ubiquitin ligase complex; Biological process=protein amino acid phosphorylation
  Homolog annotation: Hit_ID=Q1S3M6; Match level="QueryCoverage=82%, HitCoverage=23%, E-value=2e-70, Identity=70%"; Hit description =Protein kinase; UspA
FRIAAEIGTRLLFLHQTKPEPLVHRDLKLGNILLDQNYVSKISDVGLARLVPAVAENVTQCCMTSATETFCYIDPKYQQTGMLGAKSDVYSLGIIFLQLLTRRAPTGLAHHAEESIEKDSFVQMLDPSVTDWPLEQALCLAKIAVKYAELRRKDRPDLAKLVLPELDKLRDFAEQNMTMTMPIILGCTAPSPSHSEPSDLISDLQLAHSESSSAPSTPTEGKP

SEQ ID NO: 175214 - protein, 75 aa, Glycine max
  Coding DNA Sequence Number=SeqID_58436
MGVTRPLYITLTVHLHHRRVTNLITISTIYFSLSVVIVHTKLQIRCLDVLLEDTDVVKAIENLVVGAPSRHGFIR

SEQ ID NO: 175215 - protein, 45 aa, Glycine max
  Coding DNA Sequence Number=SeqID_58437
MVVIKWWDGIVVATMVTVMRSDGRDDSMMVVTRATVVVTIVNVKE

SEQ ID NO: 175216 - protein, 303 aa, Glycine max
  Coding DNA Sequence Number=SeqID_58438
MMKKVKEFLKYIPVSKSQLLDAIILSIQDDIDAHHFRLLTSCLDSILHAEHKTILEEMRSDYQLTDSLQQLVSNPNVKEEGNLYDYQPALDLTALLRSLDIPTKKDYDTGSRVTIATRFQRAFMQLLSNAQFEELSARDLMLTSALNTDYLLTLPVYVDWKRAYESNAIIFRRGYATEKQKGLLIVEKLDYLQSKFLRRTFFAISEPLTKLGTWISERLCKEIQSHKLYENASQKHEVQNWTERLRLWLKELSVFQKSLLYNDPASDEQIGEDQVPNVELPIWLAAQRAVARYEGILSPVGPR

SEQ ID NO: 175217 - protein, 64 aa, Glycine max
  Coding DNA Sequence Number=SeqID_58439
MASKLASKRELLDRWRGIEEEEDNHDDDNADPSKRPPEIIQTTVLLIAICFNNHGIAMLILAFR

SEQ ID NO: 175218 - protein, 542 aa, Glycine max
  Coding DNA Sequence Number=SeqID_58440
  Gene Ontology: Mol. function=protein serine/threonine kinase activity; Cellular component=ubiquitin ligase complex; Biological process=protein amino acid phosphorylation
  Homolog annotation: Hit_ID=Q1PE30; Match level="QueryCoverage=64%, HitCoverage=55%, E-value=1e-108, Identity=51%"; Hit description =Protein kinase family protein
  Pfam annotation: Domain name=Pkinase; Domain location=272-476; Score=- 9.3; E_value=5.3e-08; Accession=PF00069.15; Description=Protein kinase domain
  Pfam annotation: Domain name=Pkinase_Tyr; Domain location=272-480; Score=-99.2; E_value=2.2e-06; Accession=PF07714.7; Description =Protein tyrosine kinase
  Pfam module annotation: Pfam domain module=Pkinase::Pkinase_Tyr; Domain location=272-476::272-480
GHQAIICNINSSSASSQSYQLDNNINDLFLTFHCHCTRKAVGTDVVKAIENLVVGAPSRHGFIRSPFVRGRGMDGMSCLDFPESDTDISFVSSERPSSGRSSSVYDYIDAGRTSRVSTSSDRSFGSTRLGALKFNNHNSPDTPFSHESSTTSFSYSLQSVDEAAEADMRRLKLELKQTMEMYSKACRQALASQQKEAAMSIAEKEKARCRAVMETTEASKKSAEETQRRTGAEVKALKEAEEIRKLLDNLALTDVRYRRYCIEEIEAATNYFSELQKIGEGGYGPVYKCYLDHTPVAVKVLRPDASQGNVSGLKFRIAAEIGTRLLFLHQIKPEPLVHRDLKPGNILLDQNYVSKISDVGLARLVPAVAENVTQCCMTSATETFCYIDPKYQQTGMLGAKSDVYSLGIIFLQLLTRRAPTGLAHHAEESIEKDSFVQMLDPSVTDWPLEQALCLAKIAVKCAELRRKDRPDLAKLVLPELDKLRDFAEQNMTMTMTMPIILGCTAPSPSHSEPSVQQDLISDLQLAHSESSSAPSTPTEGKP

SEQ ID NO: 175219 - protein, 523 aa, Glycine max
  Coding DNA Sequence Number=SeqID_58441
  Pfam annotation: Domain name=Motile_Sperm; Domain location=5-110; Score=108.3; E_value=2.3e-29; Accession=PF00635.16; Description=MSP (Major sperm protein) domain
  Pfam module annotation: Pfam domain module=Motile_Sperm::Retrotrans _gag; Domain location=5-110::407-497
MATELLQIDPPHLTFIVELKKQSSCLVHLINNNASHYGAFKVKTTSPKKYCVRPTVGIVKPHGTCDFTVTMQAQRTAPPDLHCKDKFLVQSAFVKDYGRLVDEKKLRVVLLSSPSSPVNGDFKLDPTTQMPPSLTVGKGLEAAQDMEEDGADNGTFPSTRSVEKVGDMKHVNDVVKLSLATKDSEELKSRLSIMDAKLREAEGTIEKLNEERRRNIREKDLLKQELVDVASEGQIGESINKEGVQLAKAKRKDLLDSNVPCKDASITNSVMQIFLGDLDKSISSSHYIYEDPGPRSPATTMPDPDESSSSYDKLEDVLSRLTKQQLYLGESVNAMTLKIEELLHRVSPIVPPSQPTPTPLPHPQPATPIHRLKLEVPRFDGSEPLGWIYKINQLFDYHNTPEADKLTVASFHMEGRTLAWFQWMNTTHQFPSWPAFLEALRTRFAPSQFEDPSGALCKLTQTGTVAQYLADFEDLANRTIGLPTPFLLSCFISGLTPEIRREVQAHQPATLVQAAGLARLQEE

SEQ ID NO: 175220 - protein, 239 aa, Glycine max
  Coding DNA Sequence Number=SeqID_58442
  Gene Ontology: Mol. function=phosphopantetheine binding; Cellular component=chloroplast; Biological process=fatty acid biosynthetic process
  Homolog annotation: Hit_ID=P93092; Match level="QueryCoverage=48%, HitCoverage=84%, E-value=8e-40, Identity=76%"; Hit description=Acyl carrier protein 1, chloroplast precursor
  Pfam annotation: Domain name=PP-binding; Domain location=164-231; Score=69.2; E_value=1.3e-17; Accession=PF00550.15; Description =Phosphopantetheine attachment site
MTWERKSKANKQLLSSHVPSSKLTKRTVVEETTESEPPLLYPALCFPYKYTHCPFLPSLETQTHTLCTLRPSFFDPDLSPSPSNGFPSAMFHAPRLSFQSSSAKCSWYWVLAIIEDLFYVPGTRISNPSSVSLSIKGRSFPSVTLQPRGRRFQLRCAAKPETVKKVCDIVKKQLALPDESAVTGESKFAALGADSLDTVEIVMGLEEEFGITVEEESAQSITTVQDAADMIDKLLETKA

SEQ ID NO: 175221 - protein, 1172 aa, Glycine max
  Coding DNA Sequence Number=SeqID_58443
  Gene Ontology: Mol. function=nucleoside-triphosphatase activity; Cellular component=membrane; Biological process=cell division
  Homolog annotation: Hit_ID=Q1RST2; Match level="QueryCoverage=99%, HitCoverage=88%, E-value=0.0, Identity=73%"; Hit description =Peptidase S1 and S6, chymotrypsin/Hap; Immunoglobulin/major histocompatibility complex; AAA ...
  Homolog annotation: Hit description=ATPase, central region
  Pfam annotation: Domain name=AAA; Domain location=854-1041; Score =255.7; E_value=9.3e-74; Accession=PF00004.19; Description=ATPase family associated with various cellular activities (AAA)
  Pfam annotation: Domain name=AAA_3; Domain location=854-980; Score= -8.4; E_value=0.0027; Accession=PF07726.2; Description=ATPase family associated with various
  Pfam annotation: Domain name=AAA_5; Domain location=854-986; Score =17.7; E_value=8e-05; Accession=PF07728.4; Description=ATPase family associated with various
  Pfam module annotation: Pfam domain module=AAA::AAA_3::AAA_5; Domain location=854-1041::854-980::854-986
MSDLIFTVGQGRNCNLWLKDPTVGNVLCKLSHIERGGSSVALLEITGGKGSIQVNGKTYRKNARLILSGGDEVVFGSSGKHAYIFQQLTNNNINPADIPSSVSILEAQSAPINGTQVEARSGDPSAVAGASILASLSNLPKDLSLLSPPAKTGKNVQQNADISSLPSGNGDDMPDSEMKDATNDVASEVFSADKTVNKNPNLDTAEVNINVDPDVGKVTAATYELRPLLRMLAGSCPEVDLSCGITKILEERRELRELLKDVDTPTILASTRRQAFKDSLQQRILKSENIDVSFETFPYYLSDTTKNVLIASTFIHLKCIGFGKYASDLPSVSPRILLSGPPGSEIYQETLCKALAKHFGARLLIVDSLSLPGGASSKEVDSAKESSRPERPSSVCAKRSSQTTTLQHKKPASSVDAEIVGGSTLSSQAMLKQEVSTASSKGTTLKEGDRVKFVGNFPSAVSSLPNYPSRGPSYGSRGKVLLAFEDNRSSKIGVRFDKSIPDGNDLGGLCEDDRGFFCSANHLLRVDGSGGDDADKVAINDIFEVTSNQSKSGSLVLFIKDIEKAMVGNYEVLKNKFESLPPNVVVIGSHTLLDNRKEKTQPGGLLFTKFGSNQTALLDLAFPDNFGRLHDRSKETPKVMKQLGRLFPNKVTIQLPQDEALLSDWKQQLERDIETMKAQSNIVSVCTVLNRIGLDCPDLETLCINDQTLTTETKYKMFRFAALLLIKSYELDFLGVEKIIGWAISYHFMHSSEASIKDSKLVISAKSINYGLNILQGIQNENKNLKKSLKDVVTENEFEKKLLADVIPPTDIGVTFDDIGALENVKDTLKELVMLPLQRPELFCKGQLTKPCKGILLFGPPGTGKTMLAKAVATEAGANFINISMSSITSKWFGEGEKYVKAVFSLASKIAPSVIFVDEVDSMLGRRENPSEHEAMRKMKNEFMVNWDGLRTKDKERVLVLAATNRPFDLDEAVIRRLPRRLMVNLPDAPNREKILSVILAKEDLAPDIDFEAIANMTDGYSGSDLKVVYLCIFHFLSWLLEKNLCVTAAHCPIREILEKEKKERSLALSENKPLPGLCSSGDIRPLKMDDFRYAHEQFKDELANGSSNGIIRCVWWMDGSFSQIMLNLAQLKELVCASVSSESTNMNELLQWNDLYGEGGSRKMRSLSYFM

SEQ ID NO: 175222 - protein, 831 aa, Glycine max
  Coding DNA Sequence Number=SeqID_58444
  Gene Ontology: Mol. function=mismatched DNA binding; Cellular component=nucleus; Biological process=mismatch repair
  Homolog annotation: Hit_ID=Q1RSS9; Match level="QueryCoverage=99%, HitCoverage=85%, E-value=0.0, Identity=66%"; Hit description=ATP -binding region, ATPase-like
  Pfam annotation: Domain name=DNA_mis_repair; Domain location=225-340; Score=112.3; E_value=1.4e-30; Accession=PF01119.9; Description=DNA mismatch repair protein, C-terminal domain
  Pfam annotation: Domain name=HATPase_c; Domain location=23-157; Score= 33.3; E_value=8.4e-07; Accession=PF02518.16; Description=Histidine kinase-, DNA gyrase B-, and HSP90-like ATPase
  Pfam module annotation: Pfam domain module=DNA_mis_repair::HATPase_c; Domain location=225-340::23-157
MVVEAQIIKPIGKGIVHRICAGQVILDLSSAVKELVENSLDAGATSIEISLKDFGEQWFQVIDNGCGISPNNFKVLALKHHTSKLSEFHDLQSLTTFGFRGEALSSLCALGNLTVETRTASEPVATHLTFDNSGVLVAERKTARQIGTTVMVKKLFSNLPVRSKEFSRNIRREYGKLVSLLNAYALIAKGVRFVCTNTTGKNVRSVVLKTQGSGSLKDNVITVLGMNTFSCLEPVTLSISDSCKVEGFLSKSGQGNGRNLGDRQYFFVNGRPVDMPKVSKLVNELYKGANSKQYPIAILNFTVPTRVYDVNVTPDKRKIFFSEENAILQALREGLQQIYSASNVCYSVNEVMLPAEKEECVELCSSHGKSPIVRKLYSPNASCPQKEQCSESNNGSVSLDEIDTECNNDTISQDEHEEKHITDSKNASESINEYRYTHIDEGLICENDGSLMNQEFTLRAHSASKDDDSGSRSACPSSIIPDQATLVSRTVESGSTSSKYSFNHSRHVQSTLNNFVSVNKRNRDSVIRALSEVPVLRNQAPHCQLKTANTETQDLITRSSLCFDQSDEPARASEIESLKQLNPDNVFYKNENAVSFKGDSSVREPKSNMELDLKNNTPLGDTASITPSSIDMITTDVLASDPPLHSSPVWLNSCKSSSNKICSNMQFSFQELKKRREKRLSLLQSSKFGCGKAKVKSHYSAATLEILQSEIGEQKERALAAAATELERFFKKEDFSRMKVIGPFNLGFIICKLDPDLFLVDQDAADEKYNFERLSQSTILNQQTLLRGVSITRYKEIAYSDANFQRRPIKLELSPEEEIVASMHMDIISYY

SEQ ID NO: 175223 - protein, 109 aa, Glycine max
  Coding DNA Sequence Number=SeqID_58445
MKGNQNIFLYPSLQEKDFTAEKEVTCSGTPSKFKISYTLLIPLFSFHLLLPPSSFLSVLFFFPFLKAQTEELKNGASDRGESINRRIFLPLYNNQDQGSTTLPTESDFG

SEQ ID NO: 175224 - protein, 533 aa, Glycine max
  Coding DNA Sequence Number=SeqID_58446
MVCGTWLGIPDTRRVRGWDNKLKPVGYWVRVWEYVEEPGVIVALLPIPPFLTSTSRLLQQVHCFCLSMVCSPGSGRMEVMARLLAAGTFSHTVADDFAREKLAAEYICRELREADEANLLHEEDMHVYGESPMTDALQLVCCNTCKKPIKDSQFAAHAGTNIEPSLFSPSIPPVIFSELCRSLKLTEQTMVELDTGNRKPPRKEKKKLGASSANQASAVGEQRRSESIDNIDSALSQSHLNSQIRVVPFSNEVTGYSSCVGAALIMDGTGIDAGNRDHSASVMYPPTKRHKLIANIHLPVLESHGTESGETKTVSFTDGITCNFLERTISQRGDPNHKNRGQVLVQHQGIMKNDSPAPLATKIYYSQRTNRLRARIRHLYFQDLNGQCCTDVVCPKTSHAEMVAFQDSSLRDPSFDQMDNVHEALTFCLKAKDGNTFHHPPQIQILTKKSLGRLPAQKSDHILAKSSEIGLLKAGGLPSSGLPNQFLDNVSRSAGTNGGLTRSNFLPTSYSFVSNTGNPLGTMQQPNGSVPVI

SEQ ID NO: 175225 - protein, 231 aa, Glycine max
  Coding DNA Sequence Number=SeqID_58447
  Gene Ontology: Mol. function=transferase activity; Cellular component= extracellular region; Biological process=RNA-dependent DNA replication
  Homolog annotation: Hit_ID=Q1T4N4; Match level="QueryCoverage=95%, HitCoverage=42%, E-value=1e-33, Identity=35%"; Hit description =Polynucleotidyl transferase, Ribonuclease H fold
MEKLRGGMGFRNLFAFNMVMLGKQGWRLLYKPNALPGRIFKAKYYPTGDFMGSSIGHNPSYIMAKLVLFKGFQSWLRKQGHRYVTSPIVPGLENLELSSIVHHQNNAWNLEILNQILSLEDINEIIHTLVPSFKAEDKLIWAEAIDGLYSVKSAYTMIMKNFLQHDDMCVDGGWKMIWDTKIPQRVKLMICRSFAGIIFFPEEATYEEEESNARLLAHYAKSLLTLSLLAQ

SEQ ID NO: 175226 - protein, 673 aa, Glycine max
  Coding DNA Sequence Number=SeqID_58448
  Gene Ontology: Mol. function=RNA-directed DNA polymerase activity; Cellular component=chromatin; Biological process=chromatin assembly or disassembly
  Pfam annotation: Domain name=Chromo; Domain location=574-623; Score =29.1; E_value=1.5e-05; Accession=PF00385.14; Description='chromo' (CHRromatin Organisation MOdifier
  Pfam annotation: Domain name=RnaseH; Domain location=7-128; Score= -29.0; E_value=0.029; Accession=PF00075.14; Description=RNase H
  Pfam annotation: Domain name=rve; Domain location=268-424; Score =103.7; E_value=5.3e-28; Accession=PF00665.16; Description=Integrase core domain
  Pfam annotation: Domain name=zf-H2C2; Domain location=213-250; Score =15.6; E_value=0.003; Accession=PF09337.1; Description=His(2)-Cys(2) zinc finger
  Pfam module annotation: Pfam domain module=Chromo::RnaseH::rve::zf -H2C2; Domain location=574-623::7-128::268-424::213-250
MALPDFQVPFTVETDASGNGMGAVLSQKGHPIAYFSKPFTQKLLSASTYVRELFAITSVVKKWRQYLLGHQFTIITDHRSLKELLTQVIQTPEQHTYLARLMGFDYQIQYRSGAHNQAADALSRSPENAPPEYPASQFLILSVPCLTFLEELKHQVTINQQYCQKRQAILDSPDSHSDFTIHQNFILQKGRLWLPRDLPIIQSLLQEYHSTPMGGHAGVTKTLARLSENFIWPGLRADVVTYVTNCRECQVTKYETKRIAGLLCPLPVPFRPWEDLSIDFVVGLPPFQGKTVLLVIVDRFSKGIHLGILPQAHTAHMVAQLFINIVVKLHGIPRSLVSDRDPLFISGFWQELFKLSGTHLRMSYAYHPQSDGQTEVMNRVIEGYLRAFVHRRPTSWGKFLPWVELSHNTSWNSSTGSTPYEITYGRKPFSFPDYIAGSSKIDAVDDLLLSRDEVFTTIRRKLLKAQASMKKTADAKRREVNYEPDSWVLLKLRPYRQSSVKSAQAVTGKLSKRFYGPFQIIERVGKVAYRLKLPDGARIHPVFHCSLLKPFHGDPILDSPNSLPTRFINGQPMLTPLAILDYRRHKERDTWEVLVQWHGLSPDESSWEDWEQLKQDHHLEDKVILQGPKEVDSSILTDVASEGQIGESINKEGVQLAKAKRKVIRPAYLKDYV

SEQ ID NO: 175227 - protein, 73 aa, Glycine max
  Coding DNA Sequence Number=SeqID_58449
  Homolog annotation: Hit_ID=Q1RST2; Match level="QueryCoverage=51%, HitCoverage=3%, E-value=1e-12, Identity=89%"; Hit description =Peptidase S1 and S6, chymotrypsin/Hap; Immunoglobulin/major histocompatibility complex; ...
  Homolog annotation: Hit description=AAA ATPase, central region
METERLRRTGRNKENKEEKELRNKETHEGTSGQRAKVCASVSSESTNMSELLQWNDLYGEGGSRKMRSLSYFM

SEQ ID NO: 175228 - protein, 54 aa, Glycine max
  Coding DNA Sequence Number=SeqID_58450
  Homolog annotation: Hit_ID=Q1RST0; Match level="QueryCoverage=78%, HitCoverage=3%, E-value=2e-10, Identity=72%"; Hit description =Peptidase S1 and S6, chymotrypsin/Hap; Immunoglobulin/major histocompatibility complex; ...
  Homolog annotation: Hit description=AAA ATPase, central region
ERSLALAENQPLPQLCSSTDVRPLKMEDFRYAHEQSFALSSSDVYPSFFSFHMD

SEQ ID NO: 175229 - protein, 239 aa, Glycine max
  Coding DNA Sequence Number=SeqID_58451
  Gene Ontology: Mol. function=sequence-specific DNA binding; Cellular component=nucleus; Biological process=regulation of transcription, DNA-dependent
  Homolog annotation: Hit_ID=Q1S5S6; Match level="QueryCoverage=62%, HitCoverage=52%, E-value=5e-35, Identity=48%"; Hit description=Zinc finger, GATA-type
MAEGLSAEIEKSMVHEENIASNLDKRLMGEGLLMNPVVIMRAWSWFTCFVVVHFGSVVSVGMAASPATISDAEVLHRHTSVVRLRWHLAKLTVSPLENSSPREGTQQALTRGAGGLVHTPAPLGRAGADEAAAGKEMRGNECGAFQTQMPSLRCGEDAAVANGTDGTKNSMQRVRHEVQVREAGAGILADGESNVHINEAFEFASEGFEIQAAEGDATIAASSAIDESKFNFRYIQRWR

SEQ ID NO: 175230 - protein, 130 aa, Glycine max
  Coding DNA Sequence Number=SeqID_58452
MSMFIMPTLFLLLFIVFNTGYLENRIFRINLIRKRLTDQVIRKLPSNFPMAVSAIAGNNGGRRRKAKEKRTSKKKQKLEEEAATQRRSFPLDPDNNGGNEDEEEAETRRRRLHLGRRGSAKKKKTEEGAE

SEQ ID NO: 175231 - protein, 111 aa, Glycine max
  Coding DNA Sequence Number=SeqID_58453
MDTLPLVNNAPQEWTMNNTHLMVNNVALGASVQNLFMLSVIFHPSGALQKKLSLCISMKVVDIFTLEVLALVPSHFDIYKLRYAQNNSTYVSVVRATINFNFKPNFLNDSH

SEQ ID NO: 175232 - protein, 94 aa, Glycine max
  Coding DNA Sequence Number=SeqID_58454
  Gene Ontology: Mol. function=DNA binding; Biological process=DNA integration
  Homolog annotation: Hit_ID=Q1S1X7; Match level="QueryCoverage=74%, HitCoverage=5%, E-value=4e-14, Identity=53%"; Hit description =Integrase, catalytic region; Zinc finger, CCHC-type; Peptidase aspartic, catalytic
MANHIPIEISARHTSIRAVLALVNIQDLHSEHMYLKTTFLHGDLEEQIYMEQPEGFNQDGTNRLVCKLKTKDHPRFPNNWYQNMVRSGGQLRQV

SEQ ID NO: 175233 - protein, 125 aa, Glycine max
  Coding DNA Sequence Number=SeqID_58455
MACCCSRENPVLPLASFLCCIANQQQAFCLQSISLCSSAPKENILHASRDCPHSKEVWRRLGFQSRRILTCKDNKEWVLADEWLSHDVMGDGGVLRDSNGNWVFGFAQHYGLGSPLKGELLAFGL

SEQ ID NO: 175234 - protein, 226 aa, Glycine max
  Coding DNA Sequence Number=SeqID_58456
MDTRLRVIGDPMNEVQRVKIHTNCFVPVVFPVRLAHKIDLSKCVVLLTHPSFEVDNDKRRRSNWRCGRGSEEWEVQEACRAVSSYLGELGVSLEDSVWMASKSPEYVKMLVEGVRDLEQWHEWDAGLSFRDKILHIAPQKGDKGKVAYLETLGFSLSSSMNIARYFSADTLTLPSLMHKVTRIKQLLFFSPSPDHHLLLIKNIPLMMRHLSISVDQDLQHTLSFFF

SEQ ID NO: 175235 - protein, 196 aa, Glycine max
  Coding DNA Sequence Number=SeqID_58457
MDIDKGKHWWVWNWEEGGSSDLWVYQGEGGRWKKGKSKDLNVVKFKGHVYLNNILELGAETNKGCSLHLRAQIPDVEPKTPLNARLVGLNDLKEHCSCLGCRRVRGKKCAFRLATTAQIELGVIVITQALIVGINNFGHTKVFVMGVGEKVKGRKWIGLRRRSQGILWEGCLEFRESHGLDKGDGLVCLDFTTNLR

SEQ ID NO: 175236 - protein, 1164 aa, Glycine max
  Coding DNA Sequence Number=SeqID_58458
  Gene Ontology: Mol. function=protein serine/threonine kinase activity; Biological process=protein amino acid phosphorylation
  Homolog annotation: Hit_ID=Q1T199; Match level="QueryCoverage=47%, HitCoverage=48%, E-value=1e-135, Identity=57%"; Hit description =Homeobox
  Pfam annotation: Domain name=PPR; Domain location=137-171; Score=1.7; E_value=4.7; Accession=PF01535.11; Description=PPR repeat
  Pfam annotation: Domain name=PPR; Domain location=213-247; Score =11.3; E_value=0.35; Accession=PF01535.11; Description=PPR repeat
  Pfam annotation: Domain name=PPR; Domain location=248-282; Score =33.8; E_value=6.1e-07; Accession=PF01535.11; Description=PPR repeat
  Pfam annotation: Domain name=PPR; Domain location=283-317; Score =29.7; E_value=1e-05; Accession=PF01535.11; Description=PPR repeat
  Pfam annotation: Domain name=PPR; Domain location=318-352; Score =33.6; E_value=7e-07; Accession=PF01535.11; Description=PPR repeat
  Pfam annotation: Domain name=PPR; Domain location=386-420; Score =28.1; E_value=3.1e-05; Accession=PF01535.11; Description=PPR repeat
  Pfam annotation: Domain name=PPR; Domain location=421-455; Score =11.6; E_value=0.32; Accession=PF01535.11; Description=PPR repeat
  Pfam annotation: Domain name=PPR; Domain location=456-490; Score =10.6; E_value=0.42; Accession=PF01535.11; Description=PPR repeat
  Pfam annotation: Domain name=PPR; Domain location=491-525; Score =27.3; E_value=5.6e-05; Accession=PF01535.11; Description=PPR repeat
  Pfam annotation: Domain name=PPR; Domain location=526-560; Score =20.2; E_value=0.0077; Accession=PF01535.11; Description=PPR repeat
  Pfam module annotation: Pfam domain module=PPR::PPR::PPR::PPR::PPR::PP R::PPR::PPR::PPR::PPR; Domain location=137-171::213-247::248-282::283- 317::318-352::386-420::421-455::456-490::491-525::526-560
MRYRRTHKIAVEGCLCLCRSWHSSSKWRRRNTVNSESLSRCPSDLIALSLFLWSAQRRRHDSFAFDRIVTVLLRLTHRYDTVPAILSHLETIGCASLTNPVSQLVLLRIYSRAGMYAMLLEAYHHLQASYAFVPDTFARNLVMDALFRVGHSHLALTLTLSLFSHTHPPNFFTFHILLLHLSKLNNNNLNLYLPHIARILRLLLWAGYSPSPLTFQMLLNSLCKINAFPQAYQLLALMTALGINFSVNIWTILIHNYCKFGRLRLANNLFHNMLQTGCSPNVVTYTILFKAFMQSNMPTPAFRLFNIMLSSGQSPDLILCNVLIDCLSKAGRCQDAIQVFLSLSERNLKPDSYTFASLLSTICRSRMFYLLPKLVLVSRHIDADLVFCNALLSSLTKADLPSLAVGFYDHMIDEGFVPDKYTFAGLLSALCCAGRVDKAVNVYHGVVMSYHDTDAHIHTVIIVGLLKTGKFHKAVSVLRFAVMNKYPLDTVAYTVGICALLRGRRTQEACTLYDQMKNNGLKPSVHTYNMMLFTFCKERDLQMIKQILQEMIDSRIYLSGRNFSNLCKYMCRSDTHLSLLKLLAKMRDLRQLVIRYVKHRAVLGAKYHRIDWTSISDLPASPIACMRRMNLLNSNMRFRKAVNKLCNMLSERYAKQLEKSQYPSLNNDCKQFVRSQSCEGILNNSSPDAEIQITSLNKEAWDDFENKNTKMSLDEILRCKLMAKLGASSQKGQLQYGGWSDANANADGLVGGTGNERFELSQHFLQSVSKSPFPFNTGKQAVKFSAWLEERGKDLTEVGANLAEDLQCGDIFHLLDLVSSGELSISPFLPDNGVGEAEDLRSAKHKYDTTKSSYSDKAKKSKSFFGVEGEIISRREKGFPGIIISAHQTTISRADILNLLKDNDNCGQPFDEDFQLNIGQSSNYSLPDHILEITKSSDPVFRVVYAAIQKAGDQGLSMGEISQIDVLIVDALQAFGQALKVNAYDTVRVVDVLYRHKYFLTPMSDFHLHVVQPSSTKTIEKSDHTCELYESEERDTTSVDTLRERNTAIDSVHTLTILNLPHGDVDPENQACDRNEGCKQNRLGLSRVNHKKETLEFSSGESCVPILPWVNGDGIINNIVYRGLRRRVLGIVMQNPGILEISNRIIKEDKKDILRERENLGSKK

SEQ ID NO: 175237 - protein, 168 aa, Glycine max
  Coding DNA Sequence Number=SeqID_58459
  Homolog annotation: Hit_ID=Q7XBT9; Match level="QueryCoverage=73%, HitCoverage=18%, E-value=4e-08, Identity=31%"; Hit description =Pentatricopeptide, putative, expressed
MEEVGSKTKAAEFTVVMDENGPNIDREIDLESGHESEELFGNMEERNVEGEEIRGMSVVEERESEGESEMGVTDPKESVHDQIMSKGIGDKSVRGLQVVITLQEHHIHTRTRVNPQQHRLRYRVCERGTADGLQVRENGWNSVVAVSEPMEHSHDAIEGDGVVAATLG

SEQ ID NO: 175238 - protein, 819 aa, Glycine max
  Coding DNA Sequence Number=SeqID_58460
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=P22180; Match level="QueryCoverage=99%, HitCoverage=85%, E-value=0.0, Identity=84%"; Hit description=Plasma membrane ATPase 1
  Pfam annotation: Domain name=E1-E2_ATPase; Domain location=2-186; Score=196.9; E_value=4.7e-56; Accession=PF00122.10; Description=E1 -E2 ATPase
  Pfam annotation: Domain name=Hydrolase; Domain location=190-476; Score=72.7; E_value=1.2e-18; Accession=PF00702.16; Description =haloacid dehalogenase-like hydrolase
  Pfam module annotation: Pfam domain module=E1-E2_ATPase::Hydrolase; Domain location=2-186::190-476
FLRDGKWVEEDASILVPGDIISVKLGDIIPADARLLEGDPLKIDQSALTGESLPVTKGHGDSVYSGSTCKQGEINAVVIATGVHTFFGKAAHLVDSTNQVGHFQKVLTAIGNFCICSIAVGMIVEIIVMYPIQHREYRPGIDNLLVLLIGGIPIAMPTVLSVTMAIGSHRLAQQGAITKRMTAIEEMAGMDVLCSDKTGTLTLNKLTVDKNLIEIFAKGVDVDTVVLMAARAARLENQDAIDASIVGMLGDPKEARAGIQEVHFLPFNPTDKRTAITYIDSESKMHRVSKGAPEQILNLARNKSEIERRVHSVIDKFADRGLRSLAVAYQEVPDGKKESQGGPWQFIGLLPLFDPPRHDSAQTIRRALNLGVNVKMITGDQLAIGKETGRRLGMGTNMYPSSALLGQNKDESIATLPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWQFDFPPFMVLIIAILNDGTIMTISKDRVKPSPYPDSWKLAEIFTTGIILGGYLAMMTVIFFWAAYKTDFFPQTFGVSSLQKKDRDDFRKLASAIYLQVSTVSQALIFVTRARSWSFVERPGLLLVAAFVIAQLIATLIAVYANWSFAAIEGIGWGWAGVVWLYNLVFYIPLDFIKFIIRYALSGRAWDLVIEQRIAFTRKKDFGKEERELKWAHAHRTLHGLHPPETKMFNERTSYTELNQMAEEARRRANIARLRELHTLTGHVESVFRLKGLDIDTIQQAYTI

SEQ ID NO: 175239 - protein, 231 aa, Glycine max
  Coding DNA Sequence Number=SeqID_58461
  Gene Ontology: Mol. function=protein-tyrosine kinase activity; Cellular component=cellulose and pectin-containing cell wall; Biological process=protein amino acid phosphorylation
  Homolog annotation: Hit_ID=Q9SIX4; Match level="QueryCoverage=79%, HitCoverage=22%, E-value=4e-31, Identity=44%"; Hit description =Putative LRR receptor protein kinase
  Pfam annotation: Domain name=LRR_1; Domain location=123-145; Score =12.1; E_value=1.5; Accession=PF00560.23; Description=Leucine Rich Repeat
  Pfam annotation: Domain name=LRR_1; Domain location=147-169; Score =14.0; E_value=0.53; Accession=PF00560.23; Description=Leucine Rich Repeat
  Pfam annotation: Domain name=LRR_1; Domain location=177-198; Score =17.6; E_value=0.044; Accession=PF00560.23; Description=Leucine Rich Repeat
  Pfam annotation: Domain name=LRR_1; Domain location=200-223; Score =6.7; E_value=16; Accession=PF00560.23; Description=Leucine Rich Repeat
  Pfam annotation: Domain name=LRR_1; Domain location=99-121; Score =15.2; E_value=0.24; Accession=PF00560.23; Description=Leucine Rich Repeat
  Pfam module annotation: Pfam domain module=LRR_1::LRR_1::LRR_1::LRR _1::LRR_1; Domain location=123-145::147-169::177-198::200-223::99-121
MGIVWLGLLLLVLSQVTLEQNEPLSSVEERESLLELRGSLGMVVSLGSISLASEEPDLGGGTRNLQWMLWTISPSCGPSMPPISPFLALFLIGLVSLPSLTVLDLRSCSIVDAIPSTLGNLTNLTSLYLSDDNLTGNVPGTLGQLLALSVLDLSRNSLTGSLPASSAFLGNLSSLDMLQYLNLSNNGLSSLPAQLGGLASLVDLDLSENSFVGGGLPPDPHANTKLFSHKI

SEQ ID NO: 175240 - protein, 69 aa, Glycine max
  Coding DNA Sequence Number=SeqID_58462
MDTKGAMCHEKQRVFRCKGRGNAECCFFDTWHRSQPLKEHGKKIAAPWFCHYAKLNTQASDTKGETAQN

SEQ ID NO: 175241 - protein, 96 aa, Glycine max
  Coding DNA Sequence Number=SeqID_58463
  Gene Ontology: Mol. function=chromatin binding; Cellular component =chromatin; Biological process=chromatin assembly or disassembly
  Homolog annotation: Hit_ID=Q1SAV4; Match level="QueryCoverage=62%, HitCoverage=15%, E-value=1e-13, Identity=65%"; Hit description =Integrase, catalytic region
MMIRGHRRKNIYLRRKRSLVWLQKGAMESDVDFGSKSAHAQESTTKLKKLSLKLAYKIWVAIKDGAMGKAMKCAHDIQKQLSHLKGCKMGKQCCKM

SEQ ID NO: 175242 - protein, 53 aa, Glycine max
  Coding DNA Sequence Number=SeqID_58464
MDFSKGDIDSTTPNNICVAFEYARWGGVWESKMFDLRMLELAGVFLLREGPMY

SEQ ID NO: 175243 - protein, 169 aa, Glycine max
  Coding DNA Sequence Number=SeqID_58465
MAAPLNSKCSFMCPPMPAPNRRSASGRKDEAAAPVAVVQIHANLRQQLHAGLQVESCDEEECGAAIDVHGVDFATIVGSMPSPAMKRSCCCFLLLLVLENDGDGAEGASDKQIKRAYRKLAVTCIKKEGDLAQNSVRREGHMAHDPQSEGGRRSTRLRRENIRLEDYMF

SEQ ID NO: 175244 - protein, 223 aa, Glycine max
  Coding DNA Sequence Number=SeqID_58466
  Pfam annotation: Domain name=DUF1442; Domain location=1-220; Score =404.1; E_value=2e-118; Accession=PF07279.2; Description=Protein of unknown function (DUF1442)
MKLVWSPESALQAYIDTVKSCEKFKETGVPELLSAMAAGWNTKFIVESWSYGGPIAASVGLAVAARNTGARHVCIVPDERSRAQYIKALAEMGVSPPPEVVVGEAEVAVSQLAGLDFLVVDCKRKEFARVLRVAKVGPKGAVLACKNAWQRNFCGGFRWSVVLQKGVRVVRSVFLPVGKGLDIAYIGSSRSGAAATASKGPRRWIKHIDQQSGEEHLFRKPSH

SEQ ID NO: 175245 - protein, 298 aa, Glycine max
  Coding DNA Sequence Number=SeqID_58467
  Gene Ontology: Mol. function=DNA binding; Cellular component =chromatin; Biological process=DNA integration
  Homolog annotation: Hit_ID=Q1RSG2; Match level="QueryCoverage=99%, HitCoverage=25%, E-value=6e-65, Identity=39%"; Hit description =Integrase, catalytic region; Zinc finger, CCHC-type
  Pfam annotation: Domain name=rve; Domain location=7-135; Score=28.0; E_value=2.7e-05; Accession=PF00665.16; Description=Integrase core domain
MVTGLPKITPPSEICEECVVGKQHRSQFPKGKSWRAKGVLELVYSDICGPIKPSSNGAYCEHHGIRRDLTATYTPQQNGVSERKNRTILNMVRSLLTRGRLPKTFWPEAVNWSIHVLNRSPTFSVQNMTPKEAWSGRQPSVGHFKIFGCIAYAHIPNEKRKKLDDKAEKCVFVGVSETLKAYKLFNPLTKKIVTSRDVIFDEDNTWDWKEQQPNSIIDDNEDVKELQLPVNIVLTSPNAAQIAPETEISTPTNAGTTDATTTTQSKYCDPTTFESFIKEEKWQKAMDDEIDAIERNDT

SEQ ID NO: 175246 - protein, 298 aa, Glycine max
  Coding DNA Sequence Number=SeqID_58468
  Homolog annotation: Hit_ID=Q9XGX0; Match level="QueryCoverage=80%, HitCoverage=75%, E-value=1e-40, Identity=41%"; Hit description =Putative zinc finger protein SHI
  Pfam annotation: Domain name=DUF702; Domain location=89-232; Score =292.0; E_value=1.1e-84; Accession=PF05142.3; Description=Domain of unknown function (DUF702)
NNNQSSEIPPAETLFWYSKNDDVSSYHRGFELWNQHQEHQHHHHAMHHPHARPLLQRDLYSSGVGPSRGGISDDHSSSRSAAFVAMRAAGAEGGGISCQDCGNQAKKDCPHMRCRTCCKSRGYDCQTHVKSTWVPASKRRERQQQLMALHQQQQEQQQQRDISKRPRDSRLSSSGLEEEGHFPSVVSSPAEFRCVRVSCVEDSDDRYAYQTAVSIGGHVFKGILYDYGPENSNNNNSNNNSNNYMAGETSAVAATAQPLNLAAAASSAALIDPSSLYSAPANAFMAGSGTQFFPHTRS

SEQ ID NO: 175247 - protein, 507 aa, Glycine max
  Coding DNA Sequence Number=SeqID_58469
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=81%, HitCoverage=27%, E-value=1e-120, Identity=48%"; Hit description =Chromo
  Pfam annotation: Domain name=DnaJ; Domain location=388-467; Score =44.6; E_value=3.5e-10; Accession=PF00226.21; Description=DnaJ domain
  Pfam annotation: Domain name=rve; Domain location=84-240; Score =108.1; E_value=2.6e-29; Accession=PF00665.16; Description=Integrase core domain
  Pfam module annotation: Pfam domain module=DnaJ::rve; Domain location= 388-467::84-240
MTSAPVLAIPNFKEIFVLEIDASGSGVGKIMLPPDVGLLNQIMEEFHSSKIGGHSGVNKTTTRIGAPFYWNGMRSDISKFPLLIPPQIWEDIAMNFIFQLPPSQGFTTIFTIVDRLSKFGHFIPMKSEFNNKVVAEAFITNIVKIHGFPKTIVSDRDKIFISTFWQQLFKAQGTTLAMSSSYHPQSNGLTENLNKTLEMYLRCFVFDHPMSWVTMLPWAQFWYNTSFHQSLGMTPFQAVFGRPPPMVMHYEVDPKDLDPLKDLLQLCDQLLSKLKGNLLKAQQYMKMQDDKKRRDLQFKVGDLVLVKLQPYRQHSVALRKHRKLGMHYFGLFPVIERIGTVAYKVQLPESAKIHLVFHIALLKPFHGKSPPPYLPFPLTSSELGPTLCPWKVLNVRVVKHLEATMSQLLIQWEAIKAKGATWEYLRDISLKYHPDKNLNNEEANKKFAEIINAYEVLSDCKKRNIYDRYGDDGLKQHAASGGRGGGVNFQDIFSTQVINYNFCSFSS

SEQ ID NO: 175248 - protein, 207 aa, Glycine max
  Coding DNA Sequence Number=SeqID_58470
  Gene Ontology: Mol. function=nucleic acid binding; Biological process= DNA integration
  Homolog annotation: Hit_ID=Q1RWN2; Match level="QueryCoverage=86%, HitCoverage=15%, E-value=1e-47, Identity=51%"; Hit description =Peptidase S8 and S53, subtilisin, kexin, sedolisin; Integrase, catalytic region; Zinc finger, CCHC-type
MENFLQSKEYWPIIESRIQEPEEGASLTKPQKAIDRPILETILCKETSKDIWDSMKKKYQGSTRVKRAQLQALRRDFETLAMKDGEYVFSYFARTMEISTRMRFHGEKMKDVTIVEKILQSLTPTFDYVVCAIEESKDLDALSLDELQSSLLVHEQKMNRSSNLTAEEQALKASTNTHSIGRGRGKGIGRGRGQGRGRSNYRGNQHQ

SEQ ID NO: 175249 - protein, 160 aa, Glycine max
  Coding DNA Sequence Number=SeqID_58471
  Gene Ontology: Mol. function=oxidoreductase activity, acting on the CH-OH group of donors, NAD or NADP as acceptor; Cellular component =chloroplast; Biological process=malate metabolic process
  Homolog annotation: Hit_ID=Q9SDL2; Match level="QueryCoverage=55%, HitCoverage=15%, E-value=4e-38, Identity=86%"; Hit description=NADP -dependent malate dehydrogenase
  Pfam annotation: Domain name=malic; Domain location=36-154; Score =54.8; E_value=2.8e-13; Accession=PF00390.9; Description=Malic enzyme, N-terminal domain
MLNANPPFIGLAFNCNQHHSKHTISCWPHPFAYRLQERNERLFYKLLLDHVEELLPVVYTSTVGEACQKYGSIFMHPQGLYISLKEKGRILEVLRNWPEKNIQFIVVIDGERILAFGDLRCQGSESWVVIVKDIHASKALDLSYRGLKYIVYGVLLLYFE

SEQ ID NO: 175250 - protein, 185 aa, Glycine max
  Coding DNA Sequence Number=SeqID_58472
  Gene Ontology: Mol. function=RNA-directed DNA polymerase activity; Biological process=RNA-dependent DNA replication
MSEPSNQASQSRDYLCIFRDFNDLPSNNEKIRLVDHPNWLINDFREVVSDCNLHDLPIEGYQYTWARRKGKHVEIQEKLDKGLATTDWIDLFPNFKLINEIATKSDHSPILICLNTAQRRRNIHVSTSTYDNDSSLSLFTIDEFKDAFFSQMNSDKSNGLNGLNPTFSKKFWHLCGAEIFQSGTT

SEQ ID NO: 175251 - protein, 47 aa, Glycine max
  Coding DNA Sequence Number=SeqID_58473
MVFLVYHSTGAYKPYSPNSKKIVPSRSVTVDDESKETIQIQSQSSDN

SEQ ID NO: 175252 - protein, 55 aa, Glycine max
  Coding DNA Sequence Number=SeqID_58474
MAHQIWMELSTCKRGTIDTKRISIPRDMFWKTLEKKGVPMAYIRTIQDMYEGLLE

SEQ ID NO: 175253 - protein, 84 aa, Glycine max
  Coding DNA Sequence Number=SeqID_58475
MEIAWARRGTAKAYKLDQTPPEQQIQAVAPCHEGQGFIVGEANGEGHESEDSSCNVRLVPYALCWDIKRGDEDNSTRRLVGGRE

SEQ ID NO: 175254 - protein, 74 aa, Glycine max
  Coding DNA Sequence Number=SeqID_58476
MVKLMRMSHIGYKQDSKHQGLFVIAKHQPYSKASFMIEYEMTLYEKRWFGRRPQEAPVRRVDRKIFSLEKRRRG

SEQ ID NO: 175255 - protein, 53 aa, Glycine max
  Coding DNA Sequence Number=SeqID_58477
MKLLSLTSAVSTFSLIASLESCHLRRRKGYGVKTWSIFTSKIVRGKNDHVPMA

SEQ ID NO: 175256 - protein, 82 aa, Glycine max
  Coding DNA Sequence Number=SeqID_58478
MDDEVLRWSQNNETPSCSASVNVKPALDKNKQVSNIKVRKPHKPNILLGFGLNVVSSSLVWCACGSLMDFSFVFYSPHIPYK

SEQ ID NO: 175257 - protein, 72 aa, Glycine max
  Coding DNA Sequence Number=SeqID_58479
MHKRSGEPSCEVRDVTYTYALDEEVCMIGDVNSSEQESETLVRGQRVGVIFTSLSALVAFNLAKEVKLLLSN

SEQ ID NO: 175258 - protein, 71 aa, Glycine max
  Coding DNA Sequence Number=SeqID_58480
MLKLLSKIKVQKNHTFMVVYKRDYCDVKGRALVEALNQQPENDREGALEAELVEQSDIFGNNDKTDFDVEE

SEQ ID NO: 175259 - protein, 134 aa, Glycine max
  Coding DNA Sequence Number=SeqID_58481
  Homolog annotation: Hit_ID=Q1RW23; Match level="QueryCoverage=76%, HitCoverage=58%, E-value=4e-18, Identity=45%"; Hit description=Plant self-incompatibility S1
  Pfam annotation: Domain name=Self-incomp_S1; Domain location=31-130; Score=69.2; E_value=1.4e-17; Accession=PF05938.2; Description=Plant self-incompatibility protein S1
MLKSLVTIIVFLLIVRAQDDLGDDSVFDGKKTVRVLNAMNDGILVYLHCRSRDNDLGKHVLAVGEYQQWSFRDNFLDSTLFWCKMDAGNVHARFEVYRAKIEETLCDSLCNRALTNDGAYFYDQFRGYWQKRLS

SEQ ID NO: 175260 - protein, 179 aa, Glycine max
  Coding DNA Sequence Number=SeqID_58482
  Gene Ontology: Biological process=regulation of transcription
  Homolog annotation: Hit_ID=Q1SWC6; Match level="QueryCoverage=51%, HitCoverage=14%, E-value=1e-21, Identity=58%"; Hit description =Tesmin/TSO1-like, CXC
  Pfam annotation: Domain name=CXC; Domain location=93-133; Score=54.0; E_value=5.1e-13; Accession=PF03638.5; Description=TesminTSO1-like CXC domain
MFECRQFFPHSNTVTHILIQGTPTYGRIRKEMKLSFYLELDMCLKIEQKQGKFLIGFVRFAFIHRAILRWCPIYLKARSQPQCNVELKDITPKKQKQSNCKNCRCLKTYCECFAAGIHCHGCNCVNCHNNVDNEPARLEAVGITLERNPNAFRPKIATSPLERRDSNKGGDREREYEEN

SEQ ID NO: 175261 - protein, 109 aa, Glycine max
  Coding DNA Sequence Number=SeqID_58483
CWIYEHFHTIASIITDEDYHERKPCVCHWKFGKALPMTTYLDYMEWFYRISHPFMSMTQLRDPPRHPLVVHDDTFIVPNPPHEPAYTTTMPQPLVPTAADVDVPRHAVV

SEQ ID NO: 175262 - protein, 88 aa, Glycine max
  Coding DNA Sequence Number=SeqID_58484
MENVNGNVKFQNHYSRIHVDLSGNCNSWRSDIISEDGGWLSANVFVDTIEQNWHANLKIDNLFVPLFERILEIPITWSKGRASGEVFF

SEQ ID NO: 175263 - protein, 664 aa, Glycine max
  Coding DNA Sequence Number=SeqID_58485
  Subcellular localization annotation: CTP_CleavageSite=52; ConfidenceScore=5.56e-01
MSLKNHTLFFGTSLHGSLESGTSKRSPFRLDKRQLLPQKVLCSCTCCVSPKRCRLVSQALRFSTFSGQNVGLLGKDLILRSGSRLECSRDPYFRSEALVSYLIPLWKEGLLLIRASVYTAVISGVCMLVWYGQNKAKGFIEANLLPSVCSAISEHIQRDLVFGKVRQISLLSITLESCSFGPHKEEFSCGEAPTVKLRLRPFVSLRRGKLVIDAVLSHPSLLVVQRKDFTWLGIPFNEGGRERSCSAEEGIDYRTRTRRLAREEAFAQWERERDDAAREAAEVGYFVSERSCGLSQGDDGLKEIETRSLESSESAPFFCMNDGKHDHRLMDKGVNYDTKHSALEKSFGVRFPGTGLRFWSRVISGPRKHKFKRKATGSNIFPSGGAIKKRMFERSASAAHAYFCDQSQWKFGEPSSSSESYGFMSHDMHLVKSEVDRNTISVIVGDENRSDDNQSGTQYRDLGFQSSSVNENVSSQSDYLKFVCDPTLQTRESEIENLQSTDDVAQPANPNSSTVKNEECVPYVADNQIDDNDNSSGGQRGLPSEDLGFLKPKPQLATYFQNPFVPLLVKFGLTSFLKNIEDLISHFLSGSIEMLKSDVGLKVEDIVSEHVDGVDFVQSEGITKTLPITLDSVHFRGATLMLLAYGDKEVSFINGGWQKAKILP

SEQ ID NO: 175264 - protein, 295 aa, Glycine max
  Coding DNA Sequence Number=SeqID_58486
  Homolog annotation: Hit_ID=Q1RW23; Match level="QueryCoverage=46%, HitCoverage=80%, E-value=2e-18, Identity=39%"; Hit description=Plant self-incompatibility S1
  Pfam annotation: Domain name=Self-incomp_S1; Domain location=31-136; Score=62.2; E_value=1.7e-15; Accession=PF05938.2; Description=Plant self-incompatibility protein S1
MLKSLVTIIVFLLIVRAQDDLGDDSIFDGRKTVCVLNGMNDDILVYLHCQSRYNDLGQHVLAVGEYQEWSFRDNIRDTTLFWCTMDAGKVHASFQVYRAEIEEKLCDSQCNRTLTNDGGYFYDQFHGYWEKRLSCKHPTKTRGNKDIITDSPFLPPLLGSHKSCWFDKALLLSYEKVKNKNNNSNKSKVEIKSAQRKSKECKEEESKHKIYTCSATTCAYVQSRSNPRITTQVDVRSTCTTKDVRSNVLRQRILFEQPSNPLLEANDKGCTLPCVHYYNQETTRFLHRILRRLVL

SEQ ID NO: 175265 - protein, 110 aa, Glycine max
  Coding DNA Sequence Number=SeqID_58487
MSALCFLPSLLIAARLTPPNSSYIVGYYIHDDMYLFPSPSASFLSLFSISPILLMIFAWSELLFTPNIFANSHWDDASSLMLSPCPKLETCPGGVGDHSVGPISDYTPFF

SEQ ID NO: 175266 - protein, 94 aa, Glycine max
  Coding DNA Sequence Number=SeqID_58488
MASPGFNAHRLWLAFIVLSTFTYWFNFKGKTKTKAKAQDPSPMQPDAKDYNVISRAARLDCGDSPVTTPQENTVATLYFYLASFLRITNVNSEH

SEQ ID NO: 175267 - protein, 161 aa, Glycine max
  Coding DNA Sequence Number=SeqID_58489
  Gene Ontology: Mol. function=unspecific monooxygenase activity
  Homolog annotation: Hit_ID=O04892; Match level="QueryCoverage=58%, HitCoverage=17%, E-value=3e-28, Identity=79%"; Hit description =Cytochrome P450 like_TBP
MRDEPDEWVTSAQLRANLDPTKGVGRLRQAGRWSWKSKSAKDLPTLETAQPEVGSSGWKSTARRVVSGKGSRQNGSVTSGKGLALRAGHGGPSPEPVGCRWTARAASAARAGRRVPVGGRIGNGPFGASSPGVEQSTQNWYGQGESDCLIKTKHCDGPCGC

SEQ ID NO: 175268 - protein, 56 aa, Glycine max
  Coding DNA Sequence Number=SeqID_58490
MFGVTLSVPCCVKPELLSAKRTLCVKPKGYSSEAKLSAQRSTKLIPSSILKIEDLG

SEQ ID NO: 175269 - protein, 64 aa, Glycine max
  Coding DNA Sequence Number=SeqID_58491
  Subcellular localization annotation: CTP_CleavageSite=34; ConfidenceScore=5.03e-01
MHAGSDQEDPSGFYFSCQPEPATPTPAAGPAQSSAAAAKAAPAPGAAGSLRNCRGSTADSRPAT

SEQ ID NO: 175270 - protein, 101 aa, Glycine max
  Coding DNA Sequence Number=SeqID_58492
  Gene Ontology: Mol. function=RNA binding
  Homolog annotation: Hit_ID=Q1T614; Match level="QueryCoverage=56%, HitCoverage=11%, E-value=3e-11, Identity=56%"; Hit description =Cyclin-like F-box; Agenet
  Pfam annotation: Domain name=F-box; Domain location=64-100; Score =16.6; E_value=0.092; Accession=PF00646.23; Description=F-box domain
MACPLTLAMVIRQLRSFFFGWLEKRMNPQTTQVSLEVGKEAKGILTIKKKIQRTSGSDRQEERDRLSEFPDCVLLHILEFMNTTDAVRTCILSKRWKDLWK

SEQ ID NO: 175271 - protein, 190 aa, Glycine max
  Coding DNA Sequence Number=SeqID_58493
MSPVCATYSEWHVCKNMFPKTRLENSLVNPPKGSQNLRSALSESHQFTPPCLQYFPLCKRHVCKSKQVRHQYMPSSASAMYAKTQHLHAHKTRQTQASGLLIFTSLQNPRPILGIHAYQKPKVFPWYSHLQNPKSALGTHFYKTQGQDDPPPDCMTGLSIKCNSYLHLVTIIGVTQQVKRPIPSLVRQDL

SEQ ID NO: 175272 - protein, 118 aa, Glycine max
  Coding DNA Sequence Number=SeqID_58494
MDLMTTFGQGKLSRSFTIKYLLVDANTSYFALIERKTLNELEAIFSTPHLTMKFPTLKREIVTTMVNQKQACLFYAESLKLVPYPPIQEPTVPHPTVAEDTQVMTVDEGRSVRTLTVY

SEQ ID NO: 175273 - protein, 140 aa, Glycine max
  Coding DNA Sequence Number=SeqID_58495
GYLFSISSVSIYYGTQSDIRVKSYCRLNLLGASVFNFERLDIFQDSVGHPTKKLLSFEFGASVFNFECLDILRDSIGNPNKRLLSFEFATSFRFEFGASRYITGLNWQPSKKLLSFKFAQSFCFNVEHLDILPDSIGHPS

SEQ ID NO: 175274 - protein, 273 aa, Glycine max
  Coding DNA Sequence Number=SeqID_58496
  Gene Ontology: Mol. function=protein binding; Cellular component =integral to membrane; Biological process=xylan catabolic process
  Homolog annotation: Hit_ID=Q1SWI7; Match level="QueryCoverage=99%, HitCoverage=85%, E-value=2e-86, Identity=40%"; Hit description =Leucine-rich repeat
  Pfam annotation: Domain name=LRR_1; Domain location=110-143; Score =5.2; E_value=30; Accession=PF00560.23; Description=Leucine Rich Repeat
  Pfam annotation: Domain name=LRR_1; Domain location=155-176; Score =3.6; E_value=60; Accession=PF00560.23; Description=Leucine Rich Repeat
  Pfam annotation: Domain name=LRR_1; Domain location=183-204; Score =12.2; E_value=1.5; Accession=PF00560.23; Description=Leucine Rich Repeat
  Pfam annotation: Domain name=LRR_1; Domain location=207-229; Score =3.1; E_value=75; Accession=PF00560.23; Description=Leucine Rich Repeat
  Pfam annotation: Domain name=LRR_1; Domain location=231-253; Score =10.9; E_value=2.6; Accession=PF00560.23; Description=Leucine Rich Repeat
  Pfam annotation: Domain name=LRR_1; Domain location=255-273; Score =4.3; E_value=45; Accession=PF00560.23; Description=Leucine Rich Repeat
  Pfam annotation: Domain name=LRR_1; Domain location=37-60; Score=5.5; E_value=26; Accession=PF00560.23; Description=Leucine Rich Repeat
  Pfam annotation: Domain name=LRR_1; Domain location=85-108; Score =10.1; E_value=3.7; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=110-143::155-176::183- 204::207-229::231-253::255-273::37-60::85-108
GNPFESLGSLSKLSSRYIGGNLFQTVVKEDDLANLTSLMEIHASGNNFTLKVGPNWLPNFQLFHLDVRSWQLGPSFPSWIKSQNKLEYLDMSNAGIIDSIPTQMWEALPQVLYLNLSHNHIHGESGTTLKNPISIPVIDLSSNHLCGKLPYLSSDVSQLDLSSNSFSESMNDFLCNDQDEPMQLQFLNLASNNLSGEIPDCWMNWTFLGNVNLQSNHFVGNLPQSMGSLAELQSLQIRNNTFSGIFPSSLKKNNQLISLDLGENNLSGCIPTW

SEQ ID NO: 175275 - protein, 276 aa, Glycine max
  Coding DNA Sequence Number=SeqID_58497
  Gene Ontology: Mol. function=ribonucleoside-diphosphate reductase activity; Cellular component=ribonucleoside-diphosphate reductase complex; Biological process=DNA replication
  Homolog annotation: Hit_ID=Q81TB6; Match level="QueryCoverage=99%, HitCoverage=41%, E-value=2e-95, Identity=61%"; Hit description =Ribonucleoside-diphosphate reductase, alpha subunit, group I intron- containing
  Pfam annotation: Domain name=Ribonuc_red_lgC; Domain location=1-276; Score=-108.1; E_value=1.4e-10; Accession=PF02867.5; Description =Ribonucleotide reductase, barrel doma
MKLSSIGGGVSFNISKIRARGEAIKGVEGRAGGVLPIMKIMEDTFSYANQLGQRPGAGAVYLNIFHSDIEEFLDCKKINVDEKVRIKSLSIGIIVPDKFMELAEKDEPCYLIYPHTVMQEYGQFLDEMDMDKMYDELITNPNVKKKKINARHLLVKIAQTQKESGYPYIFFKENTNRVHALNEIGQVSQVSDIEIYGKQDTIRYGISCNLGSLNIATVMDNKRIKETVKTAMRALTVVTDVTNIDMVPSIAKANRELHSVGLGAMNLHGYLAKSFI

SEQ ID NO: 175276 - protein, 87 aa, Glycine max
  Coding DNA Sequence Number=SeqID_58498
MASKSGSWQLVVVEEKVGGVGGGFRGRYGDKKWLFYAVGRICSLQDSPKRNLARPSNSAPTNFTASSNCEGDPIVNESRIEILVEQV

SEQ ID NO: 175277 - protein, 110 aa, Glycine max
  Coding DNA Sequence Number=SeqID_58499
MSSDGEASIHPTIPKINTTTMHIANEPTNYIEYFFNIHYLEHIGLDMHETFLSCGIRSQTTKFWCDKLQDHEVRDNFTQREVPQVDEKESNKRPWECITHVLAAKDDALP

SEQ ID NO: 175278 - protein, 126 aa, Glycine max
  Coding DNA Sequence Number=SeqID_58500
  Gene Ontology: Mol. function=protein binding; Biological process =protein modification process
  Homolog annotation: Hit_ID=Q7XDQ7; Match level="QueryCoverage=68%, HitCoverage=24%, E-value=9e-15, Identity=46%"; Hit description =Ubiquitin family protein, putative, expressed
DGPVWKKAQVVPKSRKDDSGSNNDMKKIPVKNRMERWKATGVVALSECNLEVIPDEVWVCGSSARVLDCNNNSITDVPDEIARLTGLDVSVSSPSRLGTLSEQSEEKLKESQEIARDVAIAVTIHT

SEQ ID NO: 175279 - protein, 104 aa, Glycine max
  Coding DNA Sequence Number=SeqID_58501
MATRMEAMMSMKKITEANVVRIAATSAVAKVNPMPPSGLNQMNHPTPYMVDKDLGSTSGPHYVQIQNKHAFTPYGLPSNYTPPNVAYTPNENVNNSTPILIDSQ

SEQ ID NO: 175280 - protein, 82 aa, Glycine max
  Coding DNA Sequence Number=SeqID_58502
MDMIKSLSSKPEKFTEIKTSTSSTDIVQTDATIKHDVSDKDILCHGRILSALADNIYKIFCHTKTSVELWEALELKYGSAEK

SEQ ID NO: 175281 - protein, 107 aa, Glycine max
  Coding DNA Sequence Number=SeqID_58503
MAAQLIHDRVEMECLEGAWETLEGNTRCRFRGTIRFTATSLVHPDEPARTLQRTVEWTTFFGLVLYTFEDLMYRNLIIVYLWLKPPLWTPLLWMTLYFVKLPYFEQL

SEQ ID NO: 175282 - protein, 612 aa, Glycine max
  Coding DNA Sequence Number=SeqID_58504
  Gene Ontology: Mol. function=nucleic acid binding; Cellular component= chromatin; Biological process=DNA integration
  Homolog annotation: Hit_ID=Q1S7C5; Match level="QueryCoverage=95%, HitCoverage=51%, E-value=1e-131, Identity=40%"; Hit description =Integrase, catalytic region
  Pfam annotation: Domain name=rve; Domain location=2-103; Score=0.9; E_ value=0.005; Accession=PF00665.16; Description=Integrase core domain
  Pfam module annotation: Pfam domain module=RVT_2::rve; Domain location=203-459::2-103
MVELQLNTKIKALQTNGAKEYLALTKYLADHGIQHCIPCPHTHEHNGAQERKHRHLTETGLTLVTASSLPSKFWVEAFSTAIFIINRIPSPVINYKSPFEVLFHKTPDYSIFKPFGCLCYPYLRPYTKTKLDFRSTSCIFLGYNTKYKGYKSPEQAPYPTPTTNVHPMTTRAKSGVFKPKALLKEITPRCTKDEMQDPQWLDTMKEEYMVLTQNKTWDLVPLPPHRKAIGSKWIYRLKYNVDGSVARHKARLVAQGYSQRPGLDYNETFSPVIKHVTIRTVLSIAVTRKWNIRQVDVNNAFLNGSIQEEVYMQQPEVFIFVNPHLVCKLKESLYGLKQAPRAWFSKLASSLISFGFKPTRCDTSLFVHATPKFITYILVYVDDIIITGISNSAIQYVISKLHSLYPLKDLGTLHFFLGIEAKHTTTGALLLSQSKYINDLLSKVNMHNAKPIKTPLAPGSQLHMDAFYPSQNLFITGYSDSDWACDSSDMRSTSGFCVYLGNNLVSWLVKKQHSVSWSSTEAEFRSLVALVVEIKWIKSLLTELHVIQTKSPLLWCDNQGAVMITANPILHSKSKHFELDLCFVREKAVNGEIVVKHIPSQLVWGGCLGCES

SEQ ID NO: 175283 - protein, 923 aa, Glycine max
  Coding DNA Sequence Number=SeqID_58505
  Gene Ontology: Mol. function=DNA binding; Cellular component =chromatin; Biological process=DNA integration
  Pfam annotation: Domain name=RVP_2; Domain location=218-340; Score= -60.2; E_value=0.048; Accession=PF08284.2; Description=Retroviral aspartyl protease
  Pfam module annotation: Pfam domain module=RVP_2::Retrotrans_gag; Domain location=218-340::8-98
MPDLERLTIASFYMEGPALSRFQWMHRNAQLSSWSAFLHALHSSFATTTYEDPTGLLCKLQQRSSLMAYLSEFESLANRIVGLPAQFVLSCFISGLSPSIRREVQVLQPISLAQAVSYARLQEGKLLDARRPSPYRTPTSTAGSTTARSSSANTTPSLLPKPVRNSTSIPFKRLTPEELASHREKGLCFHCDEKFSRGHKCASSLFLLVMEDEEPMVEVDQLRDASPTPELLPESPPAQLSLHALSEHNFLHNRVVVNLGLKPTETTPLRVTVGNGEEIRCHQLCTAVQVHIQQQSFTIDFHMLPLCGDDVVLGVQWLKTLGPVLTDYGALTMKFITDGKLIELFAHTNPTSTFFHIRIESTTKLTPQTTHPLPEIDTLVTKYASLFQPLMNLPSSRPTDHTINLLPNSTLVNVRPYRYPYFQKKETEEQVAAMLARGALNAITVRDRFPILTMDELLDELGRAALRVSGDALWIMQCSFLFSSHDEPLEYLGHMVAGNGVTPIPEKVKAIQQWPTPRSPRALRGFLGLAGFYRRFIRGYATLAAPLTKLLCLGQLSWNQDAAEAFQNLKNALTAAPVLALPDFSAPFVVETNASGAGMGAFLMQGGHPLAYFSKQFCPRLLNSSTYYFLGHHFVILTDHRSLSELMNQTIQTPEQHRYLALLLGFDYTIQYHAGKSNVVADALSRAMECQAASLYLLSMSRFVFLEDLRKELASLTAFLDLRDRIREDPVAYADYTLTEGFILHRGRIWLPSNSSFIKLLLEEFHQSPTSGHMGVQKTLHRLQDNFTWPTIKEDTQKFIAGYVTCQYTKYDNRKPAGLFCPLPVPTRPWEDLSMDFITGIPAYHGNTYIFVVVDQAVDAILSQREVVFELLRRKLLKAQDRMKTNADRHRHDQEFKVGDWVMVKLRPHRQTSVTGAAYSKLG

SEQ ID NO: 175284 - protein, 39 aa, Glycine max
  Coding DNA Sequence Number=SeqID_58506
MDLGRFQVSVPSNNYPTVPHLLRMPPSSDNTSLDGSWGK

SEQ ID NO: 175285 - protein, 60 aa, Glycine max
  Coding DNA Sequence Number=SeqID_58507
  Subcellular localization annotation: CTP_CleavageSite=20; ConfidenceScore=5.24e-01
MSPDFMVRTTKGAEDDVSLRASTGSFAPGRRKVRVTIRTTKGAEDNVSLRASTGSFFAGS

SEQ ID NO: 175286 - protein, 361 aa, Glycine max
  Coding DNA Sequence Number=SeqID_58508
  Gene Ontology: Mol. function=alkanesulfonate monooxygenase activity; Cellular component=intracellular
  Homolog annotation: Hit_ID=Q3MDP6; Match level="QueryCoverage=99%, HitCoverage=78%, E-value=1e-110, Identity=56%"; Hit description =Xenobiotic compound monooxygenase, DszA family, A subunit
  Subcellular localization annotation: CTP_CleavageSite=48; ConfidenceScore=5.53e-01
MARLEPLTLLSALAVNTKRIGLAATASTTFSDPFTMARSFSSLDHISRGRAAWNVVTSFSTDVARNFSRSDMPNHAERYARAREFLDVTYKLWDGWQAGAVQPNKETGQYFIDDKIQPINHVGEHFQVQGPLNITRSPQGRPVIIEAGSSSDGQKLAAETAEVIFTASASLEEAQSFYRSQKDQVIAAGRNPDHVVIMPGVMPIIGRTREEAKALWKELNTLVDIDNGLRQLSLRFNMDLSQYPLDGPVPEVPLGEGNQSRVKLMTDMAKRENLTLRELAAVAAGSRGHRVIVGTAQDIADDVELWLNEGGADGFNIMPAIMSEQLDLFVELVIPELRRRGLFREEYEFATLRENLGLPVV

SEQ ID NO: 175287 - protein, 563 aa, Glycine max
  Coding DNA Sequence Number=SeqID_58509
  Gene Ontology: Mol. function=protein dimerization activity; Cellular component=endoplasmic reticulum; Biological process=proteolysis
  Homolog annotation: Hit_ID=Q6CZG0; Match level="QueryCoverage=50%, HitCoverage=73%, E-value=1e-105, Identity=68%"; Hit description =Putative peptidase
  Pfam annotation: Domain name=M20_dimer; Domain location=305-411; Score=25.5; E_value=0.00019; Accession=PF07687.4; Description =Peptidase dimerisation domain
  Pfam annotation: Domain name=Peptidase_M20; Domain location=200-450; Score=89.2; E_value=1.3e-23; Accession=PF01546.18; Description =Peptidase family M20M25M40
  Pfam module annotation: Pfam domain module=M20_dimer::Peptidase_M20; Domain location=305-411::200-450
MTLEFRQVTEDEVDTYQALMHAAYAPTLALGIKFDAATADREKTLRHLQSHGVYALYAQGVMVSSVTVRYPWGPLPGPFGLPHIGWFGAHPDYAGQQFGRQVQDRLEQEILRGQLRAPAVSLGGITRKPGMSQLNETALGEQLIAFRHELHRFPELSNQEFETTARLRQQLEQHQIRIVDLPLKTGLVAEVGPAQGPLIVLRSDIDALPIEEQSDVAFRSERPGVMHACGHDFHASAALGAAILLKQQEATLPGRVRILFQAAEETGQGAPDVIATGALQEAVAIFGIHNDPSLPPGVVGSKAGALTAAVDRFDIRITGTGSHAAKPHQGNDPIVIAAQIVSAAQTLISRNAPSADNAVVSITQLHSGSTWNVIPDSAWLEGTVRTFSQSTRERLEQRFREIVLGLGAAFAAEVEFNWHAGMNLSHALAERILQSQPDAAARDAARTGVQDFLAVSWPVLQQQVPDSGLPALRQVYGDGSVRSQALLLGYAGHALDYDDFHADFRGHPSVAILPALFAWQQQQPATTEAFLDAYVIGVEVAGRLGLAASQQHYALGYPNTATL

SEQ ID NO: 175288 - protein, 138 aa, Glycine max
  Coding DNA Sequence Number=SeqID_58510
  Gene Ontology: Mol. function=transporter activity; Cellular component= integral to membrane; Biological process=transport
  Homolog annotation: Hit_ID=UPI00005F7CB4; Match level="QueryCoverage =86%, HitCoverage=30%, E-value=2e-23, Identity=48%"; Hit description =COG0477: Permeases of the major facilitator superfamily
MDKARRLNAVLHRDVMMNSNLLNLRQQRATRTLFFIAGLGMAAWAPLIPFAKAQLAINDGMLGLLLFCIAAGSMSVMPFTGALIAHFGCRTLLLLCGAGLALDLPLLMLLSSPLPMAGALLLFGAINGLMDVSMNYQA

SEQ ID NO: 175289 - protein, 333 aa, Glycine max
  Coding DNA Sequence Number=SeqID_58511
  Gene Ontology: Mol. function=transcription factor activity; Cellular component=intracellular; Biological process=regulation of transcription, DNA-dependent
  Homolog annotation: Hit_ID=UPI0000E68BDD; Match level="QueryCoverage =68%, HitCoverage=97%, E-value=3e-60, Identity=51%"; Hit description =transcriptional regulator
  Pfam annotation: Domain name=HTH_11; Domain location=6-60; Score =70.5; E_value=5.3e-18; Accession=PF08279.2; Description=HTH domain
  Pfam annotation: Domain name=HTH_DeoR; Domain location=6-63; Score =15.6; E_value=0.0013; Accession=PF08220.3; Description=DeoR-like helix-turn-helix domain
  Pfam module annotation: Pfam domain module=HTH_11::HTH_DeoR; Domain location=6-60::6-63
MSKTQRLPELLQLLRCHRYPLTAQRIAEQLHISVRTVYRDILSLQQQGVEIEGSAGVGYLLKSDGHLPPLMFSRQEIDALVLGLNWVTRHTDDELKSAARHALAKVQAVIPPHLTQSIDHQSLLIASQGEALFETHLPQIRQAIHQRSKISLRYKDLQDNLSTRTIWPVVIGYFERVRLLCGWCELRQEFRNFRVDRIEAISVTSELYPGTRHQLLKRWRDYHHLRHPPRAAVIATQHYNSQSITAFIREVIFMATSIRLDDDFVSDVKIHAEAASRSIPKQIEHWAKIGRIAEDNPDLPYSFIAEVLIAQAEVDNQKVSPYVRRTPRSKTTK

SEQ ID NO: 175290 - protein, 127 aa, Glycine max
  Coding DNA Sequence Number=SeqID_58512
  Gene Ontology: Mol. function=oxidoreductase activity, acting on single donors with incorporation of molecular oxygen, incorporation of two atoms of oxygen
  Homolog annotation: Hit_ID=UPI00005F931B; Match level="QueryCoverage =93%, HitCoverage=97%, E-value=5e-26, Identity=52%"; Hit description =COG0346: Lactoylglutathione lyase and related lyases
  Pfam annotation: Domain name=Glyoxalase; Domain location=3-120; Score= 8.7; E_value=0.023; Accession=PF00903.15; Description=GlyoxalaseBleomy cin resistance proteinDioxygenase superfamily
MLTANMTIIYVPNVVKSADFYAALFDIKPAELSPTFAMFVFESGFKLGIWSQYIVEPALSLTASAARSEIVFKTARKDDVDFLYHEWGVLREITIIQSPVRMDFGYTFTALDPDGHRLRVCYLQLDE

SEQ ID NO: 175291 - protein, 362 aa, Glycine max
  Coding DNA Sequence Number=SeqID_58513
  Gene Ontology: Mol. function=hydrolase activity, hydrolyzing O -glycosyl compounds; Biological process=carbohydrate metabolic process
  Homolog annotation: Hit_ID=Q1IUL9; Match level="QueryCoverage=99%, HitCoverage=58%, E-value=1e-108, Identity=53%"; Hit description =Glycoside hydrolase, family 9 precursor
  Pfam annotation: Domain name=Glyco_hydro_9; Domain location=1-362; Score=-266.8; E_value=0.074; Accession=PF00759.9; Description =Glycosyl hydrolase family 9
SQRVTGLFDKADRKLPLPPGTGSGTVDVHGGWYDATGDYGVHLSHQNLTSYFNPQQAPLVAWSLLRGYQNLGARDNPNFDEYRRRMLDEGLYGADFLVRMKRPGESFFQAISSPGKEKLAQDRVIANPNWRTQIKEKESDSTIVEEEAVGPLAWQASFRSGAGMSIAALALASTMENDGNFTRQQYLQTAEDAFAFLQKNNLRMVNDGKENIVDDYTALLAATELYRASQKAVYLAAAQQRAESLMARLTSLDNWHDYWRADGEKRPFFHPSDAGLPVIALLEYARIAPQAQQANIRQTVKRSLGFELAVTKESNNPFGYARQLIQLKDGVKRTSFFFPHDSEAAPWWQGENARIASLAAAA

SEQ ID NO: 175292 - protein, 749 aa, Glycine max
  Coding DNA Sequence Number=SeqID_58514
  Gene Ontology: Mol. function=porin activity; Cellular component =integral to membrane; Biological process=transport
  Homolog annotation: Hit_ID=Q66DC4; Match level="QueryCoverage=60%, HitCoverage=97%, E-value=1e-131, Identity=48%"; Hit description =Possible outermembrane porin (OPR family) precursor
  Pfam annotation: Domain name=OprD; Domain location=297-743; Score= -171.5; E_value=1.9e-06; Accession=PF03573.4; Description=outer membrane porin, OprD family
  Pfam annotation: Domain name=PTS_EIIC; Domain location=18-221; Score=- 35.7; E_value=0.0027; Accession=PF02378.9; Description=Phosphotransfer ase system, EIIC
  Pfam module annotation: Pfam domain module=OprD::PTS_EIIC; Domain location=297-743::18-221
RRVCLPAAVYCRYRGRPFRCQPFHRAGADGGDGVSAHPAGSAGALYAVRPEHQPEDLRRRGDSGDSGGAAAEQALVFVPCLSLLICGFVVFTVIGPLADYVGVGIASGYSWLYQLSPMISGALLAGIGQLFVVFGVHWGIIPLALINIQVQGYDTIMAMFMSAVMGQFGAVTGAIFIARSLRDRQIAISASLSAFFGITEPALYGVNLKYRMLFIFGCIGAALGGGITGLLQVKTYSFLPVLNVFELGLFEGPESKMIYEVAAIAVAFLTPFILTLIYGRWTLRSVMNTFTRRKKAALLPLATLMLGAAPPALAEGFVEDSTLEGTVYYWQRHRERKDLDPHSTHYQHYQTNLHHSTLTGALDYQSGYLADTVGIDVAAFATWDLFEGSPAHPNEISFSHGPSMWEDRGVGERNGLDLYRAALKLKAGDYWLRAGYIQPSGQTLLGTQWGFLPGTYQGVEVGAVYDYGAAGALSLSWMGANKYKAPWYRKMYEFREIDRQTRIPCLHSLGAKYDFKNGNTLELAWGESPHYLDKYFAKAARQTTLWDNPFSVSWQFYGSQDRTGRHDVYDEFAWQQGLTLAYQWDRYQFRLEGSAVHAPGKQGYYTVAMTPIYPNSAGRIDMWWDSRSDFNADGEKALFAGLMIDLSDIVWPGVSIGGSFAWGWDGKPARGGDWSQQQRLTETAINGDLVWQVQSGWAKDTVFKLHLTAYNNHSDNPSWGGGYGNVFQDEKDVKFMMIAPFSLFNHSRH

SEQ ID NO: 175293 - protein, 564 aa, Glycine max
  Coding DNA Sequence Number=SeqID_58515
  Gene Ontology: Mol. function=2-C-methyl-D-erythritol 4-phosphate cytidylyltransferase activity; Biological process=isoprenoid biosynthetic process
  Homolog annotation: Hit_ID=Q46893; Match level="QueryCoverage=36%, HitCoverage=88%, E-value=1e-79, Identity=71%"; Hit description=2-C -methyl-D-erythritol 4-phosphate cytidylyltransferase
  Pfam annotation: Domain name=IspD; Domain location=10-221; Score =335.2; E_value=1.1e-97; Accession=PF01128.9; Description =Uncharacterized protein family UPF0007
  Pfam annotation: Domain name=TruD; Domain location=336-564; Score =228.2; E_value=1.8e-65; Accession=PF01142.9; Description=tRNA pseudouridine synthase D (TruD)
  Pfam annotation: Domain name=YgbB; Domain location=202-343; Score =223.9; E_value=3.4e-64; Accession=PF02542.7; Description=YgbB family
  Pfam module annotation: Pfam domain module=IspD::TruD::YgbB; Domain location=10-221::336-564::202-343
MNQLSSSADVIAVVPAAGIGSRMQAACPKQYLTIGPLTLLEHSVARLLAHPAVKQVVVPVSPDDGWFDSLPLAQDARVLRVTGGETRAESVLAGLQTIRHSAWVLVHDAARPCLHPDDLARLLAVREHSKVGAILAAPVRDTMKRAEPGKGAIAHTVERDDLWHALTPQFFPHALLTACLTRALNEGATITDEASALEYCGYHPELVSGRSDNIKGFIAHSDGDVALHALTDALLGAVAMGDIGKLFPDTDPAFKGADSRGLLREAWRRIQQKGYRIGNVDVTIIAQAPKMLPHVPQMRVNIAEDLGCHMDDVNVKATTTEKLGFTGRGEGRSGMSELLYLHGVPAATGVIKASPEDFVVIEDLGYPYDGEGEQLLVRIRKIGCNTRFVAEAIAKFLGVHQRDLSYAGMKDRHAVTEQTLCFRVPGTAMPNLAGFQLEGVEILQVIRHKRKLRTGALAGNAFRLVVRQVSDRAQVESRLQQIQQQGVPNYFGEQRFGRGGNNLTQARLWVEEKFRPRDRSMKGILLSAARSQLFNQLTSARLQRDGALDRVQPGDALQLSGRGS

SEQ ID NO: 175294 - protein, 134 aa, Glycine max
  Coding DNA Sequence Number=SeqID_58516
MQPAHHILGTKAFDKSVKAAKGPESESFIPCQCCPFEGHWKDSTHDRIVIGVEISLGRLTSMMRSMKGCHRVVRPSWRYVMVVQGIVGLTVMQFTLGVLVDHVGEMFVASHEPPTHSGRPVEARYHDVLMMPKK

SEQ ID NO: 175295 - protein, 88 aa, Glycine max
  Coding DNA Sequence Number=SeqID_58517
MDEESLIKTLTVYEAIKGDRDDMFDVDPHDDTIDKDLKPIEEFVKLQHGPKPKPGQPTWAFQDVPPEGGCFWSKQPSSPGQAELAWAS

SEQ ID NO: 175296 - protein, 181 aa, Glycine max
  Coding DNA Sequence Number=SeqID_58518
  Gene Ontology: Mol. function=metal ion binding; Biological process =metal ion transport
  Homolog annotation: Hit_ID=Q9ZRE7; Match level="QueryCoverage=96%, HitCoverage=63%, E-value=8e-15, Identity=26%"; Hit description=ATFP3
  Pfam annotation: Domain name=HMA; Domain location=12-73; Score=12.9; E_value=0.068; Accession=PF00403.16; Description=Heavy-metal -associated domain
MCGFKPIIRIISVKVHMHCDKCEADLKSRLIKHKGIFNVKTDQKAQNVTVEGTIEVEKLISFFRKKVHKNAEITSIKEVKKDQEKKGKEELKSSETTKEKDHSKSGESTKKKDDDNNKKSGESTKEKGDGKSSETTKIIEVHQGHPKEEIKIKDNNVPYIIHYVYAPQLFSDENPNSCSIL

SEQ ID NO: 175297 - protein, 275 aa, Glycine max
  Coding DNA Sequence Number=SeqID_58519
  Homolog annotation: Hit_ID=Q47522; Match level="QueryCoverage=13%, HitCoverage=45%, E-value=7e-14, Identity=97%"; Hit description=LacZ protein
  Subcellular localization annotation: CTP_CleavageSite=42; ConfidenceScore=5.18e-01
GTSYVPINVSFSPKVGPGLPAVPPVQLLTGWCVTAKAPPDISAGKCSGRVPFAIQAAQLLGRAIGAGLFAITPAGERGMCCKAIKLGIRSLALNHVESLLPFPASICSSIGATYLLQLASSTTPSNAATNNTNTDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 175298 - protein, 1123 aa, Glycine max
  Coding DNA Sequence Number=SeqID_58520
  Gene Ontology: Mol. function=protein binding; Cellular component =outer membrane; Biological process=pathogenesis
  Homolog annotation: Hit_ID=UPI00005F9489; Match level="QueryCoverage =70%, HitCoverage=96%, E-value=1e-118, Identity=34%"; Hit description= COG3468: Type V secretory pathway, adhesin AidA
  Pfam annotation: Domain name=Autotransporter; Domain location=842 -1114; Score=136.3; E_value=8.2e-38; Accession=PF03797.9; Description= Autotransporter beta-domain
  Pfam annotation: Domain name=Pertactin; Domain location=652-772; Score=6.0; E_value=3.7e-06; Accession=PF03212.5; Description =Pertactin
  Pfam module annotation: Pfam domain module=Autotransporter::Pertactin; Domain location=842-1114::652-772
MNKSYRVIWNYALQCYVVTSELARGKVKSSCSGKAANKSALIGGALGSALLLAGSPAALAANGATISDPAQPVELNNQTLQATGDKAYGLLVQNGGKASATDVTVLNAGSSGYGVFSTAGAASAEMTRGSVTTTGAGGYGIVASLTGAVKTNGTKVETSGQNAYAAYASSGGIINSTDTDYVTHGDGAYGAYSRAAGSLIDLTGGSVTTSGNKAYGLVAGNGSKLNASGVQVTTSGDQSNGVVANNAGTEVTLMGGTVNTTGSKAVGLAANSGGKLNASDAQVSTSGAQSYGVAVSNVGTEVTLTDSTLTTTGDNAYGAYAANGAKLSISGTKLITSGKNADGVYTSGEGSLLNVNDSTIATSGSGSNGLKADGKSTLNATKTAIEITGSGSGTYASGTGTVLKLSDSRIQMGQNAGYAVLGINNSTTNLKNVEIITDASHSALAVGFGATLNSDNVNVQTRSGGYGIEVQDGSTFSGNNITLEKSGIDSTGLNAAINVLNLYRPDAQNDISLTSSDINVSGENATGILSQYQATLADIKLANTAITATGGTAVNVLTGTSMNIDADNSVLSGSTLLKTGYNTAEGSTAGSVVLNGSNNSLFEGNVDIDRSQTQDSQINLSGSSVWTGASSGLNTLTLSDNSQWNITGDSSVDALSASNSTLNFTHDGAGFSTLTVNGNYSGDNSTLVMNAALGDDHSASDKLHILGDSSGSTDVVVNNAGGSGAQTIQGLNIIQVDGANNGEFRQKGRIVAGAYDYSLVKGADQHGWYLVSDKNGSEPDPVVTPGEGEGGEVVEPPVSQHDMIVRPEAASYSANLAAANTLFTTSMDDRPAETFYTDASGRQQSTRLWLHNSAGHSRVKDSSGQLKSDTNRYAIQLGGDVAGGTLTGSDSLRLGAMAGYGNAQSKSRSAVSGYQSRGQVNGYSLGVYGSWQQNAAEQSGAFVDSSLSYGWFNNSVKGDDIGQQSYKSKGISASLAGGYRAEVATLSDSTSLWLRPQAQLNWQGVKADDVKEQNGSRVQATGQDNLQSRLGVRASLRTLLDPQAQSAIEPYAEANWLHNSKAFGTALNGVNIQQAGTRNAAEVKLGVDARLNANVNLWAGVAQQLGNHSYSDTSAVAGVKVSF

SEQ ID NO: 175299 - protein, 202 aa, Glycine max
  Coding DNA Sequence Number=SeqID_58521
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=99%, E-value=3e-25, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MRGTVHEPQANLGGEPLGTSTLTFRELHVLAIKGLQALSFKGLHALSFRGLHVLSFRGPHVLALRGLHALAFRGLHVLTIRGLHVLTFEGLHVLAYKGLHALTFRGLHVLAFRGLHALAFRGLHVLAFRGLHALTFRGLHVLALRTTHPHLQRATRLHLQRTTRPCLEDYTSSPSEDYTPLPSEGYTPLPSEEYMSSPSEDY

SEQ ID NO: 175300 - protein, 528 aa, Glycine max
  Coding DNA Sequence Number=SeqID_58522
  Gene Ontology: Mol. function=transcription factor activity; Cellular component=membrane; Biological process=regulation of transcription, DNA-dependent
  Homolog annotation: Hit_ID=Q3KAF4; Match level="QueryCoverage=53%, HitCoverage=96%, E-value=2e-84, Identity=55%"; Hit description =Transcriptional Regulator, LysR family
  Pfam annotation: Domain name=HTH_1; Domain location=76-135; Score =84.7; E_value=2.8e-22; Accession=PF00126.17; Description=Bacterial regulatory helix-turn-helix protein, lysR family
  Pfam annotation: Domain name=LysR_substrate; Domain location=159-364; Score=72.2; E_value=1.7e-18; Accession=PF03466.10; Description=LysR substrate binding domain
  Pfam module annotation: Pfam domain module=HTH_1::LysR_substrate; Domain location=76-135::159-364
  Subcellular localization annotation: CTP_CleavageSite=49; ConfidenceScore=5.13e-01
RAHQHAGRSASGADPGTAPVDSVGVPCLRSRDAATCGSAHRALFYRCLTADAGARRSALHYSRSRIVAVMPVNFDLNDLYAFRALVEYGNFRLAAESICLSQSALSRRIEKLEAALGARLFDRTTRRVTLTLYGQNFAQRSEQLLDNVESMLADVERASQDRTGLITVATVPSGAYYFMPEVIRRFQARYPRVRIKLIDSSVGNVMDAVSSGQADFGICFARNLPPELTFTPLVEDVYVAACRHDHPLATRQQLSWQEYFAQDYVALDKCAGASYARPAKYLRNAPCHDAAGDGRSGHRHCCRARDVDAGERASATAPAGADRSAGHPFGGINSPQRTYAILRRCGAGKADYRTVSARLTRGLQRQRAAAIKRGRDHRREAAKQRGCQAVGQRETGDAHFCRHHFSQRRDHRTVIQAVNKRQPQQHAQHHAEGRRLRQQRQCRIGGRQRQQRHRQQHRFTPKAVRQRPANWQPDKVGDRHQQRHQQAVRGAQHQHFFAEGGRIDGNEVERGGGHRHHQHPGNHHRPVL

SEQ ID NO: 175301 - protein, 202 aa, Glycine max
  Coding DNA Sequence Number=SeqID_58523
  Gene Ontology: Mol. function=tricarboxylate carrier activity; Cellular component=integral to membrane; Biological process=transport
  Homolog annotation: Hit_ID=P16482; Match level="QueryCoverage=70%, HitCoverage=40%, E-value=2e-58, Identity=69%"; Hit description =Citrate-proton symporter
GFSAGAELGGVSVYLAEIATPGRKGFYTSWQSGSQQVAIMVAAAMGFALNAALEQSAISAWGWRIPFLFGCLINWPVVIAGMLMVAMTTTAFYLITVYAPTFGKKVLMLSASDSLLVTLLVAISNFIWLPVGGALSDRFGRKPVLLAMTLLALATAYPALTLLAQTPTFSMMLSKCASPVSRWPTAWQPRCLAASRRWSLPR

SEQ ID NO: 175302 - protein, 232 aa, Glycine max
  Coding DNA Sequence Number=SeqID_58524
  Gene Ontology: Mol. function=methyltransferase activity; Cellular component=nucleus; Biological process=fatty acid biosynthetic process
  Homolog annotation: Hit_ID=Q56ZV4; Match level="QueryCoverage=96%, HitCoverage=60%, E-value=8e-93, Identity=73%"; Hit description=S -adenosyl-L-methionine:salicylic acid carboxyl methyltransferase-like protein
  Pfam annotation: Domain name=Methyltransf_7; Domain location=1-231; Score=155.9; E_value=1e-43; Accession=PF03492.6; Description=SAM dependent carboxyl methyltransferase
MTFKVSFTPQLHPAKNMRSFYAVPESVLDKRSSAYNKGRVFIHGASEITANAYKNQFQTDLASFLRSRAVELKRGGSMFLVCLGRTSVDPTDQGGAGLLFGTHFQDAWDDLVQEGLISSEKRDSFNIPVYAPSLQDFKEVVEADGSFAINKLEVFKGGSPLVVNQPDDDSEVGRALANSCRSVSGVLVDAHIGDKLSEELFLRVERRATSHGKELLEQLQFFHIVASLSFAL

SEQ ID NO: 175303 - protein, 66 aa, Glycine max
  Coding DNA Sequence Number=SeqID_58525
MGISGCHLVGSRRVVGGKDNEEGDVVICVDWEMGWGNLVDALGDLEGPAKPFGQLLEEWACTKRWR

SEQ ID NO: 175304 - protein, 189 aa, Glycine max
  Coding DNA Sequence Number=SeqID_58526
  Homolog annotation: Hit_ID=Q9FLP2; Match level="QueryCoverage=87%, HitCoverage=94%, E-value=2e-12, Identity=32%"; Hit description =Arabidopsis thaliana genomic DNA, chromosome 5, P1 clone:MCO15
  Subcellular localization annotation: CTP_CleavageSite=72; ConfidenceScore=5.61e-01
MEAVGSRLSRASSRYGAPTVFSGPVRKWKKKWVHVTPSSLPNNSSHSHTNNSTTTSSASSRLLLRRWTPATVDDAAGAVSDEPPRRKFRYTPKQLKFGKELPHTSLVVVLEEQKKMNVVKAEHEPTIETDQLAARKTNVTHEMQGKLNMNEMLEETKDSNIGNLDLGSDFQSNTGGNSQNSDSQLENSM

SEQ ID NO: 175305 - protein, 315 aa, Glycine max
  Coding DNA Sequence Number=SeqID_58527
  Gene Ontology: Mol. function=adenyl-nucleotide exchange factor activity; Cellular component=mitochondrion; Biological process =protein folding
  Homolog annotation: Hit_ID=Q8LB47; Match level="QueryCoverage=98%, HitCoverage=97%, E-value=2e-70, Identity=46%"; Hit description=GrpE like protein
  Pfam annotation: Domain name=GrpE; Domain location=73-306; Score =193.0; E_value=7e-55; Accession=PF01025.9; Description=GrpE
  Subcellular localization annotation: CTP_CleavageSite=83; ConfidenceScore=5.88e-01
MFAYRVLSRSSAILSRSFTLFSVSRNSQPFSTTLSNNFHSLLHPSPNKLIPVQTNFLNSSLTSRFGFSSTASHEHASEEAKVSDQSEQAEAADQTKESDVESECDLSRDDLIKLVAEKEQLLKLKHKEIEKMQDKVLRTYAEMENVMDRTRREAENSKKFAIQNFAKSLLDVADNLGRASSVVKDNFSKIESPEESSEAAQLLKTLLEGVEMTEKQLAEVTVVFEKEGWGVDLPRIGDEFWLLLVLKKFGVEKFDPTNEPFDPHMHNAIFQIPDASKAPGTVGVVLKAGYKLYDRVLRPAEVGVTQEVEDNKAAE

SEQ ID NO: 175306 - protein, 56 aa, Glycine max
  Coding DNA Sequence Number=SeqID_58528
MGENFILAKDKDGKGIWGEVEDRESHTRPRLVIILSHGAKPVSLAHASHHQEVKHN

SEQ ID NO: 175307 - protein, 114 aa, Glycine max
  Coding DNA Sequence Number=SeqID_58529
MTNSSVENAMPSTIVFDMLASKGLKVNFSKSKFGVIGVERDVVERMVETWRPIVEKFSKKLAKDLKKVCGGGAQSDWCDWSMVLELGKGDAARRLAASLPQDPAAHLWQQTRME

SEQ ID NO: 175308 - protein, 100 aa, Glycine max
  Coding DNA Sequence Number=SeqID_58530
  Gene Ontology: Cellular component=nucleus
  Homolog annotation: Hit_ID=Q1PCH7; Match level="QueryCoverage=99%, HitCoverage=100%, E-value=2e-44, Identity=85%"; Hit description=SWIb domain-containing protein
  Pfam annotation: Domain name=SWIB; Domain location=20-96; Score=93.3; E_value=7.1e-25; Accession=PF02201.9; Description=SWIBMDM2 domain
MLPQRMKKAITDNPKKLANLIDLVNLPSTLREFVGQSQISRLGCFKCVWFYIKTNNLQDQNNKNVVNCDEKLKSILLGKPQVELAELPALIKMHFPKEPK

SEQ ID NO: 175309 - protein, 114 aa, Glycine max
  Coding DNA Sequence Number=SeqID_58531
  Gene Ontology: Mol. function=calcium ion binding; Cellular component =endomembrane system; Biological process=endosome transport
  Homolog annotation: Hit_ID=Q9LTR4; Match level="QueryCoverage=94%, HitCoverage=20%, E-value=8e-47, Identity=79%"; Hit description =Similarity to EH domain containing proteins
MNLNKINEFVKRARAAKIHAYIISHLKKQMPAMIGKAKAQQKLIDNLDTEFVKIQKEFHLPPGDFPNVEHFKETLSGYNIDKFEKLNKKMIQTVDDMLAYDVPNLLKTFRNPYG

SEQ ID NO: 175310 - protein, 167 aa, Glycine max
  Coding DNA Sequence Number=SeqID_58532
  Gene Ontology: Mol. function=calcium ion binding; Cellular component =endocytic vesicle; Biological process=endosome transport
  Homolog annotation: Hit_ID=Q653F5; Match level="QueryCoverage=98%, HitCoverage=30%, E-value=6e-56, Identity=64%"; Hit description =Putative receptor-mediated endocytosis 1 isoform I
MVWAIADSKREGYLGFKEFVIAMQLVSLGQCGYSITHDLLTSDAMRHAKPPIMDGLDVLLTKKKRKQKDKELSVSPPHPSPTSKWFTAKSAKKVPASSVTSIVDGLKRLYLQKLKPLEVTYHYNDFVSPLLTNSDFDAKPMVLLLGQYSTGKTTFIKHMLKSSYPGK

SEQ ID NO: 175311 - protein, 87 aa, Glycine max
  Coding DNA Sequence Number=SeqID_58533
MKTSPFELGSDTLPSPNTVNLWMQQNLQPPKGSNKHIIFGVALRYFFTKELGYSKVWIETGSKVMVDLLLKLIRANHHMGSQIQMAR

SEQ ID NO: 175312 - protein, 76 aa, Glycine max
  Coding DNA Sequence Number=SeqID_58534
MNEANSDLNALDEDILVELRQDASGGVSSAPMNDLEVPPIVDDDEGGGYAINKEEDEDHMEDGYLDLTLNDLLDLP

SEQ ID NO: 175313 - protein, 66 aa, Glycine max
  Coding DNA Sequence Number=SeqID_58535
MIVPEEREVSKGQEESSSQREKERIEKEPEKKKKRQKVREPKAVAGTASTVARDELDGECKMRSNE

SEQ ID NO: 175314 - protein, 464 aa, Glycine max
  Coding DNA Sequence Number=SeqID_58536
  Gene Ontology: Mol. function=extracellular ligand-gated ion channel activity; Cellular component=membrane; Biological process=transport
MAPKEANLANELDPSLNFIACDIMVCTHKESQLTRINVLYPNGGTVLVHLILTLHLPCAPPAASIASEAIYFRSSKLPTRHNHSHSQLPMKDTTTTATASTALLDRRGKYNRSVSNLNDEFHTFRSYIRWMCVDQSNPFTAALSWSLFLLLAVAVPAASHFLLACPDCDARHSRPYDAVVQLSLTSVSALSFLCLAVFVRKYGLRRFLFFDKLCDESETVRTNYMAQHNVTEDPFGVCGAMFRGRVCIQDMVVHIRSPTDPLLRKRVRERCGGVHTRTVVVAVPNHGDLPGVRSVPSDLPPPDPAALRLRKDQEAPANHKPQVPRVHPTRACIGHRKPVRVPPVTLLSALCILLRSATKITHKAQAITGLAAKWHVCATLDFDGVLTEGGTPTAPQSSHETMFPNVGTDGESETDEAGDEEDEIDTTKLIPSYAYSTISYQKRQALGNLISHTLLYFLNYMSKL

SEQ ID NO: 175315 - protein, 73 aa, Glycine max
  Coding DNA Sequence Number=SeqID_58537
RTRGLGRAIGRLIGRDRQDDHDAVDVPERRRPAASAGRQRVHQMTADAPDMVEDVPDMTEDVPDMAEDAPEIW

SEQ ID NO: 175316 - protein, 276 aa, Glycine max
  Coding DNA Sequence Number=SeqID_58538
  Gene Ontology: Mol. function=isocitrate lyase activity; Cellular component=glyoxysome; Biological process=carboxylic acid metabolic process
  Homolog annotation: Hit_ID=Q2IDV8; Match level="QueryCoverage=98%, HitCoverage=25%, E-value=7e-68, Identity=50%"; Hit description =Malate synthase A / isocitrate lyase
MVQLVGAQQRVVDALDHRRHRIGGVQRLVRVHLAGQVGVGRHLPTGQVDGLQASLDLLHGLVTGQRTQRVDELALMQRRPQLLRTQAGQRMLDVDGAAQAHHVGGAVVALDAFPARVGIPVVLDLFGSGQLAHVFLQFGRQGQEIGQFVAAAQFAEQGDGFADACTTRQRGGIAQPCRQLRESGIQQRQIDRGAVVQLLARRMQPLPQLAAADLGGGRVLHQVVDRHATVAIQPRRQVAHADFHVAFEAGTGDGARRARDQFIAAHAHILAQHAVL

SEQ ID NO: 175317 - protein, 65 aa, Glycine max
  Coding DNA Sequence Number=SeqID_58539
  Gene Ontology: Mol. function=NADH dehydrogenase (ubiquinone) activity; Cellular component=integral to membrane; Biological process=ATP synthesis coupled electron transport
  Homolog annotation: Hit_ID=A0A380; Match level="QueryCoverage=59%, HitCoverage=7%, E-value=7e-15, Identity=94%"; Hit description=NADH -plastoquinone oxidoreductase subunit 2
MYNSPGILIALLFITVGIGFKLSPAPSHQWTPDVYEGVRCYIVGSHPSETTSIIGASVNKRITLR

SEQ ID NO: 175318 - protein, 149 aa, Glycine max
  Coding DNA Sequence Number=SeqID_58540
  Subcellular localization annotation: CTP_CleavageSite=20; ConfidenceScore=5.01e-01
MLNGMPWNSPMISTCHIRVKSSGKWRLGIFVGLMSTIVLLSTYGNFVVDLGVAFVVDWVILGGRVMGNGFSLLLVEAKLHDESRLIQRCFDDNKGDDKKLKGQSKNEFKMFKIESRTLQGSRGHLISRIKIPGSSFQESRSRFKNQEKT

SEQ ID NO: 175319 - protein, 150 aa, Glycine max
  Coding DNA Sequence Number=SeqID_58541
  Homolog annotation: Hit_ID=Q6CQE5; Match level="QueryCoverage=30%, HitCoverage=42%, E-value=1e-09, Identity=67%"; Hit description =Protein TAR1
MLLRGVYADLPRAPASWLVEIWVHGRLRRDKMVDEPRSRPITCEPVSSGPIDDPFACTHAPNETSEVRAPSCPDPVAPRGAVGESGCLGMQPQSGGKFRPRLNTGERPIANNGWGPAMCPGRMWNGESRSADRLGTLTDADCDGGPSPGC

SEQ ID NO: 175320 - protein, 261 aa, Glycine max
  Coding DNA Sequence Number=SeqID_58542
  Homolog annotation: Hit_ID=Q8TGM6; Match level="QueryCoverage=46%, HitCoverage=97%, E-value=1e-09, Identity=43%"; Hit description =Protein TAR1
  Subcellular localization annotation: CTP_CleavageSite=51; ConfidenceScore=5.50e-01
MSRVDRRTGSHRSTSDRDTSPAPIRFPPDNFKHSLTLFSKSFSSFPRGTCSLSVSRQYLALDGIYRPIGAAFPNNPTRRQRLVVRQGPGTTGLSPSLAPPSRGLGPGPPLRTLLQTTIRTPRATDFHGGLFPVRSPLLREILVSFFFLRLLDMLKLSGEPRPDSEVSLGACVHAKGSSMGPELTGSHVIGRRALGLMASGATCVQRLDGSRDSAIHTKYRISLRSSSMQEPRYPLPRVIVCKCCVVTTPAGHRLRAPGSRT

SEQ ID NO: 175321 - protein, 106 aa, Glycine max
  Coding DNA Sequence Number=SeqID_58543
LGRIDGDPVLRETRIWATWEYVSSVGGGQQGMSGTWRYVAGVRRPWGRQASSWQSTDKRKTRPQSKEACGGWPAEAKMVSGIWEMIEASGNRLPACVIDYPEEWVT

SEQ ID NO: 175322 - protein, 145 aa, Glycine max
  Coding DNA Sequence Number=SeqID_58544
  Gene Ontology: Mol. function=phosphoprotein phosphatase activity; Cellular component=cAMP-dependent protein kinase complex; Biological process=protein amino acid phosphorylation
  Homolog annotation: Hit_ID=Q3BZ16; Match level="QueryCoverage=92%, HitCoverage=38%, E-value=5e-41, Identity=60%"; Hit description =Putative cyclic nucleotide-binding protein
MVAPAQLADQGLLVGQHAHDRAAQEVGDQAGIGFHQAMEIGRAQLQYFAVGQRACTGAAQVITDQQAKLTEELMLAERLDHQVLAEVQFDLALEDHIHPFAAMATLEQPLSGMKLAWTGKSGEQCHLGSGQQRVHDLGHRHPGDT

SEQ ID NO: 175323 - protein, 208 aa, Glycine max
  Coding DNA Sequence Number=SeqID_58545
  Homolog annotation: Hit_ID=Q3BZ16; Match level="QueryCoverage=72%, HitCoverage=44%, E-value=6e-32, Identity=54%"; Hit description =Putative cyclic nucleotide-binding protein
  Pfam annotation: Domain name=cNMP_binding; Domain location=99-200; Score=23.6; E_value=0.00068; Accession=PF00027.19; Description =Cyclic nucleotide-binding domain
ARPAGSVNQAHPVCRQLGRNPVKPGIGLIQQEFCPDTRDQNGPPSIFTSIKIGRRGMTGRGAAENSDVTSGIARVAMAEIVHALLSAAEVALFARFARPCKLHAGQWLFQRGHRGERMYVILQGQIELDFGEDLVIKTLGQHEFFGELGLLRQCTRAGRLRSTGAGPGRFPSPGGIRSRPGRLLPAPHDHARADQRAGPDQPAAPAQP

SEQ ID NO: 175324 - protein, 80 aa, Glycine max
  Coding DNA Sequence Number=SeqID_58546
MGGANSNFEILNWAFQSIFRSWIASGGSKPDRLGELGGNLLPLFLINRLKGTIPRIPQPPGYVFQLFLVEKIVSVKKIQA

SEQ ID NO: 175325 - protein, 69 aa, Glycine max
  Coding DNA Sequence Number=SeqID_58547
  Subcellular localization annotation: CTP_CleavageSite=9; ConfidenceScore=5.02e-01
SSRAQRTIWAQRASDAKRNFSALSVTREFGRAQESRPLAKHKISSLSEMFISCQAQRVAGAKPIYIYSR

SEQ ID NO: 175326 - protein, 98 aa, Glycine max
  Coding DNA Sequence Number=SeqID_58548
MFQQKAVPSGGSNPARLGELGGNHLPLFPINRGKRAEQIRSTLLVSEIHLKLGRKIVSVKKIQAGALPRRFRGRFREGFPPFFIFLRSFFVVLRSSTE

SEQ ID NO: 175327 - protein, 255 aa, Glycine max
  Coding DNA Sequence Number=SeqID_58549
  Pfam annotation: Domain name=Transposase_23; Domain location=62-126; Score=-6.2; E_value=0.0055; Accession=PF03017.5; Description =TNP1ENSPM transposase
MTNALKEAIKKELSNKGSPESLQIQLDIQQLGARVSTKGSNVVINVQPSQEHHADAIPLMGLYVQRKDGTLRLVAMGKIMEGDSIIHTVAYADDVVRVSVETIIDPEAEVPYATSEIQYVKQAVNTFVAWPTHLVKAVLDEDPESIPHNEDAHAPKPANVDADDPLRGLIKYSFDIYDKPVEINFDGSCFGIVDAPCHTLISSGDLCSMTCDHSLVLKAVASGGSNPARLGELSSPGRAELAWASWAATTSPILL

SEQ ID NO: 175328 - protein, 93 aa, Glycine max
  Coding DNA Sequence Number=SeqID_58550
MQTIHAPPVDSRVSYDDIHDRWMHYDDHIVLASEPRVIPQAPQTNIHRVPEPGASSTSAEEPRHAVEVCDDIAERLERHLSLGVSRLAHRHMR

SEQ ID NO: 175329 - protein, 259 aa, Glycine max
  Coding DNA Sequence Number=SeqID_58551
MEFFSNENFECFQAFENFNLIPFMSLKLPVYSELVKAFYSNLEIHEGTLISEVYGIKMVIDQSLFYDLTKLPSEGVPFEGALIDEWKFDFSVHDARRLVCTNQVDMTERLLAGSLAFESRILHYLIVRILLPRSSNLAQALRLNAPLPYPHLVTLFLQHFNILLDFEPYVPIKRSFLIGTRVIASFGYIKEHDGSWIKKGARNDGEEGHEGEDSSLLSKILEKFDGLKTFVGERFDTLEMQVDMRFNEMESRMTKVEEE

SEQ ID NO: 175330 - protein, 430 aa, Glycine max
  Coding DNA Sequence Number=SeqID_58552
  Gene Ontology: Mol. function=phosphoenolpyruvate carboxylase activity; Biological process=tricarboxylic acid cycle
  Homolog annotation: Hit_ID=UPI00006B1A88; Match level="QueryCoverage =99%, HitCoverage=51%, E-value=1e-115, Identity=47%"; Hit description= phosphoenolpyruvate carboxylase
IEDAAFPNLHSESDNGTVTNLFERSQQDHKLEKVREKLRDFTVKVVFTAHPTQFYPSSVQRIIQDLRSAITTDSVTNIDMLLQQLGKTPFVNKEKPTPIDEALSIISYLRYVYYDTIGELFTKIRKTFGNGHFHLHEDIIQLGFWPGGDRDGNPFVTADVTKRVAEELRSAILKSYYSHLKFIRRRLSFRGVSEVLQQLNDELYAAIFNNHKITTEDILKRADEAEHILIREHNSLFLDLLVNFKDRVKIFGTHFATLDIRQDSRIHQQVIDEVFAKLYGDQEADHNEKFNRLIQDSKTVKADDFEGIVKDTLLTVSEVAEIQQLNGMRGMNRYIISNSDAVKDVMNVYAFFKICGYQEENINMDIVPLFETMEGLDNAEKVMKELYENPVYKKHLEKRGNQQTIMLGFSDGTKDGGYLKANWEIYKAKE

SEQ ID NO: 175331 - protein, 88 aa, Glycine max
  Coding DNA Sequence Number=SeqID_58553
  Subcellular localization annotation: CTP_CleavageSite=48; ConfidenceScore=5.22e-01
MPISPCKSISWSVSSRHGDRTHKTPSGPEEVQQGPGVSSSGYGPLSVLQGARTPPSPARSRHHRDRARKTPSGPDEGQQGLGVASSKY

SEQ ID NO: 175332 - protein, 74 aa, Glycine max
  Coding DNA Sequence Number=SeqID_58554
MGVQIAPRPTWALQNIPPKGCCFRRKQPGSPGRAGEEVKKKGFSPLALLSLSNLLGKIVSVKENLSRGASDTFP

SEQ ID NO: 175333 - protein, 44 aa, Glycine max
  Coding DNA Sequence Number=SeqID_58555
MDDQTKSIQTLSIEGSIEHSKHNQLDIRLRIRDIVLCGDLVLSA

SEQ ID NO: 175334 - protein, 146 aa, Glycine max
  Coding DNA Sequence Number=SeqID_58556
QSKHSFPPYGLPPNYTPPNVEQTPDENVDNSAPKPIEIQHPETTIYVPLPNTLGGPQYRPQPQPLHFAVGKVPPTMVERERFDHIEERLRAIEGGGDYAFADMAELCLVPDVIIPLKFKVPDFDKYKGTTCPKNHLKMYNRKMGAY

SEQ ID NO: 175335 - protein, 115 aa, Glycine max
  Coding DNA Sequence Number=SeqID_58557
MAKYDPEIVMEFYANAWHIEEGVRDKRSWVWGQWVPFDEDTINQFLGKDPQGMYPPLFSLNLVDVPSTRTDPQEMYPLLFSVNNPSRCTLYLYHKGCALQCVKTKISGGETFDTL

SEQ ID NO: 175336 - protein, 82 aa, Glycine max
  Coding DNA Sequence Number=SeqID_58558
  Subcellular localization annotation: CTP_CleavageSite=69; ConfidenceScore=5.50e-01
IAPARHPVDPKKSNRVLELSSSNHGSLSVLRRRNTTAAWGWSVAGNRHTATTSRVNLSSSAKRLERCLRHMADQQATKSKAK

SEQ ID NO: 175337 - protein, 180 aa, Glycine max
  Coding DNA Sequence Number=SeqID_58559
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=1e-23, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
ATHPHLRGLHVLAFRGLHGLTFRGLHALSVKGLHVFDFRGLHTLAFRGVHALTFRGLHVLTFRGLHVLTFRGQHALTLHALAFTGLDALTFRGLNVLAFRGLRALAFVGLHALPFRGLHFLTFTGLHALTFRGLHALAFRGLHVLPFRGVHFLTFRGLHVLAFRWLHTITFRGLQVFAFR

SEQ ID NO: 175338 - protein, 104 aa, Glycine max
  Coding DNA Sequence Number=SeqID_58560
MTRGNPPDLHPFDPKIDRTFHRLVRHHLVPFEHPEHSVIGDFEHYSFEHSENMAQPPPCERTLREMAAPDFTYESLYIQHPIEDVPYVLKTRLIHLLPKFHGFA

SEQ ID NO: 175339 - protein, 125 aa, Glycine max
  Coding DNA Sequence Number=SeqID_58561
MGEVEEVQMKAEMEAMKEQMATMMEAMMSMKKIMEAIAVAIAATIVVAQVNPMPPSGLNQMNHPTSDMVGKDSGSTGGPCYAQILNKHAFPAYGLPPKYTPPNMAYNNSAAILIESRQAHHVHVS

SEQ ID NO: 175340 - protein, 90 aa, Glycine max
  Coding DNA Sequence Number=SeqID_58562
  Gene Ontology: Mol. function=protein kinase activity; Biological process=protein amino acid phosphorylation
  Homolog annotation: Hit_ID=Q9LTU4; Match level="QueryCoverage=90%, HitCoverage=5%, E-value=2e-19, Identity=53%"; Hit description =Helicase-like protein
  Pfam annotation: Domain name=DUF889; Domain location=1-90; Score= -64.5; E_value=4e-07; Accession=PF05970.5; Description=Eukaryotic protein of unknown function (DUF889)
MEYLSSDSLDKSETSENSYFQSITTEFLNSLKTSGLPTHSIKLKIGSPIMLLRNLDQNQGLCNGTRLVVTKMAEHVIAAEIISGSTQQKD

SEQ ID NO: 175341 - protein, 83 aa, Glycine max
  Coding DNA Sequence Number=SeqID_58563
MRLFFLSQLCQLYMRLLKQVADPLTPVHERQADPPTPIMEMPEDLTTPVLRLSSTPPATPVLHLTDEEGMQDTQGTQDQSQEF

SEQ ID NO: 175342 - protein, 71 aa, Glycine max
  Coding DNA Sequence Number=SeqID_58564
  Gene Ontology: Mol. function=nucleoside-triphosphatase activity; Cellular component=membrane; Biological process=peptide transport
  Homolog annotation: Hit_ID=Q1H0V1; Match level="QueryCoverage=94%, HitCoverage=31%, E-value=1e-18, Identity=58%"; Hit description=ABC transporter related
MQHLRGRQMGMIFQEPMTSLNPARPSNKKVAALLEQVGIDPARANSYPDELSGGQRQRVMIAMSIACELRC

SEQ ID NO: 175343 - protein, 197 aa, Glycine max
  Coding DNA Sequence Number=SeqID_58565
  Gene Ontology: Mol. function=nucleoside-triphosphatase activity; Cellular component=membrane; Biological process=peptide transport
  Homolog annotation: Hit_ID=Q11FN8; Match level="QueryCoverage=99%, HitCoverage=86%, E-value=2e-50, Identity=44%"; Hit description=ABC transporter related
  Pfam annotation: Domain name=ABC_tran; Domain location=75-197; Score =13.3; E_value=1.1e-08; Accession=PF00005.17; Description=ABC transporter
  Pfam annotation: Domain name=oligo_HPY; Domain location=29-89; Score =19.4; E_value=6.3e-06; Accession=PF08352.2; Description =Oligopeptidedipeptide transporter, C-
  Pfam module annotation: Pfam domain module=ABC_tran::oligo_HPY; Domain location=75-197::29-89
MAMLFITHDFGVVADIADEVIVMFRGEIVETGNVEQVLQSPQHPYTRALLDCVPDAEGKKTIHALDNVSLTLKQGTTLAVVGESGSGKSTLARGVMRLLPLDSGEVIFDGDDFLALDKAALRTARRHIQMVFQDPFASLNPRMRVGEVIAEGLVIHEIGNKSQQLDMVVQMLEKVGLQAEDVHKYPHQFSGGQRQRI

SEQ ID NO: 175344 - protein, 86 aa, Glycine max
  Coding DNA Sequence Number=SeqID_58566
SLARLRRNDAVGLDEREGDGHEGHEGKERHGVQPRLRGVESRDGGDKVREGKVVRLGWSEGRREWRGGGGAAMHWSMRCYRATELA

SEQ ID NO: 175345 - protein, 86 aa, Glycine max
  Coding DNA Sequence Number=SeqID_58567
MTHGGPINLKYRVQFSALNFQFFNIPITMIQNKLKRLLKRLALTNPLKLLQEHNKGLDQTYLREVAKEKKHKLLTMLECDEHDARP

SEQ ID NO: 175346 - protein, 72 aa, Glycine max
  Coding DNA Sequence Number=SeqID_58568
  Subcellular localization annotation: CTP_CleavageSite=37; ConfidenceScore=5.18e-01
MILHEIRRPNSLTIVPSGVANCRNLPFGGRATRGLTGASSKGGRSMLTDKSKGDRLRLWTLKRFLVIFADKA

SEQ ID NO: 175347 - protein, 313 aa, Glycine max
  Coding DNA Sequence Number=SeqID_58569
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=99%, HitCoverage=50%, E-value=1e-163, Identity=76%"; Hit description =Photosystem I P700 chlorophyll a apoprotein A1
  Pfam annotation: Domain name=PsaA_PsaB; Domain location=32-313; Score= 50.4; E_value=6.1e-12; Accession=PF00223.9; Description=Photosystem I psaApsaB protein
MIIRSPEPEVKILVDRDPIKTSFEEWAKPGHFSRTIAKGPDTTTWIWNLHADAHDFDSHTNDLEEISRKVFSAHFGQLSIIFLWLSGMYFHGARFSNYEAWLSDPTHIRPSAQIWRASGITSELQLYCTAIGALVFAALMLFAGHQIHVSLPINQFLNAAVDPKEIPLPHEFILNRDLLAQLYPSFAEGATPFFTLNWSKYAEFLTFRGGLDPVTGGLWLTDIIHHHLAIAILLLIAGHMYRTNWGIGHSIKDILEAHKGPFTGQGHKGLYEILTTSWHAQLSINLAMLGSLTIVVAHHMYSMPPYPYLATDY

SEQ ID NO: 175348 - protein, 83 aa, Glycine max
  Coding DNA Sequence Number=SeqID_58570
MGKRKLELGFEDQKIDFDLFVEDKPTPEHNVFLQVMEGGQEVLKVRTKIPFIKRKPRAKRFFGHALSQESLALSAQPLHLRLI

SEQ ID NO: 175349 - protein, 72 aa, Glycine max
  Coding DNA Sequence Number=SeqID_58571
GLVGACLLNANLDHLARISEFWLNVCLLAQWMDSSGAHSRMSPRSGNMHNSSFFQILPRAHPREWCAQRMAR

SEQ ID NO: 175350 - protein, 43 aa, Glycine max
  Coding DNA Sequence Number=SeqID_58572
MTFLVKPEMLSALSCSDACVKSTSKDKKESSSDATRNPRGSTR

SEQ ID NO: 175351 - protein, 56 aa, Glycine max
  Coding DNA Sequence Number=SeqID_58573
MQQGQPDILIARFPDPNYGVKTDNVYKVSVSKVFQRKHKTCNGGSKVRKDAKTRCN

SEQ ID NO: 175352 - protein, 110 aa, Glycine max
  Coding DNA Sequence Number=SeqID_58574
  Homolog annotation: Hit_ID=Q1SDG1; Match level="QueryCoverage=46%, HitCoverage=4%, E-value=2e-08, Identity=54%"; Hit description =Integrase, catalytic region; Zinc finger, CCHC-type
MVAGNTTVEKPREQWSEEERKLVQYNLKAKNIITSTLGIDEYFRVFNCKNAKDMWDTLQEYEMELMKLNQHEENDKKKKGIALKASSSTQEGSDKEDSIEIDEDDDLSLF

SEQ ID NO: 175353 - protein, 278 aa, Glycine max
  Coding DNA Sequence Number=SeqID_58575
  Gene Ontology: Mol. function=DNA binding
  Homolog annotation: Hit_ID=Q1S0F5; Match level="QueryCoverage=84%, HitCoverage=46%, E-value=2e-22, Identity=30%"; Hit description=IMP dehydrogenase/GMP reductase
MGSNQTPLFKKRFYHVKIKSLEVASLQEFGQLMNQLQRQAFRKTYGNIWDLAMIEVSVEAIASLTQYYDQSLRCFTFVDFQLVPAVEEFEEILGCLLGGRKPYLFSGFYPSMARIAKVIKISVQELDRVKQNRNGVIGIPRKHLEEKAKALVDQGEWASFIDVLVLLVFGVVLFPNVDGLVDLAAIDAFLAYHHNKESPVVVVLADAYDTFDRRCERSGVRIICCTPALYVWLVLHLFRHESRPVCPLQGHRIYAEKGKANWEQLLASMVGASINWFP

SEQ ID NO: 175354 - protein, 52 aa, Glycine max
  Coding DNA Sequence Number=SeqID_58576
  Homolog annotation: Hit_ID=O64438; Match level="QueryCoverage=57%, HitCoverage=13%, E-value=2e-09, Identity=90%"; Hit description=ARG10
VGGLRCYESPKNKITAVPTEEEEIWGAFFKVIVELKKLELNIHYVTRIARCN

SEQ ID NO: 175355 - protein, 278 aa, Glycine max
  Coding DNA Sequence Number=SeqID_58577
  Gene Ontology: Mol. function=nucleoside-triphosphatase activity; Cellular component=chloroplast
  Homolog annotation: Hit_ID=Q2PMM5; Match level="QueryCoverage=100%, HitCoverage=19%, E-value=5e-72, Identity=83%"; Hit description =Protein ycf2
MIEFQKLLDRYPTSELNSFWLKNLFLVALEQLGDSLEEIRSFAFGGNMLWGGGPTYGVKSIRSKKKYLNLIDLISIIPNPINRIAFSRNTRHLSHPIFLNKFLDNKPKGFLIDDSDDIDDSYDSDDIDRDLDMELELLTMMNTLTMDMMPEIDRFYITFQFELAKAMSPCIIWIPNIHDLDVNESNYLSLGLLVNYLSRDCERCSTRNILVIASTHIPQKVDPALIAPNKLNTCIKIRRLLISQQRKHFFTLSYTRGFHLEKKMSHTNGFGSTTMGSH

SEQ ID NO: 175356 - protein, 48 aa, Glycine max
  Coding DNA Sequence Number=SeqID_58578
MSRNFTDCLTMSVKDLEVIKRGSHPNKQMMSDFSHKLMIKFLWGCNCV

SEQ ID NO: 175357 - protein, 105 aa, Glycine max
  Coding DNA Sequence Number=SeqID_58579
  Homolog annotation: Hit_ID=Q6CYX0; Match level="QueryCoverage=84%, HitCoverage=22%, E-value=2e-25, Identity=65%"; Hit description =Putative exported protein
MTIKLALTLLAVLVSGHATAKTWVLTSAESGVEKGNWKISSDELKINDRTFSIEQKVLHGGKQEGSKVIIISSKNGLTITLSPTRGMTLLHVEGFWYPTGVEFSR

SEQ ID NO: 175358 - protein, 119 aa, Glycine max
  Coding DNA Sequence Number=SeqID_58580
DQLPSQSDACLALSNSPVSQASQADHLVQGFQSEYFQQNVCLDRASNHLDPMIHLQVILCESARQGEKDMPDSQEKDSQCSQNALLSVMPELMFRRVPVGSLMPMQGESTAKGKFNHWE

SEQ ID NO: 175359 - protein, 151 aa, Glycine max
  Coding DNA Sequence Number=SeqID_58581
MGETYEVPHHNLADFEPCLGYAIQGQAVGGVALPNTLEGPQFRPQPQPLHFAEGRVPPAMVERGKFYHREERLRAIEGGGDYAFADMAELCLVPDIVIPLKFKVLDFDKYKGTTCPKNHLKVYYRKMGAYSKDEKLLMHFFQESLIRAAIT

SEQ ID NO: 175360 - protein, 75 aa, Glycine max
  Coding DNA Sequence Number=SeqID_58582
  Subcellular localization annotation: CTP_CleavageSite=59; ConfidenceScore=5.16e-01
MTLVSACYHALSLRDSKRKFKSAGPNGSRMSSGPPPLDDKRKGPITRTMSKRLQEDWARAAEEGPRVLMNLRVDF

SEQ ID NO: 175361 - protein, 157 aa, Glycine max
  Coding DNA Sequence Number=SeqID_58583
MATPPSFPPPPPPPTVRAERPLIHVDPATRKADGPHKKKLRTYLGIITRDKVEFDIPEACDLRTKKKILQIVRERWRQFKSDLTLKWALVADKESVNDTVCEKYDISKEKWAQFFQTHKDPSWEDVRKKAQAIQKQNTTPHVLSRGGYEYLENKLMG

SEQ ID NO: 175362 - protein, 179 aa, Glycine max
  Coding DNA Sequence Number=SeqID_58584
  Gene Ontology: Mol. function=nucleic acid binding; Cellular component= nucleus
  Homolog annotation: Hit_ID=Q9SWF9; Match level="QueryCoverage=62%, HitCoverage=77%, E-value=2e-56, Identity=66%"; Hit description=Zinc finger CCCH domain-containing protein ZFN-like
  Pfam annotation: Domain name=zf-CCCH; Domain location=75-101; Score =44.5; E_value=3.7e-10; Accession=PF00642.15; Description=Zinc finger C-x8-C-x5-C-x3-H type (and similar)
MAISVELVVLNTLRNGGGRKEIKPSMRVACHPFSLSVVSGIIYLHLFEKWFHHPRDKAGIAGRVALNILGYPLRPNEPECGYYLRTGQCKFGNTCKFHHPQPNNMVLSMRSSPVYPTVHSPTTPGHQSYATGITNWSSSSYIPSPRWQGPSSYAPLILPQGMVSVSGWSAYSVSSSILS

SEQ ID NO: 175363 - protein, 131 aa, Glycine max
  Coding DNA Sequence Number=SeqID_58585
  Gene Ontology: Mol. function=DNA binding; Cellular component =chromatin; Biological process=DNA integration
  Homolog annotation: Hit_ID=Q1SXA8; Match level="QueryCoverage=94%, HitCoverage=8%, E-value=1e-42, Identity=65%"; Hit description=Zinc finger, CCHC-type; Polynucleotidyl transferase, Ribonuclease H fold
MEPKHIDDGMQDDNWVFRNKLDENGKVVRNKARLVAKGYPQKEGIDYKETYASVARLEAICILLSFATYSNMRLYQMDVKNTFLNDLIQEEFYVEQPLGFKSETFPQHVFKLNKAIYGLKQAPRTWYEKLS

SEQ ID NO: 175364 - protein, 278 aa, Glycine max
  Coding DNA Sequence Number=SeqID_58586
  Subcellular localization annotation: CTP_CleavageSite=49; ConfidenceScore=5.37e-01
VASLVTGMWGANTFPTFSSNKRWWQLRSFSPLETNTLAHLFWPFRTPIEGQVATGLKIERLMDIIVSPELAVVVKVEEYKCNNNSKHRHSSLLNVLKKTDTKVRELGGNGILHGELGLLNLLALSLGKRFYGLFNHILHLISSDSGRLCIVERSGVGTVIVAFDASGVSSMTPMFVRLMMTLCTMVSSTTLVDALAWMEEAFTFLAATTSSSAPSSFIELHGVEYMSYHLVFNHLLQIICAFILNSGMFEKMLNEQVTVSILGEADASIIKVVLPNKM

SEQ ID NO: 175365 - protein, 282 aa, Glycine max
  Coding DNA Sequence Number=SeqID_58587
MGQWTYNSYPLMISLLKRQKIPLDGEPPFDLPYTIYINILRNLKGLGGLNGIYYVVPINKLLWDQEVYHVFNKMDEDSKHTLIVKGSDEGLVQVALQKSKATTLVAPTPKRTKKVQLVSEPQPLIIPFTIRRCIKKRTTKANPKIGDKEWAVSFTANKKDSTSSSSSDSKSIDATLISPLYNHTPSTQLHPPPPPLYLDRFKKATSWEPLIDAQRATDIKMVVDKVSPHLLVWDADKKGFKLYYSEDICIRKMKSQIVWMDSQKASTSFYDGSDNVEHHDVI

SEQ ID NO: 175366 - protein, 47 aa, Glycine max
  Coding DNA Sequence Number=SeqID_58588
MVNGAPLEGDNRGQMGFVGVASESCEHWLGIFLTSAGLNPCAVESIF

SEQ ID NO: 175367 - protein, 335 aa, Glycine max
  Coding DNA Sequence Number=SeqID_58589
  Homolog annotation: Hit_ID=Q5JLN0; Match level="QueryCoverage=87%, HitCoverage=72%, E-value=3e-89, Identity=51%"; Hit description =Lysine ketoglutarate reductase trans-splicing related 1-like
  Pfam annotation: Domain name=DUF707; Domain location=37-334; Score =415.2; E_value=8.9e-122; Accession=PF05212.3; Description=Protein of unknown function (DUF707)
MLLWNRSSGFFTLCCLAFLDFILCTTLQRGIQIPPKFEHENQCRTGGSHALPEGIISNTSDLEMRHLWDLPMTKTIENKENASTNLFAMAVGIKQKDLVNKLVKKFLSSNFVVMLFHYDGIVDEWNDFEWNNHVIHVAVANQSKWWFAKRFLHPDIVAEYGYIFLWDEDLGVEHFHPDRYVSIIKSEGLEISQPALDSNKSEVHHQITARGRRSNVHRRIYKTGGSGKRCDESSTAPPCTGWVEMMAPVFSRAAWRCVWYMIQGDRTKNVGVVDAEYIVHYGHPTLGGLDVNEVSSRTKDHRVDVRRLSYRELQVFRKRWQKAVEEDDCWVDPFQ

SEQ ID NO: 175368 - protein, 346 aa, Glycine max
  Coding DNA Sequence Number=SeqID_58590
  Gene Ontology: Mol. function=transporter activity; Cellular component= integral to membrane; Biological process=auxin mediated signaling pathway
  Homolog annotation: Hit_ID=Q673E6; Match level="QueryCoverage=99%, HitCoverage=93%, E-value=1e-127, Identity=67%"; Hit description =Putative auxin efflux carrier protein 9
  Pfam annotation: Domain name=Mem_trans; Domain location=9-346; Score =239.1; E_value=9.3e-69; Accession=PF03547.8; Description=Membrane transport protein
MIGWEDVYKVVVAVVPLYFALLLGYGSLKWWNIFTKEQCEAINKLVCYFTLPLFIFEFTAHIDPFKMNFSFIAADTISKFIIMVVLALWAKCTPKCTFCWSIISFSLCNLTNAVVVGVPMVKPMYGALGVDLVVQSSVLQATIWLPLLLFVMEFWRTGIEGTTTTTVKPRSKTMINKNEGGGGKDVEAVDVKEELMLEESVTSRLPFCKVMKLVWRKLATNPNSYGCVIGISWAFISNRWNLEMPSMLEGSIQIMSKAGTGTAMFSMGIFMALQEKLIACGPSMTLIGLVLKFIAGPAATAIGAIAVGLRGDVLRVVIIQAAVPQSITSFIFAKEYGLHPEVLSTA

SEQ ID NO: 175369 - protein, 114 aa, Glycine max
  Coding DNA Sequence Number=SeqID_58591
  Homolog annotation: Hit_ID=Q1SWX1; Match level="QueryCoverage=70%, HitCoverage=15%, E-value=8e-07, Identity=37%"; Hit description=IMP dehydrogenase/GMP reductase
MGSDQVPPFKKRFYHVKVKNLELARLRKLGQWMDQVQCQAFSKVYGKIWDLEMIEVSVEAITSLTQYYEQSLRCFTFGDFQLAPTIEESEGISGCPLGGGSHTFFLDSILLWQE

SEQ ID NO: 175370 - protein, 91 aa, Glycine max
  Coding DNA Sequence Number=SeqID_58592
MVGYTPSSFADLVFAGERIKVGLEKGKFDHPALMNAKNGENEEDENKGETLAMTAIPTRHNPCQGSSTSIFPRIQLECNMCISWRSFETFH

SEQ ID NO: 175371 - protein, 54 aa, Glycine max
  Coding DNA Sequence Number=SeqID_58593
MVLVAAIAAALTSIISFMLIMASIIVAICSFKASVSVFICSYTSSTSPITLALA

SEQ ID NO: 175372 - protein, 157 aa, Glycine max
  Coding DNA Sequence Number=SeqID_58594
  Homolog annotation: Hit_ID=Q5QLZ5; Match level="QueryCoverage=43%, HitCoverage=8%, E-value=5e-26, Identity=80%"; Hit description =Putative kinase-like protein splice variant 1
MGFIEFQRCNDDDDDNGQMVMAGDFEKKKKSEFRGSQLSIGVKACPGFGFGFGLGSYHQVWLTIQKRCVCVACAPPLDRETPDQIHPASVVGGSGTGVKDLPYTIAESYPSAWGSWTHSRGTSKDDGSPVSVFSLSGSNAQDGHLAAARNGVKRLRT

SEQ ID NO: 175373 - protein, 388 aa, Glycine max
  Coding DNA Sequence Number=SeqID_58595
  Gene Ontology: Mol. function=nucleoside-triphosphatase activity; Cellular component=chloroplast; Biological process=transport
  Homolog annotation: Hit_ID=Q9AT00; Match level="QueryCoverage=75%, HitCoverage=84%, E-value=1e-130, Identity=81%"; Hit description=Non -intrinsic ABC protein 11, chloroplast precursor
  Pfam annotation: Domain name=ABC_tran; Domain location=110-312; Score= 162.1; E_value=1.4e-45; Accession=PF00005.17; Description=ABC transporter
  Subcellular localization annotation: CTP_CleavageSite=42; ConfidenceScore=5.71e-01
MVSLSTTPFLPFTAKNASTRIPPPTSFSYSKQRSNRDPRKVVCACIAPPQNFKSQDSSAIHFNGSSKSEQLSTARDHEDDSDVLIECRDVYKSFGEKKILNGVSFKIKHGEAVGIIGPSGTGKSTVLKIIAGLLAPDKGEVYIRGKKRVGLVSDDDISGLRIGLVFQSAALFDSLTVRENVGFLLYEHSSMSEDQISELVTETLAAVGLKGVEDRLPSELSGGMKKRVALARSIICDTTKESIEPEVLLYDEPTAGLDPIASTVVEDLIRSVHIKGQDARGKPGNISSYVVVTHQHSTIKRAIDRLLFLHKGKIVWEGMTHEFTTSTNPIVQQVTRSCAGLSYRRGCSLDPGTNLIQLYWIGFFSVQVETDPIQLNRSGNGFYFFSPT

SEQ ID NO: 175374 - protein, 417 aa, Glycine max
  Coding DNA Sequence Number=SeqID_58596
  Homolog annotation: Hit_ID=Q5JJJ9; Match level="QueryCoverage=96%, HitCoverage=98%, E-value=3e-96, Identity=50%"; Hit description=CBS domain containing protein-like
  Pfam annotation: Domain name=CBS; Domain location=14-151; Score=12.0; E_value=0.0054; Accession=PF00571.18; Description=CBS domain
  Pfam annotation: Domain name=CBS; Domain location=216-403; Score =16.5; E_value=0.0022; Accession=PF00571.18; Description=CBS domain
  Pfam module annotation: Pfam domain module=CBS::CBS; Domain location =14-151::216-403
MASVFVYHVVGDLTVGKPELAEFHESETVESAIRAIGESPEGSIPIWKKRSQLGIENSDMRQQRFVGILSSFDIVAFLAKSRCLEDQDKALKTPVSEVVVHNNSLLRVVDPATRLIDALDMMKQGVKRLLVPKSIAWKGMSKRFSVIYYGKWLKNSESPGNSSNNLPLSMNRSPSTSVTPIPDKYCCLSREDVLRFIIGCLGALAPLPLTSIAALEAINSNYNYIESSTPAIEATQKLPQDPSAVAVIESASDGQCKIIGEISACKLWKCDYLSAAWALANLSAGQFVMGVEDNVTPRSLPEFSLDSPSGDIDLVNSGGSRKPRKFSSRSVGFFSNSASHNFSSRSMYRGRSAPLTCKITSSLAAVLAQMLSHRATHVWVTEDENDEVLVGVVGYADILAAVTKPPTTFIPANRSTE

SEQ ID NO: 175375 - protein, 134 aa, Glycine max
  Coding DNA Sequence Number=SeqID_58597
MEEDEEKIEGGDGRAVEDHGRERVSHCHGGRTKRLRPIQLNQIREREGVAFGEDMICRDLDKINNDFRSSVYEVYARSPMIYVVNSNKLRKEVWMNVWLFNVGWWCGGYDYEVGVGKCCQFNWDSVCKVVITLS

SEQ ID NO: 175376 - protein, 717 aa, Glycine max
  Coding DNA Sequence Number=SeqID_58598
  Gene Ontology: Mol. function=receptor activity; Cellular component =integral to membrane; Biological process=protein amino acid phosphorylation
  Homolog annotation: Hit_ID=Q9SPE8; Match level="QueryCoverage=96%, HitCoverage=95%, E-value=0.0, Identity=60%"; Hit description =Receptor-like protein CLAVATA2
  Pfam annotation: Domain name=LRRNT_2; Domain location=28-66; Score =41.9; E_value=2.1e-09; Accession=PF08263.3; Description=Leucine rich repeat N-terminal domain
  Pfam annotation: Domain name=LRR_1; Domain location=119-141; Score =15.9; E_value=0.15; Accession=PF00560.23; Description=Leucine Rich Repeat
  Pfam annotation: Domain name=LRR_1; Domain location=143-166; Score =12.5; E_value=1.3; Accession=PF00560.23; Description=Leucine Rich Repeat
  Pfam annotation: Domain name=LRR_1; Domain location=169-191; Score =12.3; E_value=1.4; Accession=PF00560.23; Description=Leucine Rich Repeat
  Pfam annotation: Domain name=LRR_1; Domain location=193-212; Score =6.8; E_value=15; Accession=PF00560.23; Description=Leucine Rich Repeat
  Pfam annotation: Domain name=LRR_1; Domain location=214-235; Score =5.0; E_value=34; Accession=PF00560.23; Description=Leucine Rich Repeat
  Pfam annotation: Domain name=LRR_1; Domain location=238-260; Score =13.2; E_value=0.93; Accession=PF00560.23; Description=Leucine Rich Repeat
  Pfam annotation: Domain name=LRR_1; Domain location=262-281; Score =7.3; E_value=12; Accession=PF00560.23; Description=Leucine Rich Repeat
  Pfam annotation: Domain name=LRR_1; Domain location=286-308; Score =10.5; E_value=3.1; Accession=PF00560.23; Description=Leucine Rich Repeat
  Pfam annotation: Domain name=LRR_1; Domain location=313-335; Score =15.1; E_value=0.25; Accession=PF00560.23; Description=Leucine Rich Repeat
  Pfam annotation: Domain name=LRR_1; Domain location=337-359; Score =15.7; E_value=0.17; Accession=PF00560.23; Description=Leucine Rich Repeat
  Pfam annotation: Domain name=LRR_1; Domain location=361-383; Score =16.2; E_value=0.12; Accession=PF00560.23; Description=Leucine Rich Repeat
  Pfam annotation: Domain name=LRR_1; Domain location=385-407; Score =11.1; E_value=2.4; Accession=PF00560.23; Description=Leucine Rich Repeat
  Pfam annotation: Domain name=LRR_1; Domain location=409-431; Score =10.0; E_value=3.8; Accession=PF00560.23; Description=Leucine Rich Repeat
  Pfam annotation: Domain name=LRR_1; Domain location=433-455; Score =8.5; E_value=7.3; Accession=PF00560.23; Description=Leucine Rich Repeat
  Pfam annotation: Domain name=LRR_1; Domain location=457-479; Score =15.1; E_value=0.26; Accession=PF00560.23; Description=Leucine Rich Repeat
  Pfam annotation: Domain name=LRR_1; Domain location=481-504; Score =8.9; E_value=6.1; Accession=PF00560.23; Description=Leucine Rich Repeat
  Pfam annotation: Domain name=LRR_1; Domain location=546-568; Score =7.8; E_value=9.8; Accession=PF00560.23; Description=Leucine Rich Repeat
  Pfam annotation: Domain name=LRR_1; Domain location=570-591; Score =12.7; E_value=1.2; Accession=PF00560.23; Description=Leucine Rich Repeat
  Pfam annotation: Domain name=LRR_1; Domain location=593-615; Score =18.2; E_value=0.03; Accession=PF00560.23; Description=Leucine Rich Repeat
  Pfam annotation: Domain name=LRR_1; Domain location=617-636; Score =5.6; E_value=25; Accession=PF00560.23; Description=Leucine Rich Repeat
  Pfam annotation: Domain name=LRR_1; Domain location=71-93; Score=5.5; E_value=27; Accession=PF00560.23; Description=Leucine Rich Repeat
  Pfam annotation: Domain name=LRR_1; Domain location=95-117; Score =10.8; E_value=2.7; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1; Domain ...
  Pfam module annotation: Pfam domain module=location=28-66::119 -141::143-166::169-191::193-212::214-235::238-260::262-281::286 -308::313-335::337-359::361-383::385-407::409-431::433-455::457 -479::481-504::546-568::570-591:...
  Pfam module annotation: =:593-615::617-636::71-93::95-117
  Subcellular localization annotation: CTP_CleavageSite=64; ConfidenceScore=5.19e-01
MVMGHTTPLTLLCVILLFATPSHSIDVHPQDRISLSMFRSSLPNPNQSLPSWVGSNCTSWSGITCDNRTGRVLSINLTSMNLSGKIHPSLCYLSYLNKLGLSHNNFTSPLPECFGNLLNLRAIDLSHNRLHGGIPDSFMRLRHLTELVLSGNPDLGGPLPAWIGNFSANLERLHLGFCSFSGGIPESLLYLKSLKYLDLENNLLSGNLVNFQQPLVLLNLASNQFAGTLPCFAASVQSLTVLNLSNNSIVGGLPACIASFQALTHLNLSGNHLKYRIYPRLVFSEKLLVLDLSNNALSGPIPCKIAETTEKLGLVLLDLSHNQFSGEIPVKITELKSLQALFLSHNLLSGEIPARIGNLTYLQVIDLSHNSLSGTIPFSIVGCFQLYALILTNNNLSGVIQPEFDALDILRILDISNNRFSGAIPLTLAGCKSLEIVDFSSNELSGSLNDAITKWTNLRYLSLAQNKFSGNLPSWLFTFNAIEMMDFSHNKFTGFIPDINFKGSLIFNTRNVTVKEPLVAARKVQLRVSAVVSDSNQLSFTYDLSSMVGIDLSSNSLHGEIPRGLFGLAGLEYLNLSCNFLYGQLPGLQKMHSLKALDLSHNSLSGHIPGNISSLQDLSILNLSYNCFSGYVPQKQGYGRFPGAFAGNPDLCMETSSGVCDDGRTQSAQGSSFSEDRMDGPISVGIFFISAFVSFDFGVVVLFCSARARNYILQTKV

SEQ ID NO: 175377 - protein, 361 aa, Glycine max
  Coding DNA Sequence Number=SeqID_58599
  Gene Ontology: Mol. function=protein kinase activity; Cellular component=cytoplasm; Biological process=protein amino acid phosphorylation
  Homolog annotation: Hit_ID=Q5QLZ5; Match level="QueryCoverage=99%, HitCoverage=43%, E-value=1e-160, Identity=78%"; Hit description =Putative kinase-like protein splice variant 1
  Pfam annotation: Domain name=HEAT; Domain location=157-193; Score =13.1; E_value=1; Accession=PF02985.12; Description=HEAT repeat
  Pfam annotation: Domain name=HEAT; Domain location=196-232; Score =14.8; E_value=0.31; Accession=PF02985.12; Description=HEAT repeat
  Pfam annotation: Domain name=HEAT; Domain location=234-271; Score =10.8; E_value=2; Accession=PF02985.12; Description=HEAT repeat
  Pfam annotation: Domain name=HEAT; Domain location=314-350; Score =24.9; E_value=0.00029; Accession=PF02985.12; Description=HEAT repeat
  Pfam module annotation: Pfam domain module=HEAT::HEAT::HEAT::HEAT; Domain location=157-193::196-232::234-271::314-350
MELAKSDWDAIKKSPPWAIDSWGMGCLIYEVFSGLRLGKTEELRNIGSIPKSLLPDYQRLLSSMPSRRLNTSKLIENSEYFQNKLVDTIHFMEILSLKDSVERDTFFRKLPNLAEQLPRQIVLKKLLPLLASALEFGSAAASALTALLKMGSWLSAEEFNVKVLPTIVKLFASNDRAIRVALLQHIDQYGESLSAQAVDEQVYPHVATGFSDTSAFLRELTLKSMLILAPKLSQRTMSGSLLKYLSKLQVDEEPAIRTNTTILLGNIGSYLNEGTRKRVLINAFTVRALRDTFPPARGAGIMALCATSSYYDITEVATRILPNVVVLTIDPDSDVRTKAFQAVDQFLQIAKQHYEKISMNE

SEQ ID NO: 175378 - protein, 370 aa, Glycine max
  Coding DNA Sequence Number=SeqID_58600
  Gene Ontology: Mol. function=binding; Cellular component=integral to membrane; Biological process=protein insertion into membrane
  Homolog annotation: Hit_ID=Q8L718; Match level="QueryCoverage=98%, HitCoverage=61%, E-value=3e-70, Identity=42%"; Hit description=Inner membrane ALBINO3-like protein 2, chloroplast precursor
  Pfam annotation: Domain name=TPR_1; Domain location=169-202; Score =6.2; E_value=0.97; Accession=PF00515.18; Description=Tetratricopeptid e repeat
  Pfam annotation: Domain name=TPR_1; Domain location=313-346; Score =10.6; E_value=0.29; Accession=PF00515.18; Description=Tetratricopepti de repeat
  Pfam annotation: Domain name=TPR_2; Domain location=169-202; Score =9.8; E_value=2.4; Accession=PF07719.7; Description=Tetratricopeptide repeat
  Pfam annotation: Domain name=TPR_2; Domain location=203-236; Score =9.3; E_value=2.7; Accession=PF07719.7; Description=Tetratricopeptide repeat
  Pfam annotation: Domain name=TPR_2; Domain location=313-346; Score =18.9; E_value=0.019; Accession=PF07719.7; Description=Tetratricopepti de repeat
  Pfam module annotation: Pfam domain module=TPR_1::TPR_1::TPR_2::TPR _2::TPR_2; Domain location=169-202::313-346::169-202::203-236::313-346
MSQGGALWFQNLTELSHGYSGFIFPFLIAGLHYVTVQISFRKPLVAETRDIFDLLAKFYKQYLDFLTIPIAITGFCIPQGSQLYWVTNSSLTLIQQITLRHPAVLAKLGLLDNSQKGASEQIAASKTAPSPGLQDNIPTAATKETVSPEKNPLDSPEKWHRIPIEEMSPKELVTLAVPFLNSDDKESAIPLLKLALDKDPDYVRALVLMGRVLLLKHVNDEANEYFERAISKLSLAGHSADAEEVDLLILSSQWAGIACERQVFGYMVKEGLNMHLTEGIFRYLGKRAEGRAHFERVANMQEPEDPTSKGYYFDGLLLLASTLFDAGQKAEAAKYLRLVVAYKPGYKKFLEQCEKDDDFTSDLARSRRDL

SEQ ID NO: 175379 - protein, 401 aa, Glycine max
  Coding DNA Sequence Number=SeqID_58601
  Homolog annotation: Hit_ID=Q9FFD1; Match level="QueryCoverage=85%, HitCoverage=59%, E-value=1e-140, Identity=68%"; Hit description =Genomic DNA, chromosome 5, P1 clone:MQK4
MWISEDDQKVVTKRKTELGGAFSMASWILFIGLFAVLLYQIISKRSIEVHNVRATNGPELASFINDMEFNITTVSSMSCANLRNLGNIVTGNPGFIDQRVVPLSTLANYSCYNSSMGPTIALKCKNCKVIYDHMYISWQFVDLPNSPAIAVGFEFRLTSMDIAKKHVSFVSGTLKNGSDFDDSPVTFRGNQSNIVKFNLFPRIYHNLHELKLIQPLFHEFIPGSVLRDTNELRASLESSTDGLVNTTLFINFLSDYVVEIDKQNILGPVSFLADLGGLYCISIGIFFYLLIQCEYRIKKLRNEDSIMRRIRNRRKAQEHWDKLRKYVMYTYGCPTIDNNYNSTGKETDCGGCMLHSVRGSGSSRKRRLKSRKDSISLYQKPSLPDNKVKLFIIDLACIWEV

SEQ ID NO: 175380 - protein, 95 aa, Glycine max
  Coding DNA Sequence Number=SeqID_58602
  Homolog annotation: Hit_ID=Q00M75; Match level="QueryCoverage=36%, HitCoverage=5%, E-value=4e-10, Identity=91%"; Hit description=PPR -repeat containing protein
MAMQQHNLCRKSSTKKISIERASPGAAVKLCLGDLLVMGSNPETASLHMQGLAWRLLLAVMLLVKIIWEEEEGKYIAVGFISNVSHEELDISPVQ

SEQ ID NO: 175381 - protein, 51 aa, Glycine max
  Coding DNA Sequence Number=SeqID_58603
MDISLNLLRRRLGGATFEISLENERLMEIEKLLMTSVKIGKKGNIDATLKT

SEQ ID NO: 175382 - protein, 420 aa, Glycine max
  Coding DNA Sequence Number=SeqID_58604
  Gene Ontology: Mol. function=alpha-1,4-glucan-protein synthase (UDP -forming) activity; Cellular component=cellulose and pectin -containing cell wall; Biological process=cellulose biosynthetic process
  Homolog annotation: Hit_ID=Q2HV87; Match level="QueryCoverage=82%, HitCoverage=99%, E-value=1e-179, Identity=86%"; Hit description =Alpha-1,4-glucan-protein synthase
  Pfam annotation: Domain name=Glycos_transf_2; Domain location=75-250; Score=-12.6; E_value=0.019; Accession=PF00535.16; Description =Glycosyl transferase
  Pfam annotation: Domain name=RGP; Domain location=74-420; Score =705.2; E_value=4.7e-209; Accession=PF03214.4; Description=Reversibly glycosylated polypeptide
  Pfam module annotation: Pfam domain module=Glycos_transf_2::RGP; Domain location=75-250::74-420
MRILKAGKLTEKVLRLFIATGKDEVLSFVQALNIQHILTPVLPTIAVPVVAKGVLRQNQTISLWDSLYSVPCKMSQAVINENEVDIVIGALHSDLTTFMNEWKPIFSRFHLIIIKDPDLKEELRIPEGFSVDVYTKSEIERVVGSSTSVRFSGYSCRYFGFLISRKKYVVCIDDDCVPAKDNLGILVDAVAQHIVNLQTPATPFFFNTLYDPFCKGADFVRGYPFSLRSGVDCALSCGLWLNLADLDAPTQALKPGQRNLRYVDAVVTVPSRAMVPVSGINIAFNREVVGPALVPALRLAGEGKLRWETMEDIWCGMCVKVICDHLGLGVKSGLPYVWRTERGDAIQSLKKEWEGVKLMEDVVPFFQSLRLPQSATTAEDCVVEMAKTVKEQLGKVDPMFSAAAEAMEEWVKLWKSVRSV

SEQ ID NO: 175383 - protein, 212 aa, Glycine max
  Coding DNA Sequence Number=SeqID_58605
  Gene Ontology: Mol. function=nucleic acid binding; Cellular component= intracellular; Biological process=DNA integration
  Homolog annotation: Hit_ID=Q1S1X7; Match level="QueryCoverage=98%, HitCoverage=21%, E-value=4e-43, Identity=38%"; Hit description =Integrase, catalytic region; Zinc finger, CCHC-type; Peptidase aspartic, catalytic
MEIHLKKKSKRLWLSQQGYVEKVLDKFNMNNAKPVSTPLAKHFKLSIDQCLKIDVELEYMSKVPYANAVDCLILDLEVLKGTGHDIIFGSQQGDLSVVGYVDFDHAGDLDDSLLLARKLWLVGLVKELGIKQGGVQLHCDSQSAFDLTKNQVYYAKTKHIDVRFHKIKELMTSGQILFRKVHTLDNAADMLTKAITTDKFKHCLDLLNVAKC

SEQ ID NO: 175384 - protein, 180 aa, Glycine max
  Coding DNA Sequence Number=SeqID_58606
MEALNLEELQKKATTTIRLCLADEVLYHVMKLMSPGEAALMSHSKRRQNAVESLQGDGLYVKGKHECERTQDKSFGDKQRKKSKTSRLANVAETDDLDYYTKGDVYYNERDVLSGSCSQLTDAWILDSRYYYHMTPNREWFTTYRSDNFDSDCMGNNKTSNGDKDTLRVCKGALTVMKAQ

SEQ ID NO: 175385 - protein, 439 aa, Glycine max
  Coding DNA Sequence Number=SeqID_58607
  Gene Ontology: Mol. function=monooxygenase activity; Cellular component=membrane; Biological process=electron transport
  Homolog annotation: Hit_ID=Q2HV82; Match level="QueryCoverage=99%, HitCoverage=68%, E-value=0.0, Identity=76%"; Hit description=E-class P450, group I
  Pfam annotation: Domain name=p450; Domain location=142-439; Score= -93.7; E_value=1e-06; Accession=PF00067.12; Description=Cytochrome P450
  Subcellular localization annotation: CTP_CleavageSite=64; ConfidenceScore=5.70e-01
MASHVALLRVPPPLSISTQRFHAKQICINGLKLTNTSSSSSSSSCFPCSITTQRGSCSSVITCSSSNGRDPNSVDEEDVKQVERILEEKRRAALSAKIASGEFTVKQKSGLLSIMEGLAKVGVPNEVLEFLFGWFEGGGEHPKIPEAKGSIKAVRSVAFFIPLYELYLTYGGIFRLTFGPKSFLIVSDPSIAKHILRENSKAYSKGILAEILDFVMGKGLIPADGEIWRVRRRAIVPALHQKYVAAMIGLFGQAADRLCQKLDAAASDGEDVEMESLFSRLTLDIIGKAVFNYDFDSLSNDTGIVEAVYTVLREAEDRSVAPIPVWEIPIWKDVSPRLRKVNAALKLINDTLDDLIAICKRMVDEEELQFHEEYMNEQDPSILHFLLASGDDVSSKQLRDDLMTMLIAGHETSAAVLTWTFYLLSKEPRVMSKLQEEVS

SEQ ID NO: 175386 - protein, 159 aa, Glycine max
  Coding DNA Sequence Number=SeqID_58608
  Homolog annotation: Hit_ID=Q2HV86; Match level="QueryCoverage=99%, HitCoverage=100%, E-value=6e-44, Identity=51%"; Hit description=Late embryogenesis abundant protein
  Pfam annotation: Domain name=CsbD; Domain location=109-150; Score= -1.6; E_value=0.029; Accession=PF05532.3; Description=CsbD-like
  Subcellular localization annotation: CTP_CleavageSite=29; ConfidenceScore=5.45e-01
MASFTLVTSLPKFGHAGAAIARTRVWNPRVFAAATPRTIQVPREGPATAEGTTQGASETVNNSLNEAQDKAYTTAEHVANKTNEVAGQMSASAQNMAGKAKQTMQEAWEFSKNKANTVVGKTKESAEHAKDNVVGKTKESAEYVKDNAEAVKKNMNSKN

SEQ ID NO: 175387 - protein, 459 aa, Glycine max
  Coding DNA Sequence Number=SeqID_58609
  Gene Ontology: Mol. function=transferase activity, transferring hexosyl groups; Cellular component=membrane; Biological process =carbohydrate metabolic process
  Homolog annotation: Hit_ID=Q2HV81; Match level="QueryCoverage=98%, HitCoverage=99%, E-value=1e-132, Identity=62%"; Hit description =Glycosyl transferase, family 28
  Pfam annotation: Domain name=Glyco_transf_28; Domain location=144 -234; Score=-15.7; E_value=0.063; Accession=PF03033.10; Description =Glycosyltransferase family 28 N-terminal domain
  Subcellular localization annotation: CTP_CleavageSite=81; ConfidenceScore=5.16e-01
MAEANTRHHRATSSSSDISVYLDADHSSVPAASFGPIDRNPSSSTPPSSSRNAAAAPANQVNDKNAAAAVAKVVGRSKGSSAMALAKFLDEKVPFREKDDGTVEIKVSGEGSNIEHDVKCDESHDEFCDAIHSQDIQPIEPLQIVMLIVGTRGDVQPFVAMGKRLQLSYQIVDALIWLGIRDLINEFRKKELKLKPITYLSGSYTHPFDVPHGYIWSPHLVPKPKDWGPKIDVVGFCFLDLASNYVPPKSLVDWLEEGEKPIYVGFGSLPLQQPEKMTQIIIHALEETGQRGVINKGWGGLGSLAEQNKSVYLLDNCPHDWLFPRCTAVVHHGGAGTTAAGLRAECPTTIVPFFGDQPFWGDRVRARGVGPAPIPVDEFSFDRLVDAIHFMLKPEVKKRAVELANAMKNENGVLGAVKAFYKHYPAEFKRLASTAEPKSVHKYFSIRGCFGCSKSSGYK

SEQ ID NO: 175388 - protein, 97 aa, Glycine max
  Coding DNA Sequence Number=SeqID_58610
MMVATLFGKLREYDLELGRLKDEEEVDKKKKGLALQTSSSHHEASDEDPSAKSKGASFQKGEHAGVATNVYSRKTLEKPRKKRSNNFEKKGLGVVYT

SEQ ID NO: 175389 - protein, 68 aa, Glycine max
  Coding DNA Sequence Number=SeqID_58611
MKRALINVHEFGLTGEGETARKPYYKRNLKESWASSSKGNNTRKSSLPLIQTENAHETKSRNVNEAET

SEQ ID NO: 175390 - protein, 59 aa, Glycine max
  Coding DNA Sequence Number=SeqID_58612
MEGQLSYPNFVWEPLFGGVQPSLDRLKQPTSPGRAGRQPPPPFCLKMAFEAFGTPIMLP

SEQ ID NO: 175391 - protein, 761 aa, Glycine max
  Coding DNA Sequence Number=SeqID_58613
  Gene Ontology: Mol. function=identical protein binding; Cellular component=cellulose and pectin-containing cell wall; Biological process=negative regulation of enzyme activity
  Homolog annotation: Hit_ID=Q2HV71; Match level="QueryCoverage=98%, HitCoverage=99%, E-value=0.0, Identity=73%"; Hit description =Protease-associated PA; Proteinase inhibitor I9, subtilisin propeptide
  Pfam annotation: Domain name=PA; Domain location=366-459; Score=6.1; E_value=0.077; Accession=PF02225.12; Description=PA domain
  Pfam annotation: Domain name=Peptidase_S8; Domain location=121-590; Score=71.7; E_value=2.3e-18; Accession=PF00082.12; Description =Subtilase family
  Pfam annotation: Domain name=Subtilisin_N; Domain location=30-115; Score=66.5; E_value=8.4e-17; Accession=PF05922.7; Description =Subtilisin N-terminal Region
  Pfam module annotation: Pfam domain module=PA::Peptidase _S8::Subtilisin_N; Domain location=366-459::121-590::30-115
PKLNFVFPFPFMLLITHWFLLALHGSAETSTYIVHMDKSLFPHVFTTHHDWFESTIDSIKSAKLGHSSNQSQKLVYSYNHAMYGFSAVLTLEELEAVKNSHGFVAAYPDRNVTIDTTHTSEFLSLDSSSGLWHASNFGEDVIVGVIDTGVWPESESFKDEGMTKIPNRWKGTCEEGQDFNTSMCNFKLIGARYFNKGVIAANSKVKISMNSARDTVGHGTHTSSTIAGNYVHGASYFGYAKGVARGIAPRARLAMYKVIFDEGRVASDVLAGIDQAIADGVDVISISMGFDGVPLYEDPIAIASFAAMEKGVVVSSSAGNEGPDLGTLHNGIPWLLTVAAGTIDRTFGTLILGNGQTIIGWTLFPANALVENLPLIYNKNISACNSVKLLSKVAKQGIILCDSESDPELKMNQRSFVDEASLLGAVFISDQPLLNEEGHVSSPTIVISSQDAPSVIKYAKSHKKPTATIKFQRTFVGIKPAPAVTIYSSRGPSPSYHGVLKPDIMAPGSNVLAAYVPTEPAATIGNNVMLSSGYNLLSGTSMACPHASGVAALLKAAHTKWSAAAIRSALVTTASPLDNTQNPIRDYGYPSQYASPLAIGAGQIDPNKALDPGLVYDATPQDYVNLLCALKYTQKQILTITRSTSYNCAKPSFDLNYPSFIAFYRNNTRSVVHKFRRTVTNVGDGAATYRAKVTQPKGSVVTVSPETLTFRYKNEKLSYDVVIKYSKYKKKNISFGDLVWVEEGGTHSVRSPIVVAPSGIV

SEQ ID NO: 175392 - protein, 65 aa, Glycine max
  Coding DNA Sequence Number=SeqID_58614
  Subcellular localization annotation: CTP_CleavageSite=30; ConfidenceScore=5.31e-01
MAKANTHLRRASSSSSDISVYLDADNTSVPAASSGPIDRNPSSSMLSLSPSRNAEAAPVAQPADQ

SEQ ID NO: 175393 - protein, 1222 aa, Glycine max
  Coding DNA Sequence Number=SeqID_58615
  Gene Ontology: Mol. function=protein serine/threonine kinase activity; Cellular component=integral to membrane; Biological process=protein amino acid phosphorylation
  Homolog annotation: Hit_ID=Q2HV72; Match level="QueryCoverage=99%, HitCoverage=95%, E-value=0.0, Identity=71%"; Hit description=Protein kinase; Peptidoglycan-binding LysM
  Pfam annotation: Domain name=LysM; Domain location=122-167; Score =1.3; E_value=0.43; Accession=PF01476.10; Description=LysM domain
  Pfam annotation: Domain name=LysM; Domain location=188-237; Score =16.2; E_value=0.011; Accession=PF01476.10; Description=LysM domain
  Pfam annotation: Domain name=LysM; Domain location=69-106; Score=1.0; E_value=0.47; Accession=PF01476.10; Description=LysM domain
  Pfam annotation: Domain name=LysM; Domain location=746-791; Score =9.8; E_value=0.053; Accession=PF01476.10; Description=LysM domain
  Pfam annotation: Domain name=LysM; Domain location=812-861; Score =20.3; E_value=0.004; Accession=PF01476.10; Description=LysM domain
  Pfam annotation: Domain name=Pkinase; Domain location=354-624; Score =140.6; E_value=4.4e-39; Accession=PF00069.15; Description=Protein kinase domain
  Pfam annotation: Domain name=Pkinase; Domain location=982-1220; Score= 76.6; E_value=8e-20; Accession=PF00069.15; Description=Protein kinase domain
  Pfam annotation: Domain name=Pkinase_Tyr; Domain location=354-624; Score=121.2; E_value=3e-33; Accession=PF07714.7; Description=Protein tyrosine kinase
  Pfam module annotation: Pfam domain module=LysM::LysM::LysM::LysM::Lys M::Pkinase::Pkinase::Pkinase_Tyr; Domain location=122-167::188 -237::69-106::746-791::812-861::354-624::982-1220::354-624
MELFHNLNIFSTILLLCMFPHSLKCQQAYLNGTVYDCSDNPSAPKGYLCNGLQKSCTSFLLFRSKPPYDSPGIIAYLLGSEASTIASINRISRNDKIPSNKSIIVPVFCSCSGNIYQHNTPYTASKNDTYYELVKETFQGLTTCQAMMGQNYYASINIAIGAELTVPMLCACPTENQTARGVTSLLVHLVNYGDTIKSIGRAYGVDEQSVLEANKLAVSQSKNSSMDLLALTPIIVPLIGKSCKENPDKFYCRCYQAPDGSSKGPFCDESDGQKFPAKLVAGLGVGIGAGFLCLFLLGYKSYQYIQKKRETILKEKLFRQNGGYLLQEKLSSYGNGEMAKLFTAEELQRATDNYNRSRFLGQGGYGTVYKGMLLDGTIVAVKKSKEIERNQIQTFVNEVVVLSQINHRNIVKLLGCCLETETPILVYEFIPNGTLSHHIHRRDNEPSPSWISRLRIACEVAGAVAYMHFAASISIFHRDIKPTNILLDSNYSAKVSDFGTSRSVPLDKTHLTTAVGGTFGYIDPEYFQSSQFSDKSDVYSFGVVLVELITGRKPISFLYEDEGQNLIAQFISLMKENQVFEILDASLLKEARKDDILAIANLAMRCLRLNGKKRPTMKEVSTELEALRKAQSSLQMNHDHEHTTSDIVQECTEESITVYDCSENPSAPKGYLCNGLQKSCTSFLVFRFKSPHDNPVSLAYLLGSEASTIASINKISRDDKIPSNKSIIVPVFCSCSGNIYQHNTPYSATKNDTYFKLVTETYLGLTTCQALMGQNYYASDGIRVGSELTVPVVCACPTENQTERGITSLLVYSVKNGDTIKSIGEVYGVDEQSMLEANGLPVPTSTENSIIIYALTPILVPLRGKSCKEDPDSFYCTCSQGMLAVVDLTFTGFHCNESEGNNFPAKLVASLGVGIGAGFLCLFLLGYKLYQYIQKKRKSNRKEKLFRQNDGYLLQEKLSFYGNREMAKLFTAEELQRATDNYNRSRFLGQGGQGTVYKGMLLDGTIVAVKRSKKIERNQIETFVNEVVILSQINHRNIVKLLDKMSPPFYGTVALESLEVSGAVAYMHFAASIPIFHRDIKPTNILLDSNYSAKVSDFGTSRSVPLDKTHLTTDVGGTFGYIDPEYFQSGQFSDKSDVYSFGVVLVELITGRKPISFLYKHEGQNLIAEFISSVRQNQVYEILDARVLKEGRKDDILAAANLAMRCLRLNGKKRPTVKEVSA

SEQ ID NO: 175394 - protein, 56 aa, Glycine max
  Coding DNA Sequence Number=SeqID_58616
  Gene Ontology: Mol. function=hydrolase activity, acting on carbon -nitrogen (but not peptide) bonds; Biological process=nitrogen compound metabolic process
  Homolog annotation: Hit_ID=Q47679; Match level="QueryCoverage=98%, HitCoverage=21%, E-value=4e-13, Identity=62%"; Hit description =UPF0012 hydrolase yafV
MAFVVLVQRAVGLHQQETVYRALVALNRRAAADQGIQGFGMTVQPRHYLILRQRTG

SEQ ID NO: 175395 - protein, 116 aa, Glycine max
  Coding DNA Sequence Number=SeqID_58617
  Subcellular localization annotation: CTP_CleavageSite=35; ConfidenceScore=5.59e-01
MGSPPASPPPPPPTPPSHHPLPPTTTPSDTSASPSAVKRTRKASLVHVDPAIGKADGPHRKKLRTYLGIVACDKVDVTYENWKEVPTAQKDLIWEDIQAKFDILEASDSRTKRKLL

SEQ ID NO: 175396 - protein, 303 aa, Glycine max
  Coding DNA Sequence Number=SeqID_58618
  Gene Ontology: Mol. function=RNA-directed DNA polymerase activity; Biological process=RNA-dependent DNA replication
  Homolog annotation: Hit_ID=Q8H6Q8; Match level="QueryCoverage=99%, HitCoverage=53%, E-value=2e-38, Identity=35%"; Hit description=CTV.20
MVATTYQTSHECSEETIMDILVAGFSGQLKGWWYRDTFLTRVYTREDSQQPFWKEKFLAGLPRSLGDKVRDKIRSQSANGDIPYESLSYGQLISYVQKVALKICQDDKIQRQLAKEKAQTKKDLGHISKYCRLKKKLRNLNLEPAIEEQINNLPIETSEEETETSSSVLSDENLNLIQQDDQLSSTDDDDGQINTLTREQDLLFEAINSIPDPQEKKVFLEKLKKTLEVKPRQKDFITNNKFDVSNILKRLENSSTKPTTNQDLQTEINNLKREVKELRQQQEIHQIILSQLEEYSDSKSANN

SEQ ID NO: 175397 - protein, 188 aa, Glycine max
  Coding DNA Sequence Number=SeqID_58619
  Gene Ontology: Mol. function=nucleic acid binding; Biological process= RNA-dependent DNA replication
MLTEEGINTWEAFKIKFLVKYFLKDLRKHYVHKFIDLKQGSMSMENMLKFDELLKYFPYYQENDAAAIYSKFENKLWDDIKQVEGYLQITNFPTLNYGKSGHTTSNYLLAPKNGQNIGGVARMNNKDGSGQNMKPRVDGKVFTMSSSKVMETNEPIQVLRKVVPKQLPRGENSKELLKPIYMMENASL

SEQ ID NO: 175398 - protein, 54 aa, Glycine max
  Coding DNA Sequence Number=SeqID_58620
MGQSHLGCALEVLHGRLLQARVVDPQRWMGRICLSGSVGGNNCDHVSFHHSLHV

SEQ ID NO: 175399 - protein, 185 aa, Glycine max
  Coding DNA Sequence Number=SeqID_58621
SYEVPITPSKVIRLPITRAFIKKYSTPRQVQGDAHQAADTPPPPQQADPAGSLGVERYLQHLVRQQAANHRGQQFGAEVTWPGDWPDAQAGEEPVGSPGEADESHMDEEMTDLLSFLGGSGATRLRFRDYNHIVEIVFVEIVLSIEGVFLLLPEFVFVANWVALPSLQPHCRVRVCGVRVCASIE

SEQ ID NO: 175400 - protein, 55 aa, Glycine max
  Coding DNA Sequence Number=SeqID_58622
GQGRQQICLVERLTKGFHQLTPRTDYPTGNEVECGQRIPNKVLGGQVEWGGGIIG

SEQ ID NO: 175401 - protein, 181 aa, Glycine max
  Coding DNA Sequence Number=SeqID_58623
MVDGRKEEEGCFLAFLCVRRGQFSKASNIYIKTLRIKPRAWFRESLDEDDSVDGISDTDNEVNEMIPPVYKEFKIPFWNDALHYNNINWSHPDEEDICGLEMPSSFNVGQELYVGMDFDSKDAIKNAVKQYAMKVHQSFKVVESKWDKYVVCCLNKNADCPCPFYMRAILSKKTDSWKVTQ

SEQ ID NO: 175402 - protein, 481 aa, Glycine max
  Coding DNA Sequence Number=SeqID_58624
  Gene Ontology: Mol. function=molybdate-transporting ATPase activity; Cellular component=1-2nm peptidoglycan-based cell wall; Biological process=molybdate ion transport
  Homolog annotation: Hit_ID=P09833; Match level="QueryCoverage=58%, HitCoverage=100%, E-value=3e-83, Identity=55%"; Hit description =Molybdenum import ATP-binding protein modC
  Pfam annotation: Domain name=ABC_tran; Domain location=130-461; Score= -25.2; E_value=2.9e-05; Accession=PF00005.17; Description=ABC transporter
LARCGAGLGGDGVSADGARHSSGTGSGRQPAGTGGTYPGRGPLAGVFHHHTAADFPGHHRWHRAGVRPLARHCGAAVRGGDCAGAAVAGGLRAAGALGPQAAGSGLMLKINIAQQLGEHQLNVDVEIPASGITAIFGVSGAGKTSLINAISGLTQPQSGQIALNDLWHGAQNESAVRGAGDAAGTGRAAGSLSGLAVGWRKAARGDGPGAAERAGYPADGRTAGVARSATQARTDALFAEAGEAGGDSAAVREPQPGGDCPAGESGAAQQRTARAGAGAASGLPDDRAVAWRSAHLGQPGESAGEKRTAHPYRLGGRVAGAAAAAKYLDPQYLTGAGGGAAGAGRPGRSEAAHRRQRAVGAHFTVGARRTEYPARSVAVCADQERVDYRVTQTGRQLGTSGLRISAFFRAFFRPTLLMPCAATSLALQHFLVDHLRNARLKVGADHFARACFDGVIGIAHRHAQPGLLQHAEIVVLSPNAS

SEQ ID NO: 175403 - protein, 51 aa, Glycine max
  Coding DNA Sequence Number=SeqID_58625
MEVKDLIWEGLDEGKCGFRNLHFVQIFAVKLCSRILHKCRKMLVCDWLWKE

SEQ ID NO: 175404 - protein, 225 aa, Glycine max
  Coding DNA Sequence Number=SeqID_58626
  Gene Ontology: Mol. function=glucan 1,4-alpha-glucosidase activity; Cellular component=integral to membrane; Biological process =polysaccharide metabolic process
  Homolog annotation: Hit_ID=Q3KF74; Match level="QueryCoverage=99%, HitCoverage=36%, E-value=6e-90, Identity=69%"; Hit description =Glycoside hydrolase 15-like
  Pfam annotation: Domain name=Glyco_hydro_15; Domain location=1-210; Score=-38.4; E_value=1.3e-08; Accession=PF00723.12; Description =Glycosyl hydrolases family 15
MIDYVCVNWNQPDAGIWEMRGEPEHFLHSRLMCWVALDRALRLGMKRSLPMPYDRWDRVRSEIRDDIWQNFWNDELGHFTATRGGKYLDASMLLMPLVRFVSSTDPEWIATLDAIKTHLVSDGLVRRYNISETPADALTGGEGAFAACSFWYVECLARAGRVHEAHFEFEKLLSYANPLGLYAEEFTSHGNALGNMPQALTHLALISAAFFLNRKLSGEVTLWQP

SEQ ID NO: 175405 - protein, 405 aa, Glycine max
  Coding DNA Sequence Number=SeqID_58627
  Gene Ontology: Mol. function=oxidoreductase activity; Cellular component=membrane; Biological process=metabolic process
  Homolog annotation: Hit_ID=Q8ZNM5; Match level="QueryCoverage=61%, HitCoverage=98%, E-value=3e-98, Identity=70%"; Hit description =Putative oxidoreductase
  Pfam annotation: Domain name=KR; Domain location=61-201; Score=-73.1; E_value=0.004; Accession=PF08659.1; Description=KR domain
  Pfam annotation: Domain name=adh_short; Domain location=60-229; Score= 94.6; E_value=3e-25; Accession=PF00106.15; Description=short chain dehydrogenase
  Pfam module annotation: Pfam domain module=KR::adh_short; Domain location=61-201::60-229
MTPWSSILRLILLILPPERYPIVNYRRNGRIGCDVAQNDNFYTVKTPIRQENVMTLGKQKVAVVTASDSGIGRSCAVMLAEAGYTVGITWRSDEEGAQETARLVESKGQLAQVRQLDLSDPQAGGQQLAQLINSLGRIDVLVNNAGVMTKADFLDVTFEDWRKVFTVDVDGAFVCGQIAARHMVDQGDGGRIINITSVHEHTPLPDAAAYTAAKHALGGLTKSMALSLLPHHILVNAVAPGAIATPMNDMSNSEAHSRRMPEIPIGRPGDTREIASLVAWLCSEWATYTTGQSFVVDGGFMLANPQFKAANHKAQHDAEHNCRRQPDEVLEVLIKLVQPRRDDFTGEVAEGDKNQRPQRGANDVKHEKAQRLKAAGANNNRSNQAKAVHEAHANHKQAGVLLNQP

SEQ ID NO: 175406 - protein, 947 aa, Glycine max
  Coding DNA Sequence Number=SeqID_58628
  Gene Ontology: Mol. function=ionotropic glutamate receptor activity; Cellular component=integral to membrane; Biological process=ion transport
  Homolog annotation: Hit_ID=Q8GXJ4; Match level="QueryCoverage=94%, HitCoverage=94%, E-value=0.0, Identity=62%"; Hit description =Glutamate receptor 3.4 precursor
  Pfam annotation: Domain name=ANF_receptor; Domain location=67-425; Score=334.2; E_value=2.2e-97; Accession=PF01094.18; Description =Receptor family ligand binding region
  Pfam annotation: Domain name=Lig_chan; Domain location=606-871; Score= 307.2; E_value=3e-89; Accession=PF00060.17; Description=Ligand-gated ion channel
  Pfam annotation: Domain name=SBP_bac_3; Domain location=487-830; Score=-5.2; E_value=1e-07; Accession=PF00497.10; Description =Bacterial extracellular solute-binding proteins, family 3
  Pfam module annotation: Pfam domain module=ANF_receptor::Lig _chan::SBP_bac_3; Domain location=67-425::606-871::487-830
  Subcellular localization annotation: CTP_CleavageSite=71; ConfidenceScore=5.10e-01
MEVLWVTRHGRMFEGRVLLLLVLFLWIPTQVVVGRTRATITNSTTSSAPRVLRVGVLFTLNSIIGRSAKPALMAAFEDVNADSSVLPGIRLEVILHDTNCSGFVGTMEALQLMEDEVVAAIGPQSSGIAHVISHVVNELHVPLVSFGATDPSLSSLQYPYFVRSTQSDHYQMYAIADLVDYYRWREVIAIYVDDDNGRNGISVLGDALSKKRAKISYKAAFPPGALKKDISDLLNGVNLMESRVFILHVNPETFLNIFSIADKLGMMNSGYVWIATDALASTLDSLEPVDPNTMNLLQGILVLRHHTPDTNEKKSFLSRLKRLKTKETPSFNSYALYAYDTVWLVARALDAFLKKGSVVSFSSDPKLQDTNGSMLHLQSLRVFNDGPTFLETILSTNFTGLTGTVQFDIERNRIHPAYDILNIGGSGMRRVGYWSNYSGLSVVTPEILYKKPPNTSTSSQQLYGVIWPGETAAKPRGWVFPNNGKPLRIAVPNRVSYKEFVSKDKNPPGVRGYCIDVFEAAINLLPYPVPREYILFGPGNRNPSYDDLASQVALNNYDAAVGDVTIVPNRTRFLDFTQPYMESGLVVVVPVKEIKSSPWSFLKPFTAQMWCVTGAFFIFVGTVVWILEHRHNPEFRGRPRKQLMTVFWFSFSTMFFSHRENTVSGLGRLVLIIWLFVVLIINSSYTASLTSILTVQQLSSQIEGIDSLISGTQPIGIQEGSFARKYLTEELNIQPSRIVTLKNMEAYIDALEKGPKDGGVVAVVDELPYIEILMSSTNCKFRTVGQEFTKSGWGFAFQRDSPLAVDMSTAILQLSENGDLQKIHDKWLLKRDCSAPDSDADLNKLSLGSFWGLFLISGIACLLALVTFFIRVLCQYTKFSPEPEQDDEEISPNRPTKSKGLFRSTTSFRDLIYFVDKKEKEIKDILRQKSKKRRRSLSSDGQSSSPT

SEQ ID NO: 175407 - protein, 82 aa, Glycine max
  Coding DNA Sequence Number=SeqID_58629
  Homolog annotation: Hit_ID=Q00UQ3; Match level="QueryCoverage=56%, HitCoverage=29%, E-value=1e-09, Identity=57%"; Hit description =Chromosome 15 contig 1, DNA sequence
MSSSSRPVPRRESPWGVTGENHPEPKAHRCNDRVEDVIQACFEGNPFKTVPGPFKLFWQCMRSKPGSDYHLLLSYDYVYLIL

SEQ ID NO: 175408 - protein, 83 aa, Glycine max
  Coding DNA Sequence Number=SeqID_58630
  Pfam annotation: Domain name=Choline_kin_N; Domain location=33-78; Score=18.1; E_value=0.027; Accession=PF04428.5; Description=Choline kinase N terminus
MGATEEALQNLVNVNVVDAENPKNIKVSGTEDSVVNDKELGAKETPIKDKKDSIPGEVKEMLKSLASEWENVVDINAFASDPS

SEQ ID NO: 175409 - protein, 91 aa, Glycine max
  Coding DNA Sequence Number=SeqID_58631
MVAQQDRAGMGSSLSSPTNPVLVLDPYCGRRVEKKLDSLTTTEDGNGCFPVKERHRECDRWQVAMGVDGTTQYENKSEGIPDDGSRWRCTV

SEQ ID NO: 175410 - protein, 69 aa, Glycine max
  Coding DNA Sequence Number=SeqID_58632
MAQPPILRTYHDSDTDSSSELEGSNMSPSHETIFKRDWWHGNITVEIHNSFQFTLHCFKKLNVSPAKLT

SEQ ID NO: 175411 - protein, 134 aa, Glycine max
  Coding DNA Sequence Number=SeqID_58633
  Gene Ontology: Mol. function=metal ion binding; Cellular component =nucleus; Biological process=ubiquitin cycle
  Homolog annotation: Hit_ID=Q940X7; Match level="QueryCoverage=64%, HitCoverage=77%, E-value=2e-29, Identity=69%"; Hit description=RING -box protein 1a
MATLDSDVTVFPAGEASSSAGPSSSTKKPKRFEIKKWNAVSLWAWDIVVDNCAICRNHIMDLCIECQANQASATSEECTVAWGIFHFQSYPPQNHHTEQVFTLRPHHMSYCDDNFCGRPWQQQGSGKQQGIRVW

SEQ ID NO: 175412 - protein, 173 aa, Glycine max
  Coding DNA Sequence Number=SeqID_58634
  Homolog annotation: Hit_ID=Q1STP6; Match level="QueryCoverage=84%, HitCoverage=77%, E-value=4e-19, Identity=34%"; Hit description =Harpin-induced 1
  Pfam annotation: Domain name=Hin1; Domain location=28-160; Score =13.2; E_value=0.00012; Accession=PF07320.4; Description=Harpin -induced protein 1 (Hin1)
MANRGLKICLAVSLLFLVIVTIMIVTLFMTIFKPKNPEITVHPVGLEDFQFSLSPNLTINVTLGMIITIRNPNYGSFEYKNSTGYVNFHDTVVAEVPIEAELVPARGQINVNTSADFMVEKLINDPNFLSDVLGGTLNFTSTTALPGKARSIFLLEYIYVFFGIKEYGSILYK

SEQ ID NO: 175413 - protein, 144 aa, Glycine max
  Coding DNA Sequence Number=SeqID_58635
  Homolog annotation: Hit_ID=Q19QU4; Match level="QueryCoverage=80%, HitCoverage=51%, E-value=1e-12, Identity=30%"; Hit description=Plant cell wall protein SlTFR88
MASKGLKIKLLGHISSILDHCCHCDCDLNPNYENFEYPNATGYVKFLDTVVGQVPIVGELVPPRSQINVNTSANFMVSKLINDPNFLSDFLSGIVNFTSTASLPGKAHMLKIIKFKATVYSLCDISINITSRNVDSNCISKIKI

SEQ ID NO: 175414 - protein, 134 aa, Glycine max
  Coding DNA Sequence Number=SeqID_58636
MAEGEDSIGDEKIVDDEIGRVRGGIDGDEEDRLGGHELLPLRAARAVDPGKEEREAGIGGVGVGGGLRLVGVGERRRRGRAVEGDLVAEEGVEAVRSGADARVSDSSKRAWFEVLVEGMRDAWSGSAVHGERRK

SEQ ID NO: 175415 - protein, 63 aa, Glycine max
  Coding DNA Sequence Number=SeqID_58637
MPYTFMVVTDNDIAWMETLKNDPVSAAPSEYMHGAMALVIWKLRAKGEDVDHLKRAFKYLCHF

SEQ ID NO: 175416 - protein, 85 aa, Glycine max
  Coding DNA Sequence Number=SeqID_58638
MFVQVVWAKSAFENFYAGNIGLFPAEKLPRTLVTNATDHVRQGNDALQTAKSLQKKSRKCMMISIILVLVIAIIIVLSVLKPWKK

SEQ ID NO: 175417 - protein, 168 aa, Glycine max
  Coding DNA Sequence Number=SeqID_58639
  Gene Ontology: Mol. function=oxidoreductase activity; Cellular component=membrane; Biological process=electron transport
  Homolog annotation: Hit_ID=Q2MJ02; Match level="QueryCoverage=75%, HitCoverage=36%, E-value=3e-39, Identity=49%"; Hit description =Cytochrome P450 monooxygenase CYP704G9
MPLSLTQQELPVLLVVELDTVCGTYKQGTEFSNAIDEMVKGDILSRFIELEETDPKYLGDISLSFILPGKDTISVTLSWFLYKLCKNPYVQEKTAQEIRQTTNVEVGSTIGELVARVTEENMDKMQYLNATLNETLRLHPAVPVEGKFSSRKSMSSSRTETEPGLFDP

SEQ ID NO: 175418 - protein, 113 aa, Glycine max
  Coding DNA Sequence Number=SeqID_58640
MRMLQLHTSDIKQHIKKEASIRNTATPSGSIHRQRRNDPQYEIELGLLIPRIWSVSLNGGSKKDDAVWCRVLPAPSAFVRHENGPEKAPANDSEENRETGTDLPGSRHGSGCQ

SEQ ID NO: 175419 - protein, 255 aa, Glycine max
  Coding DNA Sequence Number=SeqID_58641
  Gene Ontology: Mol. function=translation initiation factor activity; Cellular component=mitochondrion; Biological process=translational initiation
  Homolog annotation: Hit_ID=Q9LSZ0; Match level="QueryCoverage=94%, HitCoverage=83%, E-value=2e-75, Identity=46%"; Hit description=APO protein 4, mitochondrial precursor
  Pfam annotation: Domain name=DUF794; Domain location=1-240; Score =183.5; E_value=5.3e-52; Accession=PF05634.2; Description=Arabidopsis thaliana protein of unknown function (DUF794)
MLFCPEVYIGEQGHLIQTCWGYKHCAKNWVHEWVKGGLNDILVPVESFHLDKMFQSVIRHDERFDFDHIPAVVELCWQARDDLHEENLNSSSWNLEVANGSVPGAESLSPNNLTSIANKTLTAWETLRSGVEKLLLVYPVKVCKYCSEVHAGPSGHKARFCGVFKYESWKSAHFWMKANVDNLVPPKIVWRRRPQDPPVLLNEGRGFYGGVPAVLDQCSKAGAVVPAKYNCMMKVQGLSGQVNNNFFGITRESNS

SEQ ID NO: 175420 - protein, 158 aa, Glycine max
  Coding DNA Sequence Number=SeqID_58642
  Gene Ontology: Biological process=protein modification process
  Pfam annotation: Domain name=ubiquitin; Domain location=31-100; Score= 36.5; E_value=9.3e-08; Accession=PF00240.13; Description=Ubiquitin family
MEDYPIVTEGTKVDLTIKPVEPHPNKMQITEKFSARKFDIEVDRTDTVRSLKEKIHIIDSTLIKRMTLYFSGRELDEDFRILSEYGIRGFSEIAMRDASTVGDLKQLLISRKILPVDDYLFIHKQRIMRDSCSLRWHGIENGDCLYVFKGTVSRSGYA

SEQ ID NO: 175421 - protein, 85 aa, Glycine max
  Coding DNA Sequence Number=SeqID_58643
MSNSHRCVRQRRLDKESTCPQAGRKADLAQLIAAQRVAVNRETGGQREQKLRETAMAKAVHQCDILSYERLNVGDILTDRPGEIK

SEQ ID NO: 175422 - protein, 306 aa, Glycine max
  Coding DNA Sequence Number=SeqID_58644
  Homolog annotation: Hit_ID=UPI00005F9E6C; Match level="QueryCoverage =99%, HitCoverage=77%, E-value=2e-50, Identity=40%"; Hit description =COG2128: Uncharacterized conserved protein
MERLRRQHNAQWYHETQSSVRGDAPLEPQAATLRDRFLLGLGAFADEALNAALSARAGVFNASLAGYHTLFPDQVSLSRYVTLSPYDRLSTALTVAQVTGVQSLCSHYAARLAPLHSPDASRESNIRLAQITQYARQLASQPTLICRRALQQLGDVGLSPADIVTFSQTIGFVSYQARVVAGVAALAGRPAVVVPGFPNVEDADGVDFSADELSWTARLPTIDTEAAAAEQLDVLDQSHPQARAESYYLLLAHDAAALRERNGVFNGINAEGYGLSGRLKALATLAVSRINGSRYCAATVAHEIAG

SEQ ID NO: 175423 - protein, 341 aa, Glycine max
  Coding DNA Sequence Number=SeqID_58645
  Gene Ontology: Mol. function=transporter activity; Cellular component= membrane; Biological process=transport
  Homolog annotation: Hit_ID=Q7W598; Match level="QueryCoverage=53%, HitCoverage=27%, E-value=3e-83, Identity=82%"; Hit description=High -affinity choline transport protein
MADGAVDAVADQRIQRRPQGQRQAVAEAEERQRQRHHGVDGPGVQAPVEEGDLHGFARGGRGGALAHRRRHEVHDRLGHAEEHQADAHAGREQHGEPGEVAIVGLAVVGPQLDVAIAADGQERHRKQDNGDHQDVEPTGVAQDPGLDRFEQVLRGPGRHDGKAHQQQREYRRCVEDRAVDGGWLRRWPPQSSRRAVVITITRTSTVTMPAMPRSPRPWPDCPAVWRSRAAALAAVALAEHHAAEESRQHRFGRLGADVLRIEGEAELHAVGKRQEADGQFARGQRQRRADALGKLADVLGGGVAQFAHAGDEADAELRVARRLQLGFHPQQEALVVAEMVA

SEQ ID NO: 175424 - protein, 352 aa, Glycine max
  Coding DNA Sequence Number=SeqID_58646
  Gene Ontology: Mol. function=receptor activity; Cellular component =integral to membrane
  Homolog annotation: Hit_ID=Q2HVJ5; Match level="QueryCoverage=50%, HitCoverage=48%, E-value=1e-73, Identity=67%"; Hit description=EXS, C-terminal
  Pfam annotation: Domain name=Cyclin; Domain location=203-351; Score =124.5; E_value=3e-34; Accession=PF08613.1; Description=Cyclin
  Pfam annotation: Domain name=Cyclin_N; Domain location=225-352; Score= 14.8; E_value=7.5e-06; Accession=PF00134.13; Description=Cyclin, N -terminal domain
  Pfam annotation: Domain name=EXS; Domain location=12-153; Score =120.1; E_value=6.3e-33; Accession=PF03124.5; Description=EXS family
  Pfam module annotation: Pfam domain module=Cyclin::Cyclin_N::EXS; Domain location=203-351::225-352::12-153
VATIAWLEADSVCGSHSVAIPLVLVLPYLFRLNQCLRQYKDTGEKTTLLNALKYSTAVPVIFLSALKYHVFPERWTNFYRPLWLLSGVVNSSYSFYWDVNRDWDLSNLVLRCTWTYKLSAHLRHNYLTVFFIAALEIFRRFQWIFFRVENEWNKMNSKSHSHLSVNEIPDDEEKLLHSINYSDYSNHGRPLQPETSLAELNLPRVLCVLSSMLEKLVARNEKLIDILSQELDGLNSGSVRLGNSLNTFHGVRAPSISIPKYLERIYKYTNCSPSCFVVGYVYIDRLTHRHPDSLVTSLNVHRLLVTSVMVASKMLDDEHYNNAIYARVGGVSNAELNKLELELLFLLDFRVM

SEQ ID NO: 175425 - protein, 158 aa, Glycine max
  Coding DNA Sequence Number=SeqID_58647
  Gene Ontology: Cellular component=integral to membrane
  Homolog annotation: Hit_ID=Q2HVJ5; Match level="QueryCoverage=71%, HitCoverage=24%, E-value=1e-32, Identity=59%"; Hit description=EXS, C-terminal
VNAPANSPHLRKSGSRPVVYDLDEHEVENGVEEGLLHPVEASDSKGGVIPVSAAAMMPSPVLLWRFKIEIMGPDLKDFIIFLQTGGLQVGWDSVMRMSADKRELFLYEAFLYFNPLLLAALMVWLWGINLWFFSQGGVNYAKIFDLDQNHLTHREIWK

SEQ ID NO: 175426 - protein, 102 aa, Glycine max
  Coding DNA Sequence Number=SeqID_58648
  Subcellular localization annotation: CTP_CleavageSite=40; ConfidenceScore=5.86e-01
MASTASSLLRASRSKLSSSSSASLSRTFARSAPRRSPGSSAAATRSFGSAVPRWSRGVDWRSPLGLRPHIRAAAPLIERFHRRIATSGTSPPSPIILELCCF

SEQ ID NO: 175427 - protein, 83 aa, Glycine max
  Coding DNA Sequence Number=SeqID_58649
MEDDATKFTKSKLFSKEVEVVAFKWASLMSIELSLSEVVQFEPICLQLCQAWSNKGQSGRSLCGSNAFQDYFDDAKESRVKQV

SEQ ID NO: 175428 - protein, 228 aa, Glycine max
  Coding DNA Sequence Number=SeqID_58650
  Gene Ontology: Mol. function=metal ion binding; Cellular component =intracellular
  Homolog annotation: Hit_ID=UPI00001634C4; Match level="QueryCoverage =95%, HitCoverage=51%, E-value=2e-39, Identity=43%"; Hit description =transcription factor/ zinc ion binding
  Pfam annotation: Domain name=CCT; Domain location=178-216; Score =74.9; E_value=2.6e-19; Accession=PF06203.4; Description=CCT motif
ECPNLGIHDGSELCEGFNVDNLQLNFESADEIFGCSQDATRYHLEDGGMDCLLMDKNISVTESNSLIESALEASSSIQQDCVAFQSSRAGGSASVMQVINSNTNSALMNPSCTRNISLGFPQGVHSKMPLQFPNIVGENNSTEYQDCRFSQVFLPGESPWESNLEGTCPQARDKAKMRYNEKKKTRMFGKQIRYASRKARADTRKRVKGRFVKAGEAYDYDPLGTRDI

SEQ ID NO: 175429 - protein, 146 aa, Glycine max
  Coding DNA Sequence Number=SeqID_58651
  Gene Ontology: Mol. function=receptor activity; Biological process =response to abscisic acid stimulus
  Homolog annotation: Hit_ID=Q9LRJ9; Match level="QueryCoverage=81%, HitCoverage=47%, E-value=8e-37, Identity=61%"; Hit description =Similarity to receptor kinase
  Pfam annotation: Domain name=DUF26; Domain location=91-145; Score =78.5; E_value=2.1e-20; Accession=PF01657.8; Description=Domain of unknown function DUF26
MRLVVRPCQHQNQKAYGLALCRGDVYLDTDFLGKIDNTNKFYMWNLKNVSDPATFNYKTRELLSQLAQKTYVMNNKLYATGEVKLENSETLYGLTQCTRDLSSSDCKKCLDDAINELPNCCDDKEGGRVVSGSCNFRYEIYFFVKE

SEQ ID NO: 175430 - protein, 115 aa, Glycine max
  Coding DNA Sequence Number=SeqID_58652
  Gene Ontology: Mol. function=receptor activity; Biological process =response to abscisic acid stimulus
  Homolog annotation: Hit_ID=Q9LRJ9; Match level="QueryCoverage=80%, HitCoverage=35%, E-value=9e-12, Identity=40%"; Hit description =Similarity to receptor kinase
  Pfam annotation: Domain name=DUF26; Domain location=44-100; Score =15.1; E_value=7.7e-05; Accession=PF01657.8; Description=Domain of unknown function DUF26
MSAQGLRASQLVVPLKIIILKLIYNPYSSGFVAASMGHFEDQRTYDLALCRGDNVLASECKTYVSDATKEIRNRCPYNKGATIWYDYYMFKYLDTTDFTGKVDNTIKIYMWNVNS

SEQ ID NO: 175431 - protein, 96 aa, Glycine max
  Coding DNA Sequence Number=SeqID_58653
  Gene Ontology: Mol. function=RNA-directed DNA polymerase activity; Biological process=RNA-dependent DNA replication
MKEDIEAIIEAEMELNKFFRLKDDNNVLYDDEEDVAKAMGFPDTWISLMMRCVSIVSFAMRVNGSPHREFQPQRELRQGDPLSPYLFILCVKAFPL

SEQ ID NO: 175432 - protein, 171 aa, Glycine max
  Coding DNA Sequence Number=SeqID_58654
  Gene Ontology: Mol. function=receptor activity; Cellular component =anchored to membrane; Biological process=response to abscisic acid stimulus
  Homolog annotation: Hit_ID=Q9LRJ9; Match level="QueryCoverage=97%, HitCoverage=67%, E-value=3e-47, Identity=51%"; Hit description =Similarity to receptor kinase
  Pfam annotation: Domain name=DUF26; Domain location=115-169; Score =76.8; E_value=7e-20; Accession=PF01657.8; Description=Domain of unknown function DUF26
  Pfam annotation: Domain name=DUF26; Domain location=4-58; Score=79.5; E_value=1e-20; Accession=PF01657.8; Description=Domain of unknown function DUF26
  Pfam module annotation: Pfam domain module=DUF26::DUF26; Domain location=115-169::4-58
MDQVNGLALCRGDVNATNCMACVNEATKKLQERCSKKKGAIVWYDYCLLKYSNEYFFGEIDEKNKFYMVNIYDVDDPSTFSDKVNELLSGLSYNASQTPMLYAVGELQLQESKTLYGLAQCTRDLLGPGCKKCLDDAISDLPNCCDGKQGARVVGGSCYVRYELYPIVEDP

SEQ ID NO: 175433 - protein, 137 aa, Glycine max
  Coding DNA Sequence Number=SeqID_58655
  Gene Ontology: Mol. function=metal ion binding; Cellular component =integral to membrane; Biological process=ubiquitin cycle
  Homolog annotation: Hit_ID=Q67YI6; Match level="QueryCoverage=65%, HitCoverage=21%, E-value=2e-15, Identity=51%"; Hit description=RING -H2 finger protein ATL3G
MPFLRHLYLGGNLFSDQIPPKYDTWQHLQYLALSGNKLSNNMLSGEQSLTLERMVMEPTTASPWRYRRGSSRFWSKGPSPFESLGKPRVFSSKYYRGMKSLFFWRRGFFPLSESSVRYNSRGSSLRQSKSIASPMFL

SEQ ID NO: 175434 - protein, 104 aa, Glycine max
  Coding DNA Sequence Number=SeqID_58656
MFHSQGFFKGSVKTSNNGFHVRRDAKIGSNYQGEGLELRLPQRNREGRIGGFILYRILELSLKIPLQLNCSSPCDDLKASKGSSWRSPVVSGGGGGGWGCWGRV

SEQ ID NO: 175435 - protein, 217 aa, Glycine max
  Coding DNA Sequence Number=SeqID_58657
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=2e-24, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=43; ConfidenceScore=5.37e-01
GPRLQRVARPRLQRATCPRLQRTPRPRLQRAAWPRVQRTTRPRLQKSSRPHLQRAARPHLQGPHALAFRELHFLAFRGLHVIAFRGLHAFSFRGLHALAFRGLHALAFRLHALTFKGLHILTCRGKHILAFRGLQIHAFRGLPVLPLGGLHVLAIRGLHTLAFRGVHVLAFKRVHPLALRELLVHAFRGLHVLAFKGLNTIAFRGLHALTFRGLHAL

SEQ ID NO: 175436 - protein, 72 aa, Glycine max
  Coding DNA Sequence Number=SeqID_58658
MECPRAPPRYAHVAFESYPQKNGGLREPSRGYGYHCIIKLFAAKFISWLVYWFVPKVVFSIGCVVRRRVVIG

SEQ ID NO: 175437 - protein, 103 aa, Glycine max
  Coding DNA Sequence Number=SeqID_58659
MDMNSSGGACGWLYDYGFDIPVAGSDFMASDSGGFSWGPQSYNFKGPSNMSLEMEYSLDSTVMENGPSKRLRTESCASGSKACREKLRRDKLNERHAIILHIV

SEQ ID NO: 175438 - protein, 584 aa, Glycine max
  Coding DNA Sequence Number=SeqID_58660
  Gene Ontology: Mol. function=ionotropic glutamate receptor activity; Cellular component=integral to membrane; Biological process=ion transport
  Homolog annotation: Hit_ID=Q9SDQ4; Match level="QueryCoverage=96%, HitCoverage=60%, E-value=0.0, Identity=55%"; Hit description =Glutamate receptor 3.7 precursor
  Pfam annotation: Domain name=ANF_receptor; Domain location=2-342; Score=241.1; E_value=2.4e-69; Accession=PF01094.18; Description =Receptor family ligand binding region
MVCMVPFLHSRGSDAYCTSVTSFQVLEKGVAAIIGPQSSAVAHTVSQIADALQVPLVSYAATDPTLSSLQFPFFIRTTQSDLAQMTAMADLIDFHGWKEVIVVFLDDDYGRNGVSALRDELEKRRLRISYKLPLSIKFDLDEFTNLLNQSKVFGPRVYVVHVNPDPRLRIFSIAHNLQMMAKDYVWLVTDWLSATLDSLSPVNQTSFSVLHGVVGLRQHIPDSSKKKAFVSRWIEMQKEGLANTSLNSYGIYAYDTVWAVARAIDIFIKVHNTITFSFPDNYNLSHMVGIGIQLDKLKIFAGGSDLVDILLQSNFTGVSGQLHFNSDRSIVSGGYDIINVNQMGIKGVGFWSNNSGFSVVPHTALKKRKYNRFSQDQKLGNITWPGGITDRPRGWVIADNTKPLRIGVPKRASFVEFVTELPDSHQIQGYCIDVFKKALEFIPYEVPFVFKPFGNGKANPNYDALVKMVDENVYDAVVGDIAIVTNRTMIVDFSQPFASSSLVIVAPINKARSNAWVFLQPFTADMWCATAASFLVVGVVIWILEHRVNNDFRGPPKKQIVTMLMFSLSTLFKKNRKKTFGSIV

SEQ ID NO: 175439 - protein, 145 aa, Glycine max
  Coding DNA Sequence Number=SeqID_58661
  Gene Ontology: Mol. function=transporter activity; Cellular component= integral to membrane; Biological process=transport
  Homolog annotation: Hit_ID=Q46984; Match level="QueryCoverage=100%, HitCoverage=31%, E-value=1e-68, Identity=85%"; Hit description =Hypothetical 4-hydroxyphenylacetate permease
  Subcellular localization annotation: CTP_CleavageSite=30; ConfidenceScore=5.12e-01
MGKDLGLSSTMFGLAATLFYVTYVIFGIPSNMMLSRVGARRWIATIMVLWGIASTCTMFATGPTSLYVLRMIVGITEAGFLPGILVYLTYWFPAFYRARANALFMIAMPVTMAIGSLVSGYILALDGVMNLKGWQWLFLLEGIPS

SEQ ID NO: 175440 - protein, 35 aa, Glycine max
  Coding DNA Sequence Number=SeqID_58662
RNWTILQGSLAQGRYRSLKPAQTMEKTKFYRRYLA

SEQ ID NO: 175441 - protein, 106 aa, Glycine max
  Coding DNA Sequence Number=SeqID_58663
  Gene Ontology: Mol. function=DNA binding; Biological process=DNA integration
  Homolog annotation: Hit_ID=Q1SS72; Match level="QueryCoverage=87%, HitCoverage=6%, E-value=4e-16, Identity=40%"; Hit description =Integrase, catalytic region
MSEEQDESLSVHGPYYLHPSENPTIALVSPLLDQIKNNYWSRSVLTALSVNNKVEFVDSSLPRPVSNNRLYATWKITNNLVISWLVHSVGTSIRQSILWMDNVVDI

SEQ ID NO: 175442 - protein, 196 aa, Glycine max
  Coding DNA Sequence Number=SeqID_58664
  Gene Ontology: Mol. function=RNA-directed DNA polymerase activity; Biological process=RNA-dependent DNA replication
MARQNESVLRQKARINWIQNGDYNSKFYHAYVNARRIFNLIKGLEHEGRWVKESIENIPFKCLSNDQISSLVQDFEEIEIKEAIWGCEGSKAPKSDNFNFKFFKEFWPLLKNDILLFMKKFHMHGQSAFLEGRHLIHSALAASQVVDEARRKMKSMVSVLINGSPTSEFIPKKGLRQGDPLAPLLSNVAAEALSGL

SEQ ID NO: 175443 - protein, 69 aa, Glycine max
  Coding DNA Sequence Number=SeqID_58665
  Gene Ontology: Mol. function=catalytic activity; Biological process =coenzyme M biosynthetic process
MLCYLKKVVGEESVVGASNLSDTKRMRLGGAILILLEAFPSERCHRYLQDEKGIKFFHFPYLFFLPNTT

SEQ ID NO: 175444 - protein, 114 aa, Glycine max
  Coding DNA Sequence Number=SeqID_58666
  Homolog annotation: Hit_ID=Q0KIN0; Match level="QueryCoverage=88%, HitCoverage=5%, E-value=4e-11, Identity=32%"; Hit description =Integrase core domain containing protein
MSVEPTILTNFIAFKTCYSFWKKAKIVFANEIQQLYDDAQKLATLKQIDHDMVAYVSKAQSVVDELKLSLEADKLEDIKTKLDNLYMVLVLRGMHPDFDHIHDPSINWAKKFLL

SEQ ID NO: 175445 - protein, 63 aa, Glycine max
  Coding DNA Sequence Number=SeqID_58667
MRRGEDSEGEWWLEFWSCSDTAHVFVLTLPNMELEDRWMGCFGPFRFFYSSFMNSGKHMDTYQ

SEQ ID NO: 175446 - protein, 582 aa, Glycine max
  Coding DNA Sequence Number=SeqID_58668
  Gene Ontology: Mol. function=protein-tyrosine kinase activity; Biological process=protein amino acid phosphorylation
  Homolog annotation: Hit_ID=Q0WN89; Match level="QueryCoverage=98%, HitCoverage=99%, E-value=0.0, Identity=59%"; Hit description=Protein kinase like protein
  Pfam annotation: Domain name=Pkinase; Domain location=324-574; Score =55.6; E_value=1.7e-13; Accession=PF00069.15; Description=Protein kinase domain
  Pfam annotation: Domain name=Pkinase_Tyr; Domain location=324-574; Score=48.9; E_value=1.8e-15; Accession=PF07714.7; Description =Protein tyrosine kinase
  Pfam module annotation: Pfam domain module=Pkinase::Pkinase_Tyr; Domain location=324-574::324-574
MAAALECWSRRATTTVDEDHAVLMQPPEQDPTIPQPRDSSSSSIVHKKLQKLTRNVSEAIASLKNSLNSSSTVSVESSKPDAPRSLVWTTVLRHLIHLYPGSQLPEKLVCNIRKHYDSLPLSYSKAGFEVKDVFLHMKLMEQALEDEQAAILIQEECDDEIQLQGSVFKLTFACNSPISWPAMSGALDAYSICCKKIQIFEKKCFTLGIVLLLVLSGGGQDKLVRTRVESALKIAMKRPKAGGVKLPFGLCGCQEENSKGRRLGEIEEDGWDAYCGNGFENLSQKIELQVPLPSSSFLVVVDEWQTIQSGGAEIEKWLLNSDSLEFVEQIAPNSYKGTYMGKKVGIEKLRGCEKGNSYEFELRKDLLALMTCGHRNIMQFCGVCVDDNHGLCVVTKFVEGGSVHDLMLKNKKLPSKDIVRIAADVAEGIKFKNDHGVAYRDLNTQRILLDKHGNACLGDMGIVTACKNVGEAMDYETDGYRWLAPEIIAGDPESVTETWMSNVYSFGMVIWEMVTGEAAYSAFSPVQAAVGIAACGLRPEIPKDCPQTLKSLMTRCWNNTPSKRPNFSEILAILLRSSNYNR

SEQ ID NO: 175447 - protein, 154 aa, Glycine max
  Coding DNA Sequence Number=SeqID_58669
  Gene Ontology: Mol. function=Rab GTPase activator activity; Cellular component=soluble fraction; Biological process=regulation of GTPase activity
  Homolog annotation: Hit_ID=Q9FGH0; Match level="QueryCoverage=75%, HitCoverage=18%, E-value=8e-40, Identity=66%"; Hit description =Arabidopsis thaliana genomic DNA, chromosome 5, P1 clone:MQJ2
MASSSSSKKIHADTTDKELTEQEEELEHFDDFTLASSWERFISKIEAVLRVWMSDGPKNLLEKGAVLLEDAGNLYKVKSEMKYAMKSYCMEFYFMTDPDGKLADWNFDLHDLQLCFGVKEFLVIAPQSASGVILDAPESSKLLSAIAIALSNCS

SEQ ID NO: 175448 - protein, 366 aa, Glycine max
  Coding DNA Sequence Number=SeqID_58670
  Homolog annotation: Hit_ID=Q9FGH0; Match level="QueryCoverage=25%, HitCoverage=15%, E-value=5e-25, Identity=64%"; Hit description =Arabidopsis thaliana genomic DNA, chromosome 5, P1 clone:MQJ2
  Pfam annotation: Domain name=RRM_1; Domain location=147-217; Score =34.4; E_value=4.1e-07; Accession=PF00076.12; Description=RNA recognition motif. (a.k.a. RRM, R
MVESSMEMAELENASPHEAEKWLISLRLEGSSGNRVGFASELCLLVDALQVSFEAQFMEDFVSVENPGSDNLKSMVIPPPTVRDRVLKELFIEEGEWTTVRKRGRGNLRVVSTERKDPRQSYGGARQRQYANQVYPNWRNRADITSFYFTRFPEEVHEAELWNHFKKWEDVREIFVSKQRNKEGRRYGFVRFKGVDDVSRLERQLDNTIIGGLKLHVNIPKYARGKLEKGESNNRWQGTNQKQKEGMKTIATTAAHTTVPTRTYAVILATRSGNAGQHRNKVTTQARHGGSHSSIQLDIPKEEDKWYKNAWVGRLRKPEIFERLEDELTWILGSDVTPKYLGDDMVILPGLHDAKAEELIKEEIDN

SEQ ID NO: 175449 - protein, 117 aa, Glycine max
  Coding DNA Sequence Number=SeqID_58671
  Homolog annotation: Hit_ID=Q9FGH0; Match level="QueryCoverage=91%, HitCoverage=17%, E-value=2e-33, Identity=61%"; Hit description =Arabidopsis thaliana genomic DNA, chromosome 5, P1 clone:MQJ2
MGTVFTRRFEADRIGSQVPVKLMHLEGLYELFVSKFAYSTLDLSVHNFKVRCAMKLTFRTLPYDDDNMKDAKISKSGENLTGPMCNGTQWDDDCSWSEWYSAEDPVKGKFWDVGTCM

SEQ ID NO: 175450 - protein, 297 aa, Glycine max
  Coding DNA Sequence Number=SeqID_58672
VTVDEANDGSNDPRSDRFPSGRLGTEDPLGNDQYGPTHENPVTDVTDANQTGATPDPQTDVQTCNEGQQTPKQQVTLDQIERDCADTQTEIAVNKKGRRKYRWYTTGEKRGVHTSPQPQQEKGSDWKVYSRGKGCRKKWTPTNSQQISSNPDSKDLDPQSTTRGGSTVGKQKYSTMNILSYNIRGLGRGALWGDTDLSWEIYPAINSAGGLLCIWNDGMFKAAAKRELWLSIKQIKQLHTDGKWCIVGDFNSIKHPDERLTMSQREGDSNSISEFNEWISDLEVEEVPSVGRRFTWI

SEQ ID NO: 175451 - protein, 326 aa, Glycine max
  Coding DNA Sequence Number=SeqID_58673
  Gene Ontology: Mol. function=Rab GTPase activator activity; Cellular component=soluble fraction; Biological process=regulation of GTPase activity
  Homolog annotation: Hit_ID=Q10MT9; Match level="QueryCoverage=97%, HitCoverage=33%, E-value=8e-99, Identity=58%"; Hit description =Expressed protein
MALLLDMSAFKAANPDAVFEDFIRWHSPGDWEEDDDPEGSKSSSSSALDIKKSKDSWPPQGQLSKRMSEQGNLWRKLWNSAPALPASEQKPLLDPNREGEKVLHYLETLQPHELLEQMVCTAFKAAADTLCQTSYGELKQVETEMQQLYLTMASALRPLQVNCLSGDSEIVEDLRRLTIAFEQVEKLLALAASLHRKLIQAPRVSREIFNNYYNFYIQTTGKGLIEDIGEKEFNKKQEVKDHEREVLSNMFVPPTANQSWRKVLSMGNLLNGHEPILREIILSLRDRVSGNHYAARSGSVSQQEIETYRMYICGTSNDLRVALSVV

SEQ ID NO: 175452 - protein, 102 aa, Glycine max
  Coding DNA Sequence Number=SeqID_58674
MDAALLLLWSWLKVMEKDFTMHYNQWSSQLGERKHKGEILLSHKGISLFHSGYNSMPLLVQDPFILLSPTPSNRISCLTVLSERSNRINSVLFLESFPPPIY

SEQ ID NO: 175453 - protein, 136 aa, Glycine max
  Coding DNA Sequence Number=SeqID_58675
MMFKPKAWAHKANPFSTSGAGKQMDDYVASQKGIDAPSDENPKTTQIQGPMTRSRTKQSEDTLQQMKWCHPNSVTCIKRSAPSKQTENYMASQKGIDTPRKYVQDPKRKRLRNESTKVVMWFPRFRPNTPILKGRT

SEQ ID NO: 175454 - protein, 134 aa, Glycine max
  Coding DNA Sequence Number=SeqID_58676
  Gene Ontology: Mol. function=RNA-directed DNA polymerase activity; Biological process=RNA-dependent DNA replication
MGLEDLPLIGRRFTWTRPNGKSISRIDRMLVSKEWLDLWEGSSLRALNQKFSDHCSLVLKNQKFDWGPRLFRFLNCWLEDTDFKTFMEEKWRVFNVIRRGAFVLKEKLKLLKKEIGAWNKNQFGDLNAKKKILE

SEQ ID NO: 175455 - protein, 254 aa, Glycine max
  Coding DNA Sequence Number=SeqID_58677
MEEEDGLWKKDCLCKTWERVDSMDSHSSMVGEREGPTTSQFEEDKRKNALSDGHSFGPATQKIAWCHSLPKAYNLGYGTRKLVGNGSFELGLYYHVENNMGQPPFGECFAYKEEQVQLENTSQGRIYDFGPEPITDLQLQAKVDDISHEHGSTLQSSNKTTSGEHKHNKGSVGRDFKTIRKTYFGGRKKMIKTKQIWDMAQKLGITFDGSYVGIVTSFMELDRRDIEAMEGPSRKLIYHEGDQFSCKLRLQLTA

SEQ ID NO: 175456 - protein, 120 aa, Glycine max
  Coding DNA Sequence Number=SeqID_58678
MAMENKYNFDIFFTPDLHHQSCGRPLLFSRDIFSALQRLPNCAMPHVNACGQHMTILRRVGPPLQWKVEALDGMNKYVLQPWYDFLRASDLSHGDELSFYCRIYDKIWEMVIRRKINWDR

SEQ ID NO: 175457 - protein, 151 aa, Glycine max
  Coding DNA Sequence Number=SeqID_58679
MDNLGRQQLQDNKGSHISYYCNNKVRQVHDMHKGNVEPIAYDKIWGPQYNVSHTYPINMEYCLKGVYRTYGSGRDRGIGRRHMLRVGSTSGQQYLKETKGQRVAREKNCNGIATDKHTCKDTFQGRRNYGKNAKHYQQPKQVAENEDGANK

SEQ ID NO: 175458 - protein, 273 aa, Glycine max
  Coding DNA Sequence Number=SeqID_58680
MTTTNAPIASTPSPRSLSRCTPVYSFQAVFHVDRNYIEVPRSYHKQWAPHYPAYVKIEYNGAPHIIKLLPTEVVHFVDASTPFMTVQHSSGVRDIWTISMHNGEQHVDDPWNRLLTDNDLMGGDEVQRCQHRNNGHVVVIYYTYDMTFPQGHKILLGCTKVHHFEATLDVHKNYIQVPLNYHINWYPKYPTYVVLKVNSDNSYFVRVRRYENKIYFADEIKEFRSATFHVSFSTPAYRQLSATSPVTTRRHVFTVDVDEDMLQQKKPLVGAVS

SEQ ID NO: 175459 - protein, 191 aa, Glycine max
  Coding DNA Sequence Number=SeqID_58681
MLTYLLFICSLKECIEAVAIWANLRKGVHFTKYLRDGVCFKTNNGGGLFCGGNRHCHWRHGSTRHCQWRQRRREGCIASSSGEIWPRRMERGGCRQWERRHTQLMERGGCRQWERRHTQLKPPVGLAIWPTPLLGQIFASEGCSNSRSRHVESKLPTTLNIQKFNIEESISVEEEEKVSFEESILKFAASI

SEQ ID NO: 175460 - protein, 84 aa, Glycine max
  Coding DNA Sequence Number=SeqID_58682
  Subcellular localization annotation: CTP_CleavageSite=40; ConfidenceScore=5.33e-01
MSCQLVAITFFQGICFKSSPNLSFISRSELSLLHKTVPVMTMMETQMKIQMMMMKTDGSQSQGPVNHLHHHKGGVTLKMDSGWG

SEQ ID NO: 175461 - protein, 172 aa, Glycine max
  Coding DNA Sequence Number=SeqID_58683
METQMKIQMMMMKTDESQSQGLVNQLHHHKGGVTLKMDRGWDKEEISTRPFLEGEKDDKNSRKTDLGTKVSTKPYIISTEVGSEGKLKSPSQAEEVLNGQTDNARAQNNLLKKINEKIDKICTKVSTNDENLPYLSERMEKQHHQLSKEISRLEEEWRKTTFEALLMLKKRK

SEQ ID NO: 175462 - protein, 97 aa, Glycine max
  Coding DNA Sequence Number=SeqID_58684
MYSEKSELDKETEFALNQTDSSDEESPASPILIFSIQEEQSIKPAIPQPCVEIQKPRQKLESLKKRFPPYAQTVMKISTIHILYGKTKNTLLIYHSD

SEQ ID NO: 175463 - protein, 177 aa, Glycine max
  Coding DNA Sequence Number=SeqID_58685
  Gene Ontology: Mol. function=calmodulin binding; Cellular component =integral to membrane; Biological process=cell death
  Homolog annotation: Hit_ID=Q2HSW1; Match level="QueryCoverage=97%, HitCoverage=28%, E-value=3e-37, Identity=51%"; Hit description=Mlo -related protein
MGVLVQFLCSYVTLPLYALVTQMGSTMKPTIFNERVARALRNWHHTAKKHVKQNRGLQLQTPSSAPSTPNQPKSQANLLRQCHSEMYTYPTSPIRFDSEAHHPYEIDSPPSSISHHHKSKVNASSSSSIHHHEIEMGHLDHDPPQNINEPNSTLVSSGSNQHEIDIEHKKEFSFEKR

SEQ ID NO: 175464 - protein, 189 aa, Glycine max
  Coding DNA Sequence Number=SeqID_58686
  Gene Ontology: Mol. function=sugar binding; Cellular component =histone methyltransferase complex; Biological process=histone H3-K4 methylation
  Homolog annotation: Hit_ID=Q9LJC6; Match level="QueryCoverage=50%, HitCoverage=17%, E-value=7e-41, Identity=80%"; Hit description =Retinoblastoma-binding protein-like
  Pfam annotation: Domain name=WD40; Domain location=14-51; Score=24.1; E_value=0.00049; Accession=PF00400.22; Description=WD domain, G-beta repeat
  Pfam annotation: Domain name=WD40; Domain location=58-95; Score=23.0; E_value=0.0011; Accession=PF00400.22; Description=WD domain, G-beta repeat
  Pfam module annotation: Pfam domain module=WD40::WD40; Domain location=14-51::58-95
MNAPIIDPLQGDFPEVIEEYLEHGCMKCIAFNRRGTLLAAGCNNGSCVIWDFETRGIAKELQDDECSSPITSVCWSKCGNRILVSAADKSLLLWDVMSVSLPLPLVSLHHATAPQFHLATAAFTSFDTTSPRYIKQHAMYLPWRGSHLAIMEDGSKALLVISATESCSWYAFSAVITGAYEESMKWILG

SEQ ID NO: 175465 - protein, 100 aa, Glycine max
  Coding DNA Sequence Number=SeqID_58687
MKLIITQNTNDGQIRTEIYVPEPEFQKVKDLVDDYFALEQDWKDYNAQLIEKLLHKKRYHYHHPVYGSLTRSEVCCKESNLQDKDDRNPILVIVCHVSVV

SEQ ID NO: 175466 - protein, 133 aa, Glycine max
  Coding DNA Sequence Number=SeqID_58688
  Gene Ontology: Mol. function=calmodulin binding; Cellular component =integral to membrane; Biological process=cell death
  Homolog annotation: Hit_ID=Q2HSW1; Match level="QueryCoverage=91%, HitCoverage=23%, E-value=3e-20, Identity=42%"; Hit description=Mlo -related protein
MGGKTLQETPTWAVAVVCFVLLSISILIEHILHLIGKWLKKKHKRALCEATRKDQIRAYAIGVHIVAPNEKVAGTFHPCPKKYYKKKEESEHRTNNGRRLLAAFLDSDNQNHRRILAAGGGDNCPPVCMYSCI

SEQ ID NO: 175467 - protein, 224 aa, Glycine max
  Coding DNA Sequence Number=SeqID_58689
  Gene Ontology: Mol. function=protein disulfide oxidoreductase activity; Biological process=cell redox homeostasis
  Homolog annotation: Hit_ID=Q941V7; Match level="QueryCoverage=96%, HitCoverage=83%, E-value=2e-40, Identity=43%"; Hit description =Glutaredoxin-like
  Pfam annotation: Domain name=Glutaredoxin; Domain location=86-153; Score=60.9; E_value=4.1e-15; Accession=PF00462.14; Description =Glutaredoxin
  Subcellular localization annotation: CTP_CleavageSite=68; ConfidenceScore=5.34e-01
MLQPWNKPRSSPFSCSSFKDIQTLFLDEPTTTKPKPSIFHRVTLANSLLRAWSTNPKISSRAHDEAPRAAQPHPPPSILRSEQRVVVYFTSLRVVRATFEDCKTVRSILRGFRVALDERDVSMDSGFLSELRRVTGHKSGLTLPRVFINGRYVGGAEELRWLHESGELKKLLEGLPAVDSHLRVCHVCDDHRFVLCGECSGARKVYAEKGGFKTCTACNESGLI

SEQ ID NO: 175468 - protein, 126 aa, Glycine max
  Coding DNA Sequence Number=SeqID_58690
  Gene Ontology: Mol. function=calmodulin binding; Cellular component =integral to membrane; Biological process=cell death
  Homolog annotation: Hit_ID=Q2HSW1; Match level="QueryCoverage=95%, HitCoverage=22%, E-value=7e-22, Identity=44%"; Hit description=Mlo -related protein
  Subcellular localization annotation: CTP_CleavageSite=65; ConfidenceScore=5.51e-01
TALRKWHHTAKKNVKQNRGLRLQTPSSTRPTTPNHPKSQVNFLRRYHSEMAPYPSSPIRFDFEANLSYEVNATSSSIHHHEMEMGHQAYDHAEKVDEPSSTLVGLSLPQREIDIEHGKEFSFDNKE

SEQ ID NO: 175469 - protein, 165 aa, Glycine max
  Coding DNA Sequence Number=SeqID_58691
  Gene Ontology: Mol. function=transition metal ion binding; Cellular component=chromatin; Biological process=cytoskeleton organization and biogenesis
  Pfam annotation: Domain name=Transposase_21; Domain location=39-165; Score=52.1; E_value=4.7e-19; Accession=PF02992.5; Description =Transposase family tnp2
MDKCPRCQVSRYKVKDDDECSSDKSTKKGPQQRCYDDAKDLTWHVDGRNCDGMLCHLTDSSQWKKINCLHSDFGIEARNLSLGLTTDRMNPCGSLKNDIDVYLSPLIEDLTKLWDERVAVFDGYRNETFKLHAMLFCIINDFPAYGNLSGYSVKGHHASLFVKKT

SEQ ID NO: 175470 - protein, 57 aa, Glycine max
  Coding DNA Sequence Number=SeqID_58692
  Gene Ontology: Mol. function=calmodulin binding; Cellular component =integral to membrane; Biological process=response to biotic stimulus
  Homolog annotation: Hit_ID=Q5BMD0; Match level="QueryCoverage=91%, HitCoverage=9%, E-value=4e-22, Identity=88%"; Hit description=MLO1
MGQRIQQRGEVVKGVPLVQPGDDLFWFNKPRLILYLINFVLFQNAFQLAFFSWAADL

SEQ ID NO: 175471 - protein, 98 aa, Glycine max
  Coding DNA Sequence Number=SeqID_58693
MDDYVISKKTKVYLVNRGVQIATRPTWAFQEVLQKAVPSKGSNRTHLGELGGKVLPHFPINRGRREEQKCSTLLVSENHLKLVRKIVSVKKIQAEALS

SEQ ID NO: 175472 - protein, 92 aa, Glycine max
  Coding DNA Sequence Number=SeqID_58694
  Subcellular localization annotation: CTP_CleavageSite=15; ConfidenceScore=5.23e-01
MGKWLTTESSGRPVRGSSGSSGRTFSGKFPEEVFFRKLPENVFRELSGRSGSSGRIPEDAHFRKKFQTSGRPFRKNPSSGVFPEEPLLPEIL

SEQ ID NO: 175473 - protein, 310 aa, Glycine max
  Coding DNA Sequence Number=SeqID_58695
  Gene Ontology: Mol. function=transporter activity; Cellular component= outer membrane-bounded periplasmic space; Biological process=transport
  Homolog annotation: Hit_ID=Q2K158; Match level="QueryCoverage=79%, HitCoverage=74%, E-value=1e-78, Identity=56%"; Hit description =Probable amino acid ABC transporter, substrate-binding protein
MQARQRDGVLTVALGEGLRSGTAVKVWWPERTMPKTVRVDGRSVSDFDAEGSAGPRPASLQRRQPRRIGLRLRHRFLGHIPSLQRLRIGAAADLGIQRLRHRVGQAAALARGHRNRRSVRPSPWEQANTPHLAIACRISAGGIGLERDIGAAGDHRQAADHRVVEVLVLHRLQAGSDVLLVPLAQDLVLVRAGAHHHLQPGDVGGLFDLLYRPIGARVDAQQVVAITGEIELFLALLSDRHIGEHRIVLARFQPQRPVRPGHRHDHQLQAQPIGDQPRDVRLDADHVLAVGTIDGQRQLPRMSGNGECAG

SEQ ID NO: 175474 - protein, 168 aa, Glycine max
  Coding DNA Sequence Number=SeqID_58696
MLGRGEEELTRIPWLILTQLIVLFLLFALLFFFTLLPFDPDHDHHNNLVTADIPPPTTTTSSTLFFFDDIQIHQIDSPLTNHDSSPTHPTTTLQGGQNLLIKGEIAKGPSSSMRREEEIMEEEEEASSLYFHPCHYFQLATVAFLKCFGLDSTSDSPSTRRHRKRKES

SEQ ID NO: 175475 - protein, 411 aa, Glycine max
  Coding DNA Sequence Number=SeqID_58697
  Gene Ontology: Mol. function=transmembrane receptor activity; Cellular component=membrane; Biological process=defense response
  Homolog annotation: Hit_ID=Q9FVK2; Match level="QueryCoverage=50%, HitCoverage=58%, E-value=9e-63, Identity=62%"; Hit description =Resistance protein MG13
  Pfam annotation: Domain name=TIR; Domain location=14-142; Score =105.4; E_value=1.6e-28; Accession=PF01582.10; Description=TIR domain
MALRSGFSSFTYDVFLSFRGSDTRHGFTGNLYKALADRGIYTFIDDEELQSGKEITPTLLKAIQESRIAINALSINYASSSFCLDELATILGCAERKTLLVLPVFSHVRHREDSYGEALVKHEERFEHNTEKLQKWKMTLYQVALLSGYHFKYGYPPYRSSLHYGYEYEFIGRIVERVCIKINLTHLHVAGYLVGLESQVPRAMKLLDVGSDDVGWLIQGKFKEYIFLTTEYFPHGSTRHSVMSELLYPYRRIRLSTRQLLNQQPLHLQKIRGIPPNLRFFFAINCKSLTSLGTSMFLNQELHEAAGTTVFHFPEARILECPKPMVFINVKAHESVISWGDEMVTYVGVIKTSILKASGVHVIKQERSTEDIQFAGLECSFGVHVGVQIVVSVVTKKTNLLVFEKLNAIGL

SEQ ID NO: 175476 - protein, 360 aa, Glycine max
  Coding DNA Sequence Number=SeqID_58698
  Subcellular localization annotation: CTP_CleavageSite=53; ConfidenceScore=5.04e-01
ACAVRHDCIALCVSHTEMQSALRFHFQASNPGIVVPHTNHAFATNLNSHRTLSCTKRRSLPLCSFTAQPSNQTSAVGSPSLQHWNLTNRHVTVLNVFACATAICATWLFCSAIPTLLAFKKAAESMEKLMDATREELPNTMAAIRLSGMEISDLTTELSDIGQEITQGVRSSTRAVRLAEERLRRLTTVPSSASLQGMTINPKAEYDDDEPAVARTARGVREGIVKGRATLQMFFTLTRFSRFALNFITDEKWLIWARPALNGGLGGLLIARDVVDVTHPSLAEVGSRPRQLEKAFTTCSIKWHVNLVNLNIVEKEESGRGCRRRRGNVGGDKVVVVVVVGIKREEGEEKEECEEEKEDY

SEQ ID NO: 175477 - protein, 114 aa, Glycine max
  Coding DNA Sequence Number=SeqID_58699
RVNFKVWKASFSSTEAQSSQAGILDSGGYHCCGLRLHNQEPTRQDMYSRHRRRRHARRYLKQRRLQQHRTKKERELETRERKRREASKEIRRVAQRPSQRERRIAVIVIPMRGA

SEQ ID NO: 175478 - protein, 72 aa, Glycine max
  Coding DNA Sequence Number=SeqID_58700
MELQLTRVKENTGWVGDLAAELTGIAVVWWTTLFSLYSAVAGSIIRFTALGFMNNIFGFGEKKMPPISFSFF

SEQ ID NO: 175479 - protein, 1152 aa, Glycine max
  Coding DNA Sequence Number=SeqID_58701
  Gene Ontology: Mol. function=receptor activity; Cellular component =cytoplasm; Biological process=ubiquitin cycle
  Homolog annotation: Hit_ID=Q1S9C4; Match level="QueryCoverage=99%, HitCoverage=92%, E-value=0.0, Identity=82%"; Hit description=Zinc finger, RING-type; SPla/RYanodine receptor SPRY
  Pfam annotation: Domain name=SPRY; Domain location=147-269; Score =132.3; E_value=1.3e-36; Accession=PF00622.18; Description=SPRY domain
MSEDSPRVGGFSAGLAVILNGKDGKKNSPKTRLISCCDDLGQQSVERTLEYVFGLPNRSLNSLTGPVDRDFIRSVIRNDFSRYNGKSNYSYRERDGICVNGKNGNGPDVIGLEESSICGDIKVIKSPFLIESMAMFSSARASACVWKGKWMYEVMLETSGIQQLGWATLSCPFTDHKGVGDADDSYAYDGRRVSKWNKDAETYGQSWVVGDIIGCCIDLDRDEIIFYRNGNSLGVAFQGIRKLGPGFGYYPAVSLSQGERCELNFGARPFKYPVEGYLPLQAPPSRSYFVTQLLQCWSRLLDMHSVERAEHSLARKLRRVKRSVSLEEIFHPASYSICEELFSILEADVGITEYMVWGPMLSFMFEVFGLHAPHDYLSLDKVVEVLLQFQGSHVLFEHILNALSCGCKIASLVLTECPYSGSYSHLALACHLLRLEELMVLWWKSPDFEFLFEGFLSRKTPNKQDLDSMIPTVWWPSSCEDASHEGNMMLTTTALSESISKIEEKHRDLCRLVIQFIPPTNPPQLPGAVFRTFLQSLLLKNRGAQRNIPPPGVSSNSVLVSIYTVVLHFLSEGFALGDICGWLKTCKTDVGFLHRGGEQSFPVHLFLKNDPHRADISRLGGSYSHLSKLHPTIGHEMEVIQWDEGCMDSEETRVTHSTRQKPCCCSNYDSDFTRNFKVPAKYLAKGSRGHCSSIPERPAHVAAECSDGSLNDEITDKPSSSDQSEPEYGYRQMHHMKSVPKDTNMSTDRLREEELVDALLWLYHVGLALNFKQASYYMTHQAQSISLLEETDKQIRERACSEQLKHLKEARNEYREEVIDCVRHCAWYRISLFSRWKQRGMYAMCMWVVQLLLVLSNMDSVFIYIPEYYLEALVTFVVTHFNDPRISSADLRDLLLQSISVLVQYKEYLATFESNEAATQRMPKALLSAFDNRSWIPVMNILLRLCKGSGFSFSKNGESSSSSVLFQRLLREACISDGGLFSSFLNRLFNTLSWTMTEFSVSVREMQEKYQVIEFQQRKCCVIFDLSCNLTRILEFCTREIPQAFLSGPDTNLRRLTELVVFILNHITSAVDAEFFDLSLRRHSQPPEKVNRGMILAPLVGIILNLLDATSSAEYRENNDLLDVFASMDCPDTVQYGFQYLLDYNWVSCCHP

SEQ ID NO: 175480 - protein, 390 aa, Glycine max
  Coding DNA Sequence Number=SeqID_58702
  Homolog annotation: Hit_ID=Q1S9C5; Match level="QueryCoverage=80%, HitCoverage=57%, E-value=1e-97, Identity=58%"; Hit description=HYS1 -related
MEIMSSKLTLNKEECSGDIVTEVGHSRHAEIQDQSISHDSPEEVRDNFHIDSIGRDSPEEGRDNIHNNSVSLDSPEESRDNFHMGSVSRDLTLYGQSNQMVSFSQISFGSVNNPMVSIFEKSIMEQCRSNDLKTLELGLKMKELKLKEDELALNLDSNNLNRSKLVMGESKQSFKEEKFKTQLEDTRHGELKKKCIDCLITGLLIMSSSLLYGAYVYSYERITKATESCTPSTQARIFLLVDSQVNGLIQFKVAYFVVSSSSYEPNGIWHLDDFCCCIFALAAVDHNITDYASHFHPFNVGNFLWLLWQAMCRDIGWEWYCVALILGDYVLAAFLISLLDIRFVPDPSWTSHSITNNGGEYNSSVLDSQSSVLCCYACVSTVVLWSHAIC

SEQ ID NO: 175481 - protein, 271 aa, Glycine max
  Coding DNA Sequence Number=SeqID_58703
YTDNVLGRNILPERKVELYHTELDDFKAELERHNFHKHLTNLADGSIDLALVKEFYANLYSFEDHPPKQSRVRDHLVKIDADSLNTFLETPVITESHPGKILRKDLTTLAQVWSVLSYSNLAPISHTSNLKVDGARLIFGLVSHLDMNIGALISDQMTSIAQSNTSRLGFPALITALCRAREVVSDSLTFERLSPVINLAYIRKNCWNPEDLTVSIRGARRARERQAELPSTSAAPTLASTSAAPSVPAQTNYQRFEAMLQSIHQGQIILL

SEQ ID NO: 175482 - protein, 106 aa, Glycine max
  Coding DNA Sequence Number=SeqID_58704
  Subcellular localization annotation: CTP_CleavageSite=31; ConfidenceScore=5.47e-01
MMHAPDSTLKCNVVRTNNNQISGNSLSVSTRHSHLGNCAEFVETTRVCTLSQNALLREREARLTGALSKGGKMREVATNVYLWKTSEKPKETGQKEYSKFGSCIYV

SEQ ID NO: 175483 - protein, 233 aa, Glycine max
  Coding DNA Sequence Number=SeqID_58705
  Gene Ontology: Mol. function=transferase activity, transferring phosphorus-containing groups; Cellular component=outer membrane -bounded periplasmic space; Biological process=two-component signal transduction system (phosphorelay)
  Homolog annotation: Hit_ID=UPI00005FA92A; Match level="QueryCoverage =81%, HitCoverage=17%, E-value=5e-42, Identity=48%"; Hit description =COG0834: ABC-type amino acid transport/signal transduction systems, periplasmic component/domain
  Pfam annotation: Domain name=Hpt; Domain location=135-216; Score =49.0; E_value=1.6e-11; Accession=PF01627.13; Description=Hpt domain
  Pfam annotation: Domain name=Response_reg; Domain location=1-103; Score=15.6; E_value=0.00022; Accession=PF00072.14; Description =Response regulator receiver domain
  Pfam module annotation: Pfam domain module=Hpt::Response_reg; Domain location=135-216::1-103
MERQLRHFGLQPARFEQGYALLKAQRRQPFDLLFIDYNMPRPDGLTLARLIRRDEQRLQRPPCRIVLCSADVQEFTRIPPGLVAIDHFLTKPISLAAIGQVLAQQPQVQEAKSVLTDLRQTLVEMAGGDRAMLQRLAQTLGDTLRQDRQRLADAVAANDWPRLEQAAHRIKGSLLMLQLPEAAQLCQQLVETARRGALAAAAYTKLKALVAQIVPELDALLAAAPSLAMHKDE

SEQ ID NO: 175484 - protein, 38 aa, Glycine max
  Coding DNA Sequence Number=SeqID_58706
MEGFAMNTLSAPTALSLFIATVKIFQVSDDHAKRTMSR

SEQ ID NO: 175485 - protein, 155 aa, Glycine max
  Coding DNA Sequence Number=SeqID_58707
LPEASLPNRPTYNSKPQETQHKDVEAKVEYVKRLYDQVKVQIAEKNESYAKQANKKRKEVVLEPGDDPGHLRANVFQEGGNDENPKIGQIQAKGPNGEGQSPRVEKDEGPEAETLSRLLITYQGNPCGVYPDLSSFTGSGVIQISVACIKRSAPS

SEQ ID NO: 175486 - protein, 179 aa, Glycine max
  Coding DNA Sequence Number=SeqID_58708
MSLGNYFLKIPSGVIRLNPSTERSFNYFSSLEKFFLQESTASFILPHYEVVKTRQQLVPLSPTLGATKGHHAKTSSEPRGQIRSIHPIGSLLQVCIYQNFTTKVACICIPKNYVNCIDFLHLMSKSCGFGMTGPLDESISCFLIRVDPWVLVPITFRGLHVLALRGLHALTLGTSYPHR

SEQ ID NO: 175487 - protein, 343 aa, Glycine max
  Coding DNA Sequence Number=SeqID_58709
  Gene Ontology: Mol. function=fumarate hydratase activity; Cellular component=membrane; Biological process=generation of precursor metabolites and energy
  Homolog annotation: Hit_ID=Q0VPB0; Match level="QueryCoverage=99%, HitCoverage=72%, E-value=1e-133, Identity=66%"; Hit description =Fumarate hydratase, putative
  Pfam annotation: Domain name=Fumerase; Domain location=1-151; Score =110.8; E_value=3.9e-30; Accession=PF05681.4; Description=Fumarate hydratase (Fumerase)
  Pfam annotation: Domain name=Fumerase_C; Domain location=153-334; Score=267.3; E_value=3.1e-77; Accession=PF05683.2; Description =Fumarase C-terminus
  Pfam module annotation: Pfam domain module=Fumerase::Fumerase_C; Domain location=1-151::153-334
MVAGDKVEVQVAAKGGGSENKSKLAMLNPNESIVDWVLEVVPEMGAGWCPPGMLGIGIGGSAEKAMLLAKESLMAPIDIQELQARGPQNRIEELRLELYEKVNQLGIGAQGLGGLTTVLDVKILDYPTHAASLPVAIIPNCAATRHVHFTLDGSGVAELTPPNPDVYPDVHWAPSPQAKRINLDTVTPAETQTWKTGDTLLLTGKILTGRDAAHKRIQTMLAKGEPLPVDFTNKFIYYVGPVDAVRDEAVGPAGPTTATRMDSYTDMMLNTGLLGSIGKAERGEEALAEIAKHKSVYLMAVGMEAIYEFEVVDMPVTVAVSADGESVHQTGPAQWKKTIALQA

SEQ ID NO: 175488 - protein, 56 aa, Glycine max
  Coding DNA Sequence Number=SeqID_58710
  Gene Ontology: Mol. function=ribonuclease H activity; Biological process=DNA integration
  Homolog annotation: Hit_ID=Q1S8I9; Match level="QueryCoverage=98%, HitCoverage=16%, E-value=9e-20, Identity=66%"; Hit description =Probable integrase-common tobacco
MESQPPQGVLSPYHTPKRRGLPLLRYALKCDTHAKHTLQLRHSSEVCKEKNCDAQS

SEQ ID NO: 175489 - protein, 70 aa, Glycine max
  Coding DNA Sequence Number=SeqID_58711
MDAWGANTFPEMAPRKLLAKRSKKDIVGEGSSAAPQANVDFNSHRSKVPNTNSGLRPSMAGRSSERRRVC

SEQ ID NO: 175490 - protein, 132 aa, Glycine max
  Coding DNA Sequence Number=SeqID_58712
MVKEECKEVSVSSKRLTMKERNFEIKTNIKEIFPLRQPPHFLLFKKTRVSIATPLRLEFIPQVQELLDEGLVRKSLNPCALLVPKIGIIRHRIPKIGGVEGRSPEYEEPRDLRSNPLQGGGNDAILSRRGIG

SEQ ID NO: 175491 - protein, 126 aa, Glycine max
  Coding DNA Sequence Number=SeqID_58713
  Subcellular localization annotation: CTP_CleavageSite=40; ConfidenceScore=5.71e-01
MAPSLTSSPLSSAASPCLHRSPTSKLPSSRKRKSTASRPQAQYDTRRFHSLDAWNRYMDNILGRNILSEKNVQIYHTEFDEFKVELERRPTMVASQKRSDDTGPEMECLLLLQPSSHTPHFRSKYG

SEQ ID NO: 175492 - protein, 246 aa, Glycine max
  Coding DNA Sequence Number=SeqID_58714
  Gene Ontology: Mol. function=chitin binding; Cellular component =extracellular region; Biological process=chitin metabolic process
  Homolog annotation: Hit_ID=UPI000044A8F0; Match level="QueryCoverage =64%, HitCoverage=99%, E-value=7e-17, Identity=32%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=5; ConfidenceScore=5.56e-01
ATRPRLRRATCPHLPRTTCPHLQRTTRPRLQRTTRPRLHLPRTSCPHLHRTTRTRLQRTTHPCRRLHRATRPHLLRTTCPYHLTIRGLHVLAFRGQHVLAFTFVGLHALTFRGLHVLAFRGLHVLTFNGLHAQAFKGRHVLNFRGLHALAFRGLHVLTFRASNFLLSIPGPPPDPGGGPTMQIQPEEEAIVQLLCILGQDFTHATAKRQVQIMRTNMTTLTQIWMTLLLSSILSNNHNADLPLWKY

SEQ ID NO: 175493 - protein, 58 aa, Glycine max
  Coding DNA Sequence Number=SeqID_58715
MICPLRCHEGMHDVIKEQARGISAKMHRQKRKTLYEASPLSSESENQHDDKSTSTPYC

SEQ ID NO: 175494 - protein, 268 aa, Glycine max
  Coding DNA Sequence Number=SeqID_58716
  Homolog annotation: Hit_ID=Q0WS93; Match level="QueryCoverage=99%, HitCoverage=39%, E-value=2e-88, Identity=57%"; Hit description =Putative auxin-independent growth promoter protein
SFRPPPTRSEKELKEEWKKAGPRPRPLPPPPGRPIYQHEKEGWYAWITETPTEPDPSPMDLRMKAHRLLWDALDYIVSLEADAFFPGFNNDGSGWPDISSLVMGHRLYETASFRTYRPDRKVVAELFNTTRENLYHPKHNWTILVQEHLNKSLTEEGLIRQSLLSKPAMFLSHPFPECSCRIASTKATNHVKGENGQVLYGGEDICPKWMQHANDAGKLEKEGVKSQDEGLADYESNDFVDESESDKNGSKTSQTPLWDQDEEMDPND

SEQ ID NO: 175495 - protein, 81 aa, Glycine max
  Coding DNA Sequence Number=SeqID_58717
MNNNNERRRKEPPKSVQLLRKVKGGGGGGGEGAAEYYLRRGKIREKTKGGEGGAKRRRSVIAPMEVVFVRFGSIGLVDGKG

SEQ ID NO: 175496 - protein, 73 aa, Glycine max
  Coding DNA Sequence Number=SeqID_58718
MAMGSFFAAAPAVAAAVGFYFIDRNFVKEIKQGSSVSNLKMLAEVKERAKTLQKPKLAPQLDGLHCFETLVMN

SEQ ID NO: 175497 - protein, 328 aa, Glycine max
  Coding DNA Sequence Number=SeqID_58719
  Gene Ontology: Mol. function=nucleotide binding
  Homolog annotation: Hit_ID=Q0WS93; Match level="QueryCoverage=93%, HitCoverage=46%, E-value=1e-123, Identity=70%"; Hit description =Putative auxin-independent growth promoter protein
  Pfam annotation: Domain name=DUF246; Domain location=30-327; Score =304.1; E_value=2.6e-88; Accession=PF03138.5; Description=Plant protein family
MSKALYNLYLTRPQHRFCWFPKEQSNGFIYAKVFGGFAKIRSSIPDLVAISRILNATLVIPEFQESTRSKGISSKFKSFSYLYNEEQFITFLKNDVIIAKSLPESLMERRRRNEIPTFKPTSSASLNFYIEEILPKLKKSKVIGLIIADGGALQSILPLSMAEIQRLRCRVAFHALQFRPEIQTLGRRMVHKLRALGQPFLAFHPGLLRETLAYNGCAELFQDVHTELIQHQRSQMIKEGILKDELNVDSHLRREKGLCPIMPEEVGILLRVMGYPAKTIIYLAGSELFGGQRALIPLRSMFINTLDRTSLCSEKELSDLVGPETPLP

SEQ ID NO: 175498 - protein, 138 aa, Glycine max
  Coding DNA Sequence Number=SeqID_58720
  Gene Ontology: Mol. function=structural constituent of ribosome; Cellular component=intracellular; Biological process=translational elongation
  Homolog annotation: Hit_ID=Q307Z7; Match level="QueryCoverage=99%, HitCoverage=100%, E-value=9e-17, Identity=39%"; Hit description =Acidic ribosomal protein P1a-like
  Pfam annotation: Domain name=Ribosomal_60s; Domain location=21-137; Score=97.5; E_value=4.1e-26; Accession=PF00428.9; Description=60s Acidic ribosomal protein
MDSGVQGCILATLILHDEEIPVTAEKINALLKASNVSAESYWPSLFAKLAQNKNIEDLILNAGGGGGAAAAVAAPAAGGGAAAAAAPAAEEKKGLLIFVTEHTYSCSTRNFVKLVIGYFLLEEVKEESDDDMGFGLFD

SEQ ID NO: 175499 - protein, 111 aa, Glycine max
  Coding DNA Sequence Number=SeqID_58721
MPFLTKIKWVVLSVVTLSLASIIIHLSLTKLWAVNIVQYKALPSLPEEFGSVLGRQVIKNKKLWGSIESLETLQPNANARSNYSVDGANLVGLSILDNFANKRKYMGDFAN

SEQ ID NO: 175500 - protein, 186 aa, Glycine max
  Coding DNA Sequence Number=SeqID_58722
  Homolog annotation: Hit_ID=Q9FLV2; Match level="QueryCoverage=26%, HitCoverage=16%, E-value=1e-09, Identity=61%"; Hit description =Arabidopsis thaliana genomic DNA, chromosome 5, TAC clone:K18P6
  Subcellular localization annotation: CTP_CleavageSite=52; ConfidenceScore=5.59e-01
MSTILAELFCMGATLSKTNKKCPRKQTNPKIFLASSAAATTTTSSKSSAPVPAPAAPSSDALVPEVEDEPAADRDEDEEEGNELKGFTKSEVTVIDTSCPGWKVDKFVFRKNNVWKVRERKPKNRFLAKRKSNSTFAPREVDVNAIENSNGNVGVLLTVLSSHARKFLLGFDNDLMKNKIATSSAM

SEQ ID NO: 175501 - protein, 292 aa, Glycine max
  Coding DNA Sequence Number=SeqID_58723
  Homolog annotation: Hit_ID=Q9FGE4; Match level="QueryCoverage=66%, HitCoverage=72%, E-value=1e-47, Identity=55%"; Hit description =Arabidopsis thaliana genomic DNA, chromosome 5, BAC clone:T31K7
MRPHSSAPVQLKQKVGPEELTTTEMRHNDPPLSAGSPPHGPLRLLPSLLLEAPHRWFHPLPLPASIPQNPRHVPHNDNNNLNILEKQQQPQFPPPSPPPQLRVPAVALGMAEAAAPLGILRLGETSLADSTPPVRTVHVVLVRVTGKHGRILVESHQDLSDGSVRKRGRPLSEKMKPNEDPESAAVRGIMEELGSAIGGGAKNFEIDDIVTIDPNSYEMRVEERDSGSYPGLPGCYVLHTLSATVECLPEGDFCTYEVDEYGGVFEDKIVADEAVSVKKHYWTWVSADSIGT

SEQ ID NO: 175502 - protein, 60 aa, Glycine max
  Coding DNA Sequence Number=SeqID_58724
MGSGGGTGIIFETLSSALFKKSLLAKPATTLRYIIYHDLQKGQMRKTVLESIYRSSASGI

SEQ ID NO: 175503 - protein, 374 aa, Glycine max
  Coding DNA Sequence Number=SeqID_58725
  Gene Ontology: Mol. function=protein binding; Cellular component =cytoplasm; Biological process=multicellular organismal development
  Homolog annotation: Hit_ID=Q9M610; Match level="QueryCoverage=84%, HitCoverage=100%, E-value=1e-149, Identity=75%"; Hit description =Ttg1-like protein
  Pfam annotation: Domain name=WD40; Domain location=118-156; Score =13.4; E_value=0.81; Accession=PF00400.22; Description=WD domain, G -beta repeat
  Pfam annotation: Domain name=WD40; Domain location=160-197; Score =27.3; E_value=5.5e-05; Accession=PF00400.22; Description=WD domain, G-beta repeat
  Pfam annotation: Domain name=WD40; Domain location=231-270; Score =33.1; E_value=9.6e-07; Accession=PF00400.22; Description=WD domain, G-beta repeat
  Pfam annotation: Domain name=WD40; Domain location=62-106; Score=3.3; E_value=15; Accession=PF00400.22; Description=WD domain, G-beta repeat
  Pfam module annotation: Pfam domain module=WD40::WD40::WD40::WD40; Domain location=118-156::160-197::231-270::62-106
MENSTEESHLRSENSVTYESPYPIYGMSFSPSHPHRLALGSFIEEYNNRVDILSFHPDTLSVTPHPSLSFDHPYPPTKLMFHPRKPSPSSSSDLLATSGDYLRLWEIRDNSVDAVSLFNNSKTSEFCAPLTSFDWNDIDPNRIATSSIDTTCTIWDIERTLVETQLIAHDKEVYDIAWGEARVFASVSADGSVRIFDLRDKEHSTIIYESPHPDTPLLRLAWNKQDLRSPTTPVAELERHRGSVNAIAWAPHSSTHICSAGDDTQALIWELPTLASPTGIDPVCMYSAGCEINQLQWSAAQPDWIAIAFANKMQLLKLCKLVCPPHVLLVAKLTMFNLSVKDGFLTCCEAFVWGYFNDKFPFSVHCRAPELLLL

SEQ ID NO: 175504 - protein, 737 aa, Glycine max
  Coding DNA Sequence Number=SeqID_58726
  Gene Ontology: Mol. function=two-component response regulator activity; Cellular component=nucleus; Biological process=two -component signal transduction system (phosphorelay)
  Homolog annotation: Hit_ID=Q2HTB9; Match level="QueryCoverage=91%, HitCoverage=98%, E-value=9e-92, Identity=35%"; Hit description =Response regulator receiver; CCT
  Pfam annotation: Domain name=CCT; Domain location=673-711; Score =75.2; E_value=2e-19; Accession=PF06203.4; Description=CCT motif
  Pfam annotation: Domain name=Response_reg; Domain location=50-188; Score=57.8; E_value=3.5e-14; Accession=PF00072.14; Description =Response regulator receiver domain
  Pfam module annotation: Pfam domain module=CCT::Response_reg; Domain location=673-711::50-188
MPEVVMSGEKNSLGVEGLAKEDSGGSGSKGGAAHLKGFMRWEKFLPKMILRVLLVEADDSTRQIIAALLRKCSYKVAAVPDGLKAWELLKGRPHNVDLILTEVDLPSVSGYALLTLIMEHEICKNIPVISMISKINVLAAMEFSSFVNNTSMMSSQDSISTVYKCMLRGAADYLVKPIRKNELRNLWQHVWRRQSSTTGINGPQDESVAQQKVEATAENNAASNRSSGDAACIQRNMELIEKGSDAQLFEDICSKDKEQHHQSSCTKPDCEAESGPVDNIDNIQEFSPLKCGEAYPSGTETQQVETSIRLGQTLMMHASHAGGLNVSICKNGEASTTDADPEHFGNGISGEAHDNHYVQMNSSKEAIDFIGAFHTHPICTLKNSTVNCTGKFDLSPQLDLSLRRSRPSSFENELTEERHTLMHSNASAFKRYTNRQLQISTPAVLINFSDQQRQQIANCEKNISRIATGCNSDSSTPSMQRCIVSPTTVQSKEPELATSHSQPGHSLPIPVKGVRFNDLCTTYGSVFPSVFRAQSGSPAMPSPNSVMLLEPNFQVNAFYQSNMKESSSEQLYEPGGPNGNTTQNHIVYTQEHKSENAEDQGHISPTTDQSVSSSFCNGNASHLNSIGYGSNCGSSSNVDQVNTVWAASEGKHKDLTSNANSHRSIQREAALNKFRLKRKERCYEKKVRYESRKKLAEQRPRVKGQFVRQVHPDPLVAEKDCKEYDHSHISDTLERRA

SEQ ID NO: 175505 - protein, 112 aa, Glycine max
  Coding DNA Sequence Number=SeqID_58727
  Subcellular localization annotation: CTP_CleavageSite=40; ConfidenceScore=5.46e-01
MAPMFSSILLNCPSKLKLTIASPQSSSKLVSAPFFLLGPLCFSFQYFGGGHTDVSQFVALFPDLDGRHLELFLDCLCPSSTFRACTSSLSSGVSASSSLEVFSFGSQSNPCV

SEQ ID NO: 175506 - protein, 159 aa, Glycine max
  Coding DNA Sequence Number=SeqID_58728
  Gene Ontology: Mol. function=DNA binding
  Homolog annotation: Hit_ID=Q1S0F5; Match level="QueryCoverage=84%, HitCoverage=26%, E-value=3e-15, Identity=33%"; Hit description=IMP dehydrogenase/GMP reductase
MESPIIAILADAYDTFDRRCEKSGARIVCCTPALYVWLVLHFFRHEGRPVCPIQGHRLCAEKGKENWEQLLASVVGGSINWFPQWKEGRATVLSSCEGFSNVPLMGTRACINYNPVLAIRQLGYPMRGAPSEESITPFIARGFRDPMGGYFKESARHGA

SEQ ID NO: 175507 - protein, 167 aa, Glycine max
  Coding DNA Sequence Number=SeqID_58729
  Gene Ontology: Mol. function=RNA-directed DNA polymerase activity; Cellular component=intracellular; Biological process=RNA-dependent DNA replication
MHKEIDIYVDDMIAKSKTEEEHLVNLRKLFKRHYKYWLRLNPAKCTFGVKSRKLLGFIISQKGIEVDPDKVKAILEMPEPRTEKQVQGFLGCLNYIARFILQLTTTLLVPPVPRRPLILYMNVLDESMGCMLGQHDESGKKERVVYNNYSLLERTCCALVWATHRLR

SEQ ID NO: 175508 - protein, 267 aa, Glycine max
  Coding DNA Sequence Number=SeqID_58730
  Subcellular localization annotation: CTP_CleavageSite=36; ConfidenceScore=5.07e-01
AKFDIAEATKVKTKVMSTVATRWRQFKSTLTSKFVFAKSEGQQMQDVVTKYGLDPEAWKQFEETRLTHNWEDSLEEQVTQGSFVPHGRQDILNTAIGRPDHGGRIRAAGSGVTITQYYGRASRTCSSSSTSISQQQLDEVVARLREDMTGQIREELRTQLEEENKMSLEIMTNALKEAIKKELSNKGSPESLQIQLDIQQLGARVSTKGSNVVINVQPSQEHHADAIPLMGLYVQRKDGTLRLVAMGKIMEGDSIIHTVAYADDVVR

SEQ ID NO: 175509 - protein, 59 aa, Glycine max
  Coding DNA Sequence Number=SeqID_58731
RAFAKRDTQWLSARKNPEEDELAVSLSTTLQVIKRTASAHSLSQNPLMRAKRFRFVLRA

SEQ ID NO: 175510 - protein, 212 aa, Glycine max
  Coding DNA Sequence Number=SeqID_58732
  Homolog annotation: Hit_ID=UPI0000612705; Match level="QueryCoverage =43%, HitCoverage=92%, E-value=1e-12, Identity=30%"; Hit description =UPI0000612705 related cluster
VDSRGSHRGLHVLAIRGIDVLAFRGLHVLTFRGLHALTLRGLHVLAFRGLHVLTFRGLHVLPFSGLHILAFLGLHALTFSGLHVLAFRGLHALAFRGLHRTQGPPPLMLNRGPHSRLRASSFLLSVPGPPLDPGGGPIVRAQPEEEAIAQPLCIPGQDFTRAAAKRRVRIMHTNITTLTQIWMTLLLSNILPSDHNADLPLRKYQLVCAVMT

SEQ ID NO: 175511 - protein, 57 aa, Glycine max
  Coding DNA Sequence Number=SeqID_58733
MEERERKIFRPDKFSARLPFKVILDWRYPTPHEQKGRDRNTQLPLQKHYPRENPIDP

SEQ ID NO: 175512 - protein, 79 aa, Glycine max
  Coding DNA Sequence Number=SeqID_58734
  Subcellular localization annotation: CTP_CleavageSite=29; ConfidenceScore=5.53e-01
MTLQAQGSVQSIKNKLNMGARDSSFMNKRFMQKSVLNASRSLTVKDHTLTGLCDVILTRSGSLDTGYRDLDDVTSSEGR

SEQ ID NO: 175513 - protein, 135 aa, Glycine max
  Coding DNA Sequence Number=SeqID_58735
  Pfam annotation: Domain name=Transposase_23; Domain location=37-107; Score=3.0; E_value=0.00054; Accession=PF03017.5; Description =TNP1ENSPM transposase
MQSQGLAVPPEPLVGPSGPRVSTKGSCVDPSGNDPQTGDSDRCGLYIEADPARLVAMGRVYEGSTVVHNTPLLTGQVKVSVEEVTDADAPIPVPTDEVSLVGQALHTFLAWPTHLVKSLSQQILIALTICFFFLN

SEQ ID NO: 175514 - protein, 355 aa, Glycine max
  Coding DNA Sequence Number=SeqID_58736
  Homolog annotation: Hit_ID=Q3BWE8; Match level="QueryCoverage=73%, HitCoverage=80%, E-value=1e-27, Identity=32%"; Hit description =Putative secreted protein precursor
  Subcellular localization annotation: CTP_CleavageSite=23; ConfidenceScore=5.07e-01
GRRTLQHPRRPKLLPAAPAPEVPAAVTPPATPVVDAQPAPAAGPTPVPVAPATVAPVAAPPAVVEPAVPAVAPAPPALAIVPLQPEQATERALGARCPVDLAGRLATQGELLIGACQGRMPAHLAALLVALPQQDIHLPRSWREREVQQKAWFKAVPGYGQRPDFIVRMGDIWVRSLEGRDADSTFYLVSAPFTCSDQVANRDEYGAEPVRVPAGDCREAYVAQRVYQVRGDAAPRDVTADAMPAMPTVTEADRARQLSRKGRIILDHIKLQYGPAMRWFVQYPESAQKGGPRAYGDWNREHIAFVVWTGDRFELREKVARAQWPCDPVAPGDRACGGFPDSRPDLFVTAGASAP

SEQ ID NO: 175515 - protein, 86 aa, Glycine max
  Coding DNA Sequence Number=SeqID_58737
MVLERSFRPCLSYRVIMPMMNDPTDIELYRLQGFDSNLVDGPLLGRKAEIRWNGESKKFVSGKEMEMKEKVVSQGDKNKYTHTPCS

SEQ ID NO: 175516 - protein, 69 aa, Glycine max
  Coding DNA Sequence Number=SeqID_58738
  Gene Ontology: Cellular component=chromosome, pericentric region; Biological process=meiotic chromosome segregation
  Homolog annotation: Hit_ID=Q7XDP3; Match level="QueryCoverage=96%, HitCoverage=17%, E-value=7e-11, Identity=50%"; Hit description =Expressed protein
KIIEATGSELQRLRADVKKLQIQNWNLAQSNTHMLAELNMGRERIKTLQHEILWRAALIKGKTVDVQEE

SEQ ID NO: 175517 - protein, 134 aa, Glycine max
  Coding DNA Sequence Number=SeqID_58739
MAEKTKKKLEEVAQSGSTEAVIDSPSPIRHHVKWKMARTKKTGQMTSEATKEIAEKIASQGSFVPHGREDVLTAAIGRPKHPGHVRVGGAGVTIKQYFGSAPRTSRTSSSMAPEELEQLTQQIKDQLEESITEK

SEQ ID NO: 175518 - protein, 165 aa, Glycine max
  Coding DNA Sequence Number=SeqID_58740
  Gene Ontology: Mol. function=metal ion binding; Cellular component =integral to membrane; Biological process=ubiquitin cycle
  Homolog annotation: Hit_ID=Q84KA9; Match level="QueryCoverage=57%, HitCoverage=23%, E-value=3e-21, Identity=54%"; Hit description =RING/C3HC4/PHD zinc finger-like protein
MNMHKESPLIKLHSFDQGHAWLALLHLLIHVSPAVTGQPVTPPVQPDSNKSMVTIMAILAIMFLILVFLSIYSRKCYDRQAPTRGILDRADPTGAAGNPSQAESNGLNQATIETFPSFLYGDVKGLKIGKDTLACAVCLNEFEDDETLRMIPKCCHVYHRYCIDE

SEQ ID NO: 175519 - protein, 148 aa, Glycine max
  Coding DNA Sequence Number=SeqID_58741
MGWGVQYDNVNLSFEAFVGPNSTRPLGNATLEGFYQGRWREGLKHGSFLASATTGKLTTVLSFWRVDFATAVKYKKGKYRVWYTRDRLQGGANLEIDDSQLMVNWKPVRLGDSPVAIIASGSRKHCELSNSAHCVLGLSLSLVVILFV

SEQ ID NO: 175520 - protein, 188 aa, Glycine max
  Coding DNA Sequence Number=SeqID_58742
MATGESPSLTGFQFTINWESSISKFAPPCKRSRVYQTLEEGPVLEALPPAALVEALEGGIAEWTRGVGAHKRLKGEVDVVVLDSPAHVAVHQLEGKEAESRPQRRNHDDYGYYKDATAARDGGTRRRHLRMVAGICERRRKKTLTVTVVLEIKGKRLSKWQKKLIKERGIKQHAMEEGSKRAVKMRDM

SEQ ID NO: 175521 - protein, 169 aa, Glycine max
  Coding DNA Sequence Number=SeqID_58743
  Subcellular localization annotation: CTP_CleavageSite=59; ConfidenceScore=5.00e-01
MTSFFSFFSKVFKKFSLAFKIKTFEFFSEEENNASPLLDDINGFSLLNSTIRIPSSFASTAAATDHPSSSSSSLESQEPKTPPLLPLIEAQIIQTIAISSLTIFPSGLVANAIHPNVDYARKGHNQYTWCRQWRPSGEDLEVEAAEEGAEVCDSAVDMEKEKNDLIITF

SEQ ID NO: 175522 - protein, 36 aa, Glycine max
  Coding DNA Sequence Number=SeqID_58744
MKCHNVRATEKSKNRNLTNGIKAYLTPSTVWFKDEP

SEQ ID NO: 175523 - protein, 66 aa, Glycine max
  Coding DNA Sequence Number=SeqID_58745
  Subcellular localization annotation: CTP_CleavageSite=43; ConfidenceScore=5.02e-01
MSLSLEYFPLDLMMKYIQFQGAVALSSPFGLSVHPTLSAASVRLARQKNLVEHQDQGRALSARSAR

SEQ ID NO: 175524 - protein, 784 aa, Glycine max
  Coding DNA Sequence Number=SeqID_58746
  Gene Ontology: Mol. function=RNA-directed DNA polymerase activity; Cellular component=extracellular region; Biological process=RNA -dependent DNA replication
  Homolog annotation: Hit_ID=Q1SFJ7; Match level="QueryCoverage=98%, HitCoverage=91%, E-value=1e-143, Identity=35%"; Hit description=RNA -directed DNA polymerase
MIRKQLQEDLWAAAQSHESLIRQKARSKWIKEGDCNSRYFHLLVNASRRSNSLNGVWIDGEWAEDPVRVKEAARSFFFHRFQETDQNRPRLDGIPFQTIGHHQNDMLSGKFQEEEIKDAVWGCGSDKSPGPDGINFKFIKQFWHVIKPDVLRFLDEFHANGIFPRGGNASFIVLIPKVKNPQALDEYRPISLIGCMYKIVAKILANRLKKIMSCIIDERQSAFIEGRHLLQSALIANEVIEEANRTQKPCIVFKVDYEKAYDSVSWDFLLYMLRRLGFCSKWIQWIEGCLKSASISILVNGSPSHEFIPQRGLRQGDPLAPFLFNVVAEASLENVKAIKAILRTFELVSGLKINFAKSCFGAFGMTDRWKTEAASCLNCSLLAIPFVYLGIPIGANPRRCHMWNPILEKIPKKVTEKVVSIQQRFLWGGGTDQNKIAWIKWETLCLPKDKGGLGIKDLNTFNIALLGKWGWNLFQHEGQLWARGVEMHNSIEWRPGRGDRIKFWEDNWIDGEESLAAKYPRLYLISCQQNHLIQHMGGNKEADWEWNFSWRRPLFDNEIPMAVDFLQHIESKPIQIHRRDEWVWTADSSGQYMAKSAYKMMRGGDIDGTQDRAFEELWKLKVPIRYAVFAWRLLRDRLPTKSNLLRRQVEIVNRTCPFCRSAEEEARHLFFHCSKIIPIWWESLSWVNNVGVFPQDPRQHFLQHGSIAADGLRINRWKCWWLAVTWTIWKKRNDILFSNDSFDNSKMMDEAALLMWTWLRNLEKDFATHFNQWSSNLREGFMYQ

SEQ ID NO: 175525 - protein, 88 aa, Glycine max
  Coding DNA Sequence Number=SeqID_58747
MVPFLIEVLNVGMVAQAEAVEVPIPYSAGPPRTSNTWVNPNSKSTGSGHNQPSAMLTNLASHGTAPAGSTWIPDFGGSFHVTGDSQKH

SEQ ID NO: 175526 - protein, 53 aa, Glycine max
  Coding DNA Sequence Number=SeqID_58748
MEGDKGIARRQYKWRLQSLLRLSDIWEFYQNNRRKNLRNLRESLQMSLSLSED

SEQ ID NO: 175527 - protein, 81 aa, Glycine max
  Coding DNA Sequence Number=SeqID_58749
MAESLTSNIFAGFLATVTTTVLKVTAFCACKGCNNRIHKTVLKNKGYSDNGGAEGDNALPIDSDNGGTEGDDALFIQGLQQ

SEQ ID NO: 175528 - protein, 259 aa, Glycine max
  Coding DNA Sequence Number=SeqID_58750
  Pfam annotation: Domain name=DUF1635; Domain location=18-259; Score =297.1; E_value=3.2e-86; Accession=PF07795.2; Description=Protein of unknown function (DUF1635)
MDNQRTPLLSWAYYCHGKSVEELKQSLMYTTLELEQTRAGVQEELRKRDDQLLTLKELLNKVIRERDEAQEKCQRLLVLEKMVFHQQHQTAPASGVSSIEDEPRRGGINNDSSNNGLSSSDCEESIVSSPLMEHLPPQPHHHAGPSSQLQQQLPESMIELISQDKPLPEKGKLLQAVMKAGPLLQTLLLAGPLPQWRHPPPPLESFEIPPVTIPSPPPQQQLHQDSFITSNCGRVSRKRVFFEGTDSPTQNKFQRIVLH

SEQ ID NO: 175529 - protein, 226 aa, Glycine max
  Coding DNA Sequence Number=SeqID_58751
  Gene Ontology: Mol. function=isopentenyl-diphosphate delta-isomerase activity; Cellular component=cytosol; Biological process=isoprenoid biosynthetic process
  Homolog annotation: Hit_ID=Q8L831; Match level="QueryCoverage=50%, HitCoverage=13%, E-value=1e-38, Identity=70%"; Hit description=Nudix hydrolase 3
RELEEELGITLPKDAFELIFVFLQECVINDGKYINNEYNDVYLVTTLDPIPLEAFVLQLVLHVLELSMKETEVSAVKYISYEEYKRLLAKEDSGYVPYDVNGQYGQLFDIIEKRERHVLRCWFDKVKSGHYKYGYFSPNIPKTAKTKRVHKIQTLSSSESFYGQTKYSSNKPTVIEFRWERERNRKTEKERGKERRNRIERIEGKRRETERSRKCALHPVIIIQSV

SEQ ID NO: 175530 - protein, 1221 aa, Glycine max
  Coding DNA Sequence Number=SeqID_58752
  Gene Ontology: Mol. function=RNA-directed DNA polymerase activity; Cellular component=chromatin; Biological process=chromatin assembly or disassembly
  Pfam annotation: Domain name=Chromo; Domain location=1118-1172; Score= 37.8; E_value=3.7e-08; Accession=PF00385.14; Description='chromo' (CHRromatin Organisation MOdifier
  Pfam annotation: Domain name=RnaseH; Domain location=561-682; Score= -18.6; E_value=0.0031; Accession=PF00075.14; Description=RNase H
  Pfam annotation: Domain name=rve; Domain location=816-972; Score =120.4; E_value=5e-33; Accession=PF00665.16; Description=Integrase core domain
  Pfam annotation: Domain name=zf-H2C2; Domain location=757-798; Score =13.6; E_value=0.0056; Accession=PF09337.1; Description=His(2)-Cys(2) zinc finger
  Pfam module annotation: Pfam domain module=Chromo::RVT_1::RnaseH::rve: :zf-H2C2; Domain location=1118-1172::347-559::561-682::816-972::757 -798
MSVMGNLSRAKLLQVARAVERETVRDGSGFARSSKPGQGSSRFGSVGPNKGGASDWVLVKGGKEAVTKPTGPGPRNERLGQGDRRSGPRDRGFTHLSYNEIMERRRKNQCFKCAGPFSSIHQCPDKHLRLLITDDGGGEESELLAVEVEEGEEEIEGEMSLMSFHQLSQAQQIKPQSIKLKGTIHEVPVVILIDSGATHNFISQQLAKKMNLVTTNTSPLNIRWVTLHGVDGNMKGMETLQSIISKPKRSQEVWGREVGSKVDGGSFHALEVEQSRKLEHLLNLCADVFQEPKGLPPKRKKEHVITLKEGEGPVNVRPYRYPHHHKNEIERQVKEMLEIGIIRPSTSSFSSPVILVKKKDGSWRMCIDYRALNKATIPDKFPIPVIEELLDELHGAKFFSKLDLKSGYHQVRIKEEDIHKTAFRTHEGHYEFMTHLQHLEEVLRLLQTHGLVANKKKCLFGQMSVEYLGHLISGEGVAVDPSKVISVTNWPTPKNVKGVKGFLGLTGYYRKFIKDYGKIVKPLTELTKKDAFVWSEEAQLAMNKLKICLTSAPVLALPDFDKDFVIECDASRHGIGAILMQEKRPIAYFSKALGVRNLTKSAYEKELMAVVLAIQHWRPYLLGRKFIVSTDQKSLKQLLQQRVVTAEQQNWSAKLLGYDFEIVYKPGNLNRGADALSRVNEEGGLCQIHTRIQWEEEEIVKREAATDPQLQQIIKDLQIDETSRPGYEFRQGVLLYEGRLVLSKHSTLIPRMLEEFHTTPQGGHSGFYRTYRRLAANLYWIGMKNTIQDFVKGCDVCQRQKYMASSPGGLLQPLPIPDRIWEDLSMDFITGLPKSKGYEAILVVVDRLSKYAHFVPLKHPYTARVIAEVFVKEVVRLHGIPLSIVSDRDPIFMSNFWQELFKLQGTKLKVSTAYHPETDGQTEVVNRCLETYLRCFIADQPKTWSMWMAWAEYWFNTSFNVSTGKTPYEVVYGRVPPTLTRWVQGEIRVEAVQRELLDRDEAIKQLREQLLKAQDRMKQLADRKRCDRSFEEGEWVFVKLRAHRQQSVVSRIHAKLAARYFGPYPIIARVGAVAYRLKLPDGSRVHPVFHVSLLKKAVGNYHEEDELPELEGEGGVLIEPEEVLASRIVQVQGEKVNQVLIRWKGQMVDEATWEDKIAMRSQFPNFCLEDKAVLSGGSIDRPRTQEEEPSEALAHHHPTVGPKVWYVYSRRKKNVANTNDS

SEQ ID NO: 175531 - protein, 287 aa, Glycine max
  Coding DNA Sequence Number=SeqID_58753
  Gene Ontology: Mol. function=isopentenyl-diphosphate delta-isomerase activity; Cellular component=cytosol; Biological process=isoprenoid biosynthetic process
  Homolog annotation: Hit_ID=Q8L831; Match level="QueryCoverage=94%, HitCoverage=33%, E-value=5e-90, Identity=59%"; Hit description=Nudix hydrolase 3
MKNLTGLTDSDKEALVFVVKAANVMDEIFYLQAWYSNPSLRDWLKEHADTSEFNKLKWSYYQINKSPWSSLDEDEAFLSTADSAIRLLSKATRIVKDWKGLEYRAAFPLLKPAGANFYPPDMDKMVPLCQAYAILFANLKNDKAIILQEFELWKDSLEKHEQKEATGFFSVIKRHSEFILDSHLSDNKTGSHDLYIVPYSEEYKSLLAKASDLLHKAGDISDSPGLKRLLHSKADAFLSNDYYDSDIAWMELDSKLDVTIGPYETYEDKLFGYKVSLNNEALYSLYN

SEQ ID NO: 175532 - protein, 172 aa, Glycine max
  Coding DNA Sequence Number=SeqID_58754
MDERIAALEGEITGIKASLSTLEQGQATLIAMFERSLGKKKEGDVVLIEGTQESGSGKETNLQTGASKAGPSNDEALLEFRQAVKKVELPMFDGGDPTGWISRAEVYFRVQRTRSDVKVCLAQLCMEGATIHFFNSLINDEEELTWEQLKEALLERYGGHGDGDIYEQLTEL

SEQ ID NO: 175533 - protein, 39 aa, Glycine max
  Coding DNA Sequence Number=SeqID_58755
MDTNTLGYSGWRGAKDSPLQPPISGEAHGASTKDIQVNQ

SEQ ID NO: 175534 - protein, 70 aa, Glycine max
  Coding DNA Sequence Number=SeqID_58756
MTMTKGEGESVASCHEEVQRGKEKMCGLREGDESSQGKVWVTEGAVARGKGIARKGVHRGGSRRAEGGRC

SEQ ID NO: 175535 - protein, 312 aa, Glycine max
  Coding DNA Sequence Number=SeqID_58757
  Gene Ontology: Mol. function=transcription regulator activity; Cellular component=nucleus; Biological process=regulation of transcription
  Homolog annotation: Hit_ID=Q1T110; Match level="QueryCoverage=98%, HitCoverage=100%, E-value=2e-93, Identity=59%"; Hit description =Helix-loop-helix DNA-binding
  Pfam annotation: Domain name=HLH; Domain location=127-176; Score =44.1; E_value=4.7e-10; Accession=PF00010.16; Description=Helix-loop -helix DNA-binding domain
MDTMDFQQETLVHINDFVEDPNLDQFINLIRWEHKDAICNFNSELINEAFIDNSFLSHPAIPFDQCNGNSVNVYDPISSTHSSFSCFDGEAKEEEGGGEEEDNMGDTSAATTTRTKSLNNKPIPKTDRSKTLASERRRRERMKEKLYTLRSLVPNITKMDKASIIGDAVSYMHELQAQASMLKAEVEGLETSSLNSKNYQGLIENPMRVQLITNKKIIQMDMFQVDEKGFHVKIMCNKGEGVAASLYKSLESLTGFNVQNSNLTTISDRSFLLTFSLNAKGPEPEINLPNLKLWVTEAFVKQGFEFIPFFYA

SEQ ID NO: 175536 - protein, 216 aa, Glycine max
  Coding DNA Sequence Number=SeqID_58758
  Gene Ontology: Mol. function=metal ion binding; Cellular component =cytoplasm; Biological process=ubiquitin cycle
  Homolog annotation: Hit_ID=Q9ZTM6; Match level="QueryCoverage=96%, HitCoverage=72%, E-value=3e-75, Identity=60%"; Hit description=PGPD14
  Pfam annotation: Domain name=zf-C3HC4; Domain location=92-134; Score =31.0; E_value=4.2e-06; Accession=PF00097.15; Description=Zinc finger, C3HC4 type (RING finger)
MTTAIDLLIDFHAQVQQYCINCGICMGKFQRINTTAMNVAFAEFDYSSSLFNCFYRTGGKDNFFHCNRCGCCYSKVMEKGHRCVEGAMHHNCPVCFEYLFDTVREISVLPCAHTIHLDCVKEMEKHQRYSCPVCSKSICDMSSVWEKLDELIASTPMPETYKNKMVWILCNDCGVNSHVQFHIVAHKCLSCNSYNTRQIQGVPATSSSSRVTEMVR

SEQ ID NO: 175537 - protein, 225 aa, Glycine max
  Coding DNA Sequence Number=SeqID_58759
  Gene Ontology: Mol. function=copper, zinc superoxide dismutase activity; Cellular component=chloroplast; Biological process =superoxide metabolic process
  Homolog annotation: Hit_ID=O65198; Match level="QueryCoverage=91%, HitCoverage=97%, E-value=6e-76, Identity=70%"; Hit description =Superoxide dismutase [Cu-Zn], chloroplast precursor
  Pfam annotation: Domain name=Sod_Cu; Domain location=48-208; Score =305.5; E_value=9.7e-89; Accession=PF00080.10; Description=Copperzinc superoxide dismutase (SODC)
  Subcellular localization annotation: CTP_CleavageSite=45; ConfidenceScore=5.84e-01
MAANAVVSPSPFRPQPFLRSSFSGVSVKLTPQSITLSRSKPLTVFAATKKAVAVLKGTSAVEGVATLIQEDDGPTTVSVRITGLTPGLHGFHLHEYGDTTNGCISTGAHFNPNKLTHGAPEDEVRHAGDLGNIVANAEGVAEATIVDNQLIRLYCMASNMQIPLSGPNSVVGRALVVHELEDDLGKGGHELSLTTGNAGGRLACEMVTRDLEYLCIFAFRPMTTI

SEQ ID NO: 175538 - protein, 648 aa, Glycine max
  Coding DNA Sequence Number=SeqID_58760
  Homolog annotation: Hit_ID=Q9FMQ0; Match level="QueryCoverage=93%, HitCoverage=93%, E-value=1e-113, Identity=41%"; Hit description =Genomic DNA, chromosome 5, P1 clone:MXC9
  Pfam annotation: Domain name=UBA; Domain location=158-197; Score =38.2; E_value=2.7e-08; Accession=PF00627.21; Description=UBATS-N domain
  Pfam annotation: Domain name=UBA; Domain location=220-260; Score=9.0; E_value=0.34; Accession=PF00627.21; Description=UBATS-N domain
  Pfam module annotation: Pfam domain module=UBA::UBA; Domain location =158-197::220-260
  Subcellular localization annotation: CTP_CleavageSite=36; ConfidenceScore=5.62e-01
MSPASKSKSKDKKAGKEAQKSSAKSSGSGNAVAGVPASAYNPLSGTFHTLEMSPTSTSQVHSNGRFRNIDETDEHPAGSVVAGVEYDSVSNNGSWSGDSEDHKDKASNPPARLEAVPGADNDKREKIRQKNEKKHQRQKERRAQELHDRCTGYIMSRKLEALAQQLVAMGFSHERATVALILNEGRVEESVAWLFEGGEEADNHKDTNIGGGNLKIDISEELARIADLEIRYNCSKQEVERAVVACEGDLDKAAESLRELKLDRPSGPPKPEEIGDLSSLSSKQSGAVNQNARPQTKPILSPNQPKKDEKDFNYAKQAVILGGSMESSNRLVQPLKRILPKPEWAKPQQAAVPADKRWPGAGSNPSVSYSLASPLQVSPTSAKTEASYMAAGGDYKSLQPGSAREPVIVMQRPQTVNAKQIPAASMSSSPPGVAASWYPTNSIEVMRSNGFISHPPSTRSLSSNYFSSNQLYHQLQCQPPQQFVAGNSSSVDLLATNQGNSLWNKTAASPSLAAASSLGLFSRLGSAATSGATSPVDWSTGGTMQFDYTNIDWSLDRGLSPPRSNALLFGLSPFTKSSSTLYGSNASGTVAQTTVRSLPSNGSMVPLPGLQNGVVSSAETSGSRDWSSPFEGKDLFSLPRQFVSSPSL

SEQ ID NO: 175539 - protein, 69 aa, Glycine max
  Coding DNA Sequence Number=SeqID_58761
  Gene Ontology: Mol. function=4-(cytidine 5'-diphospho)-2-C-methyl-D -erythritol kinase activity; Cellular component=chloroplast; Biological process=isoprenoid biosynthetic process
  Homolog annotation: Hit_ID=O81014; Match level="QueryCoverage=62%, HitCoverage=11%, E-value=5e-15, Identity=75%"; Hit description=4 -diphosphocytidyl-2-C-methyl-D-erythritol kinase, chloroplast precursor (EC 2.7.1.148) ...
  Homolog annotation: Hit description=(CMK) (4-(cytidine-5'-diphospho) -2-C-methyl- D-erythritol kinase)
MLSFPICLKSGSTIVGVGSPDPPQFVYDDDEYKDVFLSDAYFLTREENQWYQEPTSSPSASPSVVSESV

SEQ ID NO: 175540 - protein, 139 aa, Glycine max
  Coding DNA Sequence Number=SeqID_58762
MESNSVRTESKQQTVAGKGLGLQLYHSYWATASVKGESSFGGILKFLTSWSDLPSPIAMENRVGALEKAVSEQGQQLAEFKTDMNYIKDLLLQMKNKKSLSDEEDNPVNKNEKSAEEEEIGESEEEENFPLHPWVMTVE

SEQ ID NO: 175541 - protein, 378 aa, Glycine max
  Coding DNA Sequence Number=SeqID_58763
  Gene Ontology: Mol. function=DNA binding; Cellular component=beta -galactosidase complex; Biological process=DNA integration
  Homolog annotation: Hit_ID=Q0KIN0; Match level="QueryCoverage=97%, HitCoverage=25%, E-value=2e-64, Identity=57%"; Hit description =Integrase core domain containing protein
GISIKLLVLTPQQNGVVKRKNRHLVETARTSYCMSLDQCMPSSILNNQITYSIWYPQQNLYSVLLRVFGCTYFVHDLFLGKDKLSLLSLLSVFFLVTLTYKKDVVALVRNFNSILFMLMSSTLSLLHSSLRALPQHPPVIQYTNSLASSLAPTNPPTTPSTPELPIALCKGEEMADLAMLDEMATLQTSGTWELVHLPPEKTSVGCHWVCTMKFAPEGCIDRFKARLVAKGYAQIFGLDYGYTLSPVTKITTVHLFLAMAVIRHWPHHQLDIKNAFLHGELQEEVYMDQSLGFIASSGSHLVCHLRRSFYGLKQFPHAWFGCFSSTLIQFGMTRCEAGHSVFFLHSSFGLCIYLVVYVNDTVITGDDSDGICRLKSHL

SEQ ID NO: 175542 - protein, 118 aa, Glycine max
  Coding DNA Sequence Number=SeqID_58764
MMKSTKNVRFMALEHKMLMLPFEVSLPSFERRPKSVHFCWGIEYVKGIWQVIELRVPRPGEDSATCVSQRLRPHMKHVDVHFRNCININGARILLGYVSICRVIFRACNSIAEGSSTE

SEQ ID NO: 175543 - protein, 754 aa, Glycine max
  Coding DNA Sequence Number=SeqID_58765
  Gene Ontology: Mol. function=RNA-directed DNA polymerase activity; Cellular component=chromatin; Biological process=chromatin assembly or disassembly
  Pfam annotation: Domain name=Chromo; Domain location=672-720; Score =11.3; E_value=0.045; Accession=PF00385.14; Description='chromo' (CHRromatin Organisation MOdifier
  Pfam annotation: Domain name=rve; Domain location=415-571; Score =107.1; E_value=5.2e-29; Accession=PF00665.16; Description=Integrase core domain
  Pfam module annotation: Pfam domain module=Chromo::rve; Domain location=672-720::415-571
MTVKDRFPMPTIDELLDELGFASWFSKLDLRQGFHQISMAAANVAKTAFRTHQGHYEYKVMLFGLCNAPSTFQATMNELLKPFLHRFVTIFFDDILVYNASLEDYVSHLCQVFDCLSHAQFFLKESKCVFAQQQLAFLGHIISARGVAPDPSKIDVMVQWSVPTNTHSLRGFLGLTGFYYKFIKAFESLKSAMTQAPVLSLPDFSIPFILETDASGSAIGAVLQQRGHPLAFFSKALCLRMQRASTYVRKLHAITTAVHKWRQYLHGHSFTILTDHRSWKDLMTPEQQTYLAKLLGYNYNIQYKSGKSNVVVDALSKVPQPEASQYWFLSMPHFIFLDTLQKHFTTSSYPEFALHDDLLFFNNRIWMELDNPFVDTLLEEFHSTPIGGHLGFAKTLHRVQASFHWATLSRDPLPIPSSPWQDLSLDFITGLPPSRGYTTILVVVDRFTKGAHFEALPDRYTTHNVAFLFLDVVAKHHGFPCSLISDRDPIFVGHFWCDLFHLSGTKLRMSTLYHPQTDGQTEVLNRTLEQYLRCFVHDTPSQWSQFLSLTEWCYNTVVHSATSVTPYEATYGKPPPLLKSQQTMKDQADRKRRDVSYSVGDWVYVKLQPFRQLSLARTTFSKLSKLAYRLALPAHSKIHNVFHCSLLKPHHGPVHANIAPLPPQATDNHPLVEPLSVLDTKWDTTTSPPSLLALVQWNSLTSEETSWERWEDLCSTYHLDDKVVLPVEGIDRAQSTRPRRETQQPVYLNDYVRI

SEQ ID NO: 175544 - protein, 340 aa, Glycine max
  Coding DNA Sequence Number=SeqID_58766
  Gene Ontology: Mol. function=RNA-directed DNA polymerase activity; Cellular component=chromatin; Biological process=chromatin assembly or disassembly
MPTPILLLDQEDWGGEKVVAQLYKTQREHLMHLLLDFCLLKMGVAMDMVGDWPRWGKRCGLLEQVDILLEKICEGGVLRQMHNVLASCGGVGARTRQMVSSGHQHEGERGDPGIGIAWQDMEINVELMTLERYKGVRTELVAWERGAVADGDLQWVGQDGGELKVFSHPQLNEIMRTSSVNEHGGEGWVRAGLAGWVFGSGSSSSEMSRKKRALHLCEGAHFSSQLLHRTSSRLRVISSGVRRHKWLRMEGVGFGKGEGNGGGEGLGKVGDKGGKNVACHQVCLPATWRGKWPEEEKLAGMPEPPSVEEAEVVGVVVRAGVGFAGVGVAPGWRPNGGTCR

SEQ ID NO: 175545 - protein, 59 aa, Glycine max
  Coding DNA Sequence Number=SeqID_58767
MVVVGGISDWRVEVEIAKSFKGIKLWKEHQVCNLAFILDNYTFWFPQVFANFEQAFIYY

SEQ ID NO: 175546 - protein, 150 aa, Glycine max
  Coding DNA Sequence Number=SeqID_58768
MAIRGLWLPTPLRLCISADIRYTGHVPEADRELNSRRRTCRSSKRMKLTWRRKSGGKNDESSSELLCLLGGPHPAKRPSFDIVSGMMQVLDIGTGLSISVTRCALLQIRIRAEPTSDYFYSKRTTDYHYYGRERRFVSNGWVGIYATVGL

SEQ ID NO: 175547 - protein, 688 aa, Glycine max
  Coding DNA Sequence Number=SeqID_58769
  Gene Ontology: Mol. function=RNA-directed DNA polymerase activity; Cellular component=extracellular region; Biological process=RNA -dependent DNA replication
MPTICDKVDAYLIGKTVRVDRNTYDLGKGEVCEGCPDKDKANTWQGTHGVEQRGDNVEGASHRMEDVDGVTETKRSNEENKVGNETTNRVVVAGSGLVHVENAKGDKSKEESADGRSLNEYHSPHTEVLGDGNKDNFNQGSFDMEVVKETPFAEGKYVDANKPDILAILEGQGFSEDTADNVTGSCMIGGDFNDIICSAEKKGGTVVSKRKCQIFRNRINRAKLIDLGAVGPNFTCRGPKFNGFQRVFGRLGRALSNDSWRLLFPNTVVKVLPRLEFFYYHPFLIALHGCTLLGALPSPDDIKHALFDMKPWKAPRPDRFLADCGCGIRTLSQFEASKGEEWILCGQGKAYDCTKWTNMNRVLEENGKRSPMFAPNKGLHKGDLLLPYLFVLGMNKLSHIILKAVEAWKPFCMGRKGPLISHFMFADDLLLCGQASTKHMKCTLDTMHLFGEMLGQQISQEKTRIFFSKNVSDSSRRQLVQMSGFSEVTSLGNYLGIPLLGESPRQSDFNRLALPIYSMVTNKIPWGIINNIKKDERSFIWEDQVGRKKMHAIGWNLMARPKAYGGVPKGKYARQDFSANVLVAKPHDSPIWKVVAEIWPHLVEGELWAIGDGRLVDVWEDRWLNNGQMFSQEIIELITSILPPSNKVGLDRRLWPGNRQGEFIVASAYQRLIGNNFPALSEAWKSIW

SEQ ID NO: 175548 - protein, 80 aa, Glycine max
  Coding DNA Sequence Number=SeqID_58770
MTGQFLKLCPKIVNQEIIAKGDKLSLKQCHKNDLERTEMQNILYSSVVRSLIYAKVCTHPDIAFVVGVTDRYLSDPRMQH

SEQ ID NO: 175549 - protein, 160 aa, Glycine max
  Coding DNA Sequence Number=SeqID_58771
MSEIEEVQEHMKADMKAMKDQMAAMMEALLSMKKIMRVNVVAVIATSAAAEAVPMLCKARTLSHLTGAAVTWDLAAQVAPSMMEREMITMIVDTLPVFYYEKMVGYKPSSFADLVFVGERIEMGLRRGKFEYPALMNGKPRENGENKKEGGTHVVTVVPT

SEQ ID NO: 175550 - protein, 41 aa, Glycine max
  Coding DNA Sequence Number=SeqID_58772
  Gene Ontology: Mol. function=cyclin-dependent protein kinase regulator activity; Biological process=cell cycle
  Homolog annotation: Hit_ID=O23249; Match level="QueryCoverage=92%, HitCoverage=44%, E-value=4e-15, Identity=97%"; Hit description=Cks1 protein
  Pfam annotation: Domain name=CKS; Domain location=1-41; Score=34.9; E_ value=2.9e-07; Accession=PF01111.9; Description=Cyclin-dependent kinase regulatory subunit
MGQIQYSEKYFDDTYEYRHVVLPPEVAKLLPKNRLLSENLT

SEQ ID NO: 175551 - protein, 124 aa, Glycine max
  Coding DNA Sequence Number=SeqID_58773
MQMQSVCDEGGVKKVDGDAGGASILGCNVKHQRRLTQSIMKKVKDGVGKEVEGYFVVVASTIRKMSKDFIGNKFLSNLKDLLSSRILEGLCANYVFNKGKIERVLGVIFGSGVLCYCKVCKKIM

SEQ ID NO: 175552 - protein, 179 aa, Glycine max
  Coding DNA Sequence Number=SeqID_58774
MASCFPSTSENGEDDRGLDECEAVEKHGEEDEGCLPKREDENSKNYTMDFNHQIRGGSARLVDGSADLPDVAAEDIAFEKSKEECMVVIVRHKDQEDEATIEKRKKLIKSVEKDVGKSRMGESHIEIENEKDNAQSYEGDGQSMVGQTCHALGCDGFQTHFEIGQHIEENKELEIISCK

SEQ ID NO: 175553 - protein, 151 aa, Glycine max
  Coding DNA Sequence Number=SeqID_58775
YIMNSIITVLYFNGRVYEDNDGVIFEGSKKAIQIKRGISFNALKKKLEIRFLVSGKYVALQICDDEDVETMIESFQQQQQMSVLELYVEKDVAGGSMFHAANSVTSCGRNVSHHESELPRNISNLHDDEDDDDDDYLASNSYVEESFDEDD

SEQ ID NO: 175554 - protein, 66 aa, Glycine max
  Coding DNA Sequence Number=SeqID_58776
MEFLELKQGNMIVAEYAAKFEELVRLSRQVTYYRSIGPMKNKKNGPQHRGKLYSTPPKKYGNHPNN

SEQ ID NO: 175555 - protein, 109 aa, Glycine max
  Coding DNA Sequence Number=SeqID_58777
MPHPIVAECTQVMTVDEGSHVRALTVYQASLGGEFDIDPRYDTFNRCLKPIEDLAQLQLRPKLGPNKYHRRKGRQEKSGIKLSKKKLTSYSTQTSSERLGYVPSSPMSS

SEQ ID NO: 175556 - protein, 41 aa, Glycine max
  Coding DNA Sequence Number=SeqID_58778
MAHIHVISTGKCVVWSHTLRISNPAARIMQQIEPKSVPYKL

SEQ ID NO: 175557 - protein, 89 aa, Glycine max
  Coding DNA Sequence Number=SeqID_58779
  Homolog annotation: Hit_ID=Q10F41; Match level="QueryCoverage=70%, HitCoverage=11%, E-value=8e-11, Identity=46%"; Hit description =Nodulin family protein, putative
MAYESMRLYPPMQFNSKFCLEDDVLPYGTFVKKGKYFLTGGIYVFGSYSEAIKSSQGYDQSTLNFLRFCKDLGSNFGTPVGLLVDVIPP

SEQ ID NO: 175558 - protein, 80 aa, Glycine max
  Coding DNA Sequence Number=SeqID_58780
MAFLGETSSQMIVNSRLGFIFPNGSIIHNDTGVYFQTSTPEKIQKKFQIPSTCTIDELKDLIKQVAPKGIPPLGSHESQT

SEQ ID NO: 175559 - protein, 354 aa, Glycine max
  Coding DNA Sequence Number=SeqID_58781
MKAFPSLESPDVGSCNLFQSFLNNCLNSVVELTADKGDIFLEGLLVNGWLSKLAFLCGHVEKPVAVWAFNTMLYSSKEELHNSSSEFWCAILSSEKEVDQALVKIDWFPEYMDLRRALDSYGFLFKFSSSAEPNNLDSDIEGPPQNIRAWIRFVSACCLIRSKKAIFSTVEAEEIVEIIICLFLDRQFQGLLVLLNDCMEVIVNYFTDQEWCSSCENVAKFIACRVSKDLNCIRTIECISEASSRCKQLRSAVAYQTLLSCFDGVYSGEEILRSLTEINFKDNSCDFYRMYINLVLTENWVLSNSLIEDNPVIYEMFSLYLRHCSTLISATNLRSYASKVRHRASYLLHFSIYK

SEQ ID NO: 175560 - protein, 41 aa, Glycine max
  Coding DNA Sequence Number=SeqID_58782
MVFQESPTNETELTSSSAYDEEPVTNGDGKILTNAPMTLVK

SEQ ID NO: 175561 - protein, 290 aa, Glycine max
  Coding DNA Sequence Number=SeqID_58783
IRHRARDVLRDRCEPRLVDRQARTSGEDEAEGDERRAGLEPGRGPTGVDRAGVAGEGERGGIPRRHVVGGSGARGLPGHTGCAVVEQVLQAELCRGQHVPVCGDGVDADGVGVDVAHREGPARCRRRRREGVRRGGGAGRVVRSRAQVQVGLVSARTVLGTDARALREPGRRAADHSDLTGARVAGDGRRDRRLRSHLHGRGERTPRAGERLPGGPGGHRGGRCRERPGQDRDEDDGSDDAPTTTHTHAVRLPIYRSCGKGGSGLEVVLLQPQDGIGESRERPIDPVRVR

SEQ ID NO: 175562 - protein, 165 aa, Glycine max
  Coding DNA Sequence Number=SeqID_58784
MAPEELEQLTQQIRDQLEESITEKVTRQLMLSFSQMQSQLQSQIQSQGLALPLEPEVGPSAACVSTKGSCVDRSPTDLDMGDSDKFGLYIEENPSCLVALGRVYEGSTVVHNIPLLHGQVKVGAEEVKDAEALVPVPTDKVILVGQTINTFLAWPTHLVKRLSEQ

SEQ ID NO: 175563 - protein, 68 aa, Glycine max
  Coding DNA Sequence Number=SeqID_58785
MATIALSSRYGSKLAYDTGIWGESYRLFAAKFISWLVFFLEWQSQHGFLPHPHPLYLPQFSHSSKQDD

SEQ ID NO: 175564 - protein, 45 aa, Glycine max
  Coding DNA Sequence Number=SeqID_58786
MEETWRRLWLRSSSDFVLVIDYRTNKPTGNRLQDVVIDYRLPVHV

SEQ ID NO: 175565 - protein, 195 aa, Glycine max
  Coding DNA Sequence Number=SeqID_58787
  Homolog annotation: Hit_ID=Q6Z522; Match level="QueryCoverage=34%, HitCoverage=12%, E-value=8e-25, Identity=76%"; Hit description =Putative diphosphate-fructose-6-phosphate 1-phosphotransferase
MENNGGLWWLIVAVGDGESAWDVRNDFGRKKGEEMAFFLSYTKAKAETLKDIYQGVTAVSSTLSTRLVLSQISLTRAKRENGTKCDFEWHLQSPFLLFYSAAIDLQEAKDFIDEEDPRPTSSTWSHINGIILMDKTFGFDTTIEEAQREINSAYVEAHSAYHGIGIMELMGRDRGFIAMHASLASGQIDICLIPK

SEQ ID NO: 175566 - protein, 120 aa, Glycine max
  Coding DNA Sequence Number=SeqID_58788
MMIQIGLDLNQEGEALTDSSECRPWGSPGLSAPLSLCGSHMVGAFSQNIVTLTGLPMILLSESDLTNPWCARNVITHFLCVVVLDPVMILNLCSGEQMNRWMTMKNLMLEDTGTQRSDRM

SEQ ID NO: 175567 - protein, 103 aa, Glycine max
  Coding DNA Sequence Number=SeqID_58789
MEREMITMIVDMLLVFYYEKMVGYTPSSFADLVFAGERIEMGLRRGKVDYPALMNRKPGENGENKKEGGTHVVTSIPTWPNFPPVQQYQYSVNINPSHYPPPY

SEQ ID NO: 175568 - protein, 80 aa, Glycine max
  Coding DNA Sequence Number=SeqID_58790
VVYKSKGETKDIELVEEEQTWIGVDPSSETSNKSENYKEEALKKTQKHKPKRVESVNADAEAFADDWKILIALCIVKLKQ

SEQ ID NO: 175569 - protein, 83 aa, Glycine max
  Coding DNA Sequence Number=SeqID_58791
  Subcellular localization annotation: CTP_CleavageSite=56; ConfidenceScore=5.03e-01
MERAKGLLFSDNSQKWSNITFKGTTNDNVSSKTKTLDEASLSSSESETQDDHRSTSASCVSTDPGVDAIGFDVLMMIMMMCCN

SEQ ID NO: 175570 - protein, 119 aa, Glycine max
  Coding DNA Sequence Number=SeqID_58792
MEREMIIMIIDTLPVFYYEKMVAYMPSSFVDLVFVGERIEVGLRRCKFDYPTLMNRKPGANGENKKEGGTHVVTVGGVNSNLAPLTFQILPPEGGCFWRKQPGSPGRAGWQAPPLFCYK

SEQ ID NO: 175571 - protein, 145 aa, Glycine max
  Coding DNA Sequence Number=SeqID_58793
MNYESYSEVLDFLDNYFAGRVRDPYYLHKLKKIIEDSRYERNVPIRSIHQTFIDYTEEFNDYSVQDRAIDNIEAVIKNERKEDLRAFINDLENLKVEVINDEVKSNILRGFARRYADMYNDYLNPITNVLDRMEKAVDSYLEKEI

SEQ ID NO: 175572 - protein, 489 aa, Glycine max
  Coding DNA Sequence Number=SeqID_58794
  Gene Ontology: Mol. function=N-methyltransferase activity; Biological process=DNA methylation
  Homolog annotation: Hit_ID=O85488; Match level="QueryCoverage=55%, HitCoverage=64%, E-value=1e-81, Identity=59%"; Hit description=NcoI DNA modification methyltransferase
RYLQIEPQSPTLRDHIWWGSGSRATAEETGRKGLNMMSSTLVTEATGQPFHELQREQIELFRSAYKAAGHTGRPRVSVSRSVFPLVSDMDRAYFGLRSEENADQIGVIDGFRSTFGKTYAAEPDVLIAQLKQDEAVMAADTLLLTIPNQLGPEYNLHVLEAPGGDPRTPIGPGAACPTPGPVSERLGRLSASRFQPRENMSSLAVPPFADATAAHLAAPGTRVHGSATTFADNMKLPVHRWYRYSAGYSSEWATSLARHWGSRRVLDPFGGSGTTILAAQELGVESVGVEVHPMVARIARAKLRWTEDPNELRARLAEVLSAAAVGKPGGGAGFPAGREVLSRYGSADRPAAHPRRGARPAGPRRRRRAALARVRLDHPRLLARRHGPVAVRASEQDQEPRGRAVLRVPGRGGAFRVGHGAAPLAPRSPSGDRDGLHGGRAHVGAGVGRMGRRGHHLPAVREQLRLCRHAPSRADRPGRHRGMEGPPSA

SEQ ID NO: 175573 - protein, 200 aa, Glycine max
  Coding DNA Sequence Number=SeqID_58795
  Gene Ontology: Mol. function=glucose-1-phosphate thymidylyltransferase activity; Cellular component=phosphoribosylaminoimidazole carboxylase complex; Biological process=extracellular polysaccharide biosynthetic process
  Homolog annotation: Hit_ID=P55256; Match level="QueryCoverage=87%, HitCoverage=59%, E-value=3e-89, Identity=89%"; Hit description =Glucose-1-phosphate thymidylyltransferase
  Pfam annotation: Domain name=NTP_transferase; Domain location=30-200; Score=181.6; E_value=1.9e-51; Accession=PF00483.13; Description =Nucleotidyl transferase
MDQRRAGWQLPSAAHRHCRLRPGDNMTQRKGIILAGGSGTRLYPITKGVSKQLLPVYDKPMIYYPLSVLMLAGIREVLIINTPHEQALFQQLLGDGSQWGMDIQYAVQPSPDGLAQAYLIGRDFVAGKPSCLVLGDNIFHGHGLREVLKRADERVHGSTVFGYWVNDPERYGVAEFDQSGKVIDLVEKPEKPRSNYAVTG

SEQ ID NO: 175574 - protein, 67 aa, Glycine max
  Coding DNA Sequence Number=SeqID_58796
VKDADALVPVPTDEAILVGQALNTFLAWPTHLIKRLSEHGVVSPAKPADRPDPEVDDPLYLMTLTIA

SEQ ID NO: 175575 - protein, 201 aa, Glycine max
  Coding DNA Sequence Number=SeqID_58797
  Gene Ontology: Mol. function=phosphoglycerate kinase activity; Biological process=glycolysis
  Homolog annotation: Hit_ID=P83696; Match level="QueryCoverage=36%, HitCoverage=22%, E-value=1e-34, Identity=98%"; Hit description =Glyceraldehyde 3-phosphate dehydrogenase
  Subcellular localization annotation: CTP_CleavageSite=54; ConfidenceScore=5.77e-01
MPSSSDRRWPTLASESASVSTPSFGRPRCEVTITAAPASSARRMPGTEARMRVSSEMRPASSNGTFRSARMNTRLPDRAPALASADRVLTLDICFASPRVGERRGRTRFPPWRKTCSSPSIRQRCLLGRHQRDGGVEHAVREAPLVVVPGRNLDQAARDLGQRRVNGAGGRVVVVVHRDQGFGVVVQDALELAFRGGLQDA

SEQ ID NO: 175576 - protein, 130 aa, Glycine max
  Coding DNA Sequence Number=SeqID_58798
MGVAEKILGKENKMDEVQKMIFCGTSNIRLIYHGDMSCAIIGYSSSDYAVDLDARRHEILIPTVALSIIDVEYMVLADAIKEEILLKAKDQVHFIYFEKMVEYVHETYSKDQVDMRENLANMFMKPTLRS

SEQ ID NO: 175577 - protein, 126 aa, Glycine max
  Coding DNA Sequence Number=SeqID_58799
MEIVDCWMMNNRDKEDDSCRLVKVCIHNWQLSCELEGYFSPQLPCPLQRLNTWLYKSSKSRPLGIKLCYFEFRIVLEPMWRLLEVGVDDIERGDWMTLSISSSLTLCDEIYLLFNGASSLVYLYIV

SEQ ID NO: 175578 - protein, 270 aa, Glycine max
  Coding DNA Sequence Number=SeqID_58800
  Gene Ontology: Mol. function=pyridoxal phosphate binding; Cellular component=mitochondrial matrix; Biological process=amino acid metabolic process
  Homolog annotation: Hit_ID=UPI00006B49AC; Match level="QueryCoverage =98%, HitCoverage=68%, E-value=4e-91, Identity=58%"; Hit description =acetylornithine aminotransferase, putative
  Pfam annotation: Domain name=Aminotran_3; Domain location=1-213; Score=141.4; E_value=2.4e-39; Accession=PF00202.11; Description =Aminotransferase class-III
MKLKVLTKNAAKIIVCENNFHGRTTTIVSFSNDPDANQNYGPFTPGFIKIAYNDLSALEEVLNNEAENIAAFLVEPIQGEAGVYVPDEGFLKGASELCKKHNVLFIADEVQTGIARTGKLIACYHENVQPDILILGKALSGGMYPHGSTFGGNPIACAVAVAALDVVADENLSERAEQLGQLFRNEIQKLIEKSDLITKVRGKGLLNAILINDTPDSSTAWNLCLKLKENGLLAKPTHGNIIRLAPPLVITEEQLLDCIEIIKKTILEFK

SEQ ID NO: 175579 - protein, 59 aa, Glycine max
  Coding DNA Sequence Number=SeqID_58801
MGSFIAGTQSGYLGRNEFGCQGVGLGPNFHIIPQGTRDNDDLKTTCKISHGYSQDDVPK

SEQ ID NO: 175580 - protein, 106 aa, Glycine max
  Coding DNA Sequence Number=SeqID_58802
MVIRTFRQPGANESVDAQRLTSSSAPFVIQGQRVRWQAEIPYGRLHLSSTKANEFGGIRMMLVFTLVVRRHSSPTMHEILLCWAGTIKFDSVWKHHGYPILSLSRH

SEQ ID NO: 175581 - protein, 162 aa, Glycine max
  Coding DNA Sequence Number=SeqID_58803
LDGGGRINSARQSIHGSPTKIENGELANSARQSIRVAPDSMAINSWGSRLDGGGRMNSARQSIHGLNGGGRMNSARKSIHGSPNKIENGEFANNARQSIDGAPDSMAINSRGSILDGGGCMNSARQSIHGSPNKIEKGELANSASTQFSTLQTRWWKTHEQR

SEQ ID NO: 175582 - protein, 91 aa, Glycine max
  Coding DNA Sequence Number=SeqID_58804
  Subcellular localization annotation: CTP_CleavageSite=74; ConfidenceScore=5.31e-01
MGHATLSPYSCNLCPNMRSPSARKWPRGNLPQRDPGKIKRPKELVPLPSMTVTALGALNTSSASRPSRDGHFSRSDASSSGTMSIPISRRR

SEQ ID NO: 175583 - protein, 144 aa, Glycine max
  Coding DNA Sequence Number=SeqID_58805
MRINLICGKHANQPFLLADQRDPQVQHNINTTYGSSTLFADHLEEQHLAAEWKKKRTRRREKQQLARKKNNHLVLEKQMGSRKNEEGGRKKLKRLAEERRRRRKARRKGRRMKEKRLAEKEEERVVGCTAFFLKNNKGICDFSQ

SEQ ID NO: 175584 - protein, 51 aa, Glycine max
  Coding DNA Sequence Number=SeqID_58806
MTDSYWMHRIRVGRFCAFDPPPSLVFGLRVLELKEQGVSKEQAMAMADVVT

SEQ ID NO: 175585 - protein, 47 aa, Glycine max
  Coding DNA Sequence Number=SeqID_58807
MSVKNLVRHLRVHDKTDDTLGDQSGSRCFARMLQSCGIDTCLKEHSN

SEQ ID NO: 175586 - protein, 135 aa, Glycine max
  Coding DNA Sequence Number=SeqID_58808
DHLHMYFNAPAVEPSSSTRPNELEFTTEPGLPNKELGPFSENEGKVLHNQPYEEDYKKDARLVSLITTTTLHMKIFEETYFQDFEYRHSLDHEEVQHPVGTLFEGMHLLTKQDVQNALQQYHGEQHEDLALKLEE

SEQ ID NO: 175587 - protein, 120 aa, Glycine max
  Coding DNA Sequence Number=SeqID_58809
  Gene Ontology: Mol. function=ribulose-bisphosphate carboxylase activity; Cellular component=chloroplast ribulose bisphosphate carboxylase complex; Biological process=carbon utilization by fixation of carbon dioxide
  Homolog annotation: Hit_ID=P00865; Match level="QueryCoverage=87%, HitCoverage=92%, E-value=5e-40, Identity=56%"; Hit description =Ribulose bisphosphate carboxylase small chain 1, chloroplast precursor
  Pfam annotation: Domain name=RuBisCO_small; Domain location=61-117; Score=46.9; E_value=6.9e-11; Accession=PF00101.10; Description =Ribulose bisphosphate carboxylase, small chain
  Subcellular localization annotation: CTP_CleavageSite=18; ConfidenceScore=5.27e-01
MASSPISSPVVTIINRVGVSMVAPFTGLKSMAGIPTRKTNSDITSIATNGGRVWPPVGKKKFGTFSYLPDLDDAQLAKEVLKELQEAKTTYPNSFIRIIGFDNIRQVQCISFIAYKPPDF

SEQ ID NO: 175588 - protein, 94 aa, Glycine max
  Coding DNA Sequence Number=SeqID_58810
MAQSADGKVFKIVPCHHLEHSTSNSLSIRALSHDLTGSDRSYFQKLFMSLHAMFAFTQRGGFDQIDKDDSNLPLDTAPIKHVTQTKTRQKIKKD

SEQ ID NO: 175589 - protein, 68 aa, Glycine max
  Coding DNA Sequence Number=SeqID_58811
MSVKNLVESLGVHDKTDHTLGDQSRSCCFARMFQPCEIGKGLKEHSNWVYLPPRPRLQRVCQGLSLLI

SEQ ID NO: 175590 - protein, 58 aa, Glycine max
  Coding DNA Sequence Number=SeqID_58812
MRRYPSGYPYKHSFAIRQTQSLGQRVRWQAEIPYGRPHLSSTKANEFDGIRMMLVVRF

SEQ ID NO: 175591 - protein, 83 aa, Glycine max
  Coding DNA Sequence Number=SeqID_58813
MNLIIVIKRKEHVLWCPYQTRARARVMGEIEEVQEQMKADTEALKEQMVTMMSIKGIIEVNAAAIVTTSTIDEVDLTLPYGLN

SEQ ID NO: 175592 - protein, 98 aa, Glycine max
  Coding DNA Sequence Number=SeqID_58814
MGAGDGGGFGDGGVEVSLCTASSRHSREVWRVIYPSLFPTFILRNSRYPSFSIFHARCRQPLSLHLPYLRMPLHPKYKAHRPTHSCSLWDAVANVTAK

SEQ ID NO: 175593 - protein, 165 aa, Glycine max
  Coding DNA Sequence Number=SeqID_58815
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=96%, HitCoverage=10%, E-value=6e-51, Identity=59%"; Hit description=Chromo
MAEEDIHKTTFWTHQGHYEYCVMPFGLCNVATTFQTIMNELLKPFLCKFIIVFFDDILVYNPSWALHLQHLEVVFSMLSQGSFHLHEFKCVFAKTKLQYLGHIVLVEGVALDPSKISAMLEWPKPTNTTNLRGFLGLTGFYKRFIRRYATMATPLTTLLRKYHFI

SEQ ID NO: 175594 - protein, 229 aa, Glycine max
  Coding DNA Sequence Number=SeqID_58816
MASPWLSETLYRQALFIAVRIEGHGAERMICWLRGYSCSLNWIHCSLAPLMMSSRKRKSVSSRPTAQYDTRRFHSFEAWTRYTDNVLGRHILAERKVEIYHTELDEFKGELERRNFHKRLTNLADSSIDLALVKEFNANLYSPEGPSPEQVRIQGHIIRIDAGRLNAFLETPVVLAKGESLLAYSRYCRMPTDIREIEAALCIPGQGFILNAEGHSGNILRKDLTTLAQ

SEQ ID NO: 175595 - protein, 73 aa, Glycine max
  Coding DNA Sequence Number=SeqID_58817
MHFPSLEEAPVSLRVALPPKVRQFSLSAIPVELELALSMTILAERNSSCVKRNNYRSTQFHLELELRLAHLSR

SEQ ID NO: 175596 - protein, 99 aa, Glycine max
  Coding DNA Sequence Number=SeqID_58818
  Subcellular localization annotation: CTP_CleavageSite=33; ConfidenceScore=5.05e-01
MRKSNLCSSSRPFKALDLKTVSNDLSTDRAWFREFAKRNLQRLSARKNPEEDELSSSLSAPLQVIKCTASAHPLSETSVLSQNPLMRAKRSRSALSTRA

SEQ ID NO: 175597 - protein, 186 aa, Glycine max
  Coding DNA Sequence Number=SeqID_58819
MGGGAWPFLVGGAICLVNSVNERDLSLLNSYVEVTSTASFLEGLWPLRPRKFEAITGIPSKRESSARVDYVPALCTHRPSLLPIEWSGEVFGLRRRERFAARDVVNLRKDHCRCLTIRLTRELVYSSTVGREGMTTAPRAPGLLVLATNTNPGASCAKELKSVKCDSRGPGDGVPRESSRHNIYIQ

SEQ ID NO: 175598 - protein, 78 aa, Glycine max
  Coding DNA Sequence Number=SeqID_58820
MARRDKLWSFCTFCHLAAVILMTCVDKLWSSVPFVNREERIQQYQDDVGHSVLIIFKIFAGAVGGDIDWPNGVLLERN

SEQ ID NO: 175599 - protein, 94 aa, Glycine max
  Coding DNA Sequence Number=SeqID_58821
MERRRMIIICLCVPSDTIASGWQKGLPLDGEKVCGMTIICLRMTSGPPPLDDKWRRMTIICLCVPLDTIVSEWQKGERNNHNLSPHVIRPAVSG

SEQ ID NO: 175600 - protein, 142 aa, Glycine max
  Coding DNA Sequence Number=SeqID_58822
DGESDDMWGYRMVIRTFRQPGLNEPVDVQRLTSYSAPFVNQGGSEPVDTDSESDDMRGYRMVIRIFCHPEIASPMTCGGTGYRMVIGTFRQPGANEPTNIVFYTFCHPETASPMTCEGTGYRMVIRTFCHPETASPLTCRGT

SEQ ID NO: 175601 - protein, 142 aa, Glycine max
  Coding DNA Sequence Number=SeqID_58823
  Gene Ontology: Mol. function=ribulose-bisphosphate carboxylase activity; Cellular component=chloroplast ribulose bisphosphate carboxylase complex; Biological process=carbon utilization by fixation of carbon dioxide
  Homolog annotation: Hit_ID=P00865; Match level="QueryCoverage=68%, HitCoverage=55%, E-value=6e-42, Identity=89%"; Hit description =Ribulose bisphosphate carboxylase small chain 1, chloroplast precursor
  Pfam annotation: Domain name=RuBisCO_small; Domain location=87-142; Score=27.2; E_value=1.3e-07; Accession=PF00101.10; Description =Ribulose bisphosphate carboxylase, small chain
MPSPLDGYCRNHSLIYSKFEQKLGNLAAEAQQLPPLTMLVLAWLFHSQALNPWLASPTRKTNNDITSIAINNGRVKCMHVWQPIGKKFETLSYLPNLDDAQLAKEVEYLLRNGWIPCLEFELEHGFVYREHNRSPRYYDGRY

SEQ ID NO: 175602 - protein, 60 aa, Glycine max
  Coding DNA Sequence Number=SeqID_58824
MPALLVNVWAFLELLIYIACLCKKQIMLKGGMNRGRMGLFQDLFEIILWHLDILMRHEKS

SEQ ID NO: 175603 - protein, 135 aa, Glycine max
  Coding DNA Sequence Number=SeqID_58825
  Homolog annotation: Hit_ID=Q9SU91; Match level="QueryCoverage=47%, HitCoverage=22%, E-value=4e-16, Identity=67%"; Hit description=UDP-N- acetylglucosamine O-acyltransferase-like protein
MNVFHRLFTCISIFLDNKYKVQLGSLSEVYAQEADIHQSKITRFLRLPQVFRLVPFVLLAPLQSWGMIVNYIPEAIFFGAFVGDDHPGCTVIGSNNTIGYHAVIGVKCQDMKYKGGALAPTYPQVRWEIQINIVL

SEQ ID NO: 175604 - protein, 343 aa, Glycine max
  Coding DNA Sequence Number=SeqID_58826
  Gene Ontology: Mol. function=peptidase activity; Cellular component =cellulose and pectin-containing cell wall; Biological process =proteolysis
  Homolog annotation: Hit_ID=Q9FFC3; Match level="QueryCoverage=99%, HitCoverage=63%, E-value=1e-141, Identity=71%"; Hit description =Protease-like protein
  Pfam annotation: Domain name=Asp; Domain location=1-342; Score=-89.3; E_value=2.5e-08; Accession=PF00026.14; Description=Eukaryotic aspartyl protease
  Subcellular localization annotation: CTP_CleavageSite=59; ConfidenceScore=5.16e-01
IDTGSDVLWVSCGSCNGCPQTSGLQIQLNYFDPGSSSTSSLISCLDRRCRSGVQTSDASCSGRNNQCTYTFQYGDGSGTSGYYVSDLMHFASIFEGTLTTNSSASVVFGCSILQTGDLTKSERAVDGIFGFGQQGMSVISQLSSQGIAPRVFSHCLKGDNSGGGVLVLGEIVEPNIVYSPLVPSQPHYNLNLQSISVNGQIVRIAPSVFATSNNRGTIVDSGTTLAYLAEEAYNPFVIAIAAVIPQSVRSVLSRGNQCYLITTSSNVDIFPQVSLNFAGGASLVLRPQDYLMQQNFIGEGSVWCIGFQKISGQSITILGDLVLKDKIFVYDLAGQRIGWANYD

SEQ ID NO: 175605 - protein, 168 aa, Glycine max
  Coding DNA Sequence Number=SeqID_58827
MPSELSTDSTKTSTSSDSSTTTSKIEYPTHTNPLILQFTAVFHNDMDIIEVPTFYHQQWAPEYPEFVNFRYDGTIYQIRLRQHRTKVYFAKGLKEFRKDLSIYESVIIKFLACNNKSMFDLYFVPSLECQTCGRPEVMSRQHIWALEITQSILGALGPLRLPNCAMTH

SEQ ID NO: 175606 - protein, 53 aa, Glycine max
  Coding DNA Sequence Number=SeqID_58828
  Homolog annotation: Hit_ID=Q9SJK3; Match level="QueryCoverage=96%, HitCoverage=5%, E-value=1e-11, Identity=62%"; Hit description =Argonaute-like protein At2g27880
PPAYYAHLAAFRARYYMEGETSDSGSASGGRTANFEVKLPSVKENVKDVMFFC

SEQ ID NO: 175607 - protein, 238 aa, Glycine max
  Coding DNA Sequence Number=SeqID_58829
  Homolog annotation: Hit_ID=Q9FQZ3; Match level="QueryCoverage=22%, HitCoverage=21%, E-value=9e-08, Identity=49%"; Hit description =Avr9/Cf-9 rapidly elicited protein 231 precursor
MNTKQSHEGCKNHERLKLKWESTKDVMSRTSRVKTRGLAESNSAAMKWKNTFSRHKEWRRTECTAAMEPRRLTKGATRPVSVIWRLDVVEECVVVCGCRERADSEAKQWWEEEAENEGGNDGALAEEKNLEEWSMAKSVLVGRKQKGCCCCWVLEGKKMAFSLEPGWRRGKFQSEKERKSWSFESKKKLSLRLKIVNYFTCLSDVDTWPSTSEDNGQRPIGTSRTNIGEIYKNGRSNL

SEQ ID NO: 175608 - protein, 350 aa, Glycine max
  Coding DNA Sequence Number=SeqID_58830
  Gene Ontology: Mol. function=translation initiation factor activity; Cellular component=cytoplasm; Biological process=multicellular organismal development
  Homolog annotation: Hit_ID=Q9SJK3; Match level="QueryCoverage=96%, HitCoverage=33%, E-value=1e-133, Identity=68%"; Hit description =Argonaute-like protein At2g27880
  Pfam annotation: Domain name=Piwi; Domain location=81-350; Score =282.7; E_value=7.2e-82; Accession=PF02171.8; Description=Piwi domain
MVNGGTVQHWTCLNFSGKTNRGLAASFCQELAKMCNNKGMRFNLDPLLPITSVHSSQVESALGNVHKQAIAKLANEGRLELLIIILPDLKGSYGKIKRICETELGIVSQCCLPRHVYQMKPQYLENVALKINVKVGGSNTVLNDAFTRRIPHVSDLPTIILGADVTHPQPGEDYSPSIAAVVASMDWPYVTKYRGVVSAQTHREEIIQDLYNTHEDPVRGKTHSGIIRELLRAFRLSTKTKPERIIFYRDGVSEGQFSQVLLYEMDAIRRACASLQEDYMPRVTFVVVQKRHHTRLFPAEHGSRDQTDKSGNILPGTVVDTQICHPREFDFYLNSHAGIQVIQYSKMDQL

SEQ ID NO: 175609 - protein, 48 aa, Glycine max
  Coding DNA Sequence Number=SeqID_58831
MSRPPLKTSQSLKNSLKLFKMPPLVLYGNLVGGPSLSANLVLSLKDDG

SEQ ID NO: 175610 - protein, 95 aa, Glycine max
  Coding DNA Sequence Number=SeqID_58832
MTTSMTSVGPSTSSVGSTLTLCTTASSSDGCLYIDNQICESVGWRLCGGGLAICEPEVCPYWKLLDDALGDYDGVVSDYIELCQQHRCSSHQLGP

SEQ ID NO: 175611 - protein, 169 aa, Glycine max
  Coding DNA Sequence Number=SeqID_58833
  Subcellular localization annotation: CTP_CleavageSite=44; ConfidenceScore=5.70e-01
MSASVQLLYVHFSRGTSPSNSSHNLSQCKKLGPVTTRPSILMPRYSATSSSVMVHSPHGREICWNPVHDNNGIICGSGSGLEIRKHVNTTMLVSRIELLIHVNHGPVIDYIYKRTISPNTLHSCIKSNCESKQREQAMRLEPICGYVYINGDKTKSLLLNQWSRSCIIS

SEQ ID NO: 175612 - protein, 571 aa, Glycine max
  Coding DNA Sequence Number=SeqID_58834
  Homolog annotation: Hit_ID=Q7XYY2; Match level="QueryCoverage=54%, HitCoverage=35%, E-value=2e-68, Identity=50%"; Hit description =Phytochrome and flowering time 1 protein
MSRQKVIDECTQRTSKIRRLLEGQLKSIKAKPTDFSKVNCFNIFRTTLFFLVFKIIDDQWVWEADISGRYSVKSACSVLRQDVLEEAPAEAFKELWKLKVPSKVAMFAWRLLIDRLPTKDNLRRKQVELNDYLCPFCSSVEESASHLFFHCSKVLPLWWESLSWVNMVVVFPQHPRQHFIQHMHQSYEGLIATRWKWWWLALTWSIWKHRNSIIFSGSTFNANKMMEDAVFLLWTWLRHLEKGFQSHFNQWSSNIREGFRFNGSIPNRQPVPAGNVAPATVKVEPVLVASMVSGPAFPHNSSVPRATSTSQGVPSLQTSSLSSVSQDIITNNENAQDTKPTVSMLPLRPVNPAQANVNILNNLSIARQVMNSAALSGGTSMGLPSMSQTPVAMHMSNMISSGMTSSVPAAQNVFSSGQSGITSMTSSGPLTGPAQVGQNSGLGSLTSNTSNLSSSSNIGISQPLGNLQGAVSMGQQVSGMSQGNLSGAQMVQGGVNMNQNVMSGLGQSVVSSGTGTMIPTPGMSQPVQSGMQPLVNNAATNMPLSQQTSGGMQSAQSKYVKVWECNEVGKS

SEQ ID NO: 175613 - protein, 56 aa, Glycine max
  Coding DNA Sequence Number=SeqID_58835
MDHQQQGAQHPRGANYPTVMIHPRSQPTIMIRLRGARSGDANQGGMTLGNSHNHSE

SEQ ID NO: 175614 - protein, 53 aa, Glycine max
  Coding DNA Sequence Number=SeqID_58836
MRPSPTVALSAHQALSEQPNAGAKRDVKHEGVETVTRAKPGYAPSARSNRSTG

SEQ ID NO: 175615 - protein, 73 aa, Glycine max
  Coding DNA Sequence Number=SeqID_58837
MEKSGGKQNNFGSMKEREWKIFRSDKFSAKLPFSTGDIPPHMNKEEKTETPDFLSKNTSLEKILLVHDHTFDL

SEQ ID NO: 175616 - protein, 69 aa, Glycine max
  Coding DNA Sequence Number=SeqID_58838
  Subcellular localization annotation: CTP_CleavageSite=33; ConfidenceScore=5.36e-01
MSLPSAVHVPPLSSAKLLVTGKHVILLFSRSVSSPKEKKKGRSRDESRHREKGRTDEISVLSLLSSYLR

SEQ ID NO: 175617 - protein, 269 aa, Glycine max
  Coding DNA Sequence Number=SeqID_58839
MNSKPLVSVFPLPCFDSNVPRINNPVTEDDVSGIHGDITDQRLGIDESDAFYCGIKLILKMNCYGLQQNAFAACEEMRGPVNFVEQKEPVICPKPRRVGVVSNMPMRHLRWHFNPQAEGSDSKAGAELLEIMFKKVFGLFAIAIVAALVALNVQKCAKAATASLDLKLCRVESHGEEFSNQVASSPPFFCGSPPGRAANPLVQDARFGDEKLCPTLLISSPSGLLSPSSASRKGGCVRMSFGLKPAAVRVDGFDCLNKDCQNSRIPVVA

SEQ ID NO: 175618 - protein, 168 aa, Glycine max
  Coding DNA Sequence Number=SeqID_58840
  Gene Ontology: Mol. function=protein dimerization activity
  Homolog annotation: Hit_ID=Q1S1K5; Match level="QueryCoverage=97%, HitCoverage=35%, E-value=2e-50, Identity=63%"; Hit description =Putative transposase-related
  Pfam annotation: Domain name=hATC; Domain location=91-168; Score=1.0; E_value=0.025; Accession=PF05699.5; Description=hAT family dimerisation domain
MSWGRSRRGGKTQAITTKHHYRVELFYTVVDMQLQELKDRFTETNTQLLLCMDCLNPTSLFSSFDKARLIEFAKFYPYEFSAINLVMLDNQLETYIIDMRSNVEFSSLKGIKNLSEKLVETERYIVYPLVYLVLKLAMILPVATITVERVFSAMKIVKNRLRNRMRDA

SEQ ID NO: 175619 - protein, 116 aa, Glycine max
  Coding DNA Sequence Number=SeqID_58841
MIFTLSSSPNATQTLTPPSPPLTTTGGHHELLLLVAEPPHQEERFNWSKILRILLKNSVEKISSILHFKASLRAIKMGFGPWASPAHYGLKLGPLSPWVRWAQPVGWWASPSTHQI

SEQ ID NO: 175620 - protein, 61 aa, Glycine max
  Coding DNA Sequence Number=SeqID_58842
MEFLQIAIGEIKRKMKKKKIASYGSRFDEEMSKVGRFEGGGSLLVIDYMKTVIDYRPSVLV

SEQ ID NO: 175621 - protein, 104 aa, Glycine max
  Coding DNA Sequence Number=SeqID_58843
  Subcellular localization annotation: CTP_CleavageSite=53; ConfidenceScore=5.10e-01
MNCVFVHVSSTFEFGAMRSDCLVQFSILNLFRSPVNCVFVHVSSTFDEDPLVQSSILQSISSSRADPLDWKIKEEGVETRVVITEKAGRTKSVSYLCFPLISDK

SEQ ID NO: 175622 - protein, 372 aa, Glycine max
  Coding DNA Sequence Number=SeqID_58844
  Homolog annotation: Hit_ID=Q1T493; Match level="QueryCoverage=68%, HitCoverage=46%, E-value=6e-19, Identity=25%"; Hit description =Nucleic acid-binding, OB-fold, subgroup
  Pfam annotation: Domain name=Rep_fac-A_C; Domain location=154-284; Score=-70.1; E_value=0.093; Accession=PF08646.1; Description =Replication factor-A C terminal domain
MKNDDQFRICDHQYKLVFTGVTVLRQSNLEDLPFKKYKFADFTNIVVGLFEPKLLVDIIGVVDEVVYHHVGSKNTLVVFKLKDLSLSDLGIQVRLVFTVGDQGSSQVSGSSQLSSKDEFLSKVEAKTISDINNISKLVWNLMPIFFCQEIVCVTVSTINRIVMDNHSWCYPACSYCHRKTDVETVAFTCACGKHNDQPVLRYRVEVMVTHKEQSTNFLMWDYKCIELIGQSANEVNKLKIEEGDIDLNFSPLALDKLLGYVLAFKIKVQPKFNNVVVLRYSNDLDLINAVVDMLPDAEACSNVHAPILDSDDPSQLESQSVSDTTDHDPLLGLPLKPTKRFTSDDCDDEPKASQISPAQLSSNKLARHDQIE

SEQ ID NO: 175623 - protein, 51 aa, Glycine max
  Coding DNA Sequence Number=SeqID_58845
MLPPRLPPKSFKCHWRQDSRRILGGLRSITSEKMKKKGVNNYGAMMMIINL

SEQ ID NO: 175624 - protein, 220 aa, Glycine max
  Coding DNA Sequence Number=SeqID_58846
  Pfam annotation: Domain name=Transposase_23; Domain location=69-141; Score=-12.2; E_value=0.025; Accession=PF03017.5; Description =TNP1ENSPM transposase
MRRVEEEKQRTMDTFKGQIQEAIKLELSQIASQHSAPLQPNDIQVLAARVSTKGSCAAVETNALAKKPSKLNGDNVGLHVTVENSNKLVAVGKRCDSFGTIHNVPYADDVVRVSVVEVIFGDAEVPILTSEIKFVKEALGSFVPWPTHLVKPILPEEAEKDVSSPLKTVEEEKADEVIDPLGELVKNLFDIYQRPVEVSWDGAKFGINNVKDGYFITHAD

SEQ ID NO: 175625 - protein, 134 aa, Glycine max
  Coding DNA Sequence Number=SeqID_58847
  Gene Ontology: Mol. function=hydrolase activity; Biological process =aromatic compound metabolic process
  Homolog annotation: Hit_ID=Q1S4M1; Match level="QueryCoverage=98%, HitCoverage=41%, E-value=2e-54, Identity=75%"; Hit description =Alpha/beta hydrolase
MGIPGVDRELKKILKANMDEVGARRRAREAFKNIQLGIDHILFKTPCDGIKMEESYEKNSKGLEIFCKSWLPSASKPKAAVFYCHGIARKLASSGYAVFAMDYPGFGLSEGLHCYIHSFDGLVDDVIEHYSKIK

SEQ ID NO: 175626 - protein, 82 aa, Glycine max
  Coding DNA Sequence Number=SeqID_58848
MLKIGDSTKFVIKQDMKGRRHKYGFNNNKREKPEKIMGSPPASPPPPPSPPSDASASPSAVKWTRKASCLRSLSTRPLGARD

SEQ ID NO: 175627 - protein, 106 aa, Glycine max
  Coding DNA Sequence Number=SeqID_58849
MAMGSELEWSLPLLLLVMVALPSQAPGLWRPHPLQRKKAERGAGSGIYEGAGGIIGISVEEEEGSVEEEGVGASDCAVEGASDLLPLAFLGPLKVTVDHQDSNSSS

SEQ ID NO: 175628 - protein, 147 aa, Glycine max
  Coding DNA Sequence Number=SeqID_58850
MKGQTRVFVLYRNRKPSWKIPLRLKGSSRCGFSMENNDSLWWLMVAVGDGESSWNFINGFGRKKEEEMTFFLSYMKAKAELRAHSGYCLIDPNGPIMDNCLVKLQTKFREDATVNEGGAAFLSRHLHVASSRSFIKRLPPEASSWLL

SEQ ID NO: 175629 - protein, 66 aa, Glycine max
  Coding DNA Sequence Number=SeqID_58851
MLHPKIEVPIAGTQSFHSPQEKEVESKTKDSEKGGYTDTSPVLQEGEQSEDSSANEAHQNAKPKPA

SEQ ID NO: 175630 - protein, 99 aa, Glycine max
  Coding DNA Sequence Number=SeqID_58852
  Pfam annotation: Domain name=zf-GRF; Domain location=15-60; Score =38.7; E_value=1.9e-08; Accession=PF06839.3; Description=GRF zinc finger
MSVNSSIRENVTSNRLCYYRRRVTIRTTRTTRNNERLFYVCPLPQQHADRCNFFSWVDEDIDVGATKIGRIEPIPNFGLRLRLEILQREVRILTFRKKR

SEQ ID NO: 175631 - protein, 98 aa, Glycine max
  Coding DNA Sequence Number=SeqID_58853
  Gene Ontology: Mol. function=sequence-specific DNA binding; Cellular component=nucleus; Biological process=regulation of transcription, DNA-dependent
  Homolog annotation: Hit_ID=Q2HRN3; Match level="QueryCoverage=93%, HitCoverage=63%, E-value=2e-13, Identity=37%"; Hit description =Transcription factor, MADS-box
  Pfam annotation: Domain name=SRF-TF; Domain location=9-61; Score =33.7; E_value=6.6e-07; Accession=PF00319.9; Description=SRF-type transcription factor (DNA-binding and dimerisation domain)
MGHARITLKHISKERSHKTTLMLRKKGLIKKIFEFSTMCGVEACLIVYDNGNNGDVAPLTCPRDPTVNMLEVEISQVHKQITNIKYPTWDPSITNMED

SEQ ID NO: 175632 - protein, 188 aa, Glycine max
  Coding DNA Sequence Number=SeqID_58854
MLTLLYNTPYSLKLNLKSWPHSLDLLSCLPLSLATTSPLPSPQTNKLLPHVVFVHTKKIGEKKALGVSSEPPILCPPWVLFNEGVSECSHPNYLMENIVKEPSVNLEDNFYVNLSDMETFIHSDSDSDSESESESDSDSDSESESKVYNDNNDDKAGEAENVDDFQFELTNLEDPPLVISLMTTVWPK

SEQ ID NO: 175633 - protein, 281 aa, Glycine max
  Coding DNA Sequence Number=SeqID_58855
  Gene Ontology: Mol. function=RNA-directed DNA polymerase activity; Biological process=RNA-dependent DNA replication
  Homolog annotation: Hit_ID=Q1SFJ7; Match level="QueryCoverage=53%, HitCoverage=19%, E-value=1e-24, Identity=39%"; Hit description=RNA -directed DNA polymerase
MTGVTTETEGELGARFGDAEEFKVGPTLVVDVGLVEAAVAIEDLDDGVVDAVLEVEEEVKVAKADERGMRAKEEYGVGGGGSTEEKVERGNGRELIMFKVNFKKAYDSIDWEYLMSTMEGMGFPVKWTKWIYECLVTTLVSMLLNGSHTKEFHLGCGLRYGSFITSLVPYSCRRTEYVYSNDSYERVFRSAVGRLLMKYLGLPIGVDPRKKRTWELVVEVIKKRLRSWATKQLSLGGRVLVMRILKLAKYRLKAQVEKGEGPSREGQSPRVEKDEGPSGEG

SEQ ID NO: 175634 - protein, 369 aa, Glycine max
  Coding DNA Sequence Number=SeqID_58856
  Gene Ontology: Mol. function=sequence-specific DNA binding; Cellular component=nucleus; Biological process=regulation of transcription, DNA-dependent
  Homolog annotation: Hit_ID=Q2HRQ1; Match level="QueryCoverage=46%, HitCoverage=74%, E-value=1e-34, Identity=43%"; Hit description =Transcription factor, MADS-box
  Pfam annotation: Domain name=SRF-TF; Domain location=25-76; Score =13.6; E_value=0.012; Accession=PF00319.9; Description=SRF-type transcription factor (DNA-binding and dimerisation domain)
MENRLGWVLNIYITENMGRARITMKCISNERCRLATLKQRRNVLIRKIDQFTKMCGVEACLIVYDNDHVGPVTWPKEAVLVHSILQKYESQKNERPPKTFGIEDFFENRKNMVEADISKVHKQISNIKYPTWDPSFINMEEKQLRALITQVNAKIMACDHVLQNKHQSEANNIMQNMAWGSASSSHIPSQITPTPNNNGRVYFTNSINQFDGASNHGMNMQQVDACFGYIPTMAQESANATSSYPSQLNCLQNIPQSQPIFEDLKPLNDKNEMVDFSNQVDVPLDSTNQLGLFMDWTNDQFGDFEDWINRPIDWSNQPGCGDVMGWDSQPNESIFQNVPVQSQNEEQGGGALHVLPPPSDGFQSSNRLL

SEQ ID NO: 175635 - protein, 68 aa, Glycine max
  Coding DNA Sequence Number=SeqID_58857
MKVMQQKISGEEGLVGGSWGRVIEAEEAGDEGHGVEVGIASDGEEGLSGGTQNVMVHRLTWYSLYGRC

SEQ ID NO: 175636 - protein, 135 aa, Glycine max
  Coding DNA Sequence Number=SeqID_58858
WASSGILPDEPLLPESSRKTFSGSLPEEVFFRKTFGYFRKNTSSGNFPENVLPELPEEPLTGLPEDSAVSLCSPFFPASSPLVFYRPLLSFSTLKGVRETNLVRGEEEDDVRACLAGEEEAVRGEEEAVRGRNEE

SEQ ID NO: 175637 - protein, 79 aa, Glycine max
  Coding DNA Sequence Number=SeqID_58859
  Homolog annotation: Hit_ID=Q1SWI0; Match level="QueryCoverage=73%, HitCoverage=12%, E-value=5e-08, Identity=48%"; Hit description=RNA -directed DNA polymerase
MCAKEVGGLVVRDVRSLNLTLLEKWKWRVMVEKGSSWYNVLAGIYREKGQISRNEKKGLSWRKSICKPEVGVGVEELVV

SEQ ID NO: 175638 - protein, 172 aa, Glycine max
  Coding DNA Sequence Number=SeqID_58860
  Gene Ontology: Mol. function=RNA-directed DNA polymerase activity; Cellular component=chromatin; Biological process=chromatin assembly or disassembly
  Homolog annotation: Hit_ID=Q94HV4; Match level="QueryCoverage=58%, HitCoverage=6%, E-value=1e-35, Identity=69%"; Hit description =Putative retroelement
MEEKDTKTIKVLNPSNSAPSRHFIRKWGRWLPPSSPKRAELLPHEAIPFPEYSRWALMLVKKHDGSWRLCVDYRALNAITIKDRYPIPTIEELLDKLGGASWFSKLDLLQVYYQIRMHEPDVAKNTFRTHHGHYQFTVMPFGLCNAPSSFHATMNDIQSDPAGTSAPPRESF

SEQ ID NO: 175639 - protein, 372 aa, Glycine max
  Coding DNA Sequence Number=SeqID_58861
  Gene Ontology: Mol. function=two-component response regulator activity; Cellular component=nucleus; Biological process=two -component signal transduction system (phosphorelay)
  Homolog annotation: Hit_ID=Q948L2; Match level="QueryCoverage=58%, HitCoverage=36%, E-value=3e-41, Identity=40%"; Hit description =Response regulator 10
  Pfam annotation: Domain name=Myb_DNA-binding; Domain location=175 -225; Score=22.3; E_value=0.0018; Accession=PF00249.21; Description =Myb-like DNA-binding domain
  Pfam annotation: Domain name=Response_reg; Domain location=19-135; Score=59.7; E_value=9.8e-15; Accession=PF00072.14; Description =Response regulator receiver domain
  Pfam module annotation: Pfam domain module=Myb_DNA-binding::Response _reg; Domain location=175-225::19-135
MATYPTKEKVNFHPFPEGLTVLAVDDDHNVLVFIKRMCIQWNYRVIAFSDAPSALNFVREKKGCNIDVILTEVHMANMDGYEFLKHATKEINVPIIMMSHDNATTTSALMEAVKHGACDFWIKPLNENQFRILWTQVARKMWNEKMLAKTDDSSVHGTRVMNTEKNSSTPPKKPRLVWQGELQQRFVRAIMHLGLDKAQPKRILEVMNVPGLTKEHVASHLQICMKYRVNLKKSNKMITAHQENEMQMQLPNNIESRGMVGASSIFPYAVLHPEEQWPNYYHLEEQQGVPYIAKYPSNMINNAKNFAQPIMTVDDAPICGVLPQSNTVTANNALMHPDMYVAAAASSEAANSDALSNSFNELSAILHGNYNF

SEQ ID NO: 175640 - protein, 180 aa, Glycine max
  Coding DNA Sequence Number=SeqID_58862
  Homolog annotation: Hit_ID=Q5XM22; Match level="QueryCoverage=68%, HitCoverage=84%, E-value=2e-26, Identity=45%"; Hit description =Resistance-like protein HAAS-2
ARAETIQCHDSYVRLSWLCDVYEMKIEVCHWIVAVRAYLLHLLGCTLFANKSATHVHVVFLDALRDLTQSGGYAWGVAALVNMYDNLNDASKSTTRQLARYITLLQCWIYGYFPSVGSAVPAKDYDERRVWGPLTVIHRPERVIRQFGYIQTILPHPVASSLFVEEIDDRWMQFGEYIAL

SEQ ID NO: 175641 - protein, 58 aa, Glycine max
  Coding DNA Sequence Number=SeqID_58863
MVVATTTWWGCIGSRGGGSNGDEVNANASNVKVKAMIRDHGKSTIVGNQFFTFRYSRF

SEQ ID NO: 175642 - protein, 50 aa, Glycine max
  Coding DNA Sequence Number=SeqID_58864
MVPFSVKNLVGHLGVHDKTCHTMGLEEHSNRVYLSPRPRLRRVHEGLPPD

SEQ ID NO: 175643 - protein, 60 aa, Glycine max
  Coding DNA Sequence Number=SeqID_58865
MIVTAFVSVIIAIVTTSTAIIIGGCVVVTTDDNGGGNDNHGGGCNGSHGNGSDVDEGDGG

SEQ ID NO: 175644 - protein, 70 aa, Glycine max
  Coding DNA Sequence Number=SeqID_58866
MIFTPFLSLPNPKPPPPPPMTTGDHHESPPLAFGRPHKEEHFNQSGIFKAPLEDSIENRVFDSPFAISSR

SEQ ID NO: 175645 - protein, 129 aa, Glycine max
  Coding DNA Sequence Number=SeqID_58867
  Gene Ontology: Mol. function=RNA-directed DNA polymerase activity; Cellular component=nucleus; Biological process=RNA-dependent DNA replication
  Homolog annotation: Hit_ID=Q1T2D5; Match level="QueryCoverage=96%, HitCoverage=8%, E-value=1e-30, Identity=46%"; Hit description=Chromo
MKFQGSINGLGVQILVDSGSSDNFLQPRLAQCLKLPVEPIPNLQVLVGNGNALTAEGLIQDLEVKIHGHTLKLPVYLLPVCGADLVLGAAWLATIGPDLSDYSTLTLKFYLGNQFITLHGERPSLPQQA

SEQ ID NO: 175646 - protein, 196 aa, Glycine max
  Coding DNA Sequence Number=SeqID_58868
  Gene Ontology: Mol. function=cation transporter activity; Cellular component=integral to membrane; Biological process=potassium ion transport
  Homolog annotation: Hit_ID=Q8YHD2; Match level="QueryCoverage=99%, HitCoverage=42%, E-value=1e-100, Identity=94%"; Hit description=TRK SYSTEM POTASSIUM UPTAKE PROTEIN TRKA
  Pfam annotation: Domain name=TrkA_C; Domain location=122-190; Score =66.9; E_value=6.4e-17; Accession=PF02080.11; Description=TrkA-C domain
  Pfam annotation: Domain name=TrkA_N; Domain location=2-92; Score =26.7; E_value=8.3e-05; Accession=PF02254.8; Description=TrkA-N domain
  Pfam module annotation: Pfam domain module=TrkA_C::TrkA_N; Domain location=122-190::2-92
MIESEHDRAFAIADQLKRTMVLHGSALDQNLLQEADIQDADLMVALTNQDQVNILSSIMAKRLGCKSNMALLNTVAYQDFTHMVGIDAYINPKAVTISKILQHVRRGRIRAVYSVYRDMAELIEAEALETSSLVGAPLRDLDLPEGLRIGAIYRDGQVIRPNGDVRIKPKDRVVIFATSDAVKHVEQMFRVSLEFF

SEQ ID NO: 175647 - protein, 239 aa, Glycine max
  Coding DNA Sequence Number=SeqID_58869
  Gene Ontology: Mol. function=hydrolase activity; Cellular component =integral to membrane; Biological process=aromatic compound catabolic process
  Homolog annotation: Hit_ID=Q1M5Q2; Match level="QueryCoverage=99%, HitCoverage=81%, E-value=1e-104, Identity=75%"; Hit description =Putative dienelactone hydrolase family protein
  Pfam annotation: Domain name=AXE1; Domain location=1-237; Score= -222.6; E_value=0.066; Accession=PF05448.3; Description=Acetyl xylan esterase (AXE1)
  Pfam annotation: Domain name=Abhydrolase_3; Domain location=45-212; Score=-88.6; E_value=0.059; Accession=PF07859.3; Description =alphabeta hydrolase fold
  Pfam annotation: Domain name=BAAT_C; Domain location=103-239; Score= -69.0; E_value=0.004; Accession=PF08840.1; Description=BAAT  Acyl-CoA thioester hydrolase C t
  Pfam annotation: Domain name=DLH; Domain location=28-238; Score =209.0; E_value=1.1e-59; Accession=PF01738.9; Description =Dienelactone hydrolase family
  Pfam annotation: Domain name=Peptidase_S9; Domain location=56-237; Score=-37.1; E_value=5.9e-05; Accession=PF00326.11; Description =Prolyl oligopeptidase family
  Pfam module annotation: Pfam domain module=AXE1::Abhydrolase_3::BAAT _C::DLH::Peptidase_S9; Domain location=1-237::45-212::103-239::28 -238::56-237
MAQQVEFTDPDIHPEYITYPSPEGNGEVRAYLVRPAKLQGKLPAVVVVHENRGLNPYIEDVARRVAKAGFIALAPDGLTSVGGYPGNDDKGRELQQQVDPTKLMNDFFAAVDFMMKSDLTTGKVGITGFCYGGGVANAAAVAFPELAAAVPFYGRQAPADEVPRIKAPILLHYAELDTRINEGWPAYEEALKKNGKTYEAYIYPGVNHGFHNDSTPRYDEAAAKLAWDRTIEWFKRYLA

SEQ ID NO: 175648 - protein, 42 aa, Glycine max
  Coding DNA Sequence Number=SeqID_58870
MATPMSTACYLDKDKAGQSVDIKKYRDIKPIPKNLTLVPSKE

SEQ ID NO: 175649 - protein, 100 aa, Glycine max
  Coding DNA Sequence Number=SeqID_58871
MFATHFRALSPLGISISHLRYEKYPSHCSIVFPAEIQNCLGKTTIPKKESHDDSTSGGFNLFSVSLTFKNSIGAVGEKTSGISGNLYRCRYRCRKTRESA

SEQ ID NO: 175650 - protein, 190 aa, Glycine max
  Coding DNA Sequence Number=SeqID_58872
  Subcellular localization annotation: CTP_CleavageSite=66; ConfidenceScore=5.60e-01
MLSSNAEDSVRKKGFYKSCPPPPPPPPPIMFQKSVFMKPRFNGSSNEAPSFNKELKRSFTSERTTPVGKKSHEENKSKQGTLFRNNKFMGHASVPLVSQPAEKESLLVESNDDDDDDDTEIEDQDVEGGRTVAQNNDRGKGPPVIGGESSKIDGDEGPDVDKKADEFIAKRIESIKRSRRSARNSSSLRL

SEQ ID NO: 175651 - protein, 129 aa, Glycine max
  Coding DNA Sequence Number=SeqID_58873
MKLTDLNEKAPITDCHADASQWFNTHGEISGNTEKGIEGEHEKALPLEVLRSNSKAQQLEKSIVDFNPTSKTDPSPSLHEDSIELQCALFKEMGLTYGEDDNKVKGLLLDMENKYNMMAAEKGIKIQQL

SEQ ID NO: 175652 - protein, 73 aa, Glycine max
  Coding DNA Sequence Number=SeqID_58874
  Pfam annotation: Domain name=DUF295; Domain location=16-70; Score =43.0; E_value=1e-09; Accession=PF03478.8; Description=Protein of unknown function (DUF295)
TVGFEVFKMNWGLLTWQRVETLGERVLFVGGNSSLSFCASDFVGCSADCIYFTDDYSESNDDDACGKHDLGVF

SEQ ID NO: 175653 - protein, 55 aa, Glycine max
  Coding DNA Sequence Number=SeqID_58875
MIMAAVVVTTDDNGGGNDNHGGGCNGSHGGGSDVDKVNIGFGKTDVSMPLLTSVL

SEQ ID NO: 175654 - protein, 138 aa, Glycine max
  Coding DNA Sequence Number=SeqID_58876
MPLHPNYNQINKKHMLNSHSPLMKLTDLNEKAPITDCHADTCGPTLSATKVYVRRKEVLRSNSKAQQFKKSIVDFNPASKTDPLPSLHEDSIELQCALLKEMGLTYGEDDNKVKGLLLDMENKDNTMAAEKGIKIQQL

SEQ ID NO: 175655 - protein, 65 aa, Glycine max
  Coding DNA Sequence Number=SeqID_58877
MDIRQEIQCRKLPPLGFARQYSWREKKESHEDSISGGFNLFSVSLTFGNSIGAVGGITERISGNH

SEQ ID NO: 175656 - protein, 75 aa, Glycine max
  Coding DNA Sequence Number=SeqID_58878
MVLTSAPSLKVSILRRCLHQQRLRMPTFKDVVEVSTVLECLLSKTLVSFDDVTFNDVRRMSLYPLFDRRRIAFFQ

SEQ ID NO: 175657 - protein, 72 aa, Glycine max
  Coding DNA Sequence Number=SeqID_58879
MVVVDDGEKAWVIGNEFGRKKEEEMRREHFIYLLEDPNGQIMDKCLVKLQTKFREDSTINEGWAAFLPRQLM

SEQ ID NO: 175658 - protein, 99 aa, Glycine max
  Coding DNA Sequence Number=SeqID_58880
MPFLLTFLSGEGANDPCPLLADRGEISFSFLHEKRHHPDRTEAIVITSPKTTIDWQDTAREQKESGGEAYASMPTAPTLYYWWLIGPFAYPVFWLASKE

SEQ ID NO: 175659 - protein, 295 aa, Glycine max
  Coding DNA Sequence Number=SeqID_58881
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=2e-32, Identity=28%"; Hit description= UPI00006A17C9 related cluster
GLHVLAIRGLHVLAFRGLHALAIRTLHILAFRWLHALAFRGLRVLTIRGLHTLAFIGLDSLAFIGLDMLAFCRQYALAFRGVHVLAIRGLHALAFRGLHRATRPNLSLRGQHALAFIGLHVLTLSGLDVLTFRAQHVLNFRGLHVLTLRGLHALSFRGLHEILHLLAISGLDVLSFRGLNALAFRGLDVLTFRGLHVLAFRVLHVVAFRGLHVLLHVLAFRGLHALAFRGVHALTFIGLHTLVIRGVHVLAFRGLHALAFRGLHVLAFGGLHTLAFRGLHVLLHVLVIEAVPESN

SEQ ID NO: 175660 - protein, 358 aa, Glycine max
  Coding DNA Sequence Number=SeqID_58882
  Gene Ontology: Mol. function=nucleic acid binding; Cellular component= intracellular; Biological process=chromatin modification
  Homolog annotation: Hit_ID=Q1RZD5; Match level="QueryCoverage=71%, HitCoverage=73%, E-value=4e-18, Identity=38%"; Hit description=Zinc finger, C2H2-type
  Subcellular localization annotation: CTP_CleavageSite=59; ConfidenceScore=5.36e-01
MEFKYRDGQIRRTPSPLRSPLPSNSYVSNRPLHGCDFASGGFPSNVSAPRVFPMVMSINVNEVFQRELEKEKIWRELEKEKIRREIIASEMAFAQRRELEDEVRKEMELERTFRIPMQRSEGIAFREPISESINQSRLNNITMFGGLPFHLLSQASKQIHTDNIQFDNKEASNSKDKVIILNKPDDHCGEKRKAVTLPIDDNESLQKKAKKEWTCELCQISTTSEKGLNDHIQGKKHKANKESTRTQKIGLDSRPERETLHPCFTPADTCNMESEEKGQVVPKSKGLGDLDDQNETTTSKQAQETSALSKGKKFDFWCELCQVQTQSEIVMQSHQNGKKHLRNMKKLNHNNDGVANLG

SEQ ID NO: 175661 - protein, 49 aa, Glycine max
  Coding DNA Sequence Number=SeqID_58883
MAARAEGESVGNLDVRTGDVLVWISQMLINLVQVMTPMAVDDDNENSPF

SEQ ID NO: 175662 - protein, 206 aa, Glycine max
  Coding DNA Sequence Number=SeqID_58884
  Pfam annotation: Domain name=F-box; Domain location=20-67; Score =25.0; E_value=0.00027; Accession=PF00646.23; Description=F-box domain
MELLENGTAKQNEVSVTKKDYISTLTEHIIHEILSRLTMPDVARISCLSKTWKNFYVSFPCLNIEQQYFDHLSYDSFKNFMYHKVRSMSIKEESLVIHKFKLCMHYKYVREAKEEIVNCTRLISKMSTIKEFDFQIIQGNHFDNPDYSYELLHHIYNAKMLMVLRLSGLIMIQPFRDTKFSHLEILSCPMVREIAIVKCNGLEHLK

SEQ ID NO: 175663 - protein, 139 aa, Glycine max
  Coding DNA Sequence Number=SeqID_58885
  Subcellular localization annotation: CTP_CleavageSite=25; ConfidenceScore=5.34e-01
MALVAGSGFKAVAGGQAAVSWVGARGGFRSGDEVFRGFDSGSGCGLMVLTMSLRLRPRHRLRLQQPPSVSSAAPTTKTRKICVFFFRSEHFFPDLTKRRPPSTRWRWWWSHILSDGVVGKATAVVVRHGDGGHRGLRWL

SEQ ID NO: 175664 - protein, 271 aa, Glycine max
  Coding DNA Sequence Number=SeqID_58886
MMQYSEEISQLQECMLDINQVLWTKNIWISLWFDKFKDSADQKLVIYPKHKNFYHAVVLEDWSSMAELALMTQISEEAERIIITTMSFAHLVDYMFGDSGKDLSSVLAFSLTDESSLYELLNNKPKVSFRDKNGEVVQQTFVCSRAGLRQDRGLTTETRKHESRNEARCECGAMCHVHIDNANQDGGYHKVGYLKKDVHNQLARQRREHASDVSGALKYLAYLMSKDPLMFTLTEPMVNAAAPVIIPDHVVHYVLADEPPKNGGHIARFYL

SEQ ID NO: 175665 - protein, 512 aa, Glycine max
  Coding DNA Sequence Number=SeqID_58887
  Homolog annotation: Hit_ID=UPI00004D7A26; Match level="QueryCoverage =24%, HitCoverage=12%, E-value=2e-17, Identity=31%"; Hit description =UPI00004D7A26 related cluster
  Pfam annotation: Domain name=DUF418; Domain location=124-231; Score= -57.7; E_value=0.094; Accession=PF04235.3; Description=Protein of unknown function (DUF418)
MKEHGNEEPVFEIGVVIPRRVVQEKDESCDCAYVLVKEFEKVGFVVERVIGIADEFIKVEEVEAFVKQPDGSVFSWYERFQCYCHLIYGTVNNSKSVKTLKFDGKEIHWEIGENLLLKLESLEIVKQVFPLHDEKKRKKLLRSWALQWWDFTSQPIDEIYSYYGAKIAIYFAFLGMFTRWMLFPAAFGLTLQLIDFGSLKLVVLPIFFIMVILWAIMFSQFWKRKNSALLARWPISSIVAVDQGYKISGRKSSSWQPPMELMKVFETDRAKEKEIFQRHEWLGRLMRFRNDAIIIFSIICLQLPFELAYAHLYEVLDSDIIKASPGAAVKLCLGDLLVMGSNPETASLHMQGKGCVQHPSSIPSHSEEPLGNGYITKIGGKVSVKLIMNENNENTEKRADSLVYKVFGLYFMQTYIGIFYHALLHRNFSTLRQVLIQRLLLSEVAEKVLENLVENSLPYLKYSYKKYRVRHKKNEKGEAREKFQFSSRVEKEYLKPSYSASIGEELEDGLFD

SEQ ID NO: 175666 - protein, 492 aa, Glycine max
  Coding DNA Sequence Number=SeqID_58888
  Homolog annotation: Hit_ID=Q1SEY4; Match level="QueryCoverage=70%, HitCoverage=58%, E-value=2e-16, Identity=26%"; Hit description =Cyclin-like F-box
  Pfam annotation: Domain name=F-box; Domain location=19-66; Score =38.2; E_value=2.9e-08; Accession=PF00646.23; Description=F-box domain
  Pfam annotation: Domain name=LRR_2; Domain location=183-208; Score =18.5; E_value=0.024; Accession=PF07723.3; Description=Leucine Rich Repeat
  Pfam annotation: Domain name=LRR_2; Domain location=283-307; Score =3.7; E_value=5.1; Accession=PF07723.3; Description=Leucine Rich Repeat
  Pfam module annotation: Pfam domain module=F-box::LRR_2::LRR_2; Domain location=19-66::183-208::283-307
MELVERAKGIEVSTVEKDPLISTMPEHIIHEILSRLSMLDVARTSCLSKQWNNFCVSFPCLNIDQSDFNHLPFHHFKNTMLHKVMSIKEEEERLVIHKFRLRMHFEYVQNATKEIEECTRLVLQTSTVKEFDFQIMHHCLYATKGNWCQLFHHIYNAKTFVVLRLSGLTLIQPSDRDIIKFSHLEILRLENVWVKRENVIDWLFTSCPLIREISLVRCNGLKHLKVCGNLGHLKQLEVVFCQMLESVEIQVPSLEKLVLSEIERRRGTEFCMALRIDSETSETLRELTLCNSTIGGLTFTRLFSRCSKVESLVLERCIRFFKIKIASQKLRKLVVKRCYDLVVTDIEATNLTSFMFCNYVPNKVYQDFAVDKQIQYCEEISQLQECLLDFNKVLMSKNIWTYLWFDKFNYSADQKMIIYPLKNYKGYDVVVLEDWSSMAELTLMTQISESSSRTTITTMSFLDLASYVFGDCGKGLKGVLAISISGKSMLHE

SEQ ID NO: 175667 - protein, 71 aa, Glycine max
  Coding DNA Sequence Number=SeqID_58889
MKIYQLQILLLSLFLEVPYLTSIVDNCQWGISEKAPKAQLEVEARIIGPLLGCIGVHSTTTTTRIMTFYVG

SEQ ID NO: 175668 - protein, 123 aa, Glycine max
  Coding DNA Sequence Number=SeqID_58890
MIFYCTGSKMIVTKSMIGTFSEFSAAFPTVIENPTACLKEAEPEPEIPVFSFKTPVQTKARSKQTRNGLRVWPFRSPSFTNSSSSSTTSFSSSFSASSPLLIYSQSLRWHDLCPRLLHRRHFW

SEQ ID NO: 175669 - protein, 164 aa, Glycine max
  Coding DNA Sequence Number=SeqID_58891
  Gene Ontology: Mol. function=structural constituent of ribosome; Cellular component=intracellular; Biological process=translation
  Homolog annotation: Hit_ID=O82204; Match level="QueryCoverage=94%, HitCoverage=99%, E-value=8e-45, Identity=60%"; Hit description=60S ribosomal protein L28-1
  Pfam annotation: Domain name=Ribosomal_L28e; Domain location=5-150; Score=149.4; E_value=9.5e-42; Accession=PF01778.7; Description =Ribosomal L28e protein family
MATVPGQLVWEIVKKNNSFLVKQFGRGTQSVEFSRESNNLYNLNSFKYSDLALSEKHFMDWINVFRWFVAECLILLFMDQAVLLATTKTKKQNKPAALLHKSVMKKEFRRMAKAVENQVAKNYYRPDLKKAALARLSAVHRSLKVAKSGVKKRNRQGVRVAGRK

SEQ ID NO: 175670 - protein, 81 aa, Glycine max
  Coding DNA Sequence Number=SeqID_58892
  Subcellular localization annotation: CTP_CleavageSite=15; ConfidenceScore=5.04e-01
MSVKKSESLNGSNAVAKLKGQKPSKRRHFERCFSSVELTMEPGKQLKDMDSNKLKAEIKRWAKAVVAYARQVSGRFGKSQG

SEQ ID NO: 175671 - protein, 326 aa, Glycine max
  Coding DNA Sequence Number=SeqID_58893
  Gene Ontology: Mol. function=ATP binding; Cellular component=nucleus; Biological process=regulation of transcription, DNA-dependent
  Homolog annotation: Hit_ID=P59278; Match level="QueryCoverage=50%, HitCoverage=18%, E-value=6e-16, Identity=35%"; Hit description =Uncharacterized protein At1g51745
FSPILVSCSSGKPQVSPLGEQSCNASQCEAVSLRNESKNEPGCTSSVAGHSIVGHRADKGIGNSDGIYQGACQKVDWNGMGEPNTSYNCTSQVNCKPVAEGQLEGLRDLNKHVKVTTTEAKLLPDGSLTPQRLLPYRHSRFTVNSRYQTADFPGRNYCSDASLYDVKLEVKSSYRPQHVPLVSLVSKLNGKAFIGHPLAVEVMVEGHCDKMLSDIGCDLEVGDVYCVAKPNSVTGRIHSKNSTRFSPSKSSKMKKTGLLNKKIRKLSSLTGHRQSEEERKEKKPVVDKKGPVIACIPLQVVFSRINEAVSGQARSTHRALPTSSNP

SEQ ID NO: 175672 - protein, 117 aa, Glycine max
  Coding DNA Sequence Number=SeqID_58894
MKTLRFEHRSLVEHLKYKSIVALVMGYDEGGWWRLGRRQLHERLWMTSGVVGAKVVRRHAAMLVGVAPNLLKAQRCMCLEVESDLEVEAACNVGGGWWGWCVMSMECGKLHHLLTEK

SEQ ID NO: 175673 - protein, 718 aa, Glycine max
  Coding DNA Sequence Number=SeqID_58895
  Gene Ontology: Mol. function=RNA-directed DNA polymerase activity; Cellular component=chromatin; Biological process=chromatin assembly or disassembly
  Pfam annotation: Domain name=Chromo; Domain location=625-675; Score =30.5; E_value=6e-06; Accession=PF00385.14; Description='chromo' (CHRromatin Organisation MOdifier
  Pfam annotation: Domain name=rve; Domain location=322-478; Score =117.2; E_value=4.8e-32; Accession=PF00665.16; Description=Integrase core domain
  Pfam module annotation: Pfam domain module=Chromo::rve; Domain location=625-675::322-478
CGFGYDGLSDTYKVVIILSNVKLQRTEVRVHSVGDTRWRKTLTCHVFPFMEQLDGKFVGGTVNWLALHMSSSYYRWEDVNVNEIVIFSYDLKTQTYKYLLLPDGLSEVPHVEPILGVLKGCMCLSHEHRRTHFVVWQMMDFGVEKSWTQLLNYLLGHKFTIFTDHRSLHDLMSQVIQTPEQQFYLAKLLGFDYDIQYKAGSSNIVADSLLRIDHTGQAQCLLLSVPHHEFLTQLKQALFASPDFQTQKKAIQAHPEDHPHFTIANELIFFKNAIWIDSRNPFIPALLHEYHATPLGVLHPRMSCLPTSQARDSAGLLQPISPPTGIWEDLSMDFITHLPSSHSFTVILVVVDRFSKGLHLGALPTQFTAFKVATLFLDIVCKLHGFPSSIISDRDPVFISSFWRELFKLSGTTLRMTTAYHPQSDGQTEVMNRSVEQYLRSFIHKRPEEWHKFLPLAEWAYNTSQHSRTGVTPYEVIYGKPPPSVPGYVLGSSRNEAVDTLLHSRAELHESLRRKLLKAQAEMKHFADKKRRDVQYEIGQLVYVKLRPHRQLSLRSQRHHKLMKRYFGPFPILERIGSVAYRLQLPEGSRIHPVFHCSLLRPHHRPLDLPTSSLPADTSSPHPILEPLAILDSRMDFSVDPPTRFVLVQWVGLPPEDSTWEKWDDVCHAHHLEDKVSFTGSDDVSSSNTTKEDSSHDEPVPQRQRSSTRPKHLEDYVL

SEQ ID NO: 175674 - protein, 170 aa, Glycine max
  Coding DNA Sequence Number=SeqID_58896
MTSIEQQLNLVVVAQPINAIKDADILERLWKDFEDQLWKAKTIASERLRLGGDSSVAPTFPMIETNASDNTDETSRKTLRKRGRKTTSKVLFQVPFSFQPPEFCLKENINLEIVLLNRFKNESSWGNHVPKFSVEERLKNWVIEKRERMQSKDKEKPDAKMQDYVRLDFQ

SEQ ID NO: 175675 - protein, 239 aa, Glycine max
  Coding DNA Sequence Number=SeqID_58897
  Homolog annotation: Hit_ID=Q9AVH2; Match level="QueryCoverage=19%, HitCoverage=16%, E-value=9e-20, Identity=97%"; Hit description =Putative senescence-associated protein
MCPVVGFGPWLGLGKPLVEILPPGQLRGFCPLLAWLGSAVLGYGPVLSFGLVGPPPPPRDQFCCPGFCQLWLAPRWLSLCLGGGSSCHNMARHKVTRTHTHTHSRRHKGEEGLGREGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 175676 - protein, 77 aa, Glycine max
  Coding DNA Sequence Number=SeqID_58898
MSHPIRALCLNVLQHKGDQSGSRCFARMLQPYGINIGLKEHSNPVTPKAYTPKSPLGPFPPDSGPTPKIILAHRHCS

SEQ ID NO: 175677 - protein, 422 aa, Glycine max
  Coding DNA Sequence Number=SeqID_58899
  Gene Ontology: Mol. function=ATP binding; Cellular component=nucleus; Biological process=regulation of transcription, DNA-dependent
  Homolog annotation: Hit_ID=P59278; Match level="QueryCoverage=98%, HitCoverage=63%, E-value=3e-70, Identity=43%"; Hit description =Uncharacterized protein At1g51745
MGSSGESNLNGIDASVGGLVWVRRRNGSWWPGRIMGLHELSESCLVSPRSGTPVKLLGREDASVDWYNLEKSKRVKAFRCGEYNECIEKAKASAANSSKKAVKYARREDAILHALELESAHLDKESLSLCSRLDKPGSEHGGSAGELPLMSGEDNEDVADDLSDSDDNSNAAPELSQSGISFEEPNHNGTLKMQSVQGRRRRTPNDSEDDGFEGVKRMRGLEDLGIGVVSKRKVQGTGATEIVQHISASLNNSTAGNCLANGTSVNGGKGYSSTLKRKRSQVANAHELLKRKNRHRPLTKVLESTAMVSVPVICDQLPSSSGSPLCGVTDGRISGLDSNGSKKTFPTPTHNSDSTEATCENGTSLIGHDHGSDDASQINHKVKENEASGLPGLVGKDSPDELFDVPFVGVLGEEKHTLDLGL

SEQ ID NO: 175678 - protein, 104 aa, Glycine max
  Coding DNA Sequence Number=SeqID_58900
  Gene Ontology: Mol. function=oxidoreductase activity; Biological process=amino acid metabolic process
  Homolog annotation: Hit_ID=Q9C8I0; Match level="QueryCoverage=72%, HitCoverage=12%, E-value=5e-25, Identity=71%"; Hit description=NADP -specific glutatamate dehydrogenase, putative
MEVSISTPNIRHDIWTDLSLIFRSPCLQVVAGELELNHECSLMHWSPEDFESKLQEAMKQTYQRAMKAATDFGYQKESPEALVHGAVISAFLTIAQAMTDQGSI

SEQ ID NO: 175679 - protein, 101 aa, Glycine max
  Coding DNA Sequence Number=SeqID_58901
MALTKQLKKKSEWDTLEEAIKAKLEDIKSHKVTSCRSDLRGLALWCEKLQRRVAASIGGAMSAEAETGTMGRGCQVLMVEASLVMVFLVCATEERKFWRRV

SEQ ID NO: 175680 - protein, 435 aa, Glycine max
  Coding DNA Sequence Number=SeqID_58902
  Gene Ontology: Mol. function=oxidoreductase activity; Cellular component=chloroplast; Biological process=amino acid metabolic process
  Homolog annotation: Hit_ID=Q9C8I0; Match level="QueryCoverage=78%, HitCoverage=54%, E-value=1e-173, Identity=84%"; Hit description=NADP- specific glutatamate dehydrogenase, putative
  Pfam annotation: Domain name=ELFV_dehydrog; Domain location=292-435; Score=7.4; E_value=2.2e-10; Accession=PF00208.11; Description =GlutamateLeucinePhenylalanineValin
  Pfam annotation: Domain name=ELFV_dehydrog_N; Domain location=146 -276; Score=219.2; E_value=9.4e-63; Accession=PF02812.8; Description =GluLeuPheVal dehydrogenase, dimeri
  Pfam module annotation: Pfam domain module=ELFV_dehydrog::ELFV _dehydrog_N; Domain location=292-435::146-276
MGRVKSDYRIWILDSLGEFKPRKVPERVPVTNFFLVCTVNSAISQDLVLNPRPEDVNNFVTFSSYFYPYLIPNSQDSVNITMANFSSLLLFFAMSKTAGSILEATLKRDPHEVEFIQAVQEAVQALERVIAKNSRYINIMERLLEPERMIVFRVSWVDDRGETCVNRGFRVQFNQSMGPCRGGIRFHPSMNLSVAKFLGFEQTLKNALSPYKLGGAAGGSDFDPKGKSDNEIMRFCQSFMSEMYRYLGPDKDLPSEEMGVGTREMGYLFGQYRRLAGHFQGSFTGPRIFWSGSSLRPEATGYGLVFFAQLMLADMNKELKGLRCVVSGSGKIAMHVLEKLIAYGALPISVSDSRGYLVDEDGFDYMKISFLRDIKAQQRSLRDYSKTYARSKYYDEAKPWSERCDVAFACASQNEIDQSDAINLVNSGCRILVER

SEQ ID NO: 175681 - protein, 86 aa, Glycine max
  Coding DNA Sequence Number=SeqID_58903
MGKENEMERGYEEGWSRKREKKKSVREREKGDGSDGVTDLAIGIRRFWYDHVSTSLYTCCKHVSIGEGKENSKIRGWDWCMQSNLG

SEQ ID NO: 175682 - protein, 90 aa, Glycine max
  Coding DNA Sequence Number=SeqID_58904
  Subcellular localization annotation: CTP_CleavageSite=64; ConfidenceScore=5.59e-01
MSGTGTFFYGSVIQSLIQVQQQRYHYPLSSPPFTPTTPFLRKTERFASRQSISSIAKNRFPFPSLFAVEENKATTRFQHRRVSERIVTIS

SEQ ID NO: 175683 - protein, 306 aa, Glycine max
  Coding DNA Sequence Number=SeqID_58905
  Gene Ontology: Mol. function=ubiquitin thiolesterase activity; Cellular component=protein complex; Biological process=ubiquitin -dependent protein catabolic process
  Homolog annotation: Hit_ID=Q9LU31; Match level="QueryCoverage=75%, HitCoverage=42%, E-value=3e-90, Identity=70%"; Hit description =Ubiquitin specific protease; queuine tRNA-ribosyltransferase
  Pfam annotation: Domain name=UCH; Domain location=105-300; Score=7.3; E_value=6.1e-07; Accession=PF00443.19; Description=Ubiquitin carboxyl- terminal hydrolase
  Pfam annotation: Domain name=ubiquitin; Domain location=10-75; Score =4.6; E_value=0.089; Accession=PF00240.13; Description=Ubiquitin family
  Pfam module annotation: Pfam domain module=UCH::ubiquitin; Domain location=105-300::10-75
MWSSFYCYLSVRWQKEIFKDVELDTTQSAYVFKCQLYDLTGVPPERQKIMVKGGLLKGQKLMMMGTADEVVKTPEKGTVFVEDLPEEEQVVAVTTPHAIYNTEKGHTAGLFNLGNTCYMNSTLQCLHSVPELKSALTNYSHSGRNNDVDQSSHLLTIATRDLFNELDKSVKPVAPMQFWMVLRKKYPQFGQLHNGVFMQQDAEECWTQLLYTLSQSLRSLGISENPDAVKALFGIELISRDDSSIPLDGFRKSSTIPYFELHKSTNKRKKKNTSNKNFPSDHCLGSTYGSPPSSTHRLSYGYPFGV

SEQ ID NO: 175684 - protein, 297 aa, Glycine max
  Coding DNA Sequence Number=SeqID_58906
  Gene Ontology: Mol. function=protein transporter activity; Cellular component=type II protein secretion system complex; Biological process=protein secretion by the type II secretion system
  Homolog annotation: Hit_ID=Q0TCD6; Match level="QueryCoverage=99%, HitCoverage=48%, E-value=5e-81, Identity=52%"; Hit description =Probable general secretion pathway protein D
  Pfam annotation: Domain name=Secretin_N; Domain location=1-58; Score =9.6; E_value=0.59; Accession=PF03958.7; Description=Bacterial type IIIII secretion system short domain
  Pfam annotation: Domain name=Secretin_N; Domain location=135-213; Score=50.6; E_value=5.2e-12; Accession=PF03958.7; Description =Bacterial type IIIII secretion system short domain
  Pfam annotation: Domain name=Secretin_N; Domain location=60-131; Score=48.3; E_value=2.5e-11; Accession=PF03958.7; Description =Bacterial type IIIII secretion system short domain
  Pfam module annotation: Pfam domain module=Secretin_N::Secretin _N::Secretin_N; Domain location=1-58::135-213::60-131
ENVPVRELAPLLHQLNDATGIGNVVHFEPSNVLLLTGKASVVNRLVDLVQRVDKDGVQRREIVPLRFASAKELSDMLNNLNNEEQKGQNAPQLATKVVADDETNSLVISGSEAARTRTRSLIHELDREQNNEGNTRVFYLKYASATKVVPVLTGIGEQLKDKAGAPKAKTAAASSDLNITADESTNSLVITAQPNVMNSLEKVIDKLDIRRPQVLVEAIIAEVQDGNGMDLGVQWASKHGGVQFGSTGLPIGQVKNGTMKGLSYTGLATGFFNGDFGALMTALSTGSKNDILSTPSV

SEQ ID NO: 175685 - protein, 185 aa, Glycine max
  Coding DNA Sequence Number=SeqID_58907
  Homolog annotation: Hit_ID=Q9AY32; Match level="QueryCoverage=32%, HitCoverage=90%, E-value=4e-25, Identity=96%"; Hit description=RRNA intron-encoded homing endonuclease
PFHPGLFVGDAGGFQSPTREPLNVGGLVPPHCSLKSVVSDDACPGACFVQRDATTLIKKLVVGPWVGSIGPPPVCTGRLVPSAGDALLSLTGRVVPPDSDPIVLAFGIGVMINRDSRGHSYFIVRDTVLVSTINDADQGSADVAFRTPLAPYEKSKSLGSGGSMVARLKLKGIDGRAPPGVEPAA

SEQ ID NO: 175686 - protein, 120 aa, Glycine max
  Coding DNA Sequence Number=SeqID_58908
QNKAFGVITARPGKLLLHSEATLLAQVSRGYPGQARGQKKCKNDHFALPFEYFLHSFPKRRKNFRIVRQLVSSSSIRLARIKTLANEGPRMKLGYESCHLYLSFIGNKREVKIRTLISFE

SEQ ID NO: 175687 - protein, 235 aa, Glycine max
  Coding DNA Sequence Number=SeqID_58909
  Gene Ontology: Mol. function=transcription factor activity; Biological process=regulation of transcription, DNA-dependent
  Homolog annotation: Hit_ID=Q7WTR1; Match level="QueryCoverage=75%, HitCoverage=83%, E-value=6e-62, Identity=64%"; Hit description =Putative repressor for the acrAB genes
  Pfam annotation: Domain name=TetR_C_2; Domain location=84-210; Score =162.6; E_value=1e-45; Accession=PF08361.2; Description=MAATS-type transcriptional repressor, C-term
  Pfam annotation: Domain name=TetR_N; Domain location=16-62; Score =80.2; E_value=6.5e-21; Accession=PF00440.13; Description=Bacterial regulatory proteins, tetR family
  Pfam module annotation: Pfam domain module=TetR_C_2::TetR_N; Domain location=84-210::16-62
MARKTKAQALETRHQILDAALAHFSEHGVAASSLADIAAAAGVTRGAIYWHFKNKADLLQEIWLRCDAGLDDVELEYQTKYPGDPLSVMRSMLIYILEATAKDPQRRALMEIIFHKCEFVGEMSTLMAMQQGLLQACYDRIEEVLRSCIEAGQLPASLNTRQAALLMRGYISGMMESCATGGRGLYRYAAPEPDARRHALSGALGRQLLLVIALDNRQRSQHRGRGYLVFLQQLN

SEQ ID NO: 175688 - protein, 551 aa, Glycine max
  Coding DNA Sequence Number=SeqID_58910
  Homolog annotation: Hit_ID=Q1SEY4; Match level="QueryCoverage=99%, HitCoverage=88%, E-value=1e-174, Identity=58%"; Hit description =Cyclin-like F-box
  Pfam annotation: Domain name=F-box; Domain location=4-51; Score=28.7; E_value=2.1e-05; Accession=PF00646.23; Description=F-box domain
  Pfam annotation: Domain name=LRR_2; Domain location=177-202; Score =28.1; E_value=3.1e-05; Accession=PF07723.3; Description=Leucine Rich Repeat
  Pfam module annotation: Pfam domain module=F-box::LRR_2; Domain location=4-51::177-202
MERDMISTLPKTILHDILSRMPEEDAVRTSVLSKSWAETWSTYPILYFSDTMIVGTFPRPWEDFLRKRKNFIDHVKRTLLRFHTQGLAIKQFRLIINFDLQYMSLDVDHWLKLASESGVQVLEICLPKGHEQDEKALDPCYILPTGIIEAKSLYKLVLMGGIRVDQAFLSHSVKFFSLRVLSLWSVLLEDEQAIEHLISCCPLIEDVTLKCCSVLNNGGIGGLLEPRTSRMQSISMNALPKLKKVDVQGIPEIIIIDAPSLEYFCFCPGGDVHSPFKMNFDKCRNLRVLYLWSLKSTTITDKWFLDLFTKFPFLECLKFVNCTMSETINISSAQLKVLELSNCSKLKELNLDAPNLLSCGYCGDGASKPIISFLKSSSQLEVNAQIDIDFMDLHYLRECIQNFKPQNVLASLSLFIHQPIVDELNLEILPVSSSPPSIKHLDLRAVPKNETLYLPLVNSVLSSCCPATISLSLNSFFCSRAFIEFFYEMLTGRKEDECFCSSGHIKCWWHGLKDVKVSSTRKADENIDFKTMLDALPTFSHHDNIIFRLEL

SEQ ID NO: 175689 - protein, 567 aa, Glycine max
  Coding DNA Sequence Number=SeqID_58911
  Homolog annotation: Hit_ID=Q1SEY4; Match level="QueryCoverage=95%, HitCoverage=88%, E-value=1e-137, Identity=49%"; Hit description =Cyclin-like F-box
  Pfam annotation: Domain name=F-box; Domain location=25-72; Score =35.2; E_value=2.2e-07; Accession=PF00646.23; Description=F-box domain
  Pfam annotation: Domain name=LRR_2; Domain location=195-220; Score =19.4; E_value=0.013; Accession=PF07723.3; Description=Leucine Rich Repeat
  Pfam module annotation: Pfam domain module=F-box::LRR_2; Domain location=25-72::195-220
MALSFTVNGRRKRSGMLVVKKMEEGQIENLPDIVLHDILSRLPEKDAARTSVLSKKWAEIWSTFPILSFTDTEIIEKFPHSRKDDLVGGKKKFINRVNETFLRFRNKGLVIKEFKLSINCFDLEDLSKDIDHWMKLASESGVGVLELCLHDEFEDDQCYILPTGIIEAESLYKLVLMGRIGVDQAFLNHSVKFLSLRVLSLWFIFSRDEQVIEHLISCCPLIEDITLHVCYAMNHGGLDGPLKYDTSWKQSISMLGLPKLKKVEVLGIQKVVIDAPSLEDFHFSPGAVDEPFEMSFGKCRNLRRLYLSSLDSLIITDNWFLDLFPKFPFLDSLKFSFCKMSETINISSAQLKVLELSNCSNLKEVNIDAPNLLSCEYSGGGASKPIISFLNSSSNLEVKAFIEIDFMEVGNLREIIQNFKPQNILASLSLFIQPPIVDELNLDILPVSSTPPSIKHLYLWVVLENETLFMHLVNSLLSCCCPVTISLCGYTLSFSRAFIEFFYETLMGRKEEECFCGYGHTKCWWHGLKDVKVSSSRKSEESIDFKTLFDALPTFLPGENIIFRLEW

SEQ ID NO: 175690 - protein, 590 aa, Glycine max
  Coding DNA Sequence Number=SeqID_58912
  Gene Ontology: Mol. function=protein phosphatase type 2A regulator activity; Cellular component=protein phosphatase type 2A complex; Biological process=signal transduction
  Homolog annotation: Hit_ID=Q9FVD4; Match level="QueryCoverage=99%, HitCoverage=100%, E-value=0.0, Identity=83%"; Hit description =Ser/Thr specific protein phosphatase 2A B regulatory subunit beta isoform
  Pfam annotation: Domain name=WD40; Domain location=104-142; Score =11.7; E_value=1.6; Accession=PF00400.22; Description=WD domain, G -beta repeat
  Pfam annotation: Domain name=WD40; Domain location=182-221; Score =12.4; E_value=1.3; Accession=PF00400.22; Description=WD domain, G -beta repeat
  Pfam annotation: Domain name=WD40; Domain location=299-337; Score =10.5; E_value=2.1; Accession=PF00400.22; Description=WD domain, G -beta repeat
  Pfam annotation: Domain name=WD40; Domain location=349-388; Score =5.7; E_value=7.8; Accession=PF00400.22; Description=WD domain, G -beta repeat
  Pfam annotation: Domain name=WD40; Domain location=408-445; Score =5.5; E_value=8.3; Accession=PF00400.22; Description=WD domain, G -beta repeat
  Pfam module annotation: Pfam domain module=WD40::WD40::WD40::WD40::WD4 0; Domain location=104-142::182-221::299-337::349-388::408-445
MNGGDEVVAAPASPPQPLEWKFSQVFGERTAGEEVQEGNCLVLRCLLSDPVVDVFGLGGREEVVVLYYGFFLVGLVLDLNGVEFGEWHWSLASGVGLVLMCKFPNYLPNFISSVDIISAIEFDKSGDHLATGDRGGRVVLFERTDTKDHCGSRRDLERMDYSISRHPEFRYKTEFQSHEPEFDYLKSLEIEEKINKIKWCQTANGALFLLSTNDKTIKFWKVQEKKVKKVSDMNVDPKLMGNGSIASSSNSGSSKSYLANGVSSDGPYNYLNNDFSFPPGGVPSLRLPLVTSHETSLMARCRRVYAHAHDYHINSISNNSDGETFISADDLRINLWNLEISNQSFNIVDVKPANMEDLTEVITSAEFHPTHCNTLAYSSSKGSIRLVDLRQSALCDSHAKLFEEQEAPGSRSFFTEIIASISDIKFGKDGRYILSRDYMTLKLWDINMDSGPVATFQVHEYLRPKLCDLYENDSIFDKFECCLSGDGLRVSTGSYSNLFRVFGCVPGSTEATTLEASKNPMRRQVPTPSRPSRSLGNSITRVVRRGAESAGVDANGNSFDFTTKLLHLAWHPTENSIACAAANSLYMYYA

SEQ ID NO: 175691 - protein, 325 aa, Glycine max
  Coding DNA Sequence Number=SeqID_58913
  Gene Ontology: Mol. function=phosphoric monoester hydrolase activity; Biological process=metabolic process
  Homolog annotation: Hit_ID=Q8GUC1; Match level="QueryCoverage=82%, HitCoverage=99%, E-value=1e-111, Identity=70%"; Hit description =Putative phosphatase
  Pfam annotation: Domain name=Put_Phosphatase; Domain location=57-288; Score=498.0; E_value=1.1e-146; Accession=PF06888.3; Description =Putative Phosphatase
MYEITFSGTGQYPEYSRVGEGCKTKPRTTDLEITTTHPNRALFLRNKFLLQNNMSGTVIVFDFDKTIVDVDSDNWVIDELGFTDLFNQLLPTMPWNSLMDRMMMELHSKGKTIEDIEEVLHRIPLHPRVIPAIQAAHAFGCDLRIVSDANMFFIETILKHLGIREYFSEINTNPGYVNEEGRLRILPYHDFNKASHGCTLCPPNMCKGLIIDRIQDSISQEGNKRMIYLGDGSGDYCPSLRLKERDYMMPRKNFPAWDLICKDPLLVKAEIHGWSDGEELEQVLLHLIAKISMEENSQFISSDCKLQTLSVSALEGLPKVLPVRP

SEQ ID NO: 175692 - protein, 123 aa, Glycine max
  Coding DNA Sequence Number=SeqID_58914
  Gene Ontology: Mol. function=ribonuclease H activity; Biological process=DNA integration
MSLEEAHHFRRPWIRAWRKKEMNEGRGREEHEILCSKRALKSEDCIKNAFNKRVHSRKFNEGDLVLKKVSHVQKDFRGKWAPNYEGPFVVKNAFSDGTLILTNMDGEELPSPVNSDDVKRYYA

SEQ ID NO: 175693 - protein, 55 aa, Glycine max
  Coding DNA Sequence Number=SeqID_58915
MVENVFSSLSTLTLSISPEAKLPLHGSLFKFRANFSVLKALGLLSEIIHQGWADR

SEQ ID NO: 175694 - protein, 118 aa, Glycine max
  Coding DNA Sequence Number=SeqID_58916
FISGFLVEPIIRFTKVILVASTVTYLPSLEVASTRTYLPSPEVASTLTYLPSLEVASSKTSVACIKRSAPTQVHINAPESDIRVKSFDHLNFLRASVVPFRASRCIMRLNRDLRVKEL

SEQ ID NO: 175695 - protein, 93 aa, Glycine max
  Coding DNA Sequence Number=SeqID_58917
MDSTVFSLHYRSLARSDSGNIQTRQFGLTSPSSQESFMELTEAKRIYGEAVLDAENAGRDSNDMSIEGEHQKKHRFDRVSPAFEAIFLQKERQ

SEQ ID NO: 175696 - protein, 259 aa, Glycine max
  Coding DNA Sequence Number=SeqID_58918
  Gene Ontology: Mol. function=ATPase activity, coupled to transmembrane movement of substances; Cellular component=integral to membrane; Biological process=transport
  Homolog annotation: Hit_ID=Q1S0T1; Match level="QueryCoverage=97%, HitCoverage=19%, E-value=3e-94, Identity=67%"; Hit description =Cyclic peptide transporter
  Pfam annotation: Domain name=ABC_tran; Domain location=152-258; Score= -26.9; E_value=4.1e-05; Accession=PF00005.17; Description=ABC transporter
MTDRFFKNYLNLVDTDATMFFHSNAAIEWLILRIELLQNLTLFTAALLLVLLPKGYVAPGLVGLSLSYAFSLTATVVYLTRMFCNLSNYVISVERIKQFIHIPAEPSAIVEDNRPPPSWPSKGRIDLQSLEIRYRPNAPLVLKGISCRFEEGSRVGVVGRTGSGKTTLISALFRLVEPTRGDILIDGINICSIGLKDLRTKLSIIPQEPTLFKGSIRKNLDPLCLYSDDEIWKALEKCQLKATISSLPNLLDTSGVLNL

SEQ ID NO: 175697 - protein, 162 aa, Glycine max
  Coding DNA Sequence Number=SeqID_58919
  Gene Ontology: Mol. function=hydroxymethylglutaryl-CoA reductase (NADPH) activity; Cellular component=endoplasmic reticulum; Biological process=isoprenoid biosynthetic process
  Homolog annotation: Hit_ID=P29057; Match level="QueryCoverage=52%, HitCoverage=14%, E-value=2e-33, Identity=82%"; Hit description=3 -hydroxy-3-methylglutaryl-coenzyme A reductase 1
  Pfam annotation: Domain name=HMG-CoA_red; Domain location=2-162; Score=-170.4; E_value=2.3e-12; Accession=PF00368.9; Description =Hydroxymethylglutaryl-coenzyme A reductase
  Subcellular localization annotation: CTP_CleavageSite=52; ConfidenceScore=5.21e-01
MQRIAEGNVFQESSNASTLPQNSMQFNTLMLSQGSGSSHQHHKSYQPWFSSSGAAIGAQSSAWSQPQSSHPSFEVPNKKPTAVNWIEGRGKLVVCEAIIKEELVQKVLKTNVSALVQLNMLKNLVGSVVSDAIGGFNAHASNIVSAIFIATGQDPAQKVESS

SEQ ID NO: 175698 - protein, 237 aa, Glycine max
  Coding DNA Sequence Number=SeqID_58920
  Gene Ontology: Mol. function=transmembrane receptor activity; Cellular component=membrane; Biological process=defense response
  Homolog annotation: Hit_ID=Q1SI46; Match level="QueryCoverage=92%, HitCoverage=22%, E-value=7e-52, Identity=47%"; Hit description =Leucine Rich Repeat, putative
  Pfam annotation: Domain name=NB-ARC; Domain location=4-237; Score= -28.1; E_value=1.7e-08; Accession=PF00931.13; Description=NB-ARC domain
MRLDKNPVSLKGLIGIDRSIQYLESMLQHESSNVRVIGIWGMGGRNKKNGIITLKEFFFSTLLQENVKMITANGLPNYIKRKIGRMKVLIVLDDVNDSDLLEKLFGNHDWFGPGSRIILTTRDKQVLIANKVHVDDIYQVGVLNPSEALELFILHAFNQKLFDMEYYKLSKRVVCYAKGIPLVLKVLGGLLCGKDKEVWESQLDKLKNMPNTDVYNAMRLPRSNNQENRDGCPAPKV

SEQ ID NO: 175699 - protein, 200 aa, Glycine max
  Coding DNA Sequence Number=SeqID_58921
MDEKRRKKLEEATQSGSTEAVIDRPSPIRQHKKWKMTRTKKNGFIGGAGVIGFLCPPWTPGCPDCCHWRLEHLGRVRAVGAGVTIKQYFEPAQRTSCTSSSIAPEELKQSTQQIRDQLEESITEKVTRQLMLSLSQIQSQFQSQMQSQGLALPSEPEVGPSTTRVSTKRSYFDPSANDPDMGDSDKCGLYIEEILPAWLP

SEQ ID NO: 175700 - protein, 98 aa, Glycine max
  Coding DNA Sequence Number=SeqID_58922
MVVIIKKGENVNHEDFDDVKKNLLDKGENVNHAYLDDLEKKSLDCHHQKGGECESLFQDSLKIKPCLKTKGFKVMQGSGNRLLGSVIDYQKGRMKKSY

SEQ ID NO: 175701 - protein, 324 aa, Glycine max
  Coding DNA Sequence Number=SeqID_58923
  Homolog annotation: Hit_ID=Q9AVH2; Match level="QueryCoverage=30%, HitCoverage=46%, E-value=9e-47, Identity=71%"; Hit description =Putative senescence-associated protein
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSVPRGGGAWSSVRPGTHLVSTRQANEREPTNGDGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPCGNFSDTSSFKFRRTKGSIGHAFT

SEQ ID NO: 175702 - protein, 113 aa, Glycine max
  Coding DNA Sequence Number=SeqID_58924
MVITLYVKMIEATWEILSVRVENLHGQSVLPTTELMVSTGSPLSSLEEQEAYTQSWLKEMIGPSMMIFHDGDAAEDKGEELGEDASMEEKKEGEKERGGSTKLKEEKGREVEL

SEQ ID NO: 175703 - protein, 120 aa, Glycine max
  Coding DNA Sequence Number=SeqID_58925
MAAQLIYDRVVMECLEEVWETPKGNERCRFRGTIQLTATSLVHPEEPARTLQQPVEWILPTPTPYRLVEPVQVIKRILCQHLRQTLQRRVALEGQRIVTTLHHSRRLLRLGVHTFVGGCI

SEQ ID NO: 175704 - protein, 164 aa, Glycine max
  Coding DNA Sequence Number=SeqID_58926
MAEMGKLDHLEERLRAIEGVEDYAFANLEELFLVPNIITPPKFKVLDFDKYKGTTFPKNHLKMYYRKMGAYAKDEELLIYSFQESLTGVAVTWYTNLEPSRVHSWKDLVVAFVKRPGSSSGTSMTEKKVMTMIVDTLPVFYYEKMVGYTPSSFADLVFTDERIK

SEQ ID NO: 175705 - protein, 134 aa, Glycine max
  Coding DNA Sequence Number=SeqID_58927
MARMKKIGQMTSEVTKEVADMIDSMEEQATLGSFVTHGQHPSHVRTTGADVTIKNYFGRASRGSRTSSSMAPEGLKQLTQNIRDRLEESITQKVMMQSYPARALGKRLQVDWAGDPRVGPRVLMSLRVDFEPMG

SEQ ID NO: 175706 - protein, 169 aa, Glycine max
  Coding DNA Sequence Number=SeqID_58928
  Gene Ontology: Mol. function=chitin binding; Cellular component =extracellular region; Biological process=chitin metabolic process
  Homolog annotation: Hit_ID=UPI000069F178; Match level="QueryCoverage =97%, HitCoverage=57%, E-value=6e-17, Identity=32%"; Hit description =UPI000069F178 related cluster
  Subcellular localization annotation: CTP_CleavageSite=42; ConfidenceScore=5.13e-01
VRACSPTKVKAHDPLTARTCSPLKLKVHDPLKARTCSPLKVKARTYSPLEVRACSPLVVRTCNPLKARTCSPLTVRVRACSPLMVRTCSPLKARTCSPLKARTCSPLKARTCSPLKARTCSPLNGEGRVVLSRRGRVVFSTVRVRACSPLMVRTCSPLKARTCSPLNGE

SEQ ID NO: 175707 - protein, 233 aa, Glycine max
  Coding DNA Sequence Number=SeqID_58929
  Gene Ontology: Mol. function=protein binding; Cellular component =integral to membrane; Biological process=protein amino acid phosphorylation
  Homolog annotation: Hit_ID=Q949G8; Match level="QueryCoverage=99%, HitCoverage=78%, E-value=6e-37, Identity=33%"; Hit description =HcrVf2 protein
  Pfam annotation: Domain name=LRR_1; Domain location=103-125; Score =8.9; E_value=6.1; Accession=PF00560.23; Description=Leucine Rich Repeat
  Pfam annotation: Domain name=LRR_1; Domain location=127-152; Score =5.2; E_value=30; Accession=PF00560.23; Description=Leucine Rich Repeat
  Pfam annotation: Domain name=LRR_1; Domain location=154-176; Score =6.7; E_value=16; Accession=PF00560.23; Description=Leucine Rich Repeat
  Pfam annotation: Domain name=LRR_1; Domain location=178-200; Score =11.7; E_value=1.8; Accession=PF00560.23; Description=Leucine Rich Repeat
  Pfam annotation: Domain name=LRR_1; Domain location=202-224; Score =11.8; E_value=1.8; Accession=PF00560.23; Description=Leucine Rich Repeat
  Pfam annotation: Domain name=LRR_1; Domain location=27-50; Score=0.8; E_value=2e+02; Accession=PF00560.23; Description=Leucine Rich Repeat
  Pfam annotation: Domain name=LRR_1; Domain location=3-25; Score=14.2; E_value=0.49; Accession=PF00560.23; Description=Leucine Rich Repeat
  Pfam annotation: Domain name=LRR_1; Domain location=77-98; Score =12.8; E_value=1.1; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=103-125::127-152::154- 176::178-200::202-224::27-50::3-25::77-98
MTSLTHLDLSGTGFMGKIPSQIWNLSNLVYLDLTYADGTIPSQIGNLSNLVYLGLGGHSVVEPLFAENVEWLSSMWKLEYLDLSNANLSKAFHWLHTLQSLPSLTHLYLSGCKLPDYNEPSLLNFSSLQILDLSRTSYSPAISFVPKWIFKLKILVSLQLWGNEIQGPIPGGIRNLTLLQNLDLSGNSFSSSIPDCLYGLHRLKFLNLMDNNLHGTISDALGNLTSLVELDLS

SEQ ID NO: 175708 - protein, 500 aa, Glycine max
  Coding DNA Sequence Number=SeqID_58930
  Gene Ontology: Mol. function=4-alpha-glucanotransferase activity; Cellular component=chloroplast; Biological process=carbohydrate metabolic process
  Homolog annotation: Hit_ID=Q1S9B5; Match level="QueryCoverage=90%, HitCoverage=72%, E-value=0.0, Identity=79%"; Hit description =Glycoside hydrolase, family 77
  Pfam annotation: Domain name=Glyco_hydro_77; Domain location=76-500; Score=471.2; E_value=1.3e-138; Accession=PF02446.8; Description=4 -alpha-glucanotransferase
  Subcellular localization annotation: CTP_CleavageSite=35; ConfidenceScore=5.52e-01
MALLALNISVCCFQQQRSPTLFKPTITKQTLSLPTASAFSSSSLTQLSVGQYLPANYGDWVPNPDPELRRRCGILLHPTSFRGPYGIGDLGDEAFRFIDWLHHSGCSVWQVLPLVPPGRKANEEGSPYSGQDANCGNTLLISLQGLVEDGLLEKHELPQPIDAERVNFSLVADVKDPLITKAAERLISSEGELKTQLENFRRDPDISSETLVYGDSLGILGLRVIEVGRKEILAYVEVISWLEDAAYFAAIDDSLNTISWYNWPEPLRNRHLVALEDIYQQKRDFINVFIAQQFLFQRQWQKVHSYAQSKGISIMGDMPIYVGYHSADVWANKKQFLLNRKGFPLLVSGVPPDAFSETGQLWGSPLYDWKAMEKDGYSWWVRRIRRAQNLFDEFRIDHFRGFAGYWAVPSEAKVAMLGKWKVGPGISLFDTIFRAVGRINIIAEDLGVITEDVVQLRRSIGAPGMAVLQFGFGGDANNPHLPHNHECNQVVYTGTHDNDT

SEQ ID NO: 175709 - protein, 1072 aa, Glycine max
  Coding DNA Sequence Number=SeqID_58931
  Gene Ontology: Mol. function=protein kinase activity; Cellular component=integral to membrane; Biological process=protein amino acid phosphorylation
  Homolog annotation: Hit_ID=Q8LI36; Match level="QueryCoverage=96%, HitCoverage=97%, E-value=0.0, Identity=49%"; Hit description =Putative receptor-like protein kinase
  Pfam annotation: Domain name=LRRNT_2; Domain location=25-72; Score =40.2; E_value=6.9e-09; Accession=PF08263.3; Description=Leucine rich repeat N-terminal domain
  Pfam annotation: Domain name=LRR_1; Domain location=102-124; Score =14.5; E_value=0.38; Accession=PF00560.23; Description=Leucine Rich Repeat
  Pfam annotation: Domain name=LRR_1; Domain location=126-148; Score =14.3; E_value=0.45; Accession=PF00560.23; Description=Leucine Rich Repeat
  Pfam annotation: Domain name=LRR_1; Domain location=150-172; Score =14.1; E_value=0.51; Accession=PF00560.23; Description=Leucine Rich Repeat
  Pfam annotation: Domain name=LRR_1; Domain location=174-196; Score =7.1; E_value=13; Accession=PF00560.23; Description=Leucine Rich Repeat
  Pfam annotation: Domain name=LRR_1; Domain location=198-223; Score =2.7; E_value=89; Accession=PF00560.23; Description=Leucine Rich Repeat
  Pfam annotation: Domain name=LRR_1; Domain location=226-250; Score =5.7; E_value=24; Accession=PF00560.23; Description=Leucine Rich Repeat
  Pfam annotation: Domain name=LRR_1; Domain location=252-273; Score =22.4; E_value=0.0016; Accession=PF00560.23; Description=Leucine Rich Repeat
  Pfam annotation: Domain name=LRR_1; Domain location=275-298; Score =9.6; E_value=4.5; Accession=PF00560.23; Description=Leucine Rich Repeat
  Pfam annotation: Domain name=LRR_1; Domain location=300-324; Score =4.1; E_value=48; Accession=PF00560.23; Description=Leucine Rich Repeat
  Pfam annotation: Domain name=LRR_1; Domain location=355-374; Score =10.7; E_value=2.8; Accession=PF00560.23; Description=Leucine Rich Repeat
  Pfam annotation: Domain name=LRR_1; Domain location=376-397; Score =7.7; E_value=10; Accession=PF00560.23; Description=Leucine Rich Repeat
  Pfam annotation: Domain name=LRR_1; Domain location=400-422; Score =8.7; E_value=6.8; Accession=PF00560.23; Description=Leucine Rich Repeat
  Pfam annotation: Domain name=LRR_1; Domain location=424-446; Score =8.5; E_value=7.4; Accession=PF00560.23; Description=Leucine Rich Repeat
  Pfam annotation: Domain name=LRR_1; Domain location=448-473; Score =9.4; E_value=4.9; Accession=PF00560.23; Description=Leucine Rich Repeat
  Pfam annotation: Domain name=LRR_1; Domain location=481-503; Score =9.0; E_value=5.8; Accession=PF00560.23; Description=Leucine Rich Repeat
  Pfam annotation: Domain name=LRR_1; Domain location=505-527; Score =12.9; E_value=1.1; Accession=PF00560.23; Description=Leucine Rich Repeat
  Pfam annotation: Domain name=LRR_1; Domain location=529-548; Score =17.5; E_value=0.05; Accession=PF00560.23; Description=Leucine Rich Repeat
  Pfam annotation: Domain name=LRR_1; Domain location=551-573; Score =11.3; E_value=2.2; Accession=PF00560.23; Description=Leucine Rich Repeat
  Pfam annotation: Domain name=Pkinase; Domain location=792-1067; Score= 5.0; E_value=7.3e-09; Accession=PF00069.15; Description=Protein kinase domain
  Pfam annotation: Domain name=Pkinase_Tyr; Domain location=796-1067; Score=-63.9; E_value=1.5e-08; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::Pkinase::Pkinase_Tyr; Domain location=...
  Pfam module annotation: Domain location=25-72::102-124::126-148::150 -172::174-196::198-223::226-250::252-273::275-298::300-324::355 -374::376-397::400-422::424-446::448-473::481-503::505-527::529 -548::551-573::792-1067::796-1067
MNSPPNFLSLLLSLLLLTISTPSSSLPELRSLLEFKKGITRDPEKLLDSWAPTTVADSTSTCPSSWQGVFCDEESGNVTGIVLDRLNLGGELKFHTLLDLKMLKNLSLSGNAFSGRLPPSLGSLSSLQHLDLSQNKFYGPIPARINDLWGLNYLNLSNNNFKGGFPSGLNNLQQLRVLDLHANQLWAEIGDVLSTLRNVERVDLSLNQFFGGLSLTVENVSGLANTVHFLNLSHNNLNGRFFTNSTITLFRNLQVLDLSGNSITGELPSFGSLLALRVLRLPRNQLFGSLPEELLQTSMPLEELDLSFNGFTGKCCIVRDGKSSCQKTRDCFDLRIVFYCRKGLGCSIGVINSTTLNILNLSSNSLSGSLPTSLRRCTVIDLSRNMLSGDISVIQNWEAPLEVIVLSSNKLSGSLPSILETYSKLSTVDLSLNELKGSIPRGLVASSSVTRLNLSGNQFTGPLLLQSSGASELLLMPPYQPMEYLDASNNSLEGVLPSEIGRMGALRLLNLARNGFSGQLPNELNKLFYLEYLDLSNNNFTGNIPDKLSSSLTAFNMSNNDLSGHVPENLRHFSPSSFRPGNGKLMLPNDSPETSLVPDNIPDKGRHHSSKGNIRIAIILASVGAAIMIAFVLLAYHRTQLKEFHGRSEFTGQNTRRDVKLGGLSRSSLFKFNTNVQPPTSSLSFSNDHLLTSNSRSLSAGQSEFITEISEHGLTQGMVATSSASLNPNLMDNPPTSSGRKSSPGSPLSSSPRFIEACEKPVMLDVYSPDRLAGELFFLDSSLAFTAEELSRAPAEVLGRSSHGTLYKATLDSGHMLTVKWLRVGLVKHKKEFAREVKRIGSMRHPNIVPLLAYYWGPREQERLLLADHIHGDNLALHLYESTPRRYSPLSFSQRIRVADDVARCLLYLHDRGLPHGNLKPTNIVLAGPDFNARLTDYGLHRLMTPAGIAEQILNLGALGYRAPELATASKPVPSFKADVYALGVVLMELLTRKSAGDIISGQSGAVDLTDWVRLCEREGRVRDCIDRDIAGGEESNKEMDELLAISLRCILPVNERPNIRQVFDDLCSISV

SEQ ID NO: 175710 - protein, 75 aa, Glycine max
  Coding DNA Sequence Number=SeqID_58932
  Subcellular localization annotation: CTP_CleavageSite=30; ConfidenceScore=5.10e-01
MRLSKPALLLFLVFIFTVVQGQAVTNERVVCSKSSTTVRRSGGCEKQGFEYKEGNGGLEDTVLENEDYIYTNFLP

SEQ ID NO: 175711 - protein, 54 aa, Glycine max
  Coding DNA Sequence Number=SeqID_58933
  Homolog annotation: Hit_ID=Q8L5T5; Match level="QueryCoverage=75%, HitCoverage=19%, E-value=2e-08, Identity=75%"; Hit description=LOB domain-containing protein 15
MRPAKFLHAYYYCRERFDEIGKKIKRERDVSSQMGRRHMLGPPGTLNTITPCAA

SEQ ID NO: 175712 - protein, 110 aa, Glycine max
  Coding DNA Sequence Number=SeqID_58934
  Homolog annotation: Hit_ID=Q9ZUS2; Match level="QueryCoverage=71%, HitCoverage=29%, E-value=2e-07, Identity=39%"; Hit description =Nodulin-like protein
MGGIIAGHLPLIVMIGLQIHYAALNIFTRAVLLDGLSTVVFVVYGHGIATVFGAYETIKSLLGFRSFSLMFVTALVGGALTMTLIKGQKMLHIELLPASMHLTSNGGEDY

SEQ ID NO: 175713 - protein, 259 aa, Glycine max
  Coding DNA Sequence Number=SeqID_58935
MAINMCSSDKSGPGMSPRISFSHDPKNTVPLEEGPDQDTSSDFVFCITNAQKLSSADELFSNGKILPTQINSRLVSIPNSNYAPRHHHPQQQQRKKMLKEFLSEPDEDDIIDIIIEEEEEMRPSNSVKLFWRSSSVNCDGATRGKSMLRSSLQFLSRSYSTGSAPNTPKHHAVNVIPRHKLAKQSSASSFSLSSSSSTSSGAYYFYDSCQKNPSLKKNFSGNNGVRISPILNLPHHKATRSIFGFGSLFCNGKIKRKKK

SEQ ID NO: 175714 - protein, 489 aa, Glycine max
  Coding DNA Sequence Number=SeqID_58936
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q1SQS9; Match level="QueryCoverage=99%, HitCoverage=99%, E-value=0.0, Identity=72%"; Hit description =Glycoside hydrolase, family 17
  Pfam annotation: Domain name=Glyco_hydro_17; Domain location=32-353; Score=300.5; E_value=3.1e-87; Accession=PF00332.9; Description =Glycosyl hydrolases family 17
  Pfam annotation: Domain name=X8; Domain location=374-457; Score =119.4; E_value=1.1e-32; Accession=PF07983.3; Description=X8 domain
  Pfam module annotation: Pfam domain module=Glyco_hydro_17::X8; Domain location=32-353::374-457
MAPTEFFMWGLCLILVFAHYQGAQGEESIPGLGINWGALASHTLNPNVVVNMLKDNGIKKVKLFDADSWTLSALSGTDIEVMVGIPNDQLSKFAGSSGDAEAWVRENLTKHIHNHHGSVNIRHVSVGNEPFMKGYKGAYVKTTFPAMQNIQKAIDKAGLGDTVKVTTALNADVYESASDKPSDGDFRSDIYDAIKQILSLLHERNSPFLVNIYPFLSLYQNDNFPEEFAFFDGQGRTIQDKDAQYSNVYDANLDTLVWSLRKAGYPDLRIVVGEIGWPTDGNKNANNYNAKRFYQGLLKKMVHKKGTPLRPGAMEMYLFSLTDENLKSIEPGNFERHWGIFGYDGRPKFPIDFSGQGQDKWPVAAKGVVYQERQWCVLSSDVKNLSLVPSALDYACAGADCTSLGFGCSCDKLDLAGNASFAFNQYFQTRDQSVEACDFNGMGTIVKQDPSKGSCLFPIEIESSGDMVRAMRAIGSILIGLALFFVTFT

SEQ ID NO: 175715 - protein, 401 aa, Glycine max
  Coding DNA Sequence Number=SeqID_58937
  Gene Ontology: Mol. function=binding; Cellular component=chloroplast envelope; Biological process=photosynthesis, light reaction
  Homolog annotation: Hit_ID=Q1SQT1; Match level="QueryCoverage=99%, HitCoverage=100%, E-value=1e-103, Identity=54%"; Hit description=TPR repeat
  Pfam annotation: Domain name=TPR_2; Domain location=181-214; Score =18.4; E_value=0.026; Accession=PF07719.7; Description=Tetratricopepti de repeat
  Pfam annotation: Domain name=TPR_2; Domain location=278-311; Score =8.2; E_value=3.7; Accession=PF07719.7; Description=Tetratricopeptide repeat
  Pfam annotation: Domain name=TPR_2; Domain location=334-367; Score =3.4; E_value=13; Accession=PF07719.7; Description=Tetratricopeptide repeat
  Pfam module annotation: Pfam domain module=TPR_2::TPR_2::TPR_2; Domain location=181-214::278-311::334-367
  Subcellular localization annotation: CTP_CleavageSite=97; ConfidenceScore=5.49e-01
MASTSITTLSIYSHSQPKFLNLLQHPLIHTRNKSTSITFKPAIVRATLFSTLTCSHTPSTPSSNLPPGRALTKFLSEKVAFFLIGSFLLSGCFSKRPAFAETAPSVGSGAVLEEKMNPTEEKNEEEKSEEEVEEMWEGILEKDPKNVEALKVVLYGKIRRGKSKEAVKVVEDLIAAEPNEVEWRLLLALCYETMGQLSKAKRLFREILKKRPLLVRALHDLIRLVEFFIPTDMLHTLDLALEGLAMAMHKIHEGPAVFEMLNNAQELASRENRVTEERNIRILIAQMHVVQGNLEEGLKRFQELIDQNRRDFRPYICQSIHGRAEVFKRLQIILCHYDLIGIIYSLLGKNEEAAQQFETYQTLVPEEFPQRRFLDDVAIAAKRSSLEQFKKEFRDQFSYRK

SEQ ID NO: 175716 - protein, 120 aa, Glycine max
  Coding DNA Sequence Number=SeqID_58938
  Gene Ontology: Mol. function=sequence-specific DNA binding; Cellular component=nucleus; Biological process=regulation of transcription
  Homolog annotation: Hit_ID=Q2PJS3; Match level="QueryCoverage=99%, HitCoverage=66%, E-value=6e-32, Identity=58%"; Hit description=WRKY21
  Pfam annotation: Domain name=WRKY; Domain location=99-120; Score= -13.2; E_value=0.03; Accession=PF03106.6; Description=WRKY DNA -binding domain
MDYYFGNLNPNPYYHHSAVVNMASPSSEFMLSDYLVLEDALVVDHHQESWSQSTETESSEKATSSDASHGKCQNSGIKGKNAEVSQRITFRTRSQLEVMDDGYKWRKYGKKTVKSSPNPR

SEQ ID NO: 175717 - protein, 279 aa, Glycine max
  Coding DNA Sequence Number=SeqID_58939
  Gene Ontology: Cellular component=cytoplasm; Biological process =apoptosis
  Homolog annotation: Hit_ID=Q016B7; Match level="QueryCoverage=35%, HitCoverage=15%, E-value=3e-13, Identity=38%"; Hit description=[R] KOG2061 Uncharacterized MYND Zn-finger protein
  Pfam annotation: Domain name=PDCD2_C; Domain location=81-243; Score= -17.2; E_value=5.8e-06; Accession=PF04194.4; Description=Programmed cell death protein 2, C-terminal putative domain
MDTSRQKQPASVGELPIATVSDDDDDGSDMDLEQLGKALFEAGTLASNTKCKKPRKKCQNKLPSSSPNPKTTTMVQNDVPVVPCFYIYAQEEQSSGDLSSVCSSYSSLSIKGNGSDVDNADPSQAEETLEKEQYEYDKALNADRTYLKFKKRLDAYPEQCYRYSYGGRPILAAADKMNPGSCDLCGRPRQFEMQLMLPLLYFLQEALGDQRKIVGKWDWMTLIIYTCSESCCEGIEQAKSNNKAPFVENFHNILSSSIGLRSGIEKIAAESTLLKREVI

SEQ ID NO: 175718 - protein, 275 aa, Glycine max
  Coding DNA Sequence Number=SeqID_58940
  Gene Ontology: Mol. function=nucleoside-triphosphatase activity; Cellular component=membrane; Biological process=cobalt ion transport
  Homolog annotation: Hit_ID=Q2R1J1; Match level="QueryCoverage=76%, HitCoverage=31%, E-value=2e-69, Identity=65%"; Hit description=ABC transporter family protein, expressed
  Pfam annotation: Domain name=ABC_tran; Domain location=122-262; Score= -24.0; E_value=2.3e-05; Accession=PF00005.17; Description=ABC transporter
  Subcellular localization annotation: CTP_CleavageSite=57; ConfidenceScore=5.27e-01
MDLAAKLHRLDLTGVVILDARKPSVLRHLPPRILTKTNTNLIYTNRFSGPSRPNSASSSTITVEDDIESLFSETNSEEERRSRKQPSSGASGISSGVKLENVGKAYKGVTVLKDVSWEVKKGEKVGLVGVNGAGKTTQMRIIAGLEEPDFGNVVKAKENMRIAFLNQEFEVALSRTVREEFTSAFKEEMEVAGKLEKVQKALEGAVNDLELMGRLLDEFDLLQRRAQNVNLDEVDAKISKLMPELGFAPEDSDRLVASFSGGWQMRMCLGKILLQ

SEQ ID NO: 175719 - protein, 159 aa, Glycine max
  Coding DNA Sequence Number=SeqID_58941
  Gene Ontology: Mol. function=shikimate kinase activity; Cellular component=chloroplast; Biological process=aromatic amino acid family biosynthetic process
  Homolog annotation: Hit_ID=Q30CZ9; Match level="QueryCoverage=96%, HitCoverage=53%, E-value=6e-42, Identity=59%"; Hit description =Putative shikimate kinase
  Pfam annotation: Domain name=SKI; Domain location=2-150; Score=16.0; E_value=1.6e-06; Accession=PF01202.12; Description=Shikimate kinase
MRSSDALVEVDGTSVADIFKHIGEPFFGNKTEVLRRLSMMHRHIISTGGGAVEISVWLDVPLKALGQRITAVGTDSRPLLHYEEGDAYTKFYPLKLTCRLVLRLSALFEERSEAYANAIVKVSLETKLGRRDVSDLSPTAIAMEALEQIKDFLMGEDGC

SEQ ID NO: 175720 - protein, 99 aa, Glycine max
  Coding DNA Sequence Number=SeqID_58942
  Homolog annotation: Hit_ID=Q338G4; Match level="QueryCoverage=77%, HitCoverage=72%, E-value=8e-16, Identity=50%"; Hit description =Expressed protein
MEQSKEKNAPWLSVPQFGDWDQKGQVPDYSLDFSKIREMRKQNKTNISRASLGNEEELMASSATNNTSTVHSDDHQHPHYHQTNSPTLLFVGGIMENRE

SEQ ID NO: 175721 - protein, 120 aa, Glycine max
  Coding DNA Sequence Number=SeqID_58943
QLEVDNRGWWVYADIVDVENLLCTIARPPPKWYLEICRGGQETLGTSGGVLLPKTKLDQSRPNPGIVGDWNIVEASGNRLPACVIDYTEGWVTGNRLPGCVIQVQPLVIDYQGCVIDYQR

SEQ ID NO: 175722 - protein, 154 aa, Glycine max
  Coding DNA Sequence Number=SeqID_58944
  Gene Ontology: Mol. function=aminoacyl-tRNA ligase activity; Biological process=tRNA aminoacylation for protein translation
  Homolog annotation: Hit_ID=Q6AH61; Match level="QueryCoverage=100%, HitCoverage=36%, E-value=2e-32, Identity=50%"; Hit description=Seryl- tRNA synthetase
  Pfam annotation: Domain name=Seryl_tRNA_N; Domain location=1-106; Score=92.3; E_value=1.4e-24; Accession=PF02403.12; Description=Seryl- tRNA synthetase N-terminal domain
MIDLALLRENPEIVRRSQAARGNDQSTVDVALEADRSRRAALAAFEELRAEQNAFGKQVAKAPKEEKAALVAQAKDLAERVKHAQHAAHEAAEAAAAALARIENVVIDGVPAGGEADFVELRRVGDVRAFDFEPRDHLELGELLGAIDMDRGDK

SEQ ID NO: 175723 - protein, 192 aa, Glycine max
  Coding DNA Sequence Number=SeqID_58945
  Gene Ontology: Mol. function=catalytic activity
  Subcellular localization annotation: CTP_CleavageSite=52; ConfidenceScore=5.40e-01
MGSRPRRWRRVSGSSQRPRDSGSLGRARRCRRTAAPGWPRTEGGRARFGLPVAAPAVRLVVDSDVGRGSGESHGGPVRARPADRPVRDRQTNARAFEHVTNSHRDRQVQAEELLECAADGLRARDRCSRRRDEDHVRGVQCHQAVEVPGIEAVGEREVQLVERSHRSAHEFSFPSVDPTPTFMEEDDAAPEV

SEQ ID NO: 175724 - protein, 126 aa, Glycine max
  Coding DNA Sequence Number=SeqID_58946
VRTATRLRVKRQRDFRLAGLHQNQRAFLHLTRLRISQLAHFADIAHFRLIFILHEVAKRTAARVAAPEALRFQYFIQLPEGKIFANAGTSGAATRSVTVAAQREGFDRQRWIFNSSSQRSAAAFAG

SEQ ID NO: 175725 - protein, 39 aa, Glycine max
  Coding DNA Sequence Number=SeqID_58947
NKELEIGVLLGAPNIIAGAPSKAIKCQNCPYLFFFLRIK

SEQ ID NO: 175726 - protein, 277 aa, Glycine max
  Coding DNA Sequence Number=SeqID_58948
  Gene Ontology: Mol. function=chitin binding; Cellular component =extracellular region; Biological process=chitin metabolic process
  Homolog annotation: Hit_ID=UPI00006A17C9; Match level="QueryCoverage =94%, HitCoverage=100%, E-value=2e-35, Identity=30%"; Hit description= UPI00006A17C9 related cluster
LHVLTFIGLHALTFRGLHVLTFRGSCTFTFRGLHILTFRGLHALAIKGLHVLAFVGLHALTFGGLHVLTFIGLHALTFRGLQRVIGLHVLTFRGLHVLTFRGVHALTFRGLHTLTIVGLHALTFRGLHVLTVGGLHALAFSGLHALAVRGLHVLAIRGLHVLAFKGLHVLTFRGLHAFAFVGLHVLTFRRLHALTFRGLHVPTFKGLHTLIFIGLYVLPLRGLHVLAFGGLHALAFRGLHVPLFRGLHVLAFRRRHVLTFGGLHTPSPLEGYASLLS

SEQ ID NO: 175727 - protein, 76 aa, Glycine max
  Coding DNA Sequence Number=SeqID_58949
MVTSMLQLDSMNLFVKARAWFNPITQGMEILIANTSTIFHRDERLENTHATHGKCNYEIEMPEETSFLNHALEMGL

SEQ ID NO: 175728 - protein, 124 aa, Glycine max
  Coding DNA Sequence Number=SeqID_58950
PDPEVDDPLYLMTLTIPELFLQPFQVNWDATMFGVCHPNFPLYIKYEDLSKIAHGSQCLNISVIQLWILYMKSWMQSSQRDVYLGAYLNGPDNYLKGIINSALKGLDDTPQSKSKAGARWIVVK

SEQ ID NO: 175729 - protein, 182 aa, Glycine max
  Coding DNA Sequence Number=SeqID_58951
  Gene Ontology: Mol. function=chitin binding; Cellular component =extracellular region; Biological process=chitin metabolic process
  Homolog annotation: Hit_ID=UPI00006A17C9; Match level="QueryCoverage =68%, HitCoverage=100%, E-value=9e-17, Identity=37%"; Hit description= UPI00006A17C9 related cluster
LHVLALRGLQVLTIRGLHALTSRGLHVLALRGLPALALGLHALTFRGLHILAFRGLHVLTLRGLNVLALRGLHVLTIRGLHALTSRGLQVLALRGLHVLTIRGLHALTSRGLHVLALRGLLTLALGTSYPHLQRIHDVGYNVQDILPENTGRQDKSQMKNGSCRIHDVGYDVQDILPENTGH

SEQ ID NO: 175730 - protein, 60 aa, Glycine max
  Coding DNA Sequence Number=SeqID_58952
MCRRQRSNLIVDELRLLWCLALRLPGGAVLLDESPVNGGPNDLVGGDGRSVELTEARNQS

SEQ ID NO: 175731 - protein, 111 aa, Glycine max
  Coding DNA Sequence Number=SeqID_58953
MEKSDKTNFKEKKEKKGYITWEDNVINYSSDSEKKTISLGIMMKDYENGEEQSRYIDSNFSKHMACIKQTKATFLPKKSEYVIYGDNKHRPLDQQPQQVISNDTNRSLVFD

SEQ ID NO: 175732 - protein, 125 aa, Glycine max
  Coding DNA Sequence Number=SeqID_58954
  Pfam annotation: Domain name=zf-CCHC; Domain location=80-97; Score =25.9; E_value=5.3e-05; Accession=PF00098.13; Description=Zinc knuckle
MELMRLNQHEENDKKKKGIALKASSSIQEGSDKEDLNEIEEDDDFNFFVKRFNNFLRNKGNQRRSNLKPKKKGEDSSCLPECYECNQRGHLRVDCPSFKKRIERSDKKTFNDKKAKKAYITWEDN

SEQ ID NO: 175733 - protein, 144 aa, Glycine max
  Coding DNA Sequence Number=SeqID_58955
MYPLKRFSALNTFVAWPTHLVKHLSEHGAMGLVKPADRPNHDVDDPLYLITLTIQQLFLNSLQVMRDLTVFGVFNDNFPLHMIETSMRAGDADVYGFLEPQSIQRSGQSQFESKSYIKKWMQNSKRDVYLGAYLNGPDNYLGIL

SEQ ID NO: 175734 - protein, 81 aa, Glycine max
  Coding DNA Sequence Number=SeqID_58956
MASRKRKATASRPREPYDTTRFISEVAWERYEQNVHSRNILPKRKVNIFVMEYDEFRKELERRQWHKALTRQPDGRINVAL

SEQ ID NO: 175735 - protein, 86 aa, Glycine max
  Coding DNA Sequence Number=SeqID_58957
MMPIVAIYPSAGGRRRAHGCVSQERKMDGVTTNVYLRKMSEKPETCGPRTLILKGLGVVFTHGEGEKTFKVLDHLTISCVLKGEKR

SEQ ID NO: 175736 - protein, 82 aa, Glycine max
  Coding DNA Sequence Number=SeqID_58958
  Gene Ontology: Mol. function=transition metal ion binding
LLPVVVRGVLPEKLRVAITRLCFFFNDIYSKVIDPKKLDDLENQAAIILCELEMYFPPSFFYATCMLLITVESSSPHGQYHQ

SEQ ID NO: 175737 - protein, 67 aa, Glycine max
  Coding DNA Sequence Number=SeqID_58959
MHILLSYDQSRIVLGDGQIPSQIQRQRQIEVLRDGHEWRLGPRSTDRRTASSSGQARSTAGRQPSIL

SEQ ID NO: 175738 - protein, 80 aa, Glycine max
  Coding DNA Sequence Number=SeqID_58960
VLLADSRFTRPDMGFHPTKLNFVPSDADEAPLDVSICLHAFGIVGCGSFSGVKSCEREDPFHPGLFVGDAGGFQSPTREP

SEQ ID NO: 175739 - protein, 77 aa, Glycine max
  Coding DNA Sequence Number=SeqID_58961
MQDLVAEKGKHLLRIQKESLRVLERGFWVLLHGRVFRMVHNCENRTGDLTSPIKLLDWNQHQFGLTRPGLVKTSGPN

SEQ ID NO: 175740 - protein, 127 aa, Glycine max
  Coding DNA Sequence Number=SeqID_58962
MSSITKAPPSSNDDMSTEESGWTTYFDDFFNNHVVDNNKCSMSLSDGIASSSLVSDAASLVDKKVAHSKQVEEFYVNRNVKSSCLKKRKDAITALIDDSLEDTATSPLNSPKVLYVNQKIDKANRRK

SEQ ID NO: 175741 - protein, 143 aa, Glycine max
  Coding DNA Sequence Number=SeqID_58963
  Gene Ontology: Mol. function=nucleoside-triphosphatase activity; Cellular component=integral to membrane; Biological process=lipid transport
  Homolog annotation: Hit_ID=Q9C8K2; Match level="QueryCoverage=59%, HitCoverage=12%, E-value=1e-11, Identity=40%"; Hit description=White- brown complex homolog protein 12
MGALSARRNNFFAGLAGYALRAQISDFSFSRVSHPLSESFDKVLTNILAELGLQDSEHSRLGNWHFRGISSGEKRRFTIGIAILTQPHVLLVDEQTTRLDSAAALRFDKVELGLEDSAHSRLGNWYFRGISSREKKKAYQLRC

SEQ ID NO: 175742 - protein, 47 aa, Glycine max
  Coding DNA Sequence Number=SeqID_58964
MSYNNIADMKGHQGWMKVEEKYIEKLGQYIPIIEGVLRTALDMGVLW

SEQ ID NO: 175743 - protein, 649 aa, Glycine max
  Coding DNA Sequence Number=SeqID_58965
  Gene Ontology: Mol. function=RNA-directed DNA polymerase activity; Cellular component=chromatin; Biological process=chromatin assembly or disassembly
  Pfam annotation: Domain name=RVP_2; Domain location=237-356; Score= -55.8; E_value=0.022; Accession=PF08284.2; Description=Retroviral aspartyl protease
  Pfam module annotation: Pfam domain module=RVP_2::RVT_1; Domain location=237-356::423-592
MPPRKNTALGEPAAKEHGDTRVEFVVGEEAADNQTRLLNLMSTFSKGLKEEGEGKSSGNPRLKPLKRDDLLEFHQLMKKIELPSFYGDDPVGWIVRAKIYFSVQETREAVHVSLAQLCMEGGTIHFFHSLLNKYENLSWEDLKREMLERYGGRGEGNVYDQLASLKQSGRIEGRNPCENAKPARRESFDQGMNDERCFAIDVEISGQSRVWQGRGEIYGDGNRLDPSGKNDGGDCVLSVEGHLDHSTSAPLNTSGGLYDIESLFDEEEGGGTTTNDEVVRTKQMRILMGDGHKSEMQGVCRGIKVEFDEREFVIDVFLFKLEDMDVILGMPWFTTLGETLVDWKNQVMKIKTDQGERWLRGVPREDSLLVSMFGLLEEKGGSEENGLSQEQRRVLDEVLQNFVDVFVEPKGLPPVGHVRHSQSVYSSPIILVKKKNNKWRICVDYRALNKATIPDKFPLPVIEELLDELYGARFFSKLDLRSGYHQVRMREEDIPKTTFRTHEGHYEYLVMPFGLMNAPSTFQELMNEVFRALLRQGVLVFFDDILVYSRSWEKHVQLLETVLGVLRANMLFANKEKCTFGQESIVYLGHIISIQGVAIDPVKAQATFEELKRKITTTSVLQLPNFDEEFSLECNASGTGNQFLITAKC

SEQ ID NO: 175744 - protein, 80 aa, Glycine max
  Coding DNA Sequence Number=SeqID_58966
MGKSVSNVKTFLEKRVVTEGEALRCVGVYLSHEFSIKVVTAERVDVTVSGLLGGPEDFSLWTEPPFANGQPSIKVEKVAK

SEQ ID NO: 175745 - protein, 174 aa, Glycine max
  Coding DNA Sequence Number=SeqID_58967
  Homolog annotation: Hit_ID=Q8L9B8; Match level="QueryCoverage=32%, HitCoverage=14%, E-value=1e-11, Identity=61%"; Hit description =Transaldolase ToTAL2
MDWFYLFSFAQAAAAAQAGASVIQIFVGRIRDWARNHSGDTEIESAQLRGEDPGLALCRSSITCGPTNTLVFPERLVKIVNVNIKSEVQGDKSNGKKVALSVINRRDSQNYGIKIVMSMKFVAPNRMVWEDESTPSDILGANTQFQGDQILASSSQKVEEMEGIVSMVVEMSPG

SEQ ID NO: 175746 - protein, 189 aa, Glycine max
  Coding DNA Sequence Number=SeqID_58968
MAHRNLGSDDYKELVKEPGRLVLANSMLGNNSRRVHLVNWDVITEPKEGGGLRVRVARNHNINILGKDKYFLDENLFMAEGRKGSMTWNAIMKVPWIDIYDGLKVRTMWSNRDWNLNSLYIAISDEIHVLIEMHMTFFKKLRRWVIRKRPGVGFWKMKVLALVQFFMWQASVVRVQKPPLDSSKMIWEE

SEQ ID NO: 175747 - protein, 91 aa, Glycine max
  Coding DNA Sequence Number=SeqID_58969
  Homolog annotation: Hit_ID=Q40983; Match level="QueryCoverage=54%, HitCoverage=3%, E-value=2e-17, Identity=88%"; Hit description =Metalloendopeptidase
MDWRCFFKPKTPVQTPQKHNHLAPLLVAIVACVPKKVHIEGAGETGFKISSIEITDAIKAGLDEPIQPEPELLDHNYMFVHIPCLKFDMSL

SEQ ID NO: 175748 - protein, 175 aa, Glycine max
  Coding DNA Sequence Number=SeqID_58970
  Homolog annotation: Hit_ID=Q7XZF5; Match level="QueryCoverage=43%, HitCoverage=6%, E-value=1e-12, Identity=37%"; Hit description=RST1
MSLCLLPRWGAMDAEAYPEASKSVLQILWDVVTYGQGRQWGKARISALEAVAQYERVVKEKRVTGSKIEKLMDVFPQLSILSLASLTVRSSFQNLGLLESIAGVQTNNSSIIDLALIQAFQLYSVACSPIDAALVATTGGDDRGFLWKIGQGDWAFELQGILLVTTRTISTPSST

SEQ ID NO: 175749 - protein, 61 aa, Glycine max
  Coding DNA Sequence Number=SeqID_58971
MGQLSDQRDPTDPKRIKVIPDWPTPPSVEGRIPKYEETRDLRSNPFQGGGDDAILPPKGIE

SEQ ID NO: 175750 - protein, 143 aa, Glycine max
  Coding DNA Sequence Number=SeqID_58972
MTLLFPEEQKVQKTVSAPACYQAFCLTDSKRMGANNHKVSPRIMGISAYHGCRMTKLGLCVPSDTTVSEWQRGADNRKNDQTWSLLAIGPDASEWQKGADNRKVSPRIMGISAYHGCRMTKLGLCLSSGLPPLDDKRGANNHK

SEQ ID NO: 175751 - protein, 85 aa, Glycine max
  Coding DNA Sequence Number=SeqID_58973
MAPPPPRKCGNSSSLSCLCLCLRNDHPSMALKCDRGRTRIKLNMKMQENCQETTLQVNLKESWASSSKGNNTRKSSLPWIQQKRN

SEQ ID NO: 175752 - protein, 117 aa, Glycine max
  Coding DNA Sequence Number=SeqID_58974
MMEKEMITMIVDTLPVFYYEKMVGYMPSCFVGLVFAGDRIEVGLKSGKFDYAASMNSGDRRPRANGGNKKEGETHVLTERYLSLTRKPSCGALDDILSDCEKLPYYGELNPQLVLPM

SEQ ID NO: 175753 - protein, 229 aa, Glycine max
  Coding DNA Sequence Number=SeqID_58975
  Gene Ontology: Mol. function=nucleic acid binding; Cellular component= mitochondrion; Biological process=regulation of transcription, DNA -dependent
  Homolog annotation: Hit_ID=Q0ZCB8; Match level="QueryCoverage=98%, HitCoverage=37%, E-value=2e-78, Identity=55%"; Hit description =Integrase
  Pfam annotation: Domain name=rve; Domain location=1-142; Score=92.1; E_value=1.7e-24; Accession=PF00665.16; Description=Integrase core domain
MPQQPMLFCEVFDVWVDYVSKWVEAKPTRTNDAKVVVDFVRSNLFCRFGVPKAIVSDQGTHFFNKSMHALLKKYGVVHKVSTPYHPQTNGQAEISNREIKRILEKIVQPSRKDWSTRLDDALWAHRTSYKAPIGMSPYRVVFGKACHLLVEIEHKAYWAVKSCNFSMDQAGEERKLRLSELDEIRLEAYENVKFYKEHTKKFHDSIIIKKDFMVGQKVLLNNSKLGLMS

SEQ ID NO: 175754 - protein, 300 aa, Glycine max
  Coding DNA Sequence Number=SeqID_58976
  Gene Ontology: Mol. function=transporter activity; Cellular component= integral to membrane; Biological process=transport
  Homolog annotation: Hit_ID=Q8ZNM8; Match level="QueryCoverage=66%, HitCoverage=65%, E-value=6e-86, Identity=80%"; Hit description =Putative ABC superfamily transport protein
  Pfam annotation: Domain name=OpuAC; Domain location=1-207; Score =80.9; E_value=3.9e-21; Accession=PF04069.3; Description=Substrate binding domain of ABC-type glycine betaine transport system
DAAWKNAQQGYEKVKKLDAEKNHLVWLTPAPANNTWTIAVRGDVAQQNNLKSLDDLSTYLKKGGTFKLAASAEFIERSDALPAFEKAYNFKLGQSQLLSLAGGDTAVTIKAAAQQTSGVNAAMAYGTDGPVAALGLQTLSDPKGVQPIYAPAPVIRASVLQQYPQIADWLQPVFSKLDEKTLQQLNAQIAVDGQDASQVAQHGAVTDKPTAPAAGAAGADAADYAGAGSATAAELCGQPAGLRTAADALAGNGGLAAAAAAVMAMAGIVVAAGTRCGAGAVAGRGATVRPADWHRRPRRQ

SEQ ID NO: 175755 - protein, 123 aa, Glycine max
  Coding DNA Sequence Number=SeqID_58977
MEAIKEKMATMMEAMMRVKKIMEANAVAIAATSVVAKVNPTSPSGHSIEFNPPNLRYGRQRFGNMGGPHDVQIQKKPEHAFPPYGLPSTIRQPNWRTLPIRMSITPLLYPLRPTTPTDHAHVS

SEQ ID NO: 175756 - protein, 86 aa, Glycine max
  Coding DNA Sequence Number=SeqID_58978
  Gene Ontology: Mol. function=racemase and epimerase activity, acting on carbohydrates and derivatives; Cellular component=soluble fraction; Biological process=carbohydrate metabolic process
  Homolog annotation: Hit_ID=Q43070; Match level="QueryCoverage=97%, HitCoverage=24%, E-value=4e-36, Identity=85%"; Hit description=UDP -glucose 4-epimerase
FDAVIHFAGLKAVAESVAKPRRYFDFNLVGTINLYEFMAKYNCKKMVFSSSATVYGQPEKIPCEEDFKLQAMNPYGRTKLVVSKVG

SEQ ID NO: 175757 - protein, 86 aa, Glycine max
  Coding DNA Sequence Number=SeqID_58979
  Homolog annotation: Hit_ID=O64438; Match level="QueryCoverage=47%, HitCoverage=17%, E-value=7e-14, Identity=83%"; Hit description=ARG10
CFYSTAVGGLRCYENPKNKITAVPAEEEQIWGAFFKNRESVISPNSNIRLMSVETALGTKGKCEVILELKKLELNIPYVTRIASCN

SEQ ID NO: 175758 - protein, 134 aa, Glycine max
  Coding DNA Sequence Number=SeqID_58980
MAKAEEVQEKVKVDMEAMKEQMAMMMAMMSKRKIMEANAVTIAATSTVAKVNPMSPSGLNQMNHPTSAMVGKDLGSTGGPYYAQSQNKHAFPPYGLPPNYTPSNVAYTPNEDVNNSTPIPIKSQQPQTDHAHVS

SEQ ID NO: 175759 - protein, 161 aa, Glycine max; identical to SEQ ID NO: 143115
  Coding DNA Sequence Number=SeqID_58981
  Homolog annotation: Hit_ID=Q5CEG7; Match level="QueryCoverage=55%, HitCoverage=84%, E-value=2e-36, Identity=82%"; Hit description =Senescence-associated protein
  Subcellular localization annotation: CTP_CleavageSite=37; ConfidenceScore=5.56e-01

SEQ ID NO: 175760 - protein, 103 aa, Glycine max
  Coding DNA Sequence Number=SeqID_58982
LLDLGVEVSQVLLPGDQASSQVSGGSQLSSMDSFLSKAEAKTILEINVISEDAICVTVGTISKIVMDNHSWCYPACAQCHRKTDIQTGPFTCGCGKDNDQPVL

SEQ ID NO: 175761 - protein, 50 aa, Glycine max
  Coding DNA Sequence Number=SeqID_58983
  Gene Ontology: Mol. function=protein binding
  Homolog annotation: Hit_ID=UPI00005F98EA; Match level="QueryCoverage =92%, HitCoverage=19%, E-value=3e-18, Identity=89%"; Hit description =COG1720: Uncharacterized conserved protein
  Pfam annotation: Domain name=UPF0066; Domain location=2-48; Score= -30.5; E_value=0.0036; Accession=PF01980.7; Description =Uncharacterised protein family UPF0066
MAGGWRPTVRPPRLGGNARMGVFATRSTFRPNPIGMSLVELKCIRCEQQQ

SEQ ID NO: 175762 - protein, 74 aa, Glycine max
  Coding DNA Sequence Number=SeqID_58984
MMNVLSVAILFCKISHAPNIFMIHVIGTHRNNQRENTKKGVQGRSPKYEEPQDLRSNPFQGGGDDAILPPKGIG

SEQ ID NO: 175763 - protein, 193 aa, Glycine max
  Coding DNA Sequence Number=SeqID_58985
  Gene Ontology: Mol. function=4 iron, 4 sulfur cluster binding; Cellular component=integral to membrane; Biological process=protein -chromophore linkage
  Homolog annotation: Hit_ID=P56767; Match level="QueryCoverage=61%, HitCoverage=16%, E-value=8e-67, Identity=99%"; Hit description =Photosystem I P700 chlorophyll a apoprotein A2
MALRFPRFSQGLAQDPTTRRIWFGIATAHDFESHDDITEERLYQNIFASHFGQLAIIFLWTSGNLFHVAWQGNFEAWVQDPLHVRPIAHAIWDPHFGQPAVEAFTRGGALGPVNIAYSGHLVHVAIPGSRGEYVRWNNLLSILPHPEGLGPFFTGQWNLYAQNPDSNSHIFGTPQGAGTAILTLLGGFHPQTQ

SEQ ID NO: 175764 - protein, 275 aa, Glycine max
  Coding DNA Sequence Number=SeqID_58986
  Gene Ontology: Mol. function=nucleoside-triphosphatase activity; Cellular component=chloroplast
  Homolog annotation: Hit_ID=Q2PMM5; Match level="QueryCoverage=99%, HitCoverage=12%, E-value=1e-155, Identity=98%"; Hit description =Protein ycf2
MDDPIRKDHDWEFFDRLSPRKRRNIINLNSGQLFEILVKDWIYYLMFAFREKIPKEVEGFFKQQGTGSIIQSNDIEHVSHLFLRNKRAISLQNCAQFHMWQFRQDLFVSWGKSPHESDFLRNNMSRENWIWLDNVWLVNKDRFFSKVRNVSSNIQYDSTRSSFIQVTGSSQLKGSSDQSKDYFDSIRNEDSKYHTLINQREIQQLKERSILCWDPSFLQTERTEIESERFPKILSGYSSMCRLFMEREKQMNNHLLPQEIEDFLGSCKSYSFFFL

SEQ ID NO: 175765 - protein, 95 aa, Glycine max
  Coding DNA Sequence Number=SeqID_58987
MALARDFCRETTHGAIWFRIGSKIPLAICALGMNSEVLECIRNTRMCTYAIFDSQSALSMHGFVCHFCFKGSISWNGSEEACLKEVQEGQGARRN

SEQ ID NO: 175766 - protein, 78 aa, Glycine max
  Coding DNA Sequence Number=SeqID_58988
LLKWQTLDQTLVSREKHQLCKDMQRDQSKDQGIEVMESVGMLGTYLRKFLLKNGIILFAWGQAKYKNWRCNKHKGQKN

SEQ ID NO: 175767 - protein, 188 aa, Glycine max
  Coding DNA Sequence Number=SeqID_58989
  Homolog annotation: Hit_ID=Q5XM22; Match level="QueryCoverage=46%, HitCoverage=49%, E-value=1e-21, Identity=60%"; Hit description =Resistance-like protein HAAS-2
MLVDLLMVSPESARAETVQCREPYVRLQWVHDIYQRRCQAGHWTAAACAYLRHLLGCTLFANKSATNVHVVYLEALRDLSMTERYAWGVAPLVHMYDQLNDVDCDEEDREENSHAVVQGAPGSTPDSGCLLDPLWGASGGSGLPRQIMLFRSLALRVCCCLLSTREGRAAVWLHADHSCSSYRFMGLV

SEQ ID NO: 175768 - protein, 507 aa, Glycine max
  Coding DNA Sequence Number=SeqID_58990
  Gene Ontology: Mol. function=oxidoreductase activity; Cellular component=intracellular; Biological process=lignin catabolic process
  Homolog annotation: Hit_ID=Q2LD62; Match level="QueryCoverage=96%, HitCoverage=91%, E-value=0.0, Identity=66%"; Hit description =Putative copper ion-binding laccase
  Pfam annotation: Domain name=Cu-oxidase; Domain location=89-243; Score=168.8; E_value=1.4e-47; Accession=PF00394.12; Description =Multicopper oxidase
  Pfam annotation: Domain name=Cu-oxidase_2; Domain location=352-491; Score=169.4; E_value=8.8e-48; Accession=PF07731.4; Description =Multicopper oxidase
  Pfam annotation: Domain name=Cu-oxidase_3; Domain location=1-98; Score=131.8; E_value=1.9e-36; Accession=PF07732.5; Description =Multicopper oxidase
  Pfam module annotation: Pfam domain module=Cu-oxidase::Cu-oxidase _2::Cu-oxidase_3; Domain location=89-243::352-491::1-98
VQNKAVTRLCKERVIVTVNGLYPGPRIDVREGDAVVVHLFSAWADGPEYITQCNIRPQNSYTYKFNVIQQEGTLWWHAHSGVLRATVHGAFIIHPRSGDWYDGNIVDIYQQVLLLGDVRPSAAYTINGLPGDLYNCSRNQMFKLKVKPGKTYLLRMINAAFNNNLFVKIANHSFTVVAMDASYIEPYVTDIITIAPGQTADVLFKADQPIGSYYMAASPYVVGQPEALFDTTTTRGIVAYEGYTTSLKDSKPIVPLLPPFNATPIAHKFFSNITSLVGAPHWAPVPLEVDQHMFITININLERCPKNGTCQGVFGQKFSASMNNESFVHPVGKGYSMLEASFYNVSGVYTTDFPDKPPIIFDFTNPKIALDTKYLFTPPKSNKVKKLKFNSTVEVVFQNTQIMNAQSHPMHLHGFSFHVLAQDFGNFNYTKDKYKFNLVNPIFRNTIAVPAGGWAVIRFKANNPGMWFVHCHVDDHQLWGLDMVFEVENGPTPSTSLPPPPADLPKC

SEQ ID NO: 175769 - protein, 180 aa, Glycine max
  Coding DNA Sequence Number=SeqID_58991
MAYIEMSHCISPVKTNSEKVSKRDHVRSRLNFDAADVPGRLDNPLPNEISTSESEKELDIFDIEFPNFDALGTDFSFTEMLNDLDFSCEGMDFSCHPTPSPSMDNASGSSHECNGNHATPELSTVAEVLCEKDMKILGPDCMTAMKSVTKNITVISPVKLSMEEARERLDMLGFKFFQES

SEQ ID NO: 175770 - protein, 56 aa, Glycine max
  Coding DNA Sequence Number=SeqID_58992
MDNYSMLNIIENDVQATGKQQRNTIVISLRLKLLKLEWCHRNISTRPRINLVTKIS

SEQ ID NO: 175771 - protein, 64 aa, Glycine max
  Coding DNA Sequence Number=SeqID_58993
MESGAHSPRCHWQAMRDCHRDSGDAMAAEALLEAWWRKQNKNKEETVNERISSDPSHFSSGVAK

SEQ ID NO: 175772 - protein, 265 aa, Glycine max
  Coding DNA Sequence Number=SeqID_58994
MAGKQSKARKPEVFGKGKVTPTQIAFIVDRYLCDNNFSSTRSTFRNEASSLISHSPIHEAPKTLLTLGEMLDEYICLKEQKVMLNQERAAVEQEKNRVQMLLQGMHNVMTAYNASGNLPAPASAAKSAVVTVPQPTFGYKSQPGNPTSVQIKSNAPPLPQSSNSNVEGGNFSTPTLNVCDRKRKDTKAVDAPSAAKKPRGRSSSRKIVVQGQNALQQSDKAVNNTMVAQPSTIQSSSEKCIPRESQVQGYNVAKCLFNRSTTSVP

SEQ ID NO: 175773 - protein, 125 aa, Glycine max
  Coding DNA Sequence Number=SeqID_58995
MGDGVGMGDEVGVGSGVGKGDWLCCIGTGHGGTVSLEGKVDGEAVLEEGLPMWIQGGVELQQVWQWRPRGGPRPLEKVRHPPFEVGAKMEGTKGMDATEMVAGGWLCGKDGVGRGDSVGGVGCSG

SEQ ID NO: 175774 - protein, 87 aa, Glycine max
  Coding DNA Sequence Number=SeqID_58996
  Gene Ontology: Mol. function=protein serine/threonine kinase activity; Biological process=protein amino acid phosphorylation
  Homolog annotation: Hit_ID=Q1SHY2; Match level="QueryCoverage=47%, HitCoverage=16%, E-value=8e-11, Identity=73%"; Hit description =Protein kinase
MVAEVHSIITQVLCFSSMSFEMDLIAKLHYPYIVEYKDAWVEKEKTDDYICIITGYCEGGDMLCCWLLVIGRVLTGLVTSLLHLMKH

SEQ ID NO: 175775 - protein, 164 aa, Glycine max
  Coding DNA Sequence Number=SeqID_58997
  Gene Ontology: Mol. function=RNA-directed DNA polymerase activity; Cellular component=chromatin; Biological process=RNA-dependent DNA replication
  Subcellular localization annotation: CTP_CleavageSite=36; ConfidenceScore=5.11e-01
MTSINTLTHKYSSLFQPLTTLPPSHPTNHTITLLPNSSPVNVRPYCYPYYQKKEIESQVASMLQHGLIQLGTNPFSSTVLLVKKRDVSWRFCVDYRTLNAITIKDDFPIPTVDKLLDEFGGAKWFSYVANSLSNFLSHLVSENGVEPMLEKLKCKLFDNGHNHE

SEQ ID NO: 175776 - protein, 339 aa, Glycine max
  Coding DNA Sequence Number=SeqID_58998
  Gene Ontology: Mol. function=protein binding; Cellular component =integral to membrane; Biological process=protein amino acid phosphorylation
  Homolog annotation: Hit_ID=Q9SCN7; Match level="QueryCoverage=66%, HitCoverage=24%, E-value=6e-35, Identity=37%"; Hit description =Disease resistance-like protein
  Pfam annotation: Domain name=LRR_1; Domain location=143-165; Score =4.9; E_value=34; Accession=PF00560.23; Description=Leucine Rich Repeat
  Pfam annotation: Domain name=LRR_1; Domain location=167-189; Score =12.1; E_value=1.6; Accession=PF00560.23; Description=Leucine Rich Repeat
  Pfam annotation: Domain name=LRR_1; Domain location=191-213; Score =5.4; E_value=27; Accession=PF00560.23; Description=Leucine Rich Repeat
  Pfam annotation: Domain name=LRR_1; Domain location=215-238; Score =0.8; E_value=2e+02; Accession=PF00560.23; Description=Leucine Rich Repeat
  Pfam annotation: Domain name=LRR_1; Domain location=3-26; Score=20.3; E_value=0.0068; Accession=PF00560.23; Description=Leucine Rich Repeat
  Pfam module annotation: Pfam domain module=LRR_1::LRR_1::LRR_1::LRR _1::LRR_1; Domain location=143-165::167-189::191-213::215-238::3-26
MSSLKTLDLSDNQLFGEIPEGIFGVLYQSKGYTYIGTYKAEHSPFESQSLYWRYTKGVVPIDRFKHTTPFSSQFFWCIFNCLGKVPFEIKYPDLFLEILSGRILVDHKYCMPFDTPILPNVEEKANFTSKNRTNTYTGRILAYMSGVDLSSNKLLRNIPSELGNMRRIRSLNLSHDDLTGQIPTTFSNLVHGKSLNLSFNKLSGQIPPQLSVLSSLDVFIVAHNNLSGATPERKGQFSTFEESSYKGNQFLCGPPLPKSCNPLPLILPNDEGSDSLVDMFVFYVSFVVSYISALLVTAAALYINPYWRQAWVYYIELMNLNCYYFIMDNLCKLFKNENM

SEQ ID NO: 175777 - protein, 116 aa, Glycine max
  Coding DNA Sequence Number=SeqID_58999
  Gene Ontology: Mol. function=transferase activity; Biological process= DNA integration
  Homolog annotation: Hit_ID=Q1SAV4; Match level="QueryCoverage=49%, HitCoverage=14%, E-value=2e-10, Identity=55%"; Hit description =Integrase, catalytic region
MVKLRPHRQVLDIGSSYSKLAKHYYGPFQVEDRMGNVAYKLKLPTQSCIHLVFHCSILKLYFQATSGGVKATYHLKDKVLLGGLRNDTTDTGGLEEARATRSKRKSVPPAYLKDYA

SEQ ID NO: 175778 - protein, 68 aa, Glycine max
  Coding DNA Sequence Number=SeqID_59000
MGAKYLEAVKQRLHAINNGPRTKFSYLLGQLFHLDLKGVSSTVLVDYVDRAGSLKILLEYTLVAVDFP

SEQ ID NO: 175779 - protein, 338 aa, Glycine max
  Coding DNA Sequence Number=SeqID_59001
  Gene Ontology: Mol. function=oxidoreductase activity; Cellular component=proton-transporting two-sector ATPase complex; Biological process=ethylene biosynthetic process
  Homolog annotation: Hit_ID=Q5D0G3; Match level="QueryCoverage=98%, HitCoverage=92%, E-value=3e-91, Identity=51%"; Hit description =Gibberellin 2-oxidase 3
  Pfam annotation: Domain name=2OG-FeII_Oxy; Domain location=193-293; Score=137.3; E_value=4.1e-38; Accession=PF03171.10; Description=2OG -Fe(II) oxygenase superfamily
MDYEPPFLEFYKPLLLQGSHSVDVGISGSGIIRNDKSEWRELPLIDLGQLSLGHVEREDCMREICEAARTWGFFQVVNHGVSQELLQSLRHEQVEVFRTPFARKSRESFLNLPAARSYRWGNPSATNLRQISWSEAFHMFLPDIARMDQHQSLRSTIEAFASVVSPLAESLVQILVQKLNIKFSYFRENCSANTSFLRLNRYPPCPIFHSRVFGLLPHTDSSFLTIVNQDQIGGLQIMKDGNWFGVKPNPQALVVNIGDLLQALSNDIYISAKHRVVAAEKVERFSVAYFYNPSKDALIESHIMPPMYRKFTFGEYRRQIEKDVKETGDKVGLSRFLL

SEQ ID NO: 175780 - protein, 536 aa, Glycine max
  Coding DNA Sequence Number=SeqID_59002
  Gene Ontology: Mol. function=actin binding; Cellular component =phragmoplast; Biological process=actin cytoskeleton organization and biogenesis
  Homolog annotation: Hit_ID=Q1SGQ9; Match level="QueryCoverage=87%, HitCoverage=46%, E-value=0.0, Identity=71%"; Hit description =Pyridoxal-dependent decarboxylase; Actin-binding FH2
  Pfam annotation: Domain name=FH2; Domain location=63-471; Score =476.3; E_value=3.7e-140; Accession=PF02181.13; Description=Formin Homology 2 Domain
  Subcellular localization annotation: CTP_CleavageSite=65; ConfidenceScore=5.67e-01
GPPPPPPPSNGPRAPPPPPLRGKPGPRPSPPPRVGGGPPRTTPPFGSKVAKTQEEVGVNSEGEVNATNKAKLKPFFWDKVQANSDQTMVWNQLKAGSFQFNEEMMETLFCYNTTPVEKSKGQQKKEASSPSASPQYIQIINSKKSQNLSILLKALNVTIEEVSEALLEGNELPTEFLQTLLKMAPTSEEELKLRLFNGNLAQLGPADRFLKALVDIPFAFKRMEALLYMGILQEELTGTRESFAILEVACKTLRSSRLFLKLLEAVLKTGNRMNDGTFRGGAQAFKLDTLLKLSDVKGVDGKTTLLHFVVQEIMRTEGIRAARMAKENHSFSSIKSEDLLEDISYESEDQYRELGLQVVSRLSSELENVKKAAALDADGLIGTTSRLGHGLIKTRDFVNKDLSNIDDDKGFHETVKSFVEKAEADVTSLLEEEKKIMALVKNTGDYFHGDSGKDEGLRLFVIVRDFLVMLDKVCKEIQNGPKKPVAKNVKREASNHSRKSSSSEIHPLPPDIRQRIFPAVVANRRMDGFSSDDESP

SEQ ID NO: 175781 - protein, 144 aa, Glycine max
  Coding DNA Sequence Number=SeqID_59003
MSSHGHSHYDMLAQAAEMVNKELGFFTNESVEENDYIDDVEQNKRLRNRYRKRVRKMCKKGQLLEPREREAFDAGNKIWGSRSGGKREQHQHQHHRLLGETRDNDIREKEKEEEEDPEKDPKEDQEDPPHDPNEEDDPLARFHC

SEQ ID NO: 175782 - protein, 266 aa, Glycine max
  Coding DNA Sequence Number=SeqID_59004
  Gene Ontology: Mol. function=hydrolase activity; Biological process =glycolysis
  Homolog annotation: Hit_ID=Q3IEU3; Match level="QueryCoverage=57%, HitCoverage=32%, E-value=1e-39, Identity=52%"; Hit description =Putative amidohydrolase family
AGDCLLGVGLAAHFDRALPDRLDAFDLRTGTQQARAEQGALGDLATPLQHLLGQIAGTVTHRGDAMRDVQRQQCLVLFDQRRATTEVHVHVPQPRDQVFALGIDLAGRAPLAAQLRVRADSDDVLAADHHALTSQGTGVLDVDHGGIADQQVGALGSRCRQRCHHKEDGKGQRTGTEHGQHPGGHAQRAGGRGCGSAHRAVLAQQGFNSGIAALARVRQRRHAVAVGQLRVGTGLQQQLHDLHVARAAIAEQDRFQQRGPVQPVDM

SEQ ID NO: 175783 - protein, 253 aa, Glycine max
  Coding DNA Sequence Number=SeqID_59005
  Gene Ontology: Mol. function=actin binding; Biological process=actin cytoskeleton organization and biogenesis
  Homolog annotation: Hit_ID=Q1SGQ9; Match level="QueryCoverage=95%, HitCoverage=30%, E-value=2e-33, Identity=56%"; Hit description =Pyridoxal-dependent decarboxylase; Actin-binding FH2
MAIQQYMGNVSIEEKKTQEEFISQLFDPTSGLLTEDTAEVLWITCWEDFIHLKKEVGDLDLCLPKESYRKTNEISSEIGSIARENIQKLISSCYPHLKENVLHCLRKNNFPFNALKEEGDSKIWHVTYMGSLSSRRYLGQVFPQHVSEISIKEDESPKKNKPKEKDSNKKDKKKSKSSGSKDKNKNTSMAITIIVTILVAALLFLCCGSGRVRPNDERPLLSMSMNDYSVGSSSNNNPYQNSMKEEKIGFQSS

SEQ ID NO: 175784 - protein, 43 aa, Glycine max
  Coding DNA Sequence Number=SeqID_59006
MNLGQKYEPPYDYFKFCTMSCKASTGEAQDESLLKKQLSTSPN

SEQ ID NO: 175785 - protein, 72 aa, Glycine max
  Coding DNA Sequence Number=SeqID_59007
MSSALGWSYLTSVTASIYEILSPKYFITFVVLDLIWYYSYAAPMLYQPDMHNELRKLLAKQDLSKLRLSPVP

SEQ ID NO: 175786 - protein, 66 aa, Glycine max
  Coding DNA Sequence Number=SeqID_59008
MAKIECLGEVALCQNRSQKQRIHHIHCVPHRPMPCITTKSKPEAPPQKPNMTHQHETIVRHDLLGC

SEQ ID NO: 175787 - protein, 82 aa, Glycine max
  Coding DNA Sequence Number=SeqID_59009
  Homolog annotation: Hit_ID=Q69XQ3; Match level="QueryCoverage=39%, HitCoverage=11%, E-value=7e-07, Identity=69%"; Hit description=KH domain-containing protein / zinc finger protein-like
MTTCDEFKTYCAPPPRTIVAPPPVPNGSAPSAVKTRIWNKSNTAEGCKYGDECHFAHGGCRVYFIKCSTNSHNGFFTTVKGE

SEQ ID NO: 175788 - protein, 179 aa, Glycine max
  Coding DNA Sequence Number=SeqID_59010
MNELCQKVAKHMQMEELVKLRHQTWVEQVGERKNANKEGKKRNRDSSKERGSPRPTRKYPLTPLTLGGRQQSQMRALGYTIKKSYNHTLRQVKEKAMLAKEMSDFQNQKHFLLKAESQGIRLKECLKSIYQPTYVALSASILMKVGMKDIKKDKGRERFLSSEKPDKREELQNNCYFTK

SEQ ID NO: 175789 - protein, 109 aa, Glycine max
  Coding DNA Sequence Number=SeqID_59011
MEAPLLLSEKRTGSIEEESGKWSSYQYVGGTGSVRPTSSLAGTEVSVDEIRSAAAASGYYPPSLHGALVGSPEPDPTGTNAAEAATIVVAKTPKQNLDASAEILAMDRF

SEQ ID NO: 175790 - protein, 73 aa, Glycine max
  Coding DNA Sequence Number=SeqID_59012
MVSYDPCIHASVGGKRKPANLRPALYLLEDALITSKPAYLLLLPSGGANPRNSGKSTTGNIIPPDSKGRDLPK

SEQ ID NO: 175791 - protein, 50 aa, Glycine max
  Coding DNA Sequence Number=SeqID_59013
MGDDYLGVSPHGDALDLRPGPKDKTTKQKGRRKTNGAIGKLFKLRQIVCH

SEQ ID NO: 175792 - protein, 99 aa, Glycine max
  Coding DNA Sequence Number=SeqID_59014
MEVTTFTVTMHRVDVVMFENKKFGTMGKGGDIHNDNICNDDVCDNSEAECEDWRKDLEEGCNIRIEKLRQMMDVMVVEKHVGGFVLPTSVQLLVPDPSG

SEQ ID NO: 175793 - protein, 75 aa, Glycine max
  Coding DNA Sequence Number=SeqID_59015
MPDPNAKQGQHAAAHISKFEACYCVSKQRVQGVYQSEGCIEACLVPDALLFALVLHFSSPLFGIPRTNRQNFTDL

SEQ ID NO: 175794 - protein, 212 aa, Glycine max
  Coding DNA Sequence Number=SeqID_59016
  Subcellular localization annotation: CTP_CleavageSite=40; ConfidenceScore=5.04e-01
MASTVFSYPSLHLNIYPQKTSSNRSEFSIHIQPKKHFSIRCTSLDSTPEADFPTPDPSSSTVNSAESFPIEKRRRSEIVRKRRGEKLVQPEPPNFEIGWKRTKEINLERPIGHVIADFLEKLETLMGKEFGSTELLAKVGEIVAERAREEAEILMDEGKVEERMVTELFRVLKLMEMDLAMVKAAVKEETLGERLELAKARCRQAILVAYSF

SEQ ID NO: 175795 - protein, 48 aa, Glycine max
  Coding DNA Sequence Number=SeqID_59017
MSQLMSMCFLEGRVGCDEVSAQLAQYEFEKYPDCGLMMKDGWTTYELA

SEQ ID NO: 175796 - protein, 122 aa, Glycine max
  Coding DNA Sequence Number=SeqID_59018
  Gene Ontology: Mol. function=protein binding; Cellular component =nucleus; Biological process=regulation of transcription, DNA -dependent
  Homolog annotation: Hit_ID=Q8GV45; Match level="QueryCoverage=85%, HitCoverage=28%, E-value=2e-45, Identity=80%"; Hit description =Fertilization independent endosperm development protein
MTEDKGVVFFWTMVGLKKDYRVTNRLQEGKRPLYAIVFNVLDSRYLDVFATVGGNRVTVYQCLKEGVIAVLQSYVDEDKDESFYTVGWACNVNGTPLVVTGGLNGVIRVIDAGSEKIHSVFW

SEQ ID NO: 175797 - protein, 1222 aa, Glycine max
  Coding DNA Sequence Number=SeqID_59019
  Homolog annotation: Hit_ID=Q9LT50; Match level="QueryCoverage=29%, HitCoverage=98%, E-value=1e-122, Identity=62%"; Hit description =Arabidopsis thaliana genomic DNA, chromosome 3, P1 clone: MOE17
MESILGRALEYTLKYWLKSFSREQFKLQGRTVHLSNLDIDGDALHSSVGLPPALNVATAKVGKLEITVESLTRNVQTEPIVVHIDRLDLVLEENSDSDESLSSNCSTPSAASAKGSGYGFADKSIIERNRGIGCSERLDHCNAVRSNMILSFRIADGMTIQIQTVNLLLETRGGSRRQAGATWAPPMASITIRNLLLYTTNENWQKLEWQSLSIDLLPHPDMFTEAAFGHSQGESNFRDDDGAKRVFFGGERFIEGVSGEAYITIQRTELNSPLGLEVQLHINEAVCPAVSEPGLRALLRFMTGVYVCLNRGDLDSKIHQRSTEAAGRSLVSIVVDHIFLCIKDTEFQLELLMQSLCFSRASLSEGDNDNNLTRITIGGLFLRDTFCSPPCILVQPSMQVVTRDAFHVPEFARSFCPPIYPLQEQEWQLIEGTPLICLHALKIMPSPLPPSFASETVIDCQPLVEESCLRISSLLADGIVVNPGDILPDFSVKSFIFNLKGLDLTVPFDKTKLDISKSDMDNTVQTSFAGARLHIESLCFLNSPSLKLRILNLEKDPACFSLWEGQPIDASQEKWTARASQLTLSLEACTDRTGCQNSLKQTSGLWRCVDLKDACIEVAMATADGSPLLQVPPPGGIVRVGVACEQYLSNTSVEQLFFVLDLYGYFGRVSEKIAKAVKRKQLEDIRDKSFSGKLMDKVPSDAAVSLSVKNLQLRFLESSSVNIEGMPLVQFVGDDLFTSATHRTLGGAIIVSSFLRWGSVVIGCVDDEGHLPCENGSFLSSKENALSLSDNGYPQLRTVFWVHKNEKHLLNGNAYSVPFLDISMEHVIPLYEQDLESHSLNVSASVSGVRLAGGMNYAEALLHRFGILGPDGAPGTGLCKGLENLQKGPLSKLFKATPLIVDNSEDVGSMREGKEISFPQLKKPDDVDVTIELRDWLFALEDAQETAERWWFSSHVDEGREERSWHASFHGLRVNAKSSPTDVPGGKGQLRRIKQHPVELITVGIQGLQILKPHLQKDIPSSTLIANGGKGFTNTVGGIGVEVRLILGGENVDDEMVNWEVENLKFSVKQPIEAVVTKDEVQHLTFLCKSEIDSIGRITAGIIRLLKLEGSVGQSVIDQLGHLGSEGIDKIFSSEKYSRDGSVGSRGLSPLPNLIINEESHKTSEQTLTLLEEALTDSQAKLNDLISDIGTSESSSQHLTIVQLSQNIETMHDLLMQLRNQI

SEQ ID NO: 175798 - protein, 489 aa, Glycine max
  Coding DNA Sequence Number=SeqID_59020
MAGKQSKARKPEVFGKGKVTPTQIAFIVDRYLCDNNFSSTRSTFRNEASSLISHSPIHEAPKTLLTLGEMLDEYICLKEQKVMLDQERAVVEQEKNRVQMLLQGMHNVMTAYNASGNLPAPAPAVKSAVVAVPKPTLGYKSQPGNPTSVQNKSNAPPLPQSSNSNAEGGNFSTPTLNVSDRKRKETKAVDVPSAAKKPRGRSSSRKIVSHGQNAPQQSDKAVNNTMVAQPSAIQSSSENCIPRESQVQGSNVAKCLFNQSTTSVPSNSPVPKTPPRTKSSHSDTHISPAEISSVATCNRAVTPSRCTVISTKRVMVSPAKQMAYIEMSRCISPVKTNSSKRDHVRSRLNFDAADVPGSLDNPLPNEISTSESEKELDIFDIDFPNFDALGMDFSFTEMLNDLDFSCEGIDFSCHPTSSPSMDNASGSSHECNGDHATPELSTVAEVICEKDMKVLGPECMTAMKFVTKSITVISPEKNRQQFVDPENCT

SEQ ID NO: 175799 - protein, 68 aa, Glycine max
  Coding DNA Sequence Number=SeqID_59021
MSTSFSHTRNLGLGEEVMKEGSSTVENNNSGRTFFRGFLRKKFFREITWKKVIPLLLFSTAEEHSSVS

SEQ ID NO: 175800 - protein, 181 aa, Glycine max
  Coding DNA Sequence Number=SeqID_59022
MVEVVPARITLANRITYDGLRVFSSIAKSRTNNCTVEAKPTLITLLGQHAFADLAHEDPYNHFAIFYDLWGEVKTFLMNCPNHVIDEIDQLYIFIGGVKGKTKVMFDAATGGRIIKNKTLEEAIKLIENMASNDFEAQHDRGPTSCRGVMELNSQDAIMAQVKALKVQMSNLPQPLIKVFS

SEQ ID NO: 175801 - protein, 83 aa, Glycine max
  Coding DNA Sequence Number=SeqID_59023
MEVLFRVRGFIFLLFICNEKKEPRGTSMAPGELLIIVETEPRYTEQPMAIVDKRVKRLCSKNIMSVKVALSGPAGVGARNCYA

SEQ ID NO: 175802 - protein, 89 aa, Glycine max
  Coding DNA Sequence Number=SeqID_59024
  Gene Ontology: Mol. function=hydrolase activity, hydrolyzing O -glycosyl compounds; Biological process=carbohydrate metabolic process
  Homolog annotation: Hit_ID=Q105A0; Match level="QueryCoverage=91%, HitCoverage=17%, E-value=5e-29, Identity=56%"; Hit description =Isoamylase isoform 3
MNAWAFTSDESSGLDSNIRGSYLGMIEKIPHLLELGINAVELLPVFEFDELEFQRRPNPRDHMVILDVVYHHTNEADDAFPYYFISWHR

SEQ ID NO: 175803 - protein, 66 aa, Glycine max
  Coding DNA Sequence Number=SeqID_59025
MKFMKLGSKLDALQADGNSIRSTKLLMHARMFLEDCIATKLLRGSWTRTTNVEIWHSKTGLETNQS

SEQ ID NO: 175804 - protein, 125 aa, Glycine max
  Coding DNA Sequence Number=SeqID_59026
MLSEHLAIMQLGVSLPQPINCDFCGGEHFNDSCHLYSMENSWWEQELHLYNQYEEESLSNIENVLMQFMKASQARFKANQNSIQNLEIQGGETTKIDDAADVDVGPSDVVEPGDNEEYITEVLVA

SEQ ID NO: 175805 - protein, 117 aa, Glycine max
  Coding DNA Sequence Number=SeqID_59027
MASGTACPAGEAGWPEWLAGRASTADLFQKLGIQDMDAFKEQTVDVNKKEVVDLLKFSLISRTPMTNFILKKEQYPDKITPNQYQFELREEPSDVGRQMVAKVHLRKSNGKVVSAKA

SEQ ID NO: 175806 - protein, 104 aa, Glycine max
  Coding DNA Sequence Number=SeqID_59028
MSRNLMDYAIVPSLASGMLRNFTDCALTLPFNSRHVTEFHGLPNDCCQVPRSGQAKVAFHEKDGPRTKLGLQDVPSVGELMNLDVVSLLKNNPLMKSITWEISP

SEQ ID NO: 175807 - protein, 87 aa, Glycine max
  Coding DNA Sequence Number=SeqID_59029
MEATEASRDFDDKSEIKRVWDHFVTRKLINEPVNNKQESMKKFQISLLNYAFSFISGGAGPRKLASIFENLTFGALVVFMSDPHQPR

SEQ ID NO: 175808 - protein, 94 aa, Glycine max
  Coding DNA Sequence Number=SeqID_59030
GTKGVAERVAAATDEHPRASLPAASLVRQLGLESGAGEPAPLDESPGHLWGLRTVTEQNGFARPIGILARSAMVLKEQRAGDGGLVVVVQWKME

SEQ ID NO: 175809 - protein, 229 aa, Glycine max
  Coding DNA Sequence Number=SeqID_59031
  Gene Ontology: Mol. function=nucleic acid binding; Biological process= DNA integration
  Homolog annotation: Hit_ID=Q0KIN0; Match level="QueryCoverage=76%, HitCoverage=11%, E-value=5e-34, Identity=39%"; Hit description =Integrase core domain containing protein
MASDSQKTDGYVFSISGTPTITSEKLNGKNYLAWSASVELWFLGQEDKREQWKKLDYQLCALLWQSVEPAILTNFRAFKTCYSFWKKAQSVFANDIQQLYDVAKKLATLKQTNHDMVAYVLKAQSAVEELKLSLEANKLEDIKTKLNNLYMVLVLRGMHPDFDHIRDQVLTSQEVPSLENLITRLLRVPSPKIGGNSVDNIETSVMVSNRGGQGGRGNQGGRAGRGGRP

SEQ ID NO: 175810 - protein, 455 aa, Glycine max
  Coding DNA Sequence Number=SeqID_59032
  Gene Ontology: Mol. function=iron ion transporter activity; Cellular component=integral to membrane; Biological process=high affinity iron ion transport
  Homolog annotation: Hit_ID=UPI00005F7A07; Match level="QueryCoverage =73%, HitCoverage=86%, E-value=1e-136, Identity=70%"; Hit description= COG0614: ABC-type Fe3+-hydroxamate transport system, periplasmic component
  Pfam annotation: Domain name=Peripla_BP_2; Domain location=165-422; Score=27.0; E_value=2.6e-06; Accession=PF01497.9; Description =Periplasmic binding protein
MALPRRLDDGHFQTVGDALAAVIGMHENAGQPRGEILALMIVAGPQAGHAHRAIAIDHHQCQVIVARPAALGEAQLGALQRSAALIASANESDYHAHTIPRVGSIMRNSLILLLLSLCFGVFSAQAKTVTDITGRQVVVPDNPQRIVVGESRMLYTLALLEPGNPAQRIVGWPADLARFDAQSWQLYTQKFPQIAAIPIISGNNFRQVNIESLLQLKPDLVILARYAREDGDNDLLVSALNKAGVAVIYVDLRIDLLNNTVPSVRLLGEVLNRQPRAEQFIAFYQQHMVVIRQRLAGYQGPKPKVMLHLHLGRRDTCCTTAAHGNLGDLLTFAGGDNIANASVKGVYGELNPETILSANPDVYLATGMAGPQGKRLSDLRLGPQVSQQDAADSFRRLIAKQPMLASLQAVKNHRAWSVWHNFYLSPYHVVLVEMFAKAFYPDLFADINPQQTFQQ

SEQ ID NO: 175811 - protein, 115 aa, Glycine max
  Coding DNA Sequence Number=SeqID_59033
MTLGNGYLGSCIDEERSEMRYLAEGTPAWVSHIVSPTQTCNNVAARGCMLTSREHPPRGWLKSGFMGRLRRDKNGWMSPRSRPITCEPVSSGPIDDPFACTHAPNETSGQGGATR

SEQ ID NO: 175812 - protein, 250 aa, Glycine max
  Coding DNA Sequence Number=SeqID_59034
  Homolog annotation: Hit_ID=Q8TGM5; Match level="QueryCoverage=16%, HitCoverage=61%, E-value=1e-07, Identity=70%"; Hit description =Uncharacterized protein ART3
LGRNLPPDWGCIPKQPDSPTAPRGATGSGHDGALTLSGAPFQGTWARSATEDASPDYNSDAEGDRFSWWAFPGSLAVTKGILVSLGACVHAKGSSMGPELTGSHVIGLERGLIHPFLSRRSRPMNPDFNQPRGGRALGLMASGATCVQRLDGSRDSAIHTKYRISLRSSSMQEPRYPLPRVIDEEAGRTGRRGHPLPPDGSVDFSQRRGQRTAHVAAIRTLHRTIQSVGATGGVYKGQGRSQRELMTRAY

SEQ ID NO: 175813 - protein, 54 aa, Glycine max
  Coding DNA Sequence Number=SeqID_59035
  Homolog annotation: Hit_ID=Q1S0A6; Match level="QueryCoverage=65%, HitCoverage=2%, E-value=9e-07, Identity=61%"; Hit description=Zinc finger, CCHC-type; Peptidase aspartic, catalytic; Polynucleotidyl transferase, Ribonuclease H fold
MMKQVQTPGSQKETVQMIDELKCVIQFTDKLCVVQDRISRALIGAGEQRDGDNC

SEQ ID NO: 175814 - protein, 82 aa, Glycine max
  Coding DNA Sequence Number=SeqID_59036
  Subcellular localization annotation: CTP_CleavageSite=34; ConfidenceScore=5.12e-01
MAFLGESSSQTIVKSRLGFIFPNGSIIHNYSRVCSQTSTPAPIRVPNSCDFASLKIRIHNTLQLSDKQFLDEIHFRKPFTHT

SEQ ID NO: 175815 - protein, 239 aa, Glycine max
  Coding DNA Sequence Number=SeqID_59037
  Homolog annotation: Hit_ID=Q1RUD8; Match level="QueryCoverage=54%, HitCoverage=31%, E-value=7e-14, Identity=41%"; Hit description=IMP dehydrogenase/GMP reductase
MHTNHLLLARSLCMVGLAPIPTRHKASMSLPKPSLEGKEGVLFSCGDYPNIPLIGTRGCINYNGALAIRQIGYPMRGAPKEESLSPFLVRYFGAQSFKIIQRVHKAWENPLRKDKELRGIRNGIIGGYHEWLKNFEAPEEDEEVRALKTELGKVRLAKEKFKLVATDIQKECAGLREENAATARALEQETKRAHKEEHGRDKFRGALWGSNSELKLRREERDQSRAHSMVLKEELATCS

SEQ ID NO: 175816 - protein, 43 aa, Glycine max
  Coding DNA Sequence Number=SeqID_59038
MIQAFSEELAKRAYPAKRVHLLRMNTHPLVEMPVAKRGGIAKP

SEQ ID NO: 175817 - protein, 195 aa, Glycine max
  Coding DNA Sequence Number=SeqID_59039
  Gene Ontology: Mol. function=nucleoside-triphosphatase activity; Cellular component=membrane; Biological process=polyamine transport
  Homolog annotation: Hit_ID=Q125F1; Match level="QueryCoverage=100%, HitCoverage=53%, E-value=8e-78, Identity=76%"; Hit description=ABC transporter related
RFGLVVRHHHGGGADLLLDAAQLELHVLAQLGVQVRQRFVQQQHRRPDHQRARQRHPLALPARQFTRKAVGMLVQLHQRQRLAHPRLALGALDLAHLQAKCDVVRHRQVRKQRIALEHDAQPARVRLGMGDVAAIERDAAARHIGKARDHLQRGGLAAARGSQQGHEFPFLDRQVQVRDHPQVAVVLGDVVQPQK

SEQ ID NO: 175818 - protein, 48 aa, Glycine max
  Coding DNA Sequence Number=SeqID_59040
MGRRSLTRTHSRILGCLAAALSVCPELGKGRRSIGRDPSLYLCPSLST

SEQ ID NO: 175819 - protein, 152 aa, Glycine max
  Coding DNA Sequence Number=SeqID_59041
RDSKVSMTDLVSAEDDAFRLTDNKKVYTDDHSSISASQRDSKVSMTDLVSAEDDQKRIYTDNHSGISARQRDSKVSMTDFVSAEDDAFHLTDSKKVYTDNHSGISVRQRDSKVSMIDLVSAEDDAFRLTDSKKVYTDNHSGISACHVTPVSA

SEQ ID NO: 175820 - protein, 304 aa, Glycine max
  Coding DNA Sequence Number=SeqID_59042
  Gene Ontology: Mol. function=chitin binding; Cellular component =extracellular region; Biological process=chitin metabolic process
  Homolog annotation: Hit_ID=UPI000044A8F0; Match level="QueryCoverage =88%, HitCoverage=100%, E-value=1e-37, Identity=28%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Pfam annotation: Domain name=Cornifin; Domain location=1-265; Score= -46.3; E_value=0.047; Accession=PF02389.6; Description=Cornifin (SPRR) family
  Pfam annotation: Domain name=PT; Domain location=139-174; Score=5.3; E_value=0.19; Accession=PF04886.3; Description=PT repeat
  Pfam annotation: Domain name=PT; Domain location=75-110; Score=6.4; E_ value=0.14; Accession=PF04886.3; Description=PT repeat
  Pfam module annotation: Pfam domain module=Cornifin::PT::PT; Domain location=1-265::139-174::75-110
MSSPSEGYTPSPSEEYTSSPSEGYVPWPSEEYTSSPSEGYMSSPLEDNLSSPSKGYTPSPSKGYTPLPSEDYTSSPSKDCTSLPSEGYTPLPSEGYTSSPSEDYTSSPLDGYTPSPSEDYTSLPSEDYMSSPSEDYTSSPLEDYTSSPSKDYTPSPSEGLTSSPSEGLTSSPFEDCTSSPSEGYTTSPSEDYTSSPSEDYTSSPKECCTPLSLEGFMSSPLEDCTSSPLEDFTSSPSEGYTPSPLEDCMSSPSKVYTPSPYRATRPHFYKAIRASSFLLSVPRPPPDPGGGPTVRAQLEEEAIA

SEQ ID NO: 175821 - protein, 63 aa, Glycine max
  Coding DNA Sequence Number=SeqID_59043
MFSSEGKDGHSHPGSRFMGFRDKGDVPHYFHDTYTTMMIWKFYAKLVMHAPMWTLKHQVFMVM

SEQ ID NO: 175822 - protein, 306 aa, Glycine max
  Coding DNA Sequence Number=SeqID_59044
  Gene Ontology: Mol. function=nucleoside-triphosphatase activity; Cellular component=membrane; Biological process=cobalt ion transport
  Homolog annotation: Hit_ID=UPI00005FA363; Match level="QueryCoverage =100%, HitCoverage=76%, E-value=1e-102, Identity=54%"; Hit description=COG0488: ATPase components of ABC transporters with duplicated ATPase domains
  Pfam annotation: Domain name=ABC_tran; Domain location=163-303; Score= 46.5; E_value=1.3e-11; Accession=PF00005.17; Description=ABC transporter
MLWLEHFLQHWSGSFVLVSHDRQLLDAVTNGSWIMRDKTLHYFALPCTAARKALEARDESDAQRHKAEQKEIDRVTASAKRLATWGKVYDNEDLARKAKQMEKQVERLKESQTSLTAGSPWTLSLRGDALRADRLLEMENLSVPPAPGLPPLFNIETARLKSGDRVAIVGRNGCGKSSLMKLIWRHFTDEPTDCGLKIHPRVSPGYYDQTLNQLPDDATLLDALEPFAPDPQNRKMALISAGFPWSRHGQKVSTLSGGERSRLLFVGLTLARYSLLMLDEPTNHLDMEGKEALAETLQQFEGGVLV

SEQ ID NO: 175823 - protein, 107 aa, Glycine max
  Coding DNA Sequence Number=SeqID_59045
MLGASMPYLPKMYDFRFFSINLACQTLTKGGLAFHCHERLLHFRGLMWMEEDGWIEEEKRIMDIERGFPKLEILRLRMYSLENSKSSGVVLSRCMGYGLPFYFLIFL

SEQ ID NO: 175824 - protein, 66 aa, Glycine max
  Coding DNA Sequence Number=SeqID_59046
MGLRIRFVGRTEWSTGFFLPGKASMLFAKLLNEHSGETSGQTETGNKSLIVYKNSHRKVFYPNPKP

SEQ ID NO: 175825 - protein, 97 aa, Glycine max
  Coding DNA Sequence Number=SeqID_59047
MPISPCRWIAPTRHPVNLEKSNRALGLPALVMGLCSRTGCPSPPTRSCYRDIGIAPTRHPVDPKKSNRVLELPSSNYGPLSVLQSACRPRQGHQAPY

SEQ ID NO: 175826 - protein, 53 aa, Glycine max
  Coding DNA Sequence Number=SeqID_59048
MTHAKWECDKGQMQERYVHYDAEEMFMRCMMRKSATGGVRGSTTISINKQRRI

SEQ ID NO: 175827 - protein, 101 aa, Glycine max
  Coding DNA Sequence Number=SeqID_59049
MKRKSLKSSILQNIPTWPLLAMLEGKDKDMGDACFEEEEVEQEIALLASTMVLQSLLEKEPGYRRDFLARDEELDDSKDSCVEQVVFVELEKLRPAEKPKA

SEQ ID NO: 175828 - protein, 219 aa, Glycine max
  Coding DNA Sequence Number=SeqID_59050
  Gene Ontology: Mol. function=protein kinase activity; Cellular component=membrane; Biological process=protein amino acid phosphorylation
  Homolog annotation: Hit_ID=Q2QZ78; Match level="QueryCoverage=94%, HitCoverage=37%, E-value=4e-61, Identity=53%"; Hit description=AT hook motif-containing protein, putative
MPYPEGANLALCLENSLILSELNYNNDEARSEFENLFLSMTDEQKQIYHKIMEAVNNNEGRMFFLYGYGGTGKTYIWRTLANSLKAKNQIVIMVASSGIASLLLPGGRTAHSKFKIPVPIFEDSTCNILQGSQLAELLNQTNLIIWDEAPMAHKFCFQALDQCLRDIIKEKKSNQIFGGKVIVFGGDFRQILSVIPRGSRSDIINATINSSYLWPSCEV

SEQ ID NO: 175829 - protein, 51 aa, Glycine max
  Coding DNA Sequence Number=SeqID_59051
MLQCEGYFSYLRHDIEIPNGESARKWVANMLFKFHDDPTVNESEIVLFLRQ

SEQ ID NO: 175830 - protein, 237 aa, Glycine max
  Coding DNA Sequence Number=SeqID_59052
  Homolog annotation: Hit_ID=Q1BRF7; Match level="QueryCoverage=35%, HitCoverage=92%, E-value=2e-21, Identity=55%"; Hit description =Alkylhydroperoxidase AhpD core
  Subcellular localization annotation: CTP_CleavageSite=67; ConfidenceScore=5.51e-01
MPSARRCRYSVAGLARGLSLKLTPSRLIAFIAAMVSVRSTSVTSSDHANAARSCSENSARIHSVEKRARTPGGSILRATMCRWSQSDGAVQPLWHPRERPQTIGPLKGRDAEQGRFVTADSVRQNRRLAEHWCAVGLYPGLPPREAVDPLTDSTLIAPATPLPGLPPTREQQQQARRLAEAGAKEIERIKAALEPRKPPAETKPRARDIRSKARLRAGLQQMRGGSLVPVKGLEPSW

SEQ ID NO: 175831 - protein, 81 aa, Glycine max
  Coding DNA Sequence Number=SeqID_59053
MDKVDIFVPHPLTNACLLIQLSPECGCKPLVCLLKQPALLSVDFQDRSIRDYSSCTLVGRSELSRIECWTNGLSYLRKKGG

SEQ ID NO: 175832 - protein, 110 aa, Glycine max
  Coding DNA Sequence Number=SeqID_59054
MVNTQSDLRREIPFEGSNPLVVAMPDTDTFQQLQNHIAKMKRRHEEELRKLKADHNQLEARFRSPQDDEHSVHTLPKRTHGESYPRRTINTQDDPSDGSLLVELLWRLDL

SEQ ID NO: 175833 - protein, 193 aa, Glycine max
  Coding DNA Sequence Number=SeqID_59055
MAYRRPYQHISCFHVNFSTSLVTLAMVPVCSFPIWQKAKGSSQIVEIVRRGAWNVYKLLALSISLGEQCFLGLVSVGNLPLDKLRALKLSLRALYSDIVMTFEDDSCLTSLHIGRVVNIEAPPVGVVSSFLENSARKYSMNCVFMGTRVHLDYHLMTLKVGSKMSSRALLGVMQYAAGEVDRELMLPFLLYKG

SEQ ID NO: 175834 - protein, 240 aa, Glycine max
  Coding DNA Sequence Number=SeqID_59056
  Gene Ontology: Mol. function=RNA-directed DNA polymerase activity; Cellular component=chromatin; Biological process=RNA-dependent DNA replication
MGMDKWSPVRALTVYQVSLDNKFDVDLRDEPFERGPKPIEELIKLQLGPKPRNAHMFASQPSDMPGIHPSVNYQKFAIFPKAKPVSQKERKMGEERHKVVREEMDKLLNANFIKEASQTKEIIFYAPVMVQKWVVTNIVKVKKTNDKWRRCTDYTDLNRACPKDAYPLPNIDRLVDGVSGLQVLSFLDAYSRYNQIRMHAPDEEKMTFIIEDANFCYRVMPFGLKNVGATYQRLMDHIFK

SEQ ID NO: 175835 - protein, 247 aa, Glycine max
  Coding DNA Sequence Number=SeqID_59057
MALSSLSVFLTIKENGHEVDIASSLYLLPYEAEEWTVMRRVPVLMEVVDRVLAGLTLAWWLSSPLTNWARQFDGYLQVEGLLLDCSVIGRQGLFLLFNLPDLVLEPGHFFHLDVAFGSFTQLVHATRDSNSPNLSMNLYRDSSSACHRLASVADVTMRLASCILRIEALNKGVKAVDGPWRESTILGQESIQVFIWIGGLSYRSKLSGFQPRDLVMQSYPTRVLDRRLQEDWARAAKEGLGVLMNPM

SEQ ID NO: 175836 - protein, 69 aa, Glycine max
  Coding DNA Sequence Number=SeqID_59058
MPRIHDAILYYNGKWNMPPQNKFVGCAFTGKNPKKFQIPSTCTIDELKNLIKQVAPKGIPPLGIHESQT

SEQ ID NO: 175837 - protein, 79 aa, Glycine max
  Coding DNA Sequence Number=SeqID_59059
MANTKKTGQMTSEEAKEITDKIDDVLTAAIERPEHPSRVRATGAGIMIKQYFGPAPRTSRTSLSMALKDLEQLTQKIRD

SEQ ID NO: 175838 - protein, 80 aa, Glycine max
  Coding DNA Sequence Number=SeqID_59060
MNMIMMSVGIFDKGKGGTIGWFGKDEVGVGEDNVRGDIVGGWVHIEGGDCGSSQWLVESMTGGRLVKTHIFLVLSTKVEP

SEQ ID NO: 175839 - protein, 68 aa, Glycine max
  Coding DNA Sequence Number=SeqID_59061
MRLPGKESLLMGSPITINEILDVSISFLNDHLEETLGSTKIEENHSKCINLAQCGAKKKVASARDFGW

SEQ ID NO: 175840 - protein, 95 aa, Glycine max
  Coding DNA Sequence Number=SeqID_59062
  Homolog annotation: Hit_ID=Q1SP50; Match level="QueryCoverage=44%, HitCoverage=5%, E-value=3e-08, Identity=65%"; Hit description=RNA -directed DNA polymerase
MSKLPSRFVVKHVLWEQNKVVDVMTKGALGAVSLLVLFESPPMFVASSIVLDVSIGGREVLIKYVLQAIPTYCMSIFQIPQPLGDELKKMMNSDW

SEQ ID NO: 175841 - protein, 526 aa, Glycine max
  Coding DNA Sequence Number=SeqID_59063
  Gene Ontology: Mol. function=protein serine/threonine kinase activity; Cellular component=membrane; Biological process=protein amino acid phosphorylation
  Homolog annotation: Hit_ID=Q9SCZ4; Match level="QueryCoverage=95%, HitCoverage=55%, E-value=2e-81, Identity=38%"; Hit description =Receptor-protein kinase-like protein
MTFLSITFLTLFFLLLFLSIELQAYTPEDNFTISCGTTGIVFDGQRTWTGDADTKYLSGGQGSTVLTQAATQDPSVNQVPYTTARLSPSQFNYSFPVSAGPKFVRLFFYPADYPSFPRTHASFSVQSNGFTFLKGFNASLNADAESTKTIFREYVVNVNDGDILILSFTPSQPNSYAFINGIEVLSMPSDLYYTSATDSIGFKFLGSTTLYSVETRFALQAEYRIKMGGQEISPLNDTGLFRKWTGDEEDYLIKQNPENNDLPAITDGKMNITVNPDYVAPKELYRAGRSMGTNATLNKISNLTWEFPVDSGFTYVLRLHFCELDPDINKDGNRVFFIYIASQLAENHADVMQWSHNQKGLAVQRNYAILIPNDNTQKKVNLSLQMHPYATNDETTYSDAFLNGLEIFKISEAGSNNLAGPNPDPVQTPHNNIPAPKGNRSSKSGTSIIGIVAGVVSGVVLISLIILFLIVFFRRKTITTPKDYNKSKSSATSKWGPLSFTTTKSTTTTKSSLPSDLCRHFSLPEI

SEQ ID NO: 175842 - protein, 125 aa, Glycine max
  Coding DNA Sequence Number=SeqID_59064
  Homolog annotation: Hit_ID=UPI0000DB7FBC; Match level="QueryCoverage =37%, HitCoverage=33%, E-value=2e-10, Identity=53%"; Hit description =PREDICTED: similar to CG8675-PA, partial
  Subcellular localization annotation: CTP_CleavageSite=23; ConfidenceScore=5.32e-01
MNSSGAKRSGPPKHQNKYAWKPNAGRKINETVRNTTNLTSFRSNRLIIINKSSILNTIDVFVINMHRKLEEDSGPSLRSLGCALVARIKSNGNAVMANTSLFFNPPNARDVPSVLFAKLTITCVL

SEQ ID NO: 175843 - protein, 383 aa, Glycine max
  Coding DNA Sequence Number=SeqID_59065
  Gene Ontology: Mol. function=sugar porter activity; Cellular component=membrane; Biological process=response to nematode
  Homolog annotation: Hit_ID=Q6Z5L0; Match level="QueryCoverage=93%, HitCoverage=67%, E-value=1e-122, Identity=62%"; Hit description =Glucose-6-phosphate/phosphate-tranlocator-like
  Pfam annotation: Domain name=TPT; Domain location=205-343; Score =14.5; E_value=7.8e-05; Accession=PF03151.7; Description=Triose -phosphate Transporter family
MMKPSSYFYYLLLVTAGRALEDLRASLFNQFRSSEGAKRQQQRICGPAIALSFNFLVAVGIIFMNKMVLQTVQFKFPILLTLIHYVVSWFLMAILKAFSFLPAAPSSKSTRLSTLFTLGFVMSLSTGFANVSLKYNSIGFYQMAKIAVTPSIVLAEFVLYRKKVSFAKVSMLTRNFKTLQALALTVVSIGVAVATVTDLQFHVFGACVALAWIVPSAVNKILWSRLQQQENWTALSLMWKTTPITLIFLAAMLPCLDPPGVLSFDWNFSNSMVIFASAILGFLLQWSGALALGATSAISHVVLGQFKTCVLLLGNYYLFGSNPGKISICGAFTAIAGMSVYTYLNMRQQSNKPSPRQASVLPKSKLGKENGSTHDGHYGAESV

SEQ ID NO: 175844 - protein, 212 aa, Glycine max
  Coding DNA Sequence Number=SeqID_59066
MKQQLSDYGIFLDHIPIRCDNISAINLSKNPVQHSRTKHIEIRHHFLRDHVLKGDCVLEFVDTKNQLAGVGVVTSFGYRKDRDGQWLKKDALPLQDKCTPSPPPQRNDSTALMNEVLSELRGLRTYVGERFDSIPWMVALMAWIPTSPSLKRMWELNCHHQKGGDCRSQDFDFDVLMMPYDHDVLMPYENALLKLRSRQKSKRFKIHHQEDL

SEQ ID NO: 175845 - protein, 121 aa, Glycine max
  Coding DNA Sequence Number=SeqID_59067
MHVADNSSFYFCYQMNKDKSKSSNSAPTDTKGNKVGQLFPNASLEDYAKLNRVNVGHDDGEICDDSEGEVCEDEDDNSDNEDCDEDGNSDDEDGDSENEDCDENDDKNDENTPDHTSANHE

SEQ ID NO: 175846 - protein, 140 aa, Glycine max
  Coding DNA Sequence Number=SeqID_59068
  Gene Ontology: Mol. function=transporter activity; Cellular component= integral to membrane; Biological process=auxin mediated signaling pathway
  Homolog annotation: Hit_ID=Q9LU77; Match level="QueryCoverage=68%, HitCoverage=17%, E-value=5e-25, Identity=58%"; Hit description=Auxin efflux carrier component 2
MIKGKDIYEVVAALVPLYVALILGYGSVHWWKIFTPEQCNDINRFVGAKLFISNQFPKTADAISTLRVDSNVGSLNGREPLQTDAEIAEDGQLHVIVRNMSRSTSMVSPRTSNLTGVEIFSVTSSREVPSQRASSFIVTN

SEQ ID NO: 175847 - protein, 68 aa, Glycine max
  Coding DNA Sequence Number=SeqID_59069
  Gene Ontology: Mol. function=GPI anchor binding; Cellular component =integral to membrane
  Homolog annotation: Hit_ID=Q6Z4G8; Match level="QueryCoverage=55%, HitCoverage=8%, E-value=5e-10, Identity=71%"; Hit description=COBRA -like 1 protein precursor
MAWTSRRVELERVFEIDGTPCCVMNGDEFVAAFPVVDDANEAYDPLDPNGNITIKWDIISWTPDGYVV

SEQ ID NO: 175848 - protein, 243 aa, Glycine max
  Coding DNA Sequence Number=SeqID_59070
  Gene Ontology: Mol. function=binding; Cellular component =mitochondrial inner membrane; Biological process=transport
  Homolog annotation: Hit_ID=Q69FA0; Match level="QueryCoverage=98%, HitCoverage=77%, E-value=9e-92, Identity=56%"; Hit description =Mitochondrial carrier protein
  Pfam annotation: Domain name=Mito_carr; Domain location=107-199; Score=85.0; E_value=2.2e-22; Accession=PF00153.17; Description =Mitochondrial carrier protein
  Pfam annotation: Domain name=Mito_carr; Domain location=9-96; Score =53.2; E_value=8.6e-13; Accession=PF00153.17; Description =Mitochondrial carrier protein
  Pfam module annotation: Pfam domain module=Mito_carr::Mito_carr; Domain location=107-199::9-96
  Subcellular localization annotation: CTP_CleavageSite=34; ConfidenceScore=5.16e-01
MNVQLDKKKFFVVGAGLFTGVTVALYPVSVVKTRLQVASKDTLERSVFSVVKGLLKTDGIPGLYKGFGTVITGAIPTRIIFLTALETTKVASFRMVEPFRLSETNQAAIANGIAGMASSFLAQSLFVPIDVVSQKLMVQGYSGHAQYSGGLDVARKVLRSDGIRGLYRGFGLSVMTYVPSNAVWWASYGSSQRYLWRFLGDNNEEDAPSLPKIIFAQATGGIIAGATASCITTPLDTIKTRLQ

SEQ ID NO: 175849 - protein, 213 aa, Glycine max
  Coding DNA Sequence Number=SeqID_59071
  Gene Ontology: Mol. function=tRNA (guanine-N2-)-methyltransferase activity; Biological process=tRNA processing
  Homolog annotation: Hit_ID=Q8RXS4; Match level="QueryCoverage=99%, HitCoverage=28%, E-value=8e-52, Identity=59%"; Hit description =Putative N2,N2-dimethylguanine tRNA methyltransferase
MSSDLSDYKIIKEGEAEILMHAKNEVFYNKTQVNNRDISIAVLRTFISKRKQEHEAYLSKRTKGAQKASENGDSSELVKEEVPDTTAQEYHKSNGECEVEEEISPEERCSTVEEGSVKVTEECSTAEGHTNLSEGKGKRELKPPRVLEALSASGLRSLRYAREVEGIGQVIAVDNDKGASQLLLKLVEGTSNSMVQLQLQKWSLILMMLVYIC

SEQ ID NO: 175850 - protein, 402 aa, Glycine max
  Coding DNA Sequence Number=SeqID_59072
  Gene Ontology: Mol. function=GPI anchor binding; Cellular component =anchored to membrane; Biological process=root hair cell differentiation
  Homolog annotation: Hit_ID=Q69F98; Match level="QueryCoverage=92%, HitCoverage=83%, E-value=0.0, Identity=82%"; Hit description =Phytochelatin synthetase-like protein
  Pfam annotation: Domain name=Phytochel_synth; Domain location=10-172; Score=352.9; E_value=5.1e-103; Accession=PF04833.5; Description =Phytochelatin synthetase-like conserv
MSKKQLNGQAVVTMYNFQQYRHISAPGWSLGWTWAKKEVIWSMMGGQTTEQGDCSKYKANIPHCCKKNPIVVDLLPGTPYNQQISNCCKGGVLSSWAQDQSKAVAAFQVSVGSASTTNKTVKVPKDFTLKAPGPGYTCGPATIVKPTQFLQPDKRRVTQALMTWNVTCTYSQFLAQRTPSCCVSLSSFYNNTVVPCTTCACGCQGNSSQSGECVDPDSPHLQSVVSNAGPGKSSITPLVRCTRHMCPIRVHWHVKLNYKEYWRVKVTVTNFNYGMNYSDWNLVVQHPNFDNLTQLFSFNYKAITPYGSITMLWGLKFYNDFLMQAGPLGNVQSELLFRKDKSTFTFDKGWAFPRRVYFNGDVCVMSPPDAYPWLPNAGSRQVVSLLALVMSSLVALVLYADT

SEQ ID NO: 175851 - protein, 405 aa, Glycine max
  Coding DNA Sequence Number=SeqID_59073
  Gene Ontology: Mol. function=3,4-dihydroxy-2-butanone-4-phosphate synthase activity; Biological process=riboflavin biosynthetic process
  Homolog annotation: Hit_ID=Q7WDL7; Match level="QueryCoverage=52%, HitCoverage=92%, E-value=4e-87, Identity=80%"; Hit description=3,4 -dihydroxy-2-butanone 4-phosphate synthase
GRRARGAGVRVDRGGRPVADLDGPDAGVGLCRCAVERRGLFTGVPGIRRGGGASRAAGQPWRGHGGVCGVPGRGAGHRQSRGRLVGRDAGLWGGLCAGRRVRAGRRVRGDGAAGPDRGGHFQHFVIDRLGLAVAQLLQVVGQFGDGQGDQAVLGGIALQRGAAHHGAVGVHQFAQHAGRTQAGQRGQVDRAFGVAAAGQHAAGLGPQREDVAGAEDVVGLGGGRDGGADGGDAIHGRHAGADAFARFDRDGEGGGEAALVALDHGGQVETVEGFAGQAQADDAAAVADQLGHDGHGQLVGGDDEVGFVFAVEVIHEDDGAAQAQVMQGALQARGEGLGGQAGEGGLRGKGNGACDGTSSLIRTVTVGPGISPDLLTPVSVKDAGRSRARQVAWHTAGGEFRPALK

SEQ ID NO: 175852 - protein, 452 aa, Glycine max
  Coding DNA Sequence Number=SeqID_59074
  Gene Ontology: Mol. function=nucleoside-triphosphatase activity; Cellular component=chloroplast; Biological process=macromolecule biosynthetic process
  Homolog annotation: Hit_ID=Q2PMM5; Match level="QueryCoverage=100%, HitCoverage=19%, E-value=0.0, Identity=86%"; Hit description=Protein ycf2
  Pfam annotation: Domain name=AAA; Domain location=200-427; Score =22.4; E_value=4.3e-06; Accession=PF00004.19; Description=ATPase family associated with various cellular activities (AAA)
MLWGGGPTYGVKSIRSKKKYLNLIDLISIIPNPINRIAFSRNTRHLSHPSKTIYSLIRKIKNVNGDWIDDKIESWVLNSNSIDDKEREFLVQFSTLTTEKRIDQILLSLTHSHHLSKNNSGYQMIEQPGAIYLRYLVDIHKKYLMIYEFNTSCLAERRIFLANYQTITYSQTLRGANSFHFPSHGKPFSLRLALPPPSRGILVIGSIGTGRSYLVKYLATNSYVPFITVFLNKFLDNKPKGFLIDDSDDIDDSYDSDDIDRDLDMELELLTMMNTLTMDMMPEIDRFYITFQFELAKAMSPCIIWIPNIHDLDVNESNYLSLGLLVNYLSRDCERCSTRNILVIASTHIPQKVDPALIAPNKLNTCIKIRRLLISQQRKHFFTLSYTRGFHLEKKMSHTNGFGSTTMGSNVRDLVALTNEALSISIIQKKSIIDTNIIRSVLHRQTWDFRSQ

SEQ ID NO: 175853 - protein, 161 aa, Glycine max
  Coding DNA Sequence Number=SeqID_59075
  Gene Ontology: Mol. function=ATP binding; Biological process=cell redox homeostasis
  Homolog annotation: Hit_ID=Q7N3Y0; Match level="QueryCoverage=65%, HitCoverage=22%, E-value=1e-46, Identity=85%"; Hit description =Similar to unknown protein YcjX of Escherichia coli
MAQQRLIRPVAQRQAHLADAARRSRPHRRRAVQLGQPFIICKARRAQLTLGYALYAQHPLFAHHGKQRQTRAAVDIEQLVNQRGDKGGFAAAAQAGDGEAQMTIHATQRFQGGRQQQAQRTARHRFHCPAGQAAGRISYCTDDDEFSRRLQRRRCAPAQGQ

SEQ ID NO: 175854 - protein, 337 aa, Glycine max
  Coding DNA Sequence Number=SeqID_59076
  Gene Ontology: Mol. function=tRNA (guanine-N2-)-methyltransferase activity; Cellular component=mitochondrion; Biological process=tRNA processing
  Homolog annotation: Hit_ID=Q8RXS4; Match level="QueryCoverage=97%, HitCoverage=47%, E-value=1e-138, Identity=71%"; Hit description =Putative N2,N2-dimethylguanine tRNA methyltransferase
  Pfam annotation: Domain name=TRM; Domain location=2-213; Score=-46.8; E_value=2.5e-10; Accession=PF02005.7; Description=N2,N2 -dimethylguanosine tRNA methyltransferase
MVKRINRLCWVNISSHANRYKRYIVPVLSVQMDFYLRVFVRIYTSASAMKNTPLKLSYVYQCTGCDSFHLQPIGRTISKNTSVRYLPGFGPVVPQECSDCGKKFNMGGPIWSAPIHDQEWVAAILADVKYMKDRYPAYDRISAVLTTISEELPDVPLFLSLHNLCATLKCTSPSAIIFRSAVINAGYRISGTHVNPLGLKSDAPMDVIWDIMRCWVKNHPVKPQPADQPGSIILAKEPALQICGGRVRRDRKRVKNCIDRANFARAVASLSKAQAKKVARFLPNPERHWGPKLRAGRQITSKHVSLLGPDAINGALNQEDDEEPKSKKSRTEDSVTS

SEQ ID NO: 175855 - protein, 86 aa, Glycine max
  Coding DNA Sequence Number=SeqID_59077
MGAKYFEVVKRGSHPNNGWSLDEIRTQNDHILSLRVVGHNRAWAASHRMTIICLWVPPDTIASGWRKGARNDHNLSQPTSRLTVPK

SEQ ID NO: 175856 - protein, 154 aa, Glycine max
  Coding DNA Sequence Number=SeqID_59078
  Subcellular localization annotation: CTP_CleavageSite=39; ConfidenceScore=5.88e-01
MASAMPSSMAHFTNANSTNPNAYYQISNCASASSFSYVAFSIFASSFFFFTIFLFAFFLPLSRNLIIMPKVLKRPPFHINIIQDDINTVASDIIGNDVDTRGDLQPLHQNGAYLDKDSGNETKEGKMGAKQDRAENPTFIGKPHSISQQPKEKK

SEQ ID NO: 175857 - protein, 105 aa, Glycine max
  Coding DNA Sequence Number=SeqID_59079
MVESKGRLVVGGWWLVVGGWWKGNSRLKTCTCNTIRVNYRGNLYTNTTYNSRVITDIVERTKIKIRKMSHSLKNVEMHDLITNLHGKSFCMHINLGPSCHQEWSP

SEQ ID NO: 175858 - protein, 91 aa, Glycine max
  Coding DNA Sequence Number=SeqID_59080
MQIAGGNGDFVVDATAGTGVAIFNGVLHQAWTRQFDWRVEGFAVPRCRLFPTLQSATCNGQFLGAGCRQLQWRFGWTKSPARAAICLAWGF

SEQ ID NO: 175859 - protein, 72 aa, Glycine max
  Coding DNA Sequence Number=SeqID_59081
MAACSCWRPPLSLNSHGKENWLSRGPTHSNYYVFNYGQSVTYQEMRKKRVKVCEEMLGVVVAWRVNLMKKSL

SEQ ID NO: 175860 - protein, 177 aa, Glycine max
  Coding DNA Sequence Number=SeqID_59082
  Gene Ontology: Mol. function=amino-acid N-acetyltransferase activity; Cellular component=cytoplasm; Biological process=amino acid biosynthetic process
  Homolog annotation: Hit_ID=Q84JF4; Match level="QueryCoverage=53%, HitCoverage=15%, E-value=9e-35, Identity=76%"; Hit description =Putative amino acid acetyltransferase
  Subcellular localization annotation: CTP_CleavageSite=65; ConfidenceScore=5.62e-01
MAVLSSSSHTSLPNLSKFPFHRFSFHPHHLNLPPWPSKPMPKSPLSLSTTCKGRNVFSEEFNGSVAEEESYNSMDNKQFDIAFLHHLGIRFVLVPGTHVQIDNLLLERGRQPKYVGPYRITDDESLAAAMEAAGRIRLMIEAKLSPGPSIYNSRRHGGNSRLHEVGVSVASGNFCWF

SEQ ID NO: 175861 - protein, 952 aa, Glycine max
  Coding DNA Sequence Number=SeqID_59083
  Gene Ontology: Mol. function=DNA binding; Cellular component=beta -galactosidase complex; Biological process=DNA integration
  Homolog annotation: Hit_ID=Q1SS72; Match level="QueryCoverage=99%, HitCoverage=66%, E-value=0.0, Identity=39%"; Hit description =Integrase, catalytic region
  Pfam annotation: Domain name=rve; Domain location=580-740; Score =158.2; E_value=2.1e-44; Accession=PF00665.16; Description=Integrase core domain
  Pfam annotation: Domain name=zf-CCHC; Domain location=246-263; Score =12.7; E_value=0.0078; Accession=PF00098.13; Description=Zinc knuckle
  Pfam annotation: Domain name=zf-CCHC; Domain location=282-299; Score =12.8; E_value=0.0078; Accession=PF00098.13; Description=Zinc knuckle
  Pfam module annotation: Pfam domain module=rve::zf-CCHC::zf-CCHC; Domain location=580-740::246-263::282-299
MNEASINNTESYLYLHPSENPAIALVSPVLDSTNYHSWSRSMVTVLSAKNKVEFIDGSTPELLKIDRTYGAWRRCKNMVVSWIVHSVATSILQSILWMDKAEEILRDLKSRYSQGDLLRIPDLQQEASTMKQGSLSVAEYFTRLRVIWDEIENFRPDSVCSCNIRCSCTAFTIIAQRKLEDRAMQFLRGLNEQYTNIRSHVLLMDPIPAISKKISYVAQQERQLLGHARPNINFEPKDISINATRTTCDFCGRIGHVESACYKKHGMPTSYDGRNKNNNGRKTCTHCGKIGHTVDVCYRKHGYPPGYKPYSGRTTVNNVMIMEDKATNDQAQQHESQEVVHFSPKQYKALLALIQQPPAGSTAQSKQVALVSSCTVNTPLNPGNSLSTQAHRTSWILDSGATDHVTCSLHNLHSYTQISPITVKLPNGNLVHATHIGTVHLSSNLTLHNVLYIPTFTFNLISISKLVSSNNYELIFSSTSCVLQEAKNHMKIGIVEAKHGLYHLIPNQITTKAIYSTITHPRCNIIPIDLWHFRMGHPSNERLQCMKNYYPLLRNDKKIVCNTCHYAKHKKISFSSSSSHASHSFDLLHMDVWGPCSKLSMHGHKYFLTIVDDHSRFTWIHLMKSKAKTRHTIINFIAFIERQYNDKVKTIRSDNGIEFLMHEYYASKGILHQTTCVETPEQNGIVERKHQHLLNVTRALLFQANLPPTFWCYALPHAAYLINCIPTPFLHNISPYEKLHKHPCDISNLRVFGCLCYINTIKANWQKFDPRAHPCIFIGFKTHTKGYLVYDLHSHDVAVSRNVTFYEYHFPYLPKTQHLNLDNSTPSPSPRPFSGKDLDLPEESHSSQPIIPIHSCDEHSTKQDPSHLWRSTRSRHSPTYLQDYHKVLASSTPKASVIVRYPLSSVLSYSHLSPAHRNFVMTISSATEPSSYAEASRHDCCIKAMKAELQAL

SEQ ID NO: 175862 - protein, 241 aa, Glycine max
  Coding DNA Sequence Number=SeqID_59084
  Gene Ontology: Mol. function=amino-acid N-acetyltransferase activity; Cellular component=cytoplasm; Biological process=amino acid biosynthetic process
  Homolog annotation: Hit_ID=Q84JF4; Match level="QueryCoverage=93%, HitCoverage=31%, E-value=1e-59, Identity=56%"; Hit description =Putative amino acid acetyltransferase
MDMLVSIPLFCCCGVVKGVDFGSTGEVKKVDISRMRERLDGDCIVILSNLGYSSSGEVLDCKYALESLMITFYNLKASISYVIHILNLGGQPGANGEVVAITYEVATACALAVRADKLICITDGPILDESGHLIRFLTLQEADMLIRKRLEQSETTANYVKAVAEESFKSLKNFNGAVHSSQNGKPFSECHNSTFHNGVGFDNGNGLSEEQGFAIGGQESLCRTNGYLSELAAAAFVCRVS

SEQ ID NO: 175863 - protein, 444 aa, Glycine max
  Coding DNA Sequence Number=SeqID_59085
  Gene Ontology: Mol. function=DNA binding; Cellular component=beta -galactosidase complex; Biological process=DNA integration
  Homolog annotation: Hit_ID=Q1T2A5; Match level="QueryCoverage=99%, HitCoverage=47%, E-value=1e-136, Identity=55%"; Hit description =Integrase, catalytic region
MEGLDYLDTFSPVAKLTTVRVLLALAAQNQWHLRQLDVNNAFLHGELEEEVYMQIPPGLAVENPKLVCRLQRSLYGLKQASRQWFTKLSSFLVSHGFQQSNSGHSLFLKLTKSVTTILLVYVDDIILTGKIILEIQDITTLLDQEFKIKDLGDLKFFLGLEIARTTDGIHLCQRKYALDILSDSGMLGCKPHSTPMDYSMKLQMNSGNSLSDESSSSYRRLIGKLIYLTNTHPDIAYAVQQLSQYMSAPTNIHLQAAFRILRYLKGSPGSGLFFTATGTPQLRAFSDSDWAGCKDSRKSTTGFLVYLGSSLISWQSKKQSTVSRSSSEAEYRALASTACELQWLTYILQDIGVAFIQPATLYCDNQSAIQIATNPVFHERTKHIEIDCHIIRHKVIAGLVKLLPVSSSMQLADIFTKALPPATFQPLCNKLGMMNIHSQLEGGS

SEQ ID NO: 175864 - protein, 110 aa, Glycine max
  Coding DNA Sequence Number=SeqID_59086
  Subcellular localization annotation: CTP_CleavageSite=57; ConfidenceScore=5.56e-01
MVHDIFVKVKLEVTGTSASLNVFGSRRSSDVTRSFAPFFFKMVTSILQLDSMNLFVKARAWFNPITQEMAILIANTSSTIHRDERLGNMHAMYGKCNYEIEMPEETSFLS

SEQ ID NO: 175865 - protein, 263 aa, Glycine max
  Coding DNA Sequence Number=SeqID_59087
  Gene Ontology: Mol. function=oxidoreductase activity; Cellular component=proton-transporting two-sector ATPase complex; Biological process=flavonoid biosynthetic process
  Homolog annotation: Hit_ID=Q8LKP6; Match level="QueryCoverage=96%, HitCoverage=74%, E-value=8e-55, Identity=43%"; Hit description =Putative flavanone 3-hydroxylase
  Pfam annotation: Domain name=2OG-FeII_Oxy; Domain location=192-263; Score=58.5; E_value=2.2e-14; Accession=PF03171.10; Description=2OG -Fe(II) oxygenase superfamily
METLDQMLVSSWYNVHSLVPPSYVQLPENRPSKVVSSLHKAIPVIDFGGHDRVDTTKQILEASEEYGFFQVINHGVSKDLMDETLNIFKEFHAMAPKEKVNECSKDPNGSCKLYTSSENYKKDAIHYWKDSLTHPCPPSGEYMEYWPQKPSKYREIVGKYTRELKKLALKILELLCEGLGLNLGYFCGGLSENPSVLVHHYPPCPDPSLTLGLAKHRDPTIITILLQDKEVQGLQVLKDGEWIGVEPIPNAFVVNIGLLLQRL

SEQ ID NO: 175866 - protein, 163 aa, Glycine max
  Coding DNA Sequence Number=SeqID_59088
MLKLYFNKEQIEKATVTLHGVKVQQQDSSSSKKKNYWNKGVIKDIKGGTKTKIVKSDASGTSMPITSTPMRNSLENGHKMIMHHLISSTILDTGGYDGKISTLDLVLLWGLLTPYSHPDDQIGTTTFLIRRLQVLANSSSIVIVQGGLIISIARFYDDHHFLD

SEQ ID NO: 175867 - protein, 96 aa, Glycine max
  Coding DNA Sequence Number=SeqID_59089
  Gene Ontology: Mol. function=DNA binding; Biological process=DNA integration
MFGVPRAVISNGGSHFIERQIEFILKNYGVTHTTPYHPQTSGQLEHKDLLVVKLLNYDLKAAGERWKLDLNELDENILNAYENARIYKEQTKRWHN

SEQ ID NO: 175868 - protein, 46 aa, Glycine max
  Coding DNA Sequence Number=SeqID_59090
MRQKSEVAGLGVGAVLLCATVAATKVDAFFSSSQRRALQTPVSLGG

SEQ ID NO: 175869 - protein, 117 aa, Glycine max
  Coding DNA Sequence Number=SeqID_59091
  Gene Ontology: Mol. function=phenylalanine-tRNA ligase activity; Biological process=phenylalanyl-tRNA aminoacylation
  Homolog annotation: Hit_ID=Q9FKU1; Match level="QueryCoverage=89%, HitCoverage=45%, E-value=8e-08, Identity=31%"; Hit description =Genomic DNA, chromosome 5, P1 clone:MDA7
MAALFKFLAVKWMIILEDHFAKGIINPFEYMLHKGGKIHITHKTSHPFSKKNIKKLAKRQSLVLVKAEFYPHLYPGYKIKRGDGLKCDESFPVGECSTFMFQSYFDLFCYKIRKPCY

SEQ ID NO: 175870 - protein, 215 aa, Glycine max
  Coding DNA Sequence Number=SeqID_59092
MQETLMQYITKNDQQMKLMTKANPKEEVNVVSTKSGRPMAKFKKKKKKPLHHQKKKALTEESQEVHINIPFTETIAQIPKKLSPKLKVPGSFSVPYTISSLQIDRALCDLGASINSMPYSVYKLGMMKRFQLFWEGPSSIHEELCLMPARETNLEASHQQDEDNCGQALSNYGEGRSSEKEHHSKGSPVKPGYVKKGKVSVSYPYPTPILHGYVS

SEQ ID NO: 175871 - protein, 44 aa, Glycine max
  Coding DNA Sequence Number=SeqID_59093
MVSHDKLRVRRRGRWELSDDANSGRETSVTEEGLQRWTDVVTVS

SEQ ID NO: 175872 - protein, 55 aa, Glycine max
  Coding DNA Sequence Number=SeqID_59094
MASYMTLLMAFEYLPTIPCCENAKKYDRKYLFAAGWKPLRDIGMAYSTREALDRL

SEQ ID NO: 175873 - protein, 36 aa, Glycine max
  Coding DNA Sequence Number=SeqID_59095
MKGSSQSQGSHGQLIWIVAKLGRLKLQVQDSDNGRG

SEQ ID NO: 175874 - protein, 159 aa, Glycine max
  Coding DNA Sequence Number=SeqID_59096
MWSYLPKKFLRQFRRERHHVVFYVFHHNHNLSLNHNLVVVKYQIMYQVLFTHDKFQMMSTSMQRLRVVPKGINNHHVIQQLLLMAHEGLVSRCSSTGEHQSKKPNRSSKSGHKGSWSSSDAILPRKGPITRTMSKRLQEDWARAAEEGPRVLMNLRVDF

SEQ ID NO: 175875 - protein, 69 aa, Glycine max
  Coding DNA Sequence Number=SeqID_59097
MQSWLDNTNNKQQSLRDILRDLTLLQSYKDQIPGHVWIDEPKAEPKMVSHGGNVMPYLTQPMVKGQFRA

SEQ ID NO: 175876 - protein, 71 aa, Glycine max
  Coding DNA Sequence Number=SeqID_59098
MGSKSTLRLMRTLGPFLGSLAQSTWSLLANALAGPFYFERLVKGNDPDPKPNPSIEEPPELELKPPPFNLK

SEQ ID NO: 175877 - protein, 398 aa, Glycine max
  Coding DNA Sequence Number=SeqID_59099
MSSFIFDFAIGMGGRDFRGLIQQPLLDLEVISIDGSSSEDTLHGASDSDFCSLERLRVSRRTGGGTSCLHGRVQPFVASMVGQPVCHSIGSQSSIPTIADYEWVRDDVLMYKLSITSAASVTALQRQVSVQGLGSHSPLDHILMKLTGKIGWVSLNSKSKKLFEFDSNVFCHLKDHFFKVLVTEVMVDDSPLMFNKDREPDFSFYWFKSFDEDLLTLMEKVDKAILEHLLASLNARAFFSLPSTSNPFAAMGGIMGDFAWKSLVKQVEPVGKIVTPSVVAFIAGEGGQPAVVVAPIIGIAKVTLGVPSSVLANRKQDNDTGMPGHLPLASSAVVALALDVVVVVAPALPSLPTMLVQEVTLATVEVSAPDALAGPVVAPLSTIVAPLLSVGVVTMSAP

SEQ ID NO: 175878 - protein, 139 aa, Glycine max
  Coding DNA Sequence Number=SeqID_59100
  Gene Ontology: Mol. function=RNA-directed DNA polymerase activity; Biological process=RNA-dependent DNA replication
MASVPYTLRHIESSVHGLKDDFVGCLCLTVGLGMFNRGYEVNFSTSFTMISRSGLASIHLIVKRSMQNVCEFLAPLCEVEGVCPECRPIVAGAYHFGCKGTSSCMKDTNSFVKFSHDIVCLLAIQAFEHLNSSPSRMTQ

SEQ ID NO: 175879 - protein, 113 aa, Glycine max
  Coding DNA Sequence Number=SeqID_59101
RIQGTNRLGILCPNTLEGTSFVAQVEGTSTWVVILRTRKGTSLVDQFNWRVHPLGCSKRTREGTSLMDLWLVKDFTRLKEISRTVGCLGTGCRHELLPNQYKSCDCLLLPYTF

SEQ ID NO: 175880 - protein, 62 aa, Glycine max
  Coding DNA Sequence Number=SeqID_59102
MVLTKGGHEVDIAFGLYFFSYKAKEWAGVRLDGLIPFKSLSMKVIGGRLHGDGRSTQLMSMS

SEQ ID NO: 175881 - protein, 61 aa, Glycine max
  Coding DNA Sequence Number=SeqID_59103
METSCSKIPTLPQIQLEEITQLLVSLGPKRCLGNTCIVEIEYRQSKMSHMRTYRLTYKVKV

SEQ ID NO: 175882 - protein, 296 aa, Glycine max
  Coding DNA Sequence Number=SeqID_59104
  Gene Ontology: Mol. function=oxidoreductase activity, acting on the CH-CH group of donors; Cellular component=mitochondrion; Biological process=electron transport
  Homolog annotation: Hit_ID=Q8G2B2; Match level="QueryCoverage=95%, HitCoverage=47%, E-value=1e-131, Identity=84%"; Hit description=Acyl- CoA dehydrogenase family protein
  Pfam annotation: Domain name=Acyl-CoA_dh_1; Domain location=1-163; Score=109.2; E_value=1.2e-29; Accession=PF00441.14; Description=Acyl- CoA dehydrogenase, C-terminal doma
  Pfam annotation: Domain name=Acyl-CoA_dh_2; Domain location=7-152; Score=2.9; E_value=0.0002; Accession=PF08028.2; Description=Acyl-CoA dehydrogenase, C-terminal doma
  Pfam module annotation: Pfam domain module=Acyl-CoA_dh_1::Acyl-CoA_dh_ 2; Domain location=1-163::7-152
MMNNARLLVGIQGVGVAEAAYQQALSYAKERKQGRAIGADPKQGMTPIIEHPDVSRMLLTMKALTQIARSITYSCAHAIDMSHATDGADQQFWSDRAGLLTPLAKSFATDAGVDVASLGVQIHGGMGFIEETGAAQLLRDARITPIYEGTNGIQAIDLVVRKLPLGQGEHIKGFLEELQADADKASASNRPELGETGARLSKAIAQAREATEWLQKAVADGQLEAALAGATPYQRLLSLVSGGAYLARAALAGDDSGRAVLSRFFAENMLAEVSSLKDTVITGAASLAAAKSALEA

SEQ ID NO: 175883 - protein, 142 aa, Glycine max
  Coding DNA Sequence Number=SeqID_59105
VETRGLARCWETVDAAPYSFPPMPERQHGMYYTPPAFTQESSQMLPMYSYPHDFQPGYSLAGIFGSSPPSTGTPSFTQSGELSTPNAPLGGPWNVPEDIPDMDDLLGVDLRHDFSVEADQVDERANRRRRNPDRAARNWDRP

SEQ ID NO: 175884 - protein, 82 aa, Glycine max
  Coding DNA Sequence Number=SeqID_59106
  Homolog annotation: Hit_ID=Q8P7E7; Match level="QueryCoverage=85%, HitCoverage=7%, E-value=1e-15, Identity=61%"; Hit description =Formate dehydrogenase related protein
  Subcellular localization annotation: CTP_CleavageSite=45; ConfidenceScore=5.23e-01
MAKRCAAARYAAPRAYAWSARARCCRRHSRRGWTASSIATNSTARCVNTTPGDCTLHNTVADMHIPIQYYSLPAQNRIAKTT

SEQ ID NO: 175885 - protein, 532 aa, Glycine max
  Coding DNA Sequence Number=SeqID_59107
  Gene Ontology: Mol. function=oxidoreductase activity; Cellular component=membrane; Biological process=electron transport
  Homolog annotation: Hit_ID=Q8P7E9; Match level="QueryCoverage=53%, HitCoverage=75%, E-value=2e-55, Identity=53%"; Hit description =Cytochrome D oxidase subunit A
  Pfam annotation: Domain name=Bac_Ubq_Cox; Domain location=1-296; Score=-49.6; E_value=4.4e-15; Accession=PF01654.8; Description =Bacterial Cytochrome Ubiquinol Oxidase
GGIIGPLMLYEVLIAFFLESALTGVMLFGIDRVKPGVHFAITCLVALGAIFSAFWILAANSWMQTPRGFTLNDAGQFTPDSAWSLISAPSFGWRLAHMLLASWISVAFLLGGVAAWRLLRNAGEAASRLMLRSALTVSLCILPLQIVVGDLHGENTRDYQPAKLAAIEGSWQPPAPGEGEPLRLFALPDQTQQRNHAELAIPAIVAARAASAGADVTGWLCCAAGGLGGDGGWPAAVDGIRHAAYRRQPGANVPRQQRRHFRVGGGDLRTEFCLWSGLSAAPPGGTAAGSAGDGGSGNHTDASLRRRRGDSAVQFRPATRAAVDGAQPAAASAVTNAEGAAVSLPAGAVFARAGAGVSRSAWRDRATLAGPAADGQLAAGGVSARLDERIDAGFASAQRDSGGRAGAGAGHAVVGGDAGLLYCRAAAGAGAVAAELAVLPGKSVAEPVACAVAAAVAHAVAGSDGGVIDDHVGTDGRGGRGAGVRALSVVAAVAAGDAPAGLLAGDAGVCGDGVIDCVAADAAVPQLGVLGV

SEQ ID NO: 175886 - protein, 640 aa, Glycine max
  Coding DNA Sequence Number=SeqID_59108
  Gene Ontology: Mol. function=iron ion transporter activity; Biological process=high affinity iron ion transport
  Homolog annotation: Hit_ID=Q8CZU9; Match level="QueryCoverage=49%, HitCoverage=93%, E-value=5e-91, Identity=50%"; Hit description =Putative solute-binding periplasmic protein of ABC transporter
  Pfam annotation: Domain name=Peripla_BP_2; Domain location=327-578; Score=-21.3; E_value=0.002; Accession=PF01497.9; Description =Periplasmic binding protein
  Pfam annotation: Domain name=TonB_dep_Rec; Domain location=73-290; Score=44.4; E_value=3.8e-10; Accession=PF00593.14; Description=TonB dependent receptor
  Pfam module annotation: Pfam domain module=Peripla_BP_2::TonB_dep _Rec; Domain location=327-578::73-290
MLAPITNSSSENSANANLLNRLHSRSVYAKDSISLTDDWIAVLGGRYQHYEQRASKGFNPVVQTLDSEGNKFLPQAGLIYKLTPDVSLYSSVSKSFTPSTDVDDDGNVGKPEQGTTWEVGSKWQISPRLFASVALYRIDERDMSLNINGTTRAINKARSSGAEFELNGEVLPGWDLSANYSYDKAEIVDDGVNPANKGNRLQNAPRHAGALYLSHNLTLNGIPGDFRVGGGARYVGSRAGDPENSFTLPDYVVADSFIAWNNQLFGEKTQLKLNLNNLPALNSDRAKKSLTWRAWLAALLLLAFSTSALARVITDIDGNRVEIPDSPQRIVLGESRMLYTLALLAPDDPFRHIVGWPRDLQKYDSQTWNSFAQRFPQMLNIPTLGSGGPQAINPEQILALRPDVVILPSLARYDDADLRLVSILNAAHIPVVKIDLRVHLLKNTRRSVEIFGEVLNQQARAAAFNRFYSAHLQVIEERLARYHGPKPTVLLQLHLGRRNECCVTAINWHEEQVIAAQPEYYFATGFGDNASAGLLRLGPDVAPDAVLSSFRQLTAQQNGLRELKAIRNGHAAAIWMNFYLSPWHIAVTEFMAKTLYPQLFADIDPQQTLETLFRDFLPIPYRGTLFMRIPAVDSSTQHKP

SEQ ID NO: 175887 - protein, 870 aa, Glycine max
  Coding DNA Sequence Number=SeqID_59109
  Homolog annotation: Hit_ID=Q35NC2; Match level="QueryCoverage=34%, HitCoverage=92%, E-value=1e-97, Identity=60%"; Hit description =Putative hydrolase
  Pfam annotation: Domain name=Abhydrolase_1; Domain location=71-301; Score=54.5; E_value=3.6e-13; Accession=PF00561.10; Description =alphabeta hydrolase fold
  Pfam annotation: Domain name=MFS_1; Domain location=524-840; Score =99.0; E_value=1.4e-26; Accession=PF07690.6; Description=Major Facilitator Superfamily
  Pfam annotation: Domain name=TetR_N; Domain location=325-371; Score =44.7; E_value=3.1e-10; Accession=PF00440.13; Description=Bacterial regulatory proteins, tetR family
  Pfam module annotation: Pfam domain module=Abhydrolase_1::MFS_1::TetR_ N; Domain location=71-301::524-840::325-371
MSLPALDAAPRWSQPVGHLPQFNHAYATVAGVRLHYVSGGNVQGPVLVLLAGFPQSWFAWRKVMAQLAADYFIIAPDLPGQGDSDKPASGYDTTSLAHSVQGLLQQLGVEHYYLAAHDVGAWVAWPLAMLHGDAIIKLALLDAGIPGVTLPDALPATPDKAWKTWHFAFHLLPDLPEALIAGREALYLQWFLQRKAASPMVFGDEEMAEYVRLLQQNGALRAGMAAYREVSTSAEQNRQLLQTRGKLAIPLLAVSADQGSIADMAQPLRTFAADVSGIRLAHCGHFIPDEQPQALADALRQFFGRAVMKNLTVIGRPREFELEEAARSAMHVFWDRGYEAASLPDLIAGTGLSRGSLYKAFGDKKGLLLAALDIYMTEGLKATSDILAQPGAVKTAIRASLLRYAALSSGEKGRRGCLVVSLTTEMAAHDEQIAERTGRMFRRLQQLYAATLVRGQLSGELPERDEQVLARLLVCQIEGMRILGKTGATEAEMNAVVDCTMRVVMSDPHALNPEPRRWAMFIVLLTGAFLPPLDFFIVNVALPSIQSDLATSGSAEQFVISSYAGFYAVTLITGGRLGDLFGRGRMFFVGLTGFAAASALCGFAWSPGALIAGRVLQGITAAIMAPQALASIQAIFPEAEKSRALSLYGAVFGLASVIGQALGGILISLNLFNSGWRAIFLVNLPVALLVVLFGIPLIKETRAQHARKLDFGGMGLSMMTLGLLIVPLIEGREAGWPLWAWLSLLLVPRAGAGAVPAAGAAVLLDWRILPAVLDLFTGRAASGRTERRADLSALWCGGRPAGPGVADGQHAGWDVTSGAAAGSGTVCGGVWPGAGAADADAHRHRTRGTRLGRDDCRYRQLHVATEHGAE

SEQ ID NO: 175888 - protein, 568 aa, Glycine max
  Coding DNA Sequence Number=SeqID_59110
  Gene Ontology: Mol. function=transcription factor activity; Biological process=regulation of transcription, DNA-dependent
  Homolog annotation: Hit_ID=Q09KH2; Match level="QueryCoverage=51%, HitCoverage=98%, E-value=3e-98, Identity=63%"; Hit description=FitR
  Pfam annotation: Domain name=HTH_6; Domain location=286-391; Score =3.1; E_value=0.0005; Accession=PF01418.8; Description=Helix-turn -helix domain, rpiR family
  Pfam annotation: Domain name=SIS; Domain location=409-546; Score =35.2; E_value=2.3e-07; Accession=PF01380.12; Description=SIS domain
  Pfam module annotation: Pfam domain module=HTH_6::SIS; Domain location=286-391::409-546
VFIAAEIAPVILILLFSNQAESKTVAERAGDVQRAGAAALAGCATADFGVPGVLRLFAHNIDHATGILDTVQQRSRALQYLDTFGGGVEIQPLAAAHAITIDGTIRVAAKAAAYKAIFGTCQRIAFAYAADKAQRVGEAGGLIILQLLLRHHAHRLGFIEARHRRFTGDRTAGGAIAVVTVLLLRRHGEGAVLFSGKAVSTAECRYAVNSGKDSRMAQTFAARHCYAISQQKKAAEIQARREWTAVAAQIFTTSRPADAVHNDAILLTGNIMAANNIKNRVDVFGERYRARVTTLSASLQTVARYIHEHREAILDATALDIAQATQTSDATVVRTVQALGFAGLRDLKTTLAAWFGPAQNSEEKMSATISELSCDINSGIDFVLGGHQRACEVLAEPVNRQAVAAAVTLLLEARQVALFGINASGILAEYSARLFRRIGLPAVTLNRAGIALAEQLITLQRGDVLIMMAQKSAHREGMTTLKEAQRLGMPVILLTHALDSAFAQQADVVINVPRGGENGRMPLHGTVLVCLEMLILAVASASSARTVKTMKRIQDLNRSLKPTSKKAG

SEQ ID NO: 175889 - protein, 1238 aa, Glycine max
  Coding DNA Sequence Number=SeqID_59111
  Gene Ontology: Mol. function=siderophore-iron transporter activity; Cellular component=outer membrane; Biological process=siderophore transport
  Homolog annotation: Hit_ID=Q93K73; Match level="QueryCoverage=50%, HitCoverage=94%, E-value=0.0, Identity=57%"; Hit description=IroN protein
  Pfam annotation: Domain name=BPD_transp_1; Domain location=1038-1225; Score=1.2; E_value=0.0061; Accession=PF00528.12; Description=Binding -protein-dependent transport s
  Pfam annotation: Domain name=SBP_bac_3; Domain location=756-986; Score=147.4; E_value=3.8e-41; Accession=PF00497.10; Description =Bacterial extracellular solute-binding proteins, family 3
  Pfam module annotation: Pfam domain module=BPD_transp_1::SBP_bac_3; Domain location=1038-1225::756-986
AARFVIGRCPGIFAINALVKQVVDTGVGAQVFSDVVVEVQSDNGIRADFTLRQTTAGLEAGFRILTWLLPAVLRPVDVGAERLGRLPLQLRVDGEFRDHRQRVAGFFALRAEHIGGIGAPLQRVGDQWDAQIAFQPFDDRLAAVFPAQQVIRAGDARDIALITELDAHFFIHADLGIEVFAAQQDIALSGLIQVGRFKGARNSGFQREVITEALRQVEARAPVSAKLIVIVEAQAGNHFGGVGGGDVVFEIERADGGAVFTVTLRTVAGNAAEIDARCAGGLYRCRIVKLIAIPLSTQRNGLIDQQLQREIDLAAGAIALQPACSVRIAVDHPFGAAAGAFFQAGVIGFLIAKVELRGAPVPDAVVHHSIVLAIQAVGFAAVQRFHQSVGAGIAVAVLRVAGINIALATVAIAEIDNLRRGDFPRQHAINVFVTHPFASGGVSAILRGIDVEGVGIRFVQVAVQPHGECLTGQRTAEVEVCAAGGAFLVIFWLVGEQRQRAVPVIGRAFGNDVDHTAGGTGAITGSGRTAYHLNAFHHFRWYPVGDRHAIDQHQSVFRAHAANVDLAVVTAAAAGAVTGEVNAGHFADDVREVVNGRTFFDVFSGNGGNSRLLLQLLLCRHNHRLIVGQLLRGFSGKHRGQHRCLDGNVMANKQIIQHGSISRMTILCAARLYATWAKGKIHRYLDAFSLPGNILNIRRKVPVKFAKGITLFALALSAHTAFAAEQSVPTDSSLHVQADAALKSLVPADVAKRGYIVAGTNPNTPPTTFYKEDNKTLAGREIDIMNAVGERLGIQVQWRDTGGFDNIIPGLKTGRYDVALSNINATPARAKIIDFVSYYDASRLGIISRKDANVAPFKTLDEVCGKEVGAGSGTTQVTRLEEASKACEAAGKKPIKVSVFPDRPAGVQAVVSGRVPMFLGPYEGLLWQVKVIKPLTMSGEITVHDAPVSVAFPKDSALEPAVQAALNSLIKDGSYQKILDNWGIGFGACAGGAVVRGGDGAFDDQQSALRMGRDCGKLHRRVDPAGRADDAAADRDFGGAGLRLWHGAGADAPVIQPGAGRRQLVLYLVFPRRADAGTAVPVVQHRGAVPDHFAVAAGAAVIALVMHQSAYAAEIVRAGIQSVGNGQLEAARALGYRPAQIFRHTVLPQAMRAIMPPAGNEIIGQLKTTAVVSVISLQDVLFSAQIIYQRTYEVIPLLLVATLCSTSSATLAVASRAVKSAVYLSRCPVSLRLKPKGA

SEQ ID NO: 175890 - protein, 465 aa, Glycine max
  Coding DNA Sequence Number=SeqID_59112
  Gene Ontology: Mol. function=pyridoxal phosphate binding; Cellular component=cytosol; Biological process=amino acid metabolic process
  Homolog annotation: Hit_ID=Q7N4R2; Match level="QueryCoverage=90%, HitCoverage=95%, E-value=1e-174, Identity=76%"; Hit description =Similar to beta-alanine--pyruvate transaminase
  Pfam annotation: Domain name=Aminotran_3; Domain location=62-416; Score=462.9; E_value=4e-136; Accession=PF00202.11; Description =Aminotransferase class-III
  Subcellular localization annotation: CTP_CleavageSite=26; ConfidenceScore=5.18e-01
MAERVIPSRLSAAEKLPHSLTVLKTRSSLRSKSVTWASVFFFIQAHWMPFTANRYFQQDPRFIVAAHGHWLTDGDGRQIFDSLSGLWTCGAGHTRREIQQAVAQQLGTLDYSPGFQYGHPLSFQLAERIASLMPGHLNHVFFTGSGSESADTAVKMARAWWRAKGQPNKTRLIGRARGYHGVNIGGTSLGGIGGNRKAFGQLLEVDHLPHTLQPELAFTPGQPATGGEALADEMLKLIELHDASTIAALIVEPLSGSAGAIIPPHGYLQRLREICTQHDILLIFDEVITGFGRMGRWSGAEYFGVTPDLLNFAKQITNGAIPLGGVVASSEIYHTFMSQPLPQHAVEFAHGYTYSAHPVACAAALATLDVLENEALISQSAELAPHFERALHGLRDCPQVVDIRNCGLVGAIQLASREGDATVRPLKRAWRCGKPAFTSALAAIRCSSARCLIPSRPNWTGCLMR

SEQ ID NO: 175891 - protein, 278 aa, Glycine max
  Coding DNA Sequence Number=SeqID_59113
  Homolog annotation: Hit_ID=Q1SS26; Match level="QueryCoverage=65%, HitCoverage=22%, E-value=3e-07, Identity=22%"; Hit description =Unnamed protein product; no similarity, hypothetical start
MEFFSAESFDCIQAFQNLGLIPFMSLQLPVYPELVKAFYCNLEIQERTLISEVFGIKMVIDQSLFHNLTQLSSDGVPFEGTMNDDWKFDFSAHDARQLVCTNHADMTGRLLAGSLAFESRILHYLIVRILLPRSSNLAQVSEEDLVIMWAFHTGRQLDWAHLVRYRMHKALRLNAPFPYPHLVTLFLCHFQIPLDFEPYVPIKRSFLIGAAVIASLVTAKSMMALGSKRTFVGDKFDAMELQVDMRFDAMESRITKVEEDVSFIRTCFDPPPPPPSSS

SEQ ID NO: 175892 - protein, 355 aa, Glycine max
  Coding DNA Sequence Number=SeqID_59114
  Gene Ontology: Mol. function=transferase activity, transferring acyl groups, acyl groups converted into alkyl on transfer; Cellular component=mitochondrion; Biological process=carboxylic acid metabolic process
  Homolog annotation: Hit_ID=Q6N0U6; Match level="QueryCoverage=99%, HitCoverage=64%, E-value=1e-134, Identity=66%"; Hit description=2 -isopropylmalate synthase
  Pfam annotation: Domain name=HMGL-like; Domain location=39-317; Score= 309.2; E_value=7.7e-90; Accession=PF00682.9; Description=HMGL-like
MLTQPADKYRPWPVINLADRQWPSRHITRTPRWLSTDLRDGNQALATPMDSARKLAFWQLLLRCGFKEIEVAFPAASQTDFDFVRLLIEQQHIPHDVTIQVLTQARGDLIDRTFAALRDAPQAIIHLYNATAPLFRERVFRQSKAEIVELACAAARQIRARCAAQPATRWTFQYSPETFCFTEPEFALEICEAVAAIWQPGPQRPMIINLPATVEVNTPNVYADQIEYFCRHFSQRSQVAISVHPHNDRGTGIACAELALLAGADRVEGCLFGNGERTGNVDLVTLALNLYTQGVTPELDFSDMREVLEVVTRCNQLPVHPRHPYAGELVFTAFSGSHQDAIRKGFAERSARNEV

SEQ ID NO: 175893 - protein, 222 aa, Glycine max
  Coding DNA Sequence Number=SeqID_59115
  Homolog annotation: Hit_ID=Q1RYE3; Match level="QueryCoverage=53%, HitCoverage=13%, E-value=5e-35, Identity=65%"; Hit description=IMP dehydrogenase/GMP reductase
  Pfam annotation: Domain name=DUF827; Domain location=6-218; Score =57.1; E_value=8.8e-15; Accession=PF05701.2; Description=Plant protein of unknown function (DUF827)
MVLVEFGGTKAQLEVAKARYTGVVSDLIAVKEELETLHKEYASLVTDRDVAIKKAEEVVTTSKEVEKFIGDYTCCTFGSRGKKNRNIHGKRSRFSELGEIKTHTDIQEAVASAGKELEEVNLNIEKATVEINILKVAATSLKLELEQQKATLASIRQREGMASVVVASLEAELENTRSEIGLVQMKEKDAKEKMIELPKKLQLTTEETNQANLLAQAAREEL

SEQ ID NO: 175894 - protein, 109 aa, Glycine max
  Coding DNA Sequence Number=SeqID_59116
MDKFDIFVNHPLVITSLLPLESECKPLVCLRKRPALLSLDFQDRSIRNYSCYIFGEGAVKRRFLPCYKVITKDKVDTSKPYTGAMRGTVHKPRANLGEDQKFSPVDVFK

SEQ ID NO: 175895 - protein, 70 aa, Glycine max
  Coding DNA Sequence Number=SeqID_59117
MSKIRRFEGLGIEERHKGEEVAQGFLKMWGRQPTGNQLHEDCNRLQAIRSSVIDYSIHVIDYQNKTIAFS

SEQ ID NO: 175896 - protein, 58 aa, Glycine max
  Coding DNA Sequence Number=SeqID_59118
  Subcellular localization annotation: CTP_CleavageSite=43; ConfidenceScore=5.49e-01
MAILSFAKNKFPKFLSLSNTATPSAPVANSQTLITVHSKTPTESVAKQSLKIVAKQGT

SEQ ID NO: 175897 - protein, 134 aa, Glycine max
  Coding DNA Sequence Number=SeqID_59119
MEVVKGVVIKLLDASIIYPISNNPWALVSHVQLVLKKGDTIVMENEKQELIAIRKTIRNAEHKGRVVPVWFRLCKGFLQREWKISSGLLEYWTSNKGYKVGFELGNVKVYGKGMHFFGHKVLEIGGQHGEQPKG

SEQ ID NO: 175898 - protein, 233 aa, Glycine max
  Coding DNA Sequence Number=SeqID_59120
  Gene Ontology: Mol. function=transporter activity; Cellular component= integral to membrane; Biological process=transport
  Homolog annotation: Hit_ID=Q62KT2; Match level="QueryCoverage=98%, HitCoverage=53%, E-value=6e-95, Identity=72%"; Hit description=Major facilitator family transporter
  Pfam annotation: Domain name=MFS_1; Domain location=4-229; Score =53.9; E_value=5.4e-13; Accession=PF07690.6; Description=Major Facilitator Superfamily
MPIVFITYSLAYLDRANFSFASAAGINEDLGITKGMSSLLGALFFLGYFFFQIPGAIYAERRSVKKLIFWCLILWGGCASLTGVVSNIPMLAAIRFILGVVEAAVMPAMLIYISNWFTKSERSRANTFLILGNPVTVLWMSVVSGYLIHAFGWREMFIIEGIPAVIWAFCWWVLAKDKPAQAGWLSADEKQALQQQLDEEQKGIKAVRNYGEAFRSRNVILLCVQYFAWKHRR

SEQ ID NO: 175899 - protein, 37 aa, Glycine max
  Coding DNA Sequence Number=SeqID_59121
MKPLQGTTQTLARGSQRLRGAKSEIGDKLGDQKCNFA

SEQ ID NO: 175900 - protein, 1027 aa, Glycine max
  Coding DNA Sequence Number=SeqID_59122
  Gene Ontology: Cellular component=cytosol
  Homolog annotation: Hit_ID=Q10JI7; Match level="QueryCoverage=96%, HitCoverage=99%, E-value=2e-51, Identity=25%"; Hit description =Expressed protein
MSKKVLTSMKDENPDLQKQIGCISGFFQLFDRHSFLTGQSNSSHNQNIPTNKGGISNRIKEVNNTTHKATAKNVKLTRENQQFSTESSGTSVTSSSRSSSMSSLEFNRTIQIEPPSISQMKIPENTNSEAAMKQGNQGHQPLDFYDIVKDSMHRDVHGLSVKTVAKEERKGRILKYMDSPRPLEPSKSVNTGVTVAWDSPRLSYDGRDTQDTFKSATKPKELPRLSLDSRQGSIKSFNEGTKSRILLKGSQKGYGSSRTMQLQEPETSRRPSGVVAKLMGLEAFPDCTETSDTPSQMSSCTTNKNETIAGPSTNDEYKQHQSAASSQGTIKGSSLLQFRRDASILNVTPYSRFSLEPIPWRQPEASQGSQLQDSKRSESSAKASNLTISVYGEIEKRIADLEFKNSGKDLRALKQILDAMQRYKESLDIPRDQVSNSLSDNRSSSSLSESSIVKSPRIRQKDPTFTVVEMSNSTQGSKSPIFIMKPAKAARKTNSPASTEMSFQGKSSLGKFSSANCANGIMGGKLDGQTAKGIGPAIRHAKDSISQPLHSVDKSNKMRTSKLMQSSKVRQVINGENATNSSNTAEAKSPRLQKKFGLERRSRPTSPSSDLSSNRRQHNRQSGELSSSSTTPRQKFSEISNQRRDFRHEVVVEVIHTVHSDRINGNSTQLKGMNQNNAAEELSKESFMAEKTITAEQPSPVSVLDASFYREEPPSPVKKKSDMSKDLDDALNTYDSSEENSENLQLSSSTAKAKFGSEISDTDLRTQKLVRILQQIDYNDERFTNFRDDKDPNHKYISEILLASGLLSSQSSSQVFHSSSYPINPNLFLALEQIKTNMTCFNIECNAKKIAALNSPEQIQRKLIFDVVNDILAQKIILESFTLWCQPNQPAGRKLRGQLLLDELCTEIDKLQHKNTNANLNDEDENLTSLLWEELMHCPTIYTNSYSEIPNVVLDIERLIFKDLITEVVRSGLANHSVYAEEIHAEMQINVYINDMISLSSTTGSAPPEVLNASILDLFLPSIEYFW

SEQ ID NO: 175901 - protein, 137 aa, Glycine max
  Coding DNA Sequence Number=SeqID_59123
  Homolog annotation: Hit_ID=P0A1Z6; Match level="QueryCoverage=44%, HitCoverage=96%, E-value=2e-17, Identity=58%"; Hit description =Bacterioferritin-associated ferredoxin
EAHAQLRYLFVKRHVLHFIIHNFARHANTLAALLADRHQLAQLLNRFGLITADNFTQGSVAYGITQTDACRSMQSKKKEHRSALFHAAVATEVTTVINAIKRELQQQRPRQRYGRLRGLRNADPGPSRLGGSAQRSF

SEQ ID NO: 175902 - protein, 91 aa, Glycine max
  Coding DNA Sequence Number=SeqID_59124
MGERKRKRKEGKKAPDQGSKENRRNVQRGLWTGQYLNNTELSPNETKKKGNHDLKWSSPFNYQPKSRNNLQSQVMTYLWFGIRMKHLPVQD

SEQ ID NO: 175903 - protein, 73 aa, Glycine max
  Coding DNA Sequence Number=SeqID_59125
DRTLAFLHRLGLALMMGRLVVLLPPYLIKGLSSRLEDQDANYMLIKSKMESFSGHPHLNSLEKKANCLLAGSE

SEQ ID NO: 175904 - protein, 245 aa, Glycine max
  Coding DNA Sequence Number=SeqID_59126
  Gene Ontology: Mol. function=nucleoside-triphosphatase activity; Cellular component=membrane; Biological process=ion transport
  Homolog annotation: Hit_ID=Q63AS5; Match level="QueryCoverage=99%, HitCoverage=79%, E-value=5e-43, Identity=38%"; Hit description=ABC transporter, ATP-binding protein
  Pfam annotation: Domain name=ABC_tran; Domain location=1-162; Score =85.2; E_value=2e-22; Accession=PF00005.17; Description=ABC transporter
MKLMLGSIPDENNTIEIFSQKLPELYPDGFQRIGSLIDSPAFYDHLSGWDNLTILSKLRNLPDSECERVLNLVDLWDSRKMKMKKYSLGMKQRLAIAMTLLGNPELLILDEPVNGLDPNGMLEIRELLLKLNKEQGITIFISSHLLQEVEKMVTHLAIISHGAIKFSGSVEELNTHYRHNHMRIGLNNAPQFLQHIPEYYAPQIIDDHTLEITVQSREDIIRLTKKLVVNEAEIFEIQNSAGLED

SEQ ID NO: 175905 - protein, 166 aa, Glycine max
  Coding DNA Sequence Number=SeqID_59127
MPPTKHYLDLDKSNRALGFPALITGLYQSFEVPVTPSKVIRPPITRAFIEKYCTPRQAQGDAPQALDALPPPHQADPAGSFGMEQYLQHLVRQQAANHKGQVQSQGFIPFACPTPDQFRAEVAWPGDWPEAQAGEAPAEDPNDAEEAGMDEEMSDLLGFLGGSGAT

SEQ ID NO: 175906 - protein, 54 aa, Glycine max
  Coding DNA Sequence Number=SeqID_59128
MDFEICQIVQQKAVKFVQQNFSTCAENACALLVMGKLGGVDRDPVMRGTRIRVT

SEQ ID NO: 175907 - protein, 148 aa, Glycine max
  Coding DNA Sequence Number=SeqID_59129
  Gene Ontology: Mol. function=protein binding; Cellular component =integral to membrane; Biological process=defense response to fungus
  Homolog annotation: Hit_ID=Q1ST34; Match level="QueryCoverage=92%, HitCoverage=38%, E-value=3e-22, Identity=38%"; Hit description =Leucine-rich repeat
  Pfam annotation: Domain name=LRR_1; Domain location=105-133; Score =13.3; E_value=0.88; Accession=PF00560.23; Description=Leucine Rich Repeat
  Pfam annotation: Domain name=LRR_1; Domain location=27-49; Score =11.8; E_value=1.8; Accession=PF00560.23; Description=Leucine Rich Repeat
  Pfam annotation: Domain name=LRR_1; Domain location=3-25; Score=17.6; E_value=0.046; Accession=PF00560.23; Description=Leucine Rich Repeat
  Pfam annotation: Domain name=LRR_1; Domain location=56-78; Score=8.7; E_value=6.7; Accession=PF00560.23; Description=Leucine Rich Repeat
  Pfam annotation: Domain name=LRR_1; Domain location=80-103; Score =13.4; E_value=0.81; Accession=PF00560.23; Description=Leucine Rich Repeat
  Pfam module annotation: Pfam domain module=LRR_1::LRR_1::LRR_1::LRR _1::LRR_1; Domain location=105-133::27-49::3-25::56-78::80-103
MNSLEILHLSSNKLQGEIPSFFGNMCALQRLDLSNNKLNGEFSSFFRNSSWCNRHIFKSLDLSYNRLTGMLPKSIGLLSELEDLNLAGNSLEGDVTESHLSNFSKLEYLDLSGNSLSLKFVPSWVPPFQLEYLRIRGIKLRMLSLPCF

SEQ ID NO: 175908 - protein, 214 aa, Glycine max
  Coding DNA Sequence Number=SeqID_59130
  Gene Ontology: Mol. function=DNA binding
  Homolog annotation: Hit_ID=Q1RUD8; Match level="QueryCoverage=93%, HitCoverage=46%, E-value=9e-21, Identity=31%"; Hit description=IMP dehydrogenase/GMP reductase
MGSSQAPSLKKRLYQVKVKSLGITSLKELGQLMGQLQRQAFRKAYSKIWDLAMAEISTEAIASLAQYYDRPLRCFTFGDFQLSPMVEEFEEILGCPLGGRKPYLFSGFYPSLARISKIAKARILAGRGEWAPFIDILTLLIFRGVLFPNVDGLVDLAVIDTFLAFHDRKESPVVAILADLYDTFDRRCEKSSTRIVCCTPALYVWLVSHLFRQE

SEQ ID NO: 175909 - protein, 281 aa, Glycine max
  Coding DNA Sequence Number=SeqID_59131
  Gene Ontology: Mol. function=nucleic acid binding; Cellular component= integral to membrane; Biological process=protein amino acid phosphorylation
  Homolog annotation: Hit_ID=Q9FNZ2; Match level="QueryCoverage=97%, HitCoverage=62%, E-value=3e-65, Identity=43%"; Hit description=Zfwd1 protein
  Pfam annotation: Domain name=WD40; Domain location=124-162; Score =31.8; E_value=2.4e-06; Accession=PF00400.22; Description=WD domain, G-beta repeat
  Pfam annotation: Domain name=WD40; Domain location=203-239; Score =8.9; E_value=3.3; Accession=PF00400.22; Description=WD domain, G -beta repeat
  Pfam annotation: Domain name=WD40; Domain location=248-279; Score =6.8; E_value=5.9; Accession=PF00400.22; Description=WD domain, G -beta repeat
  Pfam annotation: Domain name=zf-CCCH; Domain location=12-36; Score =11.7; E_value=0.038; Accession=PF00642.15; Description=Zinc finger C- x8-C-x5-C-x3-H type (and similar)
  Pfam module annotation: Pfam domain module=WD40::WD40::WD40::zf-CCCH; Domain location=124-162::203-239::248-279::12-36
MDTKFARRTERIGRTTCSYWRAGKCNRNPCRFVHIETPSPPAACGYGNTAYSYGKIPHSSSENTPKYGSKKVLLRDNGDRGDAIRVAKAFKKSSPRICKYWINNNCVHGEQCMYLYSWFRGDGFSTVTKLQEHKKVITGIALPVGSDKLYSGSTDGTVRIWDCHTGQCAKVINLGAEVTSLISEGSWIFVGLQNAVKAWNIQTMSEFTLDGPKGRVRAMTVGNNTLFAGAEDGVIFAWRGSSKADSPFELVASLTGHTKAVVCLAVGCKMLYSGSMDQSIK

SEQ ID NO: 175910 - protein, 120 aa, Glycine max
  Coding DNA Sequence Number=SeqID_59132
  Subcellular localization annotation: CTP_CleavageSite=36; ConfidenceScore=5.09e-01
MTFLGETSSQTVVNSTLGFIFPNGSIVHNDNGVSFQASTPVPIRVPNGCDFQTLKTRIHNTFKLIDKQFLDEIYYRQPFTYAGKNPKNIDIPTGCTMDELKDLIKQVVPRGIPPYGVDET

SEQ ID NO: 175911 - protein, 76 aa, Glycine max
  Coding DNA Sequence Number=SeqID_59133
MKKKEELVWVGFQRFLGGGSQQWWWWRKTLFASSMTMPFEDVVADFDRLGKVLCRHTKRENKGSMKMQIFIDREAL

SEQ ID NO: 175912 - protein, 263 aa, Glycine max
  Coding DNA Sequence Number=SeqID_59134
  Gene Ontology: Mol. function=ATPase activity, coupled to transmembrane movement of substances; Cellular component=integral to membrane; Biological process=transport
  Homolog annotation: Hit_ID=Q4QMQ4; Match level="QueryCoverage=44%, HitCoverage=20%, E-value=5e-46, Identity=83%"; Hit description =Hypothetical ABC transporter, ATP-binding protein
  Pfam annotation: Domain name=ABC_tran; Domain location=46-170; Score =33.9; E_value=1.7e-10; Accession=PF00005.17; Description=ABC transporter
  Subcellular localization annotation: CTP_CleavageSite=50; ConfidenceScore=5.57e-01
TSALASVAVTLRVTTTPAALNAPLQGASHSPFRLSNCWEGRSVRASSILRQQAKEGCAAWRLSRGELELHRGGGRSRTSGSPGLQEFDPLLSRGANLSGGQIQRLSLARALLHNAELYIFDEATSNIDVESEEIILQFIQQFKQQKTIVMISHRLANAVNADCINVLEQGKLIEQGTHKDLMAKQGAYAEMFQQQKDLEQIREVANDQAYRYRRPRGGARYQLLFPLVRVNFELGVIMVIAVSCVKLLSAHNSTQHTSRKHKV

SEQ ID NO: 175913 - protein, 409 aa, Glycine max
  Coding DNA Sequence Number=SeqID_59135
  Gene Ontology: Mol. function=transporter activity; Cellular component= membrane; Biological process=transport
  Homolog annotation: Hit_ID=Q13Y39; Match level="QueryCoverage=92%, HitCoverage=76%, E-value=1e-106, Identity=53%"; Hit description=RND efflux system, outer membrane lipoprotein, NodT family
  Pfam annotation: Domain name=OEP; Domain location=79-269; Score=76.7; E_value=7.1e-20; Accession=PF02321.8; Description=Outer membrane efflux protein
MSLRLPTPAWRLATLPLLLALGACAFAPDSKPPAMAQPAQYGVEALPAAGAPAQGVAQRYAREGRPVPEWWKRFGSDALNAMVEEGLANSPDLAAAERNLAGAREQLRGQVNSSLLPSVDAGADVSRKRALTMPNLPQPTALYNVFTGQVQAKYDLDLFGAARFENVSRAAQVEQQAYQLESARRSLAGNIVTGAITSASLAERVALTEKQVVLARQVARDTQRRYELGSASQNDALQADQDAATLEASLPGLRAQWQATRHALAVLMGRSPDQAPPDLAFAMIAVPEEVPVLVPSELLAARPDIHVAEAVLRAAAADVGVATAQLFPSLSLSASMGKGGFSWPTALSGAGSIWAIGASLTQPIFHGGALLAERSAAKERYEAAVLQYKQTVLTAFRDVADTLAQLEAD

SEQ ID NO: 175914 - protein, 141 aa, Glycine max
  Coding DNA Sequence Number=SeqID_59136
MVVLDMTWNMAFIVVWAVMLAYTVKDNPNMPIHWWIYNYHKRNDAHRDKEFATNLQYDDVNDSDKDDVGTSESSSSSRKTRRLLSPSSMSTSCSHTRIACNCPCATSSRLYVDVILTMSGFLDTGHRVWMTLLPGREDKSG

SEQ ID NO: 175915 - protein, 147 aa, Glycine max
  Coding DNA Sequence Number=SeqID_59137
MAQLISDVIYCLRGSRPQDTQWTRRSPTGPWGFQLWLRASELHPQRHPVDPEKSNRAQGFPALVTGLCSPTGCLFPPARSRHHDIGIAPARHLVDPKKVPVTSNKGIRPPTNRAFIKKYCVPRQTQGETPQQPGMAGSRQQTHRHHL

SEQ ID NO: 175916 - protein, 51 aa, Glycine max
  Coding DNA Sequence Number=SeqID_59138
SLPKDVDISGKGVDDHIGLCLSIGLGVFEWRGTDNSKVSPHATGLLGHDSK

SEQ ID NO: 175917 - protein, 274 aa, Glycine max
  Coding DNA Sequence Number=SeqID_59139
  Gene Ontology: Cellular component=integral to membrane
  Homolog annotation: Hit_ID=Q11ME3; Match level="QueryCoverage=89%, HitCoverage=93%, E-value=2e-73, Identity=57%"; Hit description =Hypothetical protein precursor
MRGLTLSSALIFLLMTGSALAQVDSSGNGNTVPQLQNPADETIEIGLSTETIAITSNFGGTDLTIFGALDNADPTIQRQGRYDIIVVLQGPSRDLVVRKKDRYLGVWVNAVSETFMGVPLSYSLASTRNLQDITDEKTYRQLSVGVRNFYLVPEDPASLSGNIPRFGNELREMKIRQGLYTQRIGGVEFISRTLFRATLNLPANVPVGRHKARALLFRNGVFLREANASLEIVKAGFEQSIYNAAHQNSFLYGLFAVFLAVFTGWFGRILFRRD

SEQ ID NO: 175918 - protein, 84 aa, Glycine max
  Coding DNA Sequence Number=SeqID_59140
MRWGMGHGGIISSRRRIGRAKLGKCRLPVSVAMFWAAPNKIPIFCQKFIRVFHPSCSPQTGQMASAFSCHINRDATLRAQAQVN

SEQ ID NO: 175919 - protein, 296 aa, Glycine max
  Coding DNA Sequence Number=SeqID_59141
AGQQSKVVAVAAAAAAAAEAALQEQSGARTTIAAATTKTSKKTCKKEREENGYMPVHCTSTHIHQQQQQQKNNNATFICVLIMTTQGKCCGRLWGEWQAPKSQWSRFHVAISKSSLIHTCTHAHTAEAQLQDMYVYVHSKKSSVAVVVAAHSPHISNATPRNGDVGHIPYRAMQQPQRYIPSVSDLYGTDEIELLLDEIRELELEPVCCQLDDEQDFEIAGSRAGELSLSLESPLGTCTSWDSHANYKQRNGHTPLPWGVALHCDPQHLKSPTGIVRILLVLNCVQECVTFLPVMT

SEQ ID NO: 175920 - protein, 85 aa, Glycine max
  Coding DNA Sequence Number=SeqID_59142
MEKLKDLIKQVTPTGVPPNGIHGSQLVRRLFFRQPGHSKYSENLIEYDITELKNDEDVLKVLAQSNYWKRFCTIEILAIFSKPVI

SEQ ID NO: 175921 - protein, 86 aa, Glycine max
  Coding DNA Sequence Number=SeqID_59143
MASSNFPFPEEILSIGSYVQWAHEIQLSYLQKNNEKSDKRNFKEKKERKGYITWEDNVINASSDSENKIISLGIMMKDYENGEEQS

SEQ ID NO: 175922 - protein, 104 aa, Glycine max
  Coding DNA Sequence Number=SeqID_59144
  Homolog annotation: Hit_ID=Q1T493; Match level="QueryCoverage=88%, HitCoverage=17%, E-value=1e-10, Identity=35%"; Hit description =Nucleic acid-binding, OB-fold, subgroup
GDQIHAICKSDHLKSWKADLKENCTYVMHNFKVVKNDGQFRVCEHEYKLFFIGVTVVREANLHELPFKEFRFVEFANVVAGNFVSGLLVGGLSACFIEKYQGCF

SEQ ID NO: 175923 - protein, 85 aa, Glycine max
  Coding DNA Sequence Number=SeqID_59145
MGEEVLVYNSLLDLFHRNLQSSWGNPFELNKVFPYGELELKKSNGHTFKRNAYLVKAYKEGLQQAKTQCSAGHNRYQLQHKAMIS

SEQ ID NO: 175924 - protein, 81 aa, Glycine max
  Coding DNA Sequence Number=SeqID_59146
MVDPSLDHFDLRCGQIHLSHDQVHHGLDEFDQSYGDSHPSLGHSTTAWILPHGWGRHIQRLWKASKNNMTHSRVLDQVASE

SEQ ID NO: 175925 - protein, 174 aa, Glycine max
  Coding DNA Sequence Number=SeqID_59147
  Homolog annotation: Hit_ID=Q94FN2; Match level="QueryCoverage=38%, HitCoverage=4%, E-value=3e-18, Identity=53%"; Hit description =Microtubule organization 1 protein
  Pfam annotation: Domain name=NAM; Domain location=134-174; Score= -53.0; E_value=0.015; Accession=PF02365.6; Description=No apical meristem (NAM) protein
MEKAIKNKVAKAVVPAIDVMFQALRSEQDKEPEQEAVLEVVGPGPSEESGNDATKWSERKEAVVDLTKLASTKRISPGDFSEVCRTLKKVDQSLGENMMNYKHLPPAGEILRLLFYVLASPIAALLYYFIFALFHPPDEELVAYYLKRQINGRKIELEIISEVDLYKCEPWDLP

SEQ ID NO: 175926 - protein, 82 aa, Glycine max
  Coding DNA Sequence Number=SeqID_59148
MLVPHDHTTEIWECGHMDVNIGTGKVKWLAYDKVAYKLLGVFVQLDFLDMGCADDKIFLFEIPCRIVRFYAPGNPLCVESAL

SEQ ID NO: 175927 - protein, 1073 aa, Glycine max
  Coding DNA Sequence Number=SeqID_59149
  Gene Ontology: Mol. function=DNA binding; Cellular component=beta -galactosidase complex; Biological process=DNA integration
  Homolog annotation: Hit_ID=Q1SS72; Match level="QueryCoverage=99%, HitCoverage=75%, E-value=0.0, Identity=43%"; Hit description =Integrase, catalytic region
  Pfam annotation: Domain name=rve; Domain location=580-740; Score =155.7; E_value=1.2e-43; Accession=PF00665.16; Description=Integrase core domain
  Pfam annotation: Domain name=zf-CCHC; Domain location=247-264; Score =13.2; E_value=0.0066; Accession=PF00098.13; Description=Zinc knuckle
  Pfam annotation: Domain name=zf-CCHC; Domain location=284-301; Score =9.3; E_value=0.029; Accession=PF00098.13; Description=Zinc knuckle
  Pfam module annotation: Pfam domain module=RVT_2::rve::zf-CCHC::zf -CCHC; Domain location=934-1073::580-740::247-264::284-301
MNKSTPNIESYLYLHPSENPVVALVSPVLDSSNYHSWSRSMVTALSAKNKVEFINGNAPEPLRTDRTYSAWSRCNNMVVSWIVHSVSVAIRQSILWMNRAEEIWNDLKSRYAQGDLLRISDLQQEASSMKQGTLSVTEYFTKLRIIWDEIENFRPDPTCSCTIKCTCSVLTIIAQQKLEDRAMQFLRRLNEQYSNVRSHVLLMEPMPTIPKIFSYVAQQERKLSGINSFSNLSLESKENISINVVKVTCEFCGRIGHTESVCYKKHGVPTSYEGRRKTYNRNGKMCTHCGKIGHTIDVCYKKHGYPPGYKFGNSKVVNNIMEGKAASDQMQRQESHDLVRFSPEQYQALLALIQQPSSGSSIPTQPQVASISSCSTNTSPGMILSLKTTDSTSWILDLGATDHVSSSLANFHSYHQVNPIMVKLPNGHEVHATHSGTVHLTSSIILNDVLYIPSFSFNLISISKLISTNNYELIFSSNTCVLQDTNTKAKIGTIEVSHGLYQFTIKPSHSRTICSTIIHPKCNVIPIDLWHFHMGHPSIERLQVMQPYYPSLHNNNKNFVCNTCHYAKHKRSSFSSSTSHALSIFYLIHIDIWGPCSKVSMHGHRYFLTIVDDHSRFTWVYLMKTKAETRELIITFVTYVQTQFNKTIKIIRSDNGAEFLMNDFYAQRGIIHQTTCIETPEQNGIVERKHQHLLHVTRSLLFQANLPLNFWCFALLHATYLINCIPTPFLHNKSPYEQLYTRPCDILNLWVFGCLCYISTLKSHRQKLDHRAHPCIFIGFKPNTKGYLVYDLHSHSITTSRNVVFYEDHFPLFPDTLESSPTSTSISHLQFSNNPDSLEHPTPPNDNLSSPHIPSPSLRHSTRLKKAPTYLQDYHHALTSQANTNMHGVRYPLHSVLSYSRLSPSHKHFVMSISVHTEPKSYNEASQFGCWIKAMQAEIQALQQNQTWTLTPLPPHKTTIGCRWVYKIKYKADGTVERYKEHLVAKGYTQLEGLDFLDTFSPVAKLTTVRMLLALAALHNWHLRQLDVNNAFLHGDLDEEVYMTLPPGLHVHDRNLVCRLQRSLYGLKQASRQ

SEQ ID NO: 175928 - protein, 66 aa, Glycine max
  Coding DNA Sequence Number=SeqID_59150
MMTGEIHDNNDGGDPITTVRSNHDNDRGVPITMTMMDENQSRRRQERSNHNDDGRHLITTTMMEEI

SEQ ID NO: 175929 - protein, 87 aa, Glycine max
  Coding DNA Sequence Number=SeqID_59151
RYKGDSDDNNEVDRIGLVVIEIGQKLTIKSILRYLSGTITHGLLLQPAHMDAKISLQYSMMGWFLDQGAEVLDKDHEKHRETAVWDY

SEQ ID NO: 175930 - protein, 101 aa, Glycine max
  Coding DNA Sequence Number=SeqID_59152
MTKWFYGIMGATTWCKEVFSMRVLAGSGGYAVDLFIKVVIAEFTCILALGGSIVGIIAGAIKGHTRGAGFLDGACKGAVTGAIAALELLNIAAYDEPLSKV

SEQ ID NO: 175931 - protein, 99 aa, Glycine max
  Coding DNA Sequence Number=SeqID_59153
MASSATEEQISLKVLVDEKKNRVVYAEAGKDFVDILLSFLFLKLALGTIARVVGKELNMNKRKKHFWTNTCKEMLLQSRNSTESYCQNLKLNIDDTEIV

SEQ ID NO: 175932 - protein, 126 aa, Glycine max
  Coding DNA Sequence Number=SeqID_59154
  Gene Ontology: Mol. function=hydrolase activity
  Homolog annotation: Hit_ID=Q94B74; Match level="QueryCoverage=48%, HitCoverage=22%, E-value=3e-13, Identity=58%"; Hit description=Nudix hydrolase 2
GIDCVKMDLSIKILPATNDVHGGVIVDLKEPMDSKDFATLLRSSLLHWKQQGKDGVWIKLPIELVNLAEIAVKELTSERKKSHGEGVIARDAAERERERACDGIGEGCCVMLEGRIMYEMKVVYTC

SEQ ID NO: 175933 - protein, 126 aa, Glycine max
  Coding DNA Sequence Number=SeqID_59155
MNITTTLSSLYKCRKALSANNKKARLRPSGPGDLFESIWKRTILNSSIAKGARRETLSLDERFSFPSYPGILVAFHWKIMEVIVRDGFTKASDKPSGMIMNSHFFIDGNEVTEVIKDTPRERGKLR

SEQ ID NO: 175934 - protein, 255 aa, Glycine max
  Coding DNA Sequence Number=SeqID_59156
  Gene Ontology: Mol. function=nucleotidyltransferase activity; Cellular component=intracellular; Biological process=regulation of growth rate
  Homolog annotation: Hit_ID=Q84LH3; Match level="QueryCoverage=60%, HitCoverage=53%, E-value=6e-17, Identity=33%"; Hit description =Werner Syndrome-like exonuclease
MTPKQLSPNAVANNHIKHSDAKKEITKLRNQNASSNLTGDKGINSRVLNLFMSEEAIVPEARGDVVGLVNVDAQEEAAQCGEPGRAQPKHLELLLGEGAKVDGIGHVEIVVSQKLLGVVSDADPNEFDVAVGEEGGEGAWDKGRVEDLKDEAVVVDAELEGGDGVGLLTVGLGVGPPLNVQAHDLEVVVGVAGVGGEPDTDLAGRSGYEGLDGVGAHFHFVAFVVVVADAVFSYQSWRNRISTEPVEFGILIECG

SEQ ID NO: 175935 - protein, 67 aa, Glycine max
  Coding DNA Sequence Number=SeqID_59157
MEDLEDEAMMVHAELEGDEEVAPYPSLGGESIVVGVVEGVASRANWHAVFFYGRCHRCGLETILRKK

SEQ ID NO: 175936 - protein, 276 aa, Glycine max
  Coding DNA Sequence Number=SeqID_59158
MERIPDKIKTIDGLKETLKLAIRIKEGQALDKLLGYFLALKVKVQPNFKNVVVLRCSNDLHLISVVMDMLPDAEDYILISAFYHEQWAPDYPDFAFFSYDGAMYKIQIRQHQGKFFFVDGLKTFRKDLGIYKSTTINFWACEQKWIFNLHFTPTLDQQSCGRPLLTSRMHVWIVELTQGLLGAPDPLRLPPIATIHLPSYGLHMMILRRFDPPLQWTVVTLDVGIGDKYVVQPWYQFLAEVDFSHENELSFYHSPHDKIWEIVIRRQKNWGDNDSD

SEQ ID NO: 175937 - protein, 515 aa, Glycine max
  Coding DNA Sequence Number=SeqID_59159
  Homolog annotation: Hit_ID=Q1SR88; Match level="QueryCoverage=84%, HitCoverage=84%, E-value=1e-15, Identity=29%"; Hit description=IMP dehydrogenase/GMP reductase
  Pfam annotation: Domain name=DUF674; Domain location=9-440; Score =150.1; E_value=5.9e-42; Accession=PF05056.3; Description=Protein of unknown function (DUF674)
MVANSTPLGKQEYTIPLEVLVDKEKNNVVFAVAGKDFVDVLLSFLTLPLGTIAKTVAKESNVQPVKVGSLSSMYESMSHFEEKHLWTKTCKEMLLQPRNSMEDYCQQLKLNIDDTEPKRYYFCENWSECIIKPPLVTTFRNQRCRCGKLMNRVLGSSDELNLENGFVKEIASFIVSDDLYITPNVFGESVNLFQKLGIEDMEAVEERIVDISKKEVVDLLKFSLISRTPLTDLFLRKEQYVDNFNPINQNQFEIGKTPCDKGRQMVLKIQIRKSNGKILFAEAEEEFVDFLFSFLTFPLGGVLHMLEGFSSVSCIDKLYRSMNELSSDRYLTSQGIKEKLANPPCAPQFNLNNQILPIGAESFPFTYSFYGRSFNIVDPKSSAGESSSLLGFVKGPAMYMVTDDLVVTPMSSISAVSYLKRLPVPLSDMEERVITIGVKEGLGILKASLTSTFALTNGLKHFIKTTEENGPITSARSKFINKACLSNNGGIFPLSGDYFGHSIICPAFVFIPSVI

SEQ ID NO: 175938 - protein, 484 aa, Glycine max
  Coding DNA Sequence Number=SeqID_59160
MVKGLHGQNLPADVAQVVDQLERHCFAPDGSLISRPLFNDLQLAREEMCRERLRYLEAMAIYSEAIAMVEEYQQAISVSNLGGIRDTGNLYPQLGLRTSPQVYQTLEHQMVVAEAAQRLRLPLISKDGEVHDEDIEKLSVVSRSSLDSTVSGANSSNYNTPNSSVSGANSALAASDPVELGVGGVPNRFLGITPSYLWQTQHQKAPLSVVEARLKMKCEKLSEAFVLDDNDSSSSGSHSSSSRFPESMQPRLLHERVKLLIEEIEREETALRDDLYSADRKFAEYYNVLEQILAVLIKLVKDLKLEHQHKYDETQKTWLCKRCETMSAKLRQPLLVSLVSGGERPVSRIPERVRDSLHSTIESLIQMDLRYILLRTKGEVPKELGGVEPKQRGVLEHVLLLETYTKDSIPALHKIRKYLVEATEEASIAYNKAVTRLREYQGVDPHFDNIARQYHDIVQKLENMQWTIHQVEMDLKRLPDKPNT

SEQ ID NO: 175939 - protein, 210 aa, Glycine max
  Coding DNA Sequence Number=SeqID_59161
  Gene Ontology: Mol. function=protein transporter activity; Cellular component=membrane; Biological process=intracellular protein transport
  Homolog annotation: Hit_ID=Q1SID8; Match level="QueryCoverage=82%, HitCoverage=70%, E-value=2e-63, Identity=71%"; Hit description=SNARE domain, putative
  Pfam annotation: Domain name=SNARE; Domain location=123-185; Score =54.6; E_value=3.3e-13; Accession=PF05739.9; Description=SNARE domain
  Pfam annotation: Domain name=Syntaxin-6_N; Domain location=1-62; Score=13.7; E_value=0.0026; Accession=PF09177.1; Description =Syntaxin 6, N-terminal
  Pfam module annotation: Pfam domain module=SNARE::Syntaxin-6_N; Domain location=123-185::1-62
MKLHLPIKGIIGENTKRLRVDELDKAIAIASRDPSWYGIDEAEVESRRRWTSNTRSQVGTMKKAVESGKGSSTTSHASVNGMRRELMRLPNSHQTDSSNQYAARDNDDFILSESDRQTLLIKRQDEELDELSESVRRIGGVGLTIHDELTAQEKILDELGSEMDSTTNRLDFVQKKVAMVMKKASAKGQIMMILGLLALFIFLFILVFFT

SEQ ID NO: 175940 - protein, 234 aa, Glycine max
  Coding DNA Sequence Number=SeqID_59162
MVWVAVVEAGMTAMEGNHGLSTRAPNVRGVACQGYLVFEEPVPPEECSLNSKQALSSISPLPAQHLQPQTGTLDTFIEEREIIRETEPYFGGSIDGKDNGPEVGKDSLCDLWISWTIKWATCNGSGSLLARNLAIIRWKTLSTRKVNATSGAASVPDEVSHRSKGVQLCNTKAYQCTPTFFADSYFLNKFSSEVIAERAQVLATATVICEKHTISVLPVTRVTMSQCYVLVFEN

SEQ ID NO: 175941 - protein, 107 aa, Glycine max
  Coding DNA Sequence Number=SeqID_59163
  Subcellular localization annotation: CTP_CleavageSite=50; ConfidenceScore=5.10e-01
MQPFTAPLPTPRPMPVAYLPDLCHTCVTVSYNKLFGTFAPYSRATTPNVKALEGRNMTLFKIGTEYHEPWNDREIEVQGDDSITAVTRVQILVQIAEKGTTTAEMGV

SEQ ID NO: 175942 - protein, 152 aa, Glycine max
  Coding DNA Sequence Number=SeqID_59164
  Subcellular localization annotation: CTP_CleavageSite=34; ConfidenceScore=5.01e-01
MSYNHAPFTAPLSTPRPMPVAYLPDLCHTRATVSCNKLVGTVALYDHVTTPNGKALEGRNMTLFKIGTKYHGPTMVACKHQLVVDPEEFRSHWNDTTAPPGGSARSKGYKAQKGDCTTSLLEGLTVAWLPLDESSMFEQDGNPNNNDDQHDQ

SEQ ID NO: 175943 - protein, 33 aa, Glycine max
  Coding DNA Sequence Number=SeqID_59165
MGKQVRCCGTRTSYKGRFLLGCESISGSRSIAA

SEQ ID NO: 175944 - protein, 103 aa, Glycine max
  Coding DNA Sequence Number=SeqID_59166
MSQSDIQVKSYCRLNLFGDSIFSFEHLDILRDSIGHPSKKLLPFECGSNAFHGYFDDAKESRVKQIPKIQESRFKIQESSFKNQDSRIIKIKIQESREDSIKI

SEQ ID NO: 175945 - protein, 285 aa, Glycine max
  Coding DNA Sequence Number=SeqID_59167
  Gene Ontology: Mol. function=oxidoreductase activity, acting on CH-OH group of donors; Cellular component=membrane; Biological process =alcohol metabolic process
  Homolog annotation: Hit_ID=Q2T8G7; Match level="QueryCoverage=94%, HitCoverage=48%, E-value=1e-103, Identity=64%"; Hit description=GMC oxidoreductase
VVARADAGQHQQLRRTDRAGADDHLFGGARGHFRAAVLAVDHAGGDVALEGQPVRQGVQFHHQPPFVAHRLQVGAGGAGAFAVVGGGLVETDAVLAVAVEVVAVGQVQLLAGADKRHAERVAVAVFADRQQPVGAVVVVRQAFVGLCAFEIGQHLPVAPSGAAIALGPVVVVLRLTAQVDHAVDRTAAAQHLALRDLHAAVVGVRFRLRFVGPALFGDDLGHAGRHLDEQVIVVAAGFQQQHPRLGAADQLRRQHAAGGTGADDDVIKGIFRHDSSPCAIGILAE

SEQ ID NO: 175946 - protein, 57 aa, Glycine max
  Coding DNA Sequence Number=SeqID_59168
  Pfam annotation: Domain name=zf-CCHC; Domain location=1-18; Score =25.0; E_value=7.3e-05; Accession=PF00098.13; Description=Zinc knuckle
MTCFNCRQKGHIQRDCSYPKKGQSGGGLNDQTRHPKTMERFFTLNGVKALKSKDLIQ

SEQ ID NO: 175947 - protein, 67 aa, Glycine max
  Coding DNA Sequence Number=SeqID_59169
MLREKDEKFANQNTPETNYQGLGYNWYGRLERETDPIHQRLHPHQVTKIRKEPGHLVRSKTIKFPTV

SEQ ID NO: 175948 - protein, 198 aa, Glycine max
  Coding DNA Sequence Number=SeqID_59170
MDWDQLLAGIGSRTIKWVPPMEGRKGGSPFLMWRIPKHSADWLAKLKVVSEESFEAPEEDEEVQALKSELGKAKLAKEKFKLAATHIRKECAGLREENATTARALEQETKRARKEEYGRNKFHGALWGSINELKLRREERNQSRARSMVLKEELVACSRSKRSLSQRLCETETNMLAIIAKYQEELGLATTHEHRITD

SEQ ID NO: 175949 - protein, 64 aa, Glycine max
  Coding DNA Sequence Number=SeqID_59171
MDVLCLVGTSVKPTKHRGRARYAVPSLFYAVQTSCRILDHSCNSAQGGETSGGKIWFSSPERTS

SEQ ID NO: 175950 - protein, 57 aa, Glycine max
  Coding DNA Sequence Number=SeqID_59172
MACLDQQHSEKEGQTIVVVFVVEDLSISDLDDSSNLDCIYCLKGHNYSTVVGFAAEE

SEQ ID NO: 175951 - protein, 146 aa, Glycine max
  Coding DNA Sequence Number=SeqID_59173
  Gene Ontology: Mol. function=chitin binding; Cellular component =extracellular region; Biological process=chitin metabolic process
  Homolog annotation: Hit_ID=UPI000044A8F0; Match level="QueryCoverage =87%, HitCoverage=99%, E-value=5e-21, Identity=33%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHALAIRGLHVLAFRGLHALAFRGLHVLVFRGLHILAVRGLHDHTLRELHVPAVKWLHALAFKGLHALTFRGLHVLAIRGLHVLAFRGLHILAFRGMHALAFRGLHALAFRGLHILAFRGLHVLSFRGLCCVKIYRDQSLKRKSF

SEQ ID NO: 175952 - protein, 74 aa, Glycine max
  Coding DNA Sequence Number=SeqID_59174
MTIRGGDGGTASSSAEEGGFTTGDCGSAGFELTCTGTKVGELWTSCPLVIDGGAGVDDEGMSSVLSLFLGSILN

SEQ ID NO: 175953 - protein, 55 aa, Glycine max
  Coding DNA Sequence Number=SeqID_59175
MQTWKEILIPREALHATFYFGRYCYLRIKNPADMLTKAVITDKLRLCIASVGLQG

SEQ ID NO: 175954 - protein, 161 aa, Glycine max
  Coding DNA Sequence Number=SeqID_59176
  Homolog annotation: Hit_ID=UPI0000E45228; Match level="QueryCoverage =33%, HitCoverage=24%, E-value=5e-11, Identity=68%"; Hit description =conserved hypothetical protein
MSISPSLSPRQCPDRYAFRAGRNLPDKEFRYLRTVIVTAAVHRGFGRRLPCHQSPGPGHCDPLCEEAPLLPKLRGYFAEFLRESCLAPLGILYLPTCVGFGYRYPFVEGRSSFSWEYGMDYFSAVAPGTRTLARGIFSTPYYPEKAGAPCVLEPITIFRLT

SEQ ID NO: 175955 - protein, 222 aa, Glycine max
  Coding DNA Sequence Number=SeqID_59177
  Homolog annotation: Hit_ID=Q1NYX4; Match level="QueryCoverage=30%, HitCoverage=49%, E-value=9e-08, Identity=47%"; Hit description=Cell wall-associated hydrolase
MVIGSRTQGAPAFSGRYSAEVIHAILPGKARTTFNKWVPVPETDTGVPPHKGGRSDQARATVYQKHRSPQSREPTTEAPVNGGRNYNGPKVAKFLVGLGEIDMSVKMRTTCTWTERPYEASLFPGIGFGLFLRSLGGGQRRPPSGGARAISLPKGNGGVQRFPRARRRLALECKGRRELDCKTHPSSRDETHIDGKVWHLDVGSSPPGAVVCSKGWAVRPLK

SEQ ID NO: 175956 - protein, 206 aa, Glycine max
  Coding DNA Sequence Number=SeqID_59178
  Gene Ontology: Mol. function=RNA-directed DNA polymerase activity; Biological process=RNA-dependent DNA replication
MFKREHESFKEYAQRWRDLVAQVAPPMMEREMITMIVDTLPMFYYEKMVGYMPSSFADLMLAGKRIEVGLRRRKLDYPALMNRKPEANGENKKEGGTHVVTVIPTWPNFPPAQQYQYSANISLSHYPPPYQPRTHNHPQRPPLNQPQNPFAAYPIPNTTLNTNQNTNQGRNFPEKKHVEFSPILVSYANLLPYLLNNGMVAIIPAK

SEQ ID NO: 175957 - protein, 137 aa, Glycine max
  Coding DNA Sequence Number=SeqID_59179
ESHPQRHPVNPEKSNRALGFPALVTGLCSPTGCPFPPARSRHHDIGIAPTRHPVDPKKSNRALGFPALVTGLCQFYGVPVAPSKVIRPPTNRAFIKKYYAPRQAQGETPQRPGDGRQRATDAPPSPLEFTSAHPQKG

SEQ ID NO: 175958 - protein, 136 aa, Glycine max
  Coding DNA Sequence Number=SeqID_59180
METCLSNHYAWVQTRRWRTHERKHNSWGSEKGVENGELHKAITMHGSKLENGGHMNENAILGAPKNGLRMENCTKQSLRMAPNSKNGELHKAITTHGSKLEDGGHMNENAIHGAPKNGLRMENCTKQSLRMAPNSK

SEQ ID NO: 175959 - protein, 200 aa, Glycine max
  Coding DNA Sequence Number=SeqID_59181
  Homolog annotation: Hit_ID=Q1SKD7; Match level="QueryCoverage=87%, HitCoverage=45%, E-value=2e-09, Identity=25%"; Hit description =Ankyrin
GFLEKKGTFYALSNELDRRHWRKELTDFLDGNIDVAIVKEFYANLYDPEDKSPKQVRVRGHLIKFDEDTLNTFLKTSGVVEEGETLCAYSRFALLGPYPQELAAKLCIPGRGFELNADGYPVKILRKNMTPLAQTWSVLSFSNLFPTSHTSDVTLDRAKLIYGIIMNVDMNVGYLISHQISLIAQHDTSRLGFPALITTL

SEQ ID NO: 175960 - protein, 194 aa, Glycine max
  Coding DNA Sequence Number=SeqID_59182
  Homolog annotation: Hit_ID=O04892; Match level="QueryCoverage=48%, HitCoverage=17%, E-value=3e-28, Identity=79%"; Hit description =Cytochrome P450 like_TBP
  Subcellular localization annotation: CTP_CleavageSite=44; ConfidenceScore=5.18e-01
MNRKLGYGAQLRANLDPTKGVGRLRQQDGGHGSRNPLRRSPETSAGAPERVSFLFNSLPTLETAQPEVGSSGWKSTARRVVSGAPPAALENPEDRVPPTPGKGSRQNGSVTSGKGLALRAGHGGPSPEPVGCRWTARAASAARAGRRVPVGGRIGNGPFGASSPGVEQSTQNWYGQGESDCLIKTKHCDGPCGC

SEQ ID NO: 175961 - protein, 134 aa, Glycine max
  Coding DNA Sequence Number=SeqID_59183
  Homolog annotation: Hit_ID=Q1SKD7; Match level="QueryCoverage=95%, HitCoverage=33%, E-value=6e-13, Identity=31%"; Hit description =Ankyrin
MAPKKLSAKRSRRDTAAEGTNAALEFDSHHFRSAEHQHRFEAIKGWSFHRERRVQLRDDEYTYFQEEIARQHWTLLVTPMAKFDPDIVLEFHANAWPTEGGVRDMRSWVRGQWIPFDADALSQFLGDPLVLEEG

SEQ ID NO: 175962 - protein, 93 aa, Glycine max
  Coding DNA Sequence Number=SeqID_59184
MAMLSVHGKPIFGKRHWKNTKSASNASHRHQGLGEPGKGQDHDVGGPGPTIFKKDSWWLDNGSTTHIVVSFQGFKILRDYSLKGKQVKGRKQS

SEQ ID NO: 175963 - protein, 62 aa, Glycine max
  Coding DNA Sequence Number=SeqID_59185
MFRDGPPDSNQTQPIRPLPLAKKAYPHVKLDQNQKFPKRISDLASNYDNLIHPRTQWKQNNC

SEQ ID NO: 175964 - protein, 47 aa, Glycine max
  Coding DNA Sequence Number=SeqID_59186
MRCMLGQHDESGKRERAVYYLRINEALGLNLALGLNLELGLDLKRAD

SEQ ID NO: 175965 - protein, 207 aa, Glycine max
  Coding DNA Sequence Number=SeqID_59187
MGKLDHLEERLRAIEGGEDYDFAKLEELFLVPNIITPPKFKVLDFDKYKGTTCPKNHLKMYCQKMGAYAKDEELLIHSFQESLTGVAVTWYTNLEPSRVHSRKDLMVAFVRQCLNNSDMALDRIQLQNMCKKGHESFKEYAQRWRDLAAQVVPPMMERETIIVMIDTDAILPRKGPVTRAMSKRLQEDWARADKEGLRVLMNLRVDF

SEQ ID NO: 175966 - protein, 45 aa, Glycine max
  Coding DNA Sequence Number=SeqID_59188
MYRGPRGSFGVEGRSKVGPSGQAEGIYTNASDPIRTPQLSVLGRE

SEQ ID NO: 175967 - protein, 45 aa, Glycine max
  Coding DNA Sequence Number=SeqID_59189
MGLSQTPSLKKWFYQVKVKSLGVASLKELGQLMGQLQRQAFCKAY

SEQ ID NO: 175968 - protein, 42 aa, Glycine max
  Coding DNA Sequence Number=SeqID_59190
MATPMSTAYYLDKDEADQSVDIKKYRDIKPIPKNLTLVPSKE

SEQ ID NO: 175969 - protein, 73 aa, Glycine max
  Coding DNA Sequence Number=SeqID_59191
  Homolog annotation: Hit_ID=Q6Q2Z9; Match level="QueryCoverage=68%, HitCoverage=5%, E-value=2e-11, Identity=69%"; Hit description =Phosphoenolpyruvate carboxylase
MIDLILALKIEICGLKIWWEGKLQYGRQMNLGVQNPLQLMKLGRLFLRMVYGHFDQVFKSFVLVIPKGTYMNT

SEQ ID NO: 175970 - protein, 55 aa, Glycine max
  Coding DNA Sequence Number=SeqID_59192
AIWVDDPSKLVFWVDDPAWVGDPEEVDDFLMVGSGRASLAPLPVLLPPFREIPDA

SEQ ID NO: 175971 - protein, 82 aa, Glycine max
  Coding DNA Sequence Number=SeqID_59193
MCLSGKEKEVPGSTKNRRKSLKVYQSHTGQGLTFPPWVKVYGKLGFWLKACRTAGHDICKGLARGSGIKGMSYIISMIHMQK

SEQ ID NO: 175972 - protein, 104 aa, Glycine max
  Coding DNA Sequence Number=SeqID_59194
MAEKTKKRLEEVAQSRSTEGIIDPPSPIRRHVKWKMARTKKTGQMTSEAAKEIADRIEKHPGHVRVVGAGVTIKQYFGSASRTSRSSSSMPPEDLEQLTQSQKK

SEQ ID NO: 175973 - protein, 87 aa, Glycine max
  Coding DNA Sequence Number=SeqID_59195
MRRAQAHKEKMSLALPRRRRQHEDDDGENDPLFALRMRRHKGEHPMKKTMGRTMFVRRRRRWCEGEDNAVENIMARRRRWHFLCVRV

SEQ ID NO: 175974 - protein, 242 aa, Glycine max
  Coding DNA Sequence Number=SeqID_59196
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=100%, HitCoverage=22%, E-value=1e-73, Identity=46%"; Hit description=Chromo
HMRAIAELFTLQYSRLDGPQDQLLDIPDDMEPELAMILYIYRTVFDVPSVDMLKEGIIAPSRSPFSPPIILVKKKDGTWRFCTDYRALNAITIKDSFRIPTVDELIDELHGAVYFSKLDLRSAFRTHQGHYEWLVMPFGLTNAPATFQSLMNEINYLGHTVSGKGVTMDQEKVQAVLNWPYPINLKQLRGFLRLTGYYNKLIKGYASIATPLSNSLKKENVHWNDHASKAFDNLKAAITKAP

SEQ ID NO: 175975 - protein, 84 aa, Glycine max
  Coding DNA Sequence Number=SeqID_59197
MGDANSNFENLKLGLPKYFRSWIASGGSNPARLGELGGNLLPFFPINRLKGAVLRVPDPPGDVFQLFWVKKIVSVKKIQAEALP

SEQ ID NO: 175976 - protein, 158 aa, Glycine max
  Coding DNA Sequence Number=SeqID_59198
  Homolog annotation: Hit_ID=Q5CEG7; Match level="QueryCoverage=66%, HitCoverage=99%, E-value=9e-45, Identity=84%"; Hit description =Senescence-associated protein
  Subcellular localization annotation: CTP_CleavageSite=52; ConfidenceScore=5.26e-01
MIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGISKITLKVVSQAQQGLLSPLIPPSPFPWLWFGG

SEQ ID NO: 175977 - protein, 137 aa, Glycine max
  Coding DNA Sequence Number=SeqID_59199
  Gene Ontology: Mol. function=transferase activity
  Homolog annotation: Hit_ID=Q1RWV8; Match level="QueryCoverage=74%, HitCoverage=14%, E-value=3e-23, Identity=51%"; Hit description=IMP dehydrogenase/GMP reductase
MKNEKINTKKKKVLETPILIVAKNGVTEMVEKIIDSFLVAVHDMDAKKKNIVLLTVENRQTYLYNFLLNKKNLKKSNIFGKVDNKGNSALHLAAKLGDYKPWLIPGEALQMHWEIKWYLGIHTRVISEMEAMQLMVK

SEQ ID NO: 175978 - protein, 42 aa, Glycine max
  Coding DNA Sequence Number=SeqID_59200
MEYYVLLEQGYEYKESSGILFFGGVLEANGPKNPRNLFQEYE

SEQ ID NO: 175979 - protein, 670 aa, Glycine max
  Coding DNA Sequence Number=SeqID_59201
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=2e-54, Identity=30%"; Hit description= UPI00006A17C9 related cluster
GLYIVAIRGLHILAFRGLHVLPFRGQHDLPFRGMQALALTGLHVLIFRGLHNLAFRGLDALAFRGVHILPLRGLHALAFVGLDTLTFKGVHVLNIRGLYIVAIRGLHVLAFRGLHSLTFRGLHMLAYRGLHAFAFVGLHALTFRGLHILEAARPCLQWATRPCLQRTTRPILQRTTRHCLKRTTCPPLQRTTCPPHQRTTRLHALTIRGLHVLGFRGLHVLTFRGLHVLTFNRLHAFAFIGLHVLTFKGLHVLAFRGLQALAFVGLHAPTLKGLLILTFRGLHVLTFSGLHAFALTGLHVLTYRGLHNLAFRGLGALAFKGVHILPLRGLHALAFVGLHTLTFKGVHILNFRGLYIVAIRGLHVLAFRGLHVLPFRGQHDLPFRGLHALALTGLHVLTFRGLHNLAFRGLDALAFRGVHILPLRGLHALAFVGLHTLTFKGVHVLNIRGLYIVAIRGLHVLAFRGLHVLHFRGLHAHTFKGYLHRTTRPWLRKASRPHLQRTTHARLQRTTRLCLRRATRPHLQRTTHPRFLSDTCPRLQRTTRLTFQGSTRPCLQWATQDYMSSTSEDYTFSPLEDYMSLPYEGYTASPFEDYTPSPSEDYTGLHNLAFRGLDALAFRGVHILPLRGLHALAFVGLHTLTFKGVHVLNIRGLYIVAIRGLHVLAFRGIH

SEQ ID NO: 175980 - protein, 76 aa, Glycine max
  Coding DNA Sequence Number=SeqID_59202
MAAGLSLRTDMSDTHKHTPRTVYKGDKTKAAQRRGEKELIRLQHVDDVVRGHQLGKDVDIEFELEFTILSPWCSLT

SEQ ID NO: 175981 - protein, 41 aa, Glycine max
  Coding DNA Sequence Number=SeqID_59203
MDHKEIGSFKGQNLEERELRRNVWKKRLALGLLGVLAGLGA

SEQ ID NO: 175982 - protein, 91 aa, Glycine max
  Coding DNA Sequence Number=SeqID_59204
  Subcellular localization annotation: CTP_CleavageSite=45; ConfidenceScore=5.36e-01
KNYWNPDDLTVAIRGARRARARPADLPSTSVAPTPASTSASPSVPAQMDSQRFEAMLQSIHQGQIILLQSLQVVAPPRSIPSIEQFLERVA

SEQ ID NO: 175983 - protein, 135 aa, Glycine max
  Coding DNA Sequence Number=SeqID_59205
  Subcellular localization annotation: CTP_CleavageSite=43; ConfidenceScore=5.58e-01
MKLNQLRILQTLPVSGAKTGQGSSHSRHSTSYFTSGPSSRRLSSTYRPYLSSLLEQLLPMLYSLHHGQYLLMQRLHHLSIQQAVMTLEAFLAQIIVKVLILVSRRYCEVMKYESKNKSEEVSKSERKSWYGKPNT

SEQ ID NO: 175984 - protein, 181 aa, Glycine max
  Coding DNA Sequence Number=SeqID_59206
  Gene Ontology: Mol. function=acyltransferase activity; Cellular component=integral to membrane
  Homolog annotation: Hit_ID=Q1SWP9; Match level="QueryCoverage=63%, HitCoverage=22%, E-value=2e-49, Identity=80%"; Hit description =Chalcone and stilbene synthases, N-terminal
MTSPPPLPMVQLSHALLRGSFGSCSVGAFVGEKNHGPTNAEKAIGYEHGLVVPEVPILGYVLGTDDDGVGVGVNLKHVFCELNGDDVGAAAHAAKVEAFDITAELVLVDDHGGEGRGAVEEAAVDDKDADVFGVDKGEARRREREVVGHQRQLEEARRRERKEEKISYFFILSGVNDSIVV

SEQ ID NO: 175985 - protein, 57 aa, Glycine max
  Coding DNA Sequence Number=SeqID_59207
DIVSDIVDPAQSVKDITDLCVQYFRAGCPGHCIRHRAGSSRATFWGRDKVKAAENQS

SEQ ID NO: 175986 - protein, 147 aa, Glycine max
  Coding DNA Sequence Number=SeqID_59208
MGTSSFHLPIKKMTITLNDVSYLLHLPMIGRPIDHVSSTFTKKAIKVLLMTRLGISTEEKAIAVTTVGAKSWVFVHLPIVGYFKPRTSALDNPVASRWKPTRGIGQTHLIKEKLNNLQVDVAAWCPYERHRGCLPFPLINLFLNRPL

SEQ ID NO: 175987 - protein, 76 aa, Glycine max
  Coding DNA Sequence Number=SeqID_59209
  Subcellular localization annotation: CTP_CleavageSite=67; ConfidenceScore=5.48e-01
MWLFFRSMSKTSIVANDWTKQMILTNLNSQTSPTIGRSVFFFSFVNALLLATVTRWKWEQDNDLFGSATEEEGALI

SEQ ID NO: 175988 - protein, 105 aa, Glycine max
  Coding DNA Sequence Number=SeqID_59210
SSSRAFPPPSVGSTLTLCTTASSSDGCLYIDNQICESVGWRLCGGGLAICEPEVCPYWKLLDDALGDYDGVVSDYIELCQQHRCSSHQLGPQSESLALDMFKLKF

SEQ ID NO: 175989 - protein, 109 aa, Glycine max
  Coding DNA Sequence Number=SeqID_59211
MLESFKQQEQMSVLELYIEKDVAGGSMFHSANSLTSCGNYLSNDETQPTTNMSNLHIDEDDDDDDDDYLVSNSYVEESLDEDDSVDGVSDTDDEVTNIPQPVRIVHPAE

SEQ ID NO: 175990 - protein, 72 aa, Glycine max
  Coding DNA Sequence Number=SeqID_59212
MQTTYKTAPWRKFFQNGPIWGISLQKETKWGNLPNPDARLQILVHRDPDFVLTACGGLNIDGSMESKIHDQE

SEQ ID NO: 175991 - protein, 181 aa, Glycine max
  Coding DNA Sequence Number=SeqID_59213
  Gene Ontology: Mol. function=nucleic acid binding; Cellular component= chromatin; Biological process=DNA integration
MALVAHFDLELQQMDVKTIFLNGDLDEEVCTSPDIAFVVGILERYQNNPSIDHWKAAKKIMRYLEGTKDYMLMYRQTNDLEVIGYFDSNFFGYSDIRRSTFGYVFILAGGVVSWRSAKQSLNATSTMETEFVSCFKATSHDVWSKSFVFGLRVVDSISRLLKLYCDNATMVFMAKNNKNGS

SEQ ID NO: 175992 - protein, 214 aa, Glycine max
  Coding DNA Sequence Number=SeqID_59214
  Gene Ontology: Mol. function=methyltransferase activity; Biological process=metabolic process
  Homolog annotation: Hit_ID=Q3BPF8; Match level="QueryCoverage=78%, HitCoverage=74%, E-value=2e-34, Identity=49%"; Hit description =Putative methyltransferase
MDGTPRNGPPLPCTPLTSPQARLIAEAFRPAQAWGSRRDYYYTRSSSAAIRCTTACCSICLRTGSRCWTSAAGWACSPMYCASAAAPNATWAWMWMRARSPARNVLPSNCMTCASTAWMCRRRYRRRPGTSCCWTCCSTWTRARSRHCCARPVRGWLPVAACCCARRWPPAMAATAPRGWRTGWPGWSAGWARGRATTPIQRCCRRRLPKRDCR

SEQ ID NO: 175993 - protein, 112 aa, Glycine max
  Coding DNA Sequence Number=SeqID_59215
VSSPSKKHIVAVGTTSNNTLSKRKTLDEGSLLSSKSETQHDHKLTSTPYVPMDPEALSPNSLKTVPSGFANCRNLPFGGRVTGGSWVRLPREENAQSRYQRLFEENVGKTEK

SEQ ID NO: 175994 - protein, 205 aa, Glycine max
  Coding DNA Sequence Number=SeqID_59216
  Subcellular localization annotation: CTP_CleavageSite=48; ConfidenceScore=5.38e-01
MEGRKKMGSSSSFTSELFGSNQFQKSSASGIFESMFPPPPKVLGRGSLCSEVSGKSSSEGWNYKFGSENILLPCPFTELGLNVVNEVYGPLEGPLDYISMGNHGETQNTAQKDMSSIYQEQRLQPCQLSSSIHYGGQDIYSCPKSTQDSGYNSLLYKKDGVEDDLGSNLWQVFCHKFLIHFLSCATVYPQGVPIIKITLAKGYAP

SEQ ID NO: 175995 - protein, 631 aa, Glycine max
  Coding DNA Sequence Number=SeqID_59217
  Gene Ontology: Mol. function=guanyl-nucleotide exchange factor activity
  Homolog annotation: Hit_ID=Q93ZY2; Match level="QueryCoverage=70%, HitCoverage=77%, E-value=1e-130, Identity=55%"; Hit description=Rop guanine nucleotide exchange factor 1
  Pfam annotation: Domain name=DUF315; Domain location=9-501; Score =739.5; E_value=2.2e-219; Accession=PF03759.4; Description=Domain of unknown function (DUF315)
MEGLSLAENSTEAVEESNKGSENGAKRETFADLIEEKGRESSFSSEFLSSETTHEEHSRSSTEDSSSSPSVGWPVQEIAASDCASPHGSEDGEKKHLVLENKEFEKRVSASPEIEMMKERFAKLLLGEDMSGCGNGVATALAISNAITNLCATLFGQLWRLEPLRSEKKAMWRREIEWFLSVSDHIVELTPNWQTFPDGSKLEVMTCRPRSDLYVNLPALRKLDNMLLEILDSFVDTEFWYIDQGVLAPDADGPSSFRQALQRQEEKWWLPVPRVPPCGLNENSRKQLQHKCDCTNQILKAAMAINSITLEEMDIPESYLESLPKPEESKWRNGLIPNPTFLQNARVSLGDVIYRYITSDHFSPECLLACLDLSSEHQAIEIANRAEASMYIWRKRTNSKPASISARSSSRTSWEMVKDLMVDADKRDLFAERAESLLLSLKQRFPGLPQTALDMSKIQYNKDVGKAILESYSRVLESLAFNLVARIDDVLYVDDLTKNSDKISSLSKVGVVTHKSISVPHSVPVPGTPYKSAFGTPTLSPAHGISSPAKGGKSPLINYSNLPQRGSGVKKSLTDFLSIDPKGKDSDTSIEKQDSESNVLDEVTTCETDVESSACTEGAASPSILDWKWHV

SEQ ID NO: 175996 - protein, 139 aa, Glycine max
  Coding DNA Sequence Number=SeqID_59218
  Gene Ontology: Mol. function=lipid binding; Biological process=lipid transport
  Pfam annotation: Domain name=Tryp_alpha_amyl; Domain location=32-114; Score=36.1; E_value=1.2e-07; Accession=PF00234.12; Description =Protease inhibitorseed storageLTP f
MEGCTYCVKLLCLVGFVVLVSTIAGVESAGECGKSTTPDNEAYKLAPCASAAQDENASVSQSCCAQVKKIGQNPSCLCAVLLSNTAKMAGVNPQVAVTIPKRCNLANRPVGYKCGQSSKRPETVTARGHVPTSMDKDGR

SEQ ID NO: 175997 - protein, 119 aa, Glycine max
  Coding DNA Sequence Number=SeqID_59219
MVQDLIKNDAKLEFEDLSLLIVEDSMDKEEKGDHIQDNLFSHEFKVISAHKEEVTTTETELSIGVGIGGEASVNETENHFDLNKVHVDGVEECVLVLNKLLAEGMDLGFESEELNKERI

SEQ ID NO: 175998 - protein, 689 aa, Glycine max
  Coding DNA Sequence Number=SeqID_59220
  Gene Ontology: Mol. function=RNA-directed DNA polymerase activity; Cellular component=chromatin; Biological process=chromatin assembly or disassembly
  Homolog annotation: Hit_ID=Q1SAV4; Match level="QueryCoverage=34%, HitCoverage=99%, E-value=1e-52, Identity=51%"; Hit description =Integrase, catalytic region
  Pfam annotation: Domain name=Chromo; Domain location=591-637; Score =19.4; E_value=0.0051; Accession=PF00385.14; Description='chromo' (CHRromatin Organisation MOdifier
  Pfam annotation: Domain name=rve; Domain location=416-560; Score =47.0; E_value=6.4e-11; Accession=PF00665.16; Description=Integrase core domain
  Pfam module annotation: Pfam domain module=Chromo::rve; Domain location=591-637::416-560
MDLYALPLCGADIVLGVQWLKSLGLVLTYYNDLTMKFITNGHIVELKGDTNCDLHSMTPTQLRRMVRTDSASACFHIRLIPPELPSTKTLYPEIDTLLCTFSPLFQTPTTLPPSRTTNLSIHLLCHSESVNVRPYHYPYFQKHEIEAQVETMLQQDYRALNAITVKDRFPIPTINELLDELGGACWNWTCYRGPSKITSSFSNYPNAPSRRSRLSTLGIWFLKPVPTKVEAIQQWPIPSSTRALRGFLGLSGFYRRFIKGYVSIVAPLTQLLAKDKFRWSPEAQEAFNKLKEVIFHALVLGLLDFSLPFVIEIDASRVGMGAILSQQNHLIAFFNKAFCPKLLHASTYVRELATITSAVKKWRHTFASLRLFFMNSIQPQLEVTWALPRPWHDYVTISLGRELRTMFTTLFLLVLIVNKPRMITTNNLGYYVLFRCRRGIHLGSLPSHHMAFNVVHLFMEIVGKLHGMPCSLVSDRDSLFISRFWQELFRLSDTKLRMNSAYNPQSVGQTEVINRVVEQYLRAFVHSRLTTWGRYFMWAEWSYKTSIHSETQMTPYEITFGKQPPTIPQYIVRTSNVDVVDEFLINRDEMFAIILNTKWDTVDHTSKLRVLVQWKGLAPDDATWESWDELKAEYHLEDKVFFETHGNVMKGKEATQLPPTETQTKQIPTKRNQRQKRMVTKPQYLRDFV

SEQ ID NO: 175999 - protein, 225 aa, Glycine max
  Coding DNA Sequence Number=SeqID_59221
  Gene Ontology: Mol. function=glutathione transferase activity; Cellular component=cytoplasm; Biological process=auxin mediated signaling pathway
  Homolog annotation: Hit_ID=P32110; Match level="QueryCoverage=99%, HitCoverage=100%, E-value=1e-105, Identity=83%"; Hit description =Probable glutathione S-transferase
  Pfam annotation: Domain name=GST_C; Domain location=99-198; Score =81.9; E_value=2e-21; Accession=PF00043.15; Description=Glutathione S- transferase, C-terminal domain
  Pfam annotation: Domain name=GST_N; Domain location=6-79; Score=86.3; E_value=9.7e-23; Accession=PF02798.10; Description=Glutathione S -transferase, N-terminal domain
  Pfam module annotation: Pfam domain module=GST_C::GST_N; Domain location=99-198::6-79
MAAGQEDVKLLGVVGSPFVCRVQIALKLKGIEYKFVEENLANKSDLLLKSNPVHKKVPVFIHNEKPIAESLVIVEYIDETWKNNPILPSDPYHRALARFWSKFIDDKVFGAAWKSVFTLDEKEREKNVEESLEALQFLENELKDNKFFGGEEFGLVDIAAIFIAFWIPIFQEIAGLQIFTSEKFPKLYKWSQEFMSHPVVKEVLPPRDPLFAFFKARYESLSASK

SEQ ID NO: 176000 - protein, 174 aa, Glycine max
  Coding DNA Sequence Number=SeqID_59222
MVEEDEAAEQGSLNSPQASKMKDVNVLHVSQEESGYPMMEEYEAAKQGDHSSPQGSNMKDMNVLHVSHEESVYPMVEDDEAVEQGNQNSPQASNMKDLNVLLVSQEESGYSVVEENEAAEQGDQNSPQGSNMKDMNVLRATHEEFDYPMRNLIAIRWKKKLLDRATTVALKHQT

SEQ ID NO: 176001 - protein, 155 aa, Glycine max
  Coding DNA Sequence Number=SeqID_59223
  Gene Ontology: Mol. function=nucleic acid binding; Biological process= DNA integration
  Homolog annotation: Hit_ID=Q1SPP8; Match level="QueryCoverage=99%, HitCoverage=11%, E-value=8e-19, Identity=31%"; Hit description =Integrase, catalytic region; Zinc finger, CCHC-type; Peptidase aspartic, catalytic
MEEVIPVRFNNTKPDTKMSELDESFANLRLNEDIGPLVEQSTGTNVSDQVKGQPQEEREPTGQILSKNHLESQIIGDPSTKVQTRGSLRQQGFITLILEVETKHINDAMEDKNWVKAMQEELEKFKKNDIWKLVELPQENKVVRAKWVFRNKLGE

SEQ ID NO: 176002 - protein, 215 aa, Glycine max
  Coding DNA Sequence Number=SeqID_59224
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=4e-27, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MATRHRLQRTTRPHLQTSTCPRLQRTIYPPLYRATCHPTSKGYTSSPSEDYTSSSSEDYTPSPSEAYTPSPSEDYTSSSLEGCTPSPSEDYMSSPSEGCTPSPLEAYTPFPSEDYTSSPLEDYIGLHVLAIRGLHVLTIRGLHVQAFRGLHPLAFKGLQVLTFRGLHTLTFKGLHVLAFRGLHVPTFRGLHVLPFRGLYALAFVGLHVLTFRGLL

SEQ ID NO: 176003 - protein, 282 aa, Glycine max
  Coding DNA Sequence Number=SeqID_59225
  Homolog annotation: Hit_ID=Q413I4; Match level="QueryCoverage=52%, HitCoverage=13%, E-value=2e-08, Identity=30%"; Hit description =Fibronectin, type III precursor
MGVHPKTDPLTYQYAEAFTADARGTLGAQTEAGYQNWAGTSAPATYAWTPDWAVGTTTGLGQAGLSITGAGDMISVGGEFRSVNNKQFEGLVRFSTTPPGGPKDGPRLSGTTWTPKATSTAPGQVEVSIRQNWDRDDLDLTYELRRNGAAEPVASVTVDSTWWGKTPVTLRDDSAPGGQVGYTVVAKDGDGNTVTSGETTVSVVAAGGTGGDAAGGDAAGGDAAGGDAAGGDAAGDVGTTDYRAVVLADRPQLYYPLGSASRDLAGFNPPVIGRGVAVADAG

SEQ ID NO: 176004 - protein, 289 aa, Glycine max
  Coding DNA Sequence Number=SeqID_59226
  Gene Ontology: Mol. function=acyl-[acyl-carrier-protein]-UDP-N -acetylglucosamine O-acyltransferase activity; Cellular component =chloroplast; Biological process=lipid A biosynthetic process
  Homolog annotation: Hit_ID=Q9SU91; Match level="QueryCoverage=66%, HitCoverage=56%, E-value=4e-79, Identity=71%"; Hit description=UDP-N- acetylglucosamine O-acyltransferase-like protein
  Pfam annotation: Domain name=Hexapep; Domain location=125-142; Score =2.1; E_value=79; Accession=PF00132.14; Description=Bacterial transferase hexapeptide (three rep
  Pfam annotation: Domain name=Hexapep; Domain location=149-166; Score =10.5; E_value=6.1; Accession=PF00132.14; Description=Bacterial transferase hexapeptide (three rep
  Pfam annotation: Domain name=Hexapep; Domain location=167-184; Score =7.9; E_value=16; Accession=PF00132.14; Description=Bacterial transferase hexapeptide (three rep
  Pfam annotation: Domain name=Hexapep; Domain location=191-208; Score =2.5; E_value=71; Accession=PF00132.14; Description=Bacterial transferase hexapeptide (three rep
  Pfam annotation: Domain name=Hexapep; Domain location=30-47; Score =17.2; E_value=0.06; Accession=PF00132.14; Description=Bacterial transferase hexapeptide (three rep
  Pfam annotation: Domain name=Hexapep; Domain location=54-71; Score =11.7; E_value=2.7; Accession=PF00132.14; Description=Bacterial transferase hexapeptide (three rep
  Pfam annotation: Domain name=Hexapep; Domain location=72-89; Score =14.8; E_value=0.31; Accession=PF00132.14; Description=Bacterial transferase hexapeptide (three rep
  Pfam annotation: Domain name=Hexapep; Domain location=94-111; Score =10.1; E_value=8.1; Accession=PF00132.14; Description=Bacterial transferase hexapeptide (three rep
  Pfam module annotation: Pfam domain module=Hexapep::Hexapep::Hexapep:: Hexapep::Hexapep::Hexapep::Hexapep::Hexapep; Domain location=125 -142::149-166::167-184::191-208::30-47::54-71::72-89::94-111
MSDGEKQSKNVVSQENVADGERFDSCIHPTAVVHPNAVIGQGVSIGPFCSVSSSAKLGNGCQLHPGSHVFGSTELGDNCMLMTGAVVGDDYPGCTVIGSNNTIGYHAVIGVKCQDMKYKPEDECYLEVGHNNDIREHTSIHRSSKSTDRTVIGNANFIMGSCHIAHDCKIGNNNIFANNTLLAGHVEVEDYVHTAGATVVHQFCHLGSFSFLGGGSVGNDCYAIVETCNCQNHRQSALSRSFLVGRTKLIMDVNGEEYVKNMQPKNLSNTIKITSYPLDLGKFDRDLNF

SEQ ID NO: 176005 - protein, 111 aa, Glycine max
  Coding DNA Sequence Number=SeqID_59227
  Homolog annotation: Hit_ID=Q1S5Q3; Match level="QueryCoverage=91%, HitCoverage=71%, E-value=3e-08, Identity=33%"; Hit description=Zinc finger, GRF-type
  Pfam annotation: Domain name=zf-GRF; Domain location=1-39; Score= -0.7; E_value=0.037; Accession=PF06839.3; Description=GRF zinc finger
MAVRRVAGTNINRERAFFTCSINKDEVGYCGYFIWVDQLIEALGVDDSLGTFSMEQRRQFGREEDKTMWKAQVNSKLDCMGIEMKMFRTIVYGIFLIQLLSMVVFVCIHKY

SEQ ID NO: 176006 - protein, 69 aa, Glycine max
  Coding DNA Sequence Number=SeqID_59228
  Gene Ontology: Mol. function=ATPase activity; Cellular component =integral to membrane; Biological process=transport
  Homolog annotation: Hit_ID=Q1SCG9; Match level="QueryCoverage=92%, HitCoverage=7%, E-value=3e-26, Identity=86%"; Hit description =Probable ABC-type transport protein T23J7.110-Arabidopsis thaliana
MIGLTKPTPGTAFVQGLDIRTHMDVIYTSMGVCPQHDLLWESLPGREHLFFYDRLKNLKGSALTQLTLS

SEQ ID NO: 176007 - protein, 322 aa, Glycine max
  Coding DNA Sequence Number=SeqID_59229
  Homolog annotation: Hit_ID=Q1S2V8; Match level="QueryCoverage=99%, HitCoverage=100%, E-value=1e-124, Identity=70%"; Hit description =Saposin B
MKGVLWVVVVSMVVAAWMPFSHCSKKPVGVARKEDIQYIKCQVCEKLAKELYQQVQNKQAEIAPKKISEYQIIEIAENVCNLKKAEADWILRIDIVEKEDRLELVEQDSEGQCNSECKTIERACQEVIGYSDTDVAEYLYSSKPDIDSLRNYLCKDLTNACSTKPPPVPKHQQVLVLIPEPVLVTNYLFSVQDRAPGEPFVAKSSKEAEMEKLLKSMEGMPGAPGMKMYSRDDLMNMKNFGDEDGDDEDEDDNEEASFPSKLGKVLRAKESEKRDWKQVIKKGIEDTSMTLKKHANKVSNHIRQWWRGKKITNSKKGGKTEL

SEQ ID NO: 176008 - protein, 85 aa, Glycine max
  Coding DNA Sequence Number=SeqID_59230
  Gene Ontology: Mol. function=transferase activity, transferring glycosyl groups; Biological process=metabolic process
  Homolog annotation: Hit_ID=Q9LXV0; Match level="QueryCoverage=89%, HitCoverage=18%, E-value=1e-13, Identity=46%"; Hit description =Glucosyltransferase-like protein
MEFVERVKESAKGLVVMIGCLSHCGWNSMLESLNQGVSILGWPMAAEQFYNCKLLEEEVGVCVEVVRGKIFETKCEDIVVLGIRG

SEQ ID NO: 176009 - protein, 90 aa, Glycine max
  Coding DNA Sequence Number=SeqID_59231
  Homolog annotation: Hit_ID=P93101; Match level="QueryCoverage=34%, HitCoverage=10%, E-value=4e-07, Identity=87%"; Hit description=Cell division control protein 2 homolog
MTTILYKVENIGEGTYGVVYKGRDCVSNETIALKKIRRGCYPNANVSDFEGIRILAWGEVVSSLSENPAAVEAKAVFEKFNRKFEEACRK

SEQ ID NO: 176010 - protein, 88 aa, Glycine max
  Coding DNA Sequence Number=SeqID_59232
MKHKNQLVNISWHDEGFDRSLSGRTNEADIDGGKVRVSGSEVWEADDLFEEVIGGSVGRVIHHECGFECGLERVRVESGERVGNAETT

SEQ ID NO: 176011 - protein, 135 aa, Glycine max
  Coding DNA Sequence Number=SeqID_59233
MENCTKQSLRMAPKKWGGCMNKNVIHGAPKKGREWRIALSNHYAWLQLVGGGRMNENAIHGAPKKGREWRIALSNHYAWLQTRGWRMHERKRNSWGSEKRGREWRIAISNHCAWLQTRGWRMHERKRNSWGSEKK

SEQ ID NO: 176012 - protein, 1066 aa, Glycine max
  Coding DNA Sequence Number=SeqID_59234
  Homolog annotation: Hit_ID=Q3LHL2; Match level="QueryCoverage=17%, HitCoverage=36%, E-value=2e-57, Identity=55%"; Hit description =Hypothetical protein PPS5
  Pfam annotation: Domain name=DUF292; Domain location=34-155; Score =256.9; E_value=4.1e-74; Accession=PF03398.5; Description=Eukaryotic protein of unknown function, DUF292
MRNFKSTTTSVRLPIGNYSFDGVEAGESKTALKLAVSRIKLLKNKREAQIKQLKRELAQLLESGQDRTARIRVEHVVREEKTMAAYDLVEIYCELIAARLPMIESQKNCPIDLKEAVSSVIFASPRCSDIPELVDVKKQITSKYGKEFVSAAIELRPDCGLVEKLSAKAPDGPTKIKILAAIAEEHNIKWEPKSFGENDVKSSQDFLVGPSTSEKAAYAEPSQIHVPPAHDEKGPSNLHASSQVKPVHHASTNSYEQSASGAARKDQSTTSGVSNLEVRSSGTGSQETKFQDSYSGNNSSFPMNRQNWNMGFKDAASAAQAAAESAERASMAARAAAELSNRENMTRQYSSGSHSSSGSRLRDERPQEYTFHDDKNVSTSPVDTSFHRSSSGMHNEQITAAEQDNLVGPPYEYYRNSHENVVRHAQSASLMSDSAFRDDKPFIDGNQMADIYQHNNSFGQKSSDLHEMGIKTQAGRSEEDFVTDLYDDSDLNAENSYHFGDARTNRQSSKVSSSHFITPTDDHNDNLDLDDWNTRNKAVGDPFVTDEVNTQRNIMETNSYNDTTVVFDDSESEDDDHKFGVDKKYNGEGSSLFVSSPSNKSQVDPFENTKSCSDGQNIDEKVTSSSTPSHFSVISERLTSAVSSEKEDLPPVTFDDSDDPGSDSDMSFVNKSKVSGLSGYGASGSSSRNDKNVGSDRKSWLSPLSVDSDTVEEHFERRVDTTTVSEKNLGYDDLPASQSPTKERSSILGLDIEANNDIETLKEYRIECGKELSYGTLKGGFRNKGFKRPPYINNTLDDSSSSLGDASVQNERSLPIVRTSIGSDAPVQDKYTREVSRGNRTMGLGAHNIPSDSDSYRVVANSQETLARTNEPHIQKEQSEVKKKSSSRASFTYFNSDNSDSEEELTKQNSPSLARPVSGISRRTSASSKAATGLSSRDAPLSKASVTPATTLGWKSSRTSYESNNQNASTIMKSSENRTGPKSGSAKNKASEPISEPNRSLDGEISKSSARVQPSSSLKTVIQDNEEGQEDDADTSSKQKVGHVHPKLPDYDSFAAHFLSLKKGRQ

SEQ ID NO: 176013 - protein, 190 aa, Glycine max
  Coding DNA Sequence Number=SeqID_59235
MDNEEGVQEQMKVDLSALKDQMASITEAMLKLQKTIEDNATTAASNTAREAEPMLQPAINLGRDRNTTVFGRRYSPQAYPYGLPPDFTPRTALDDLSQAPTFEGQLPPYADYPLQEDDEGEAYLGPLLPLKDPAPHELSQPNIVRHVPSPPAPVKESVPFAKDKGKRQKHQKGRPPDRRLHCARDTWHSR

SEQ ID NO: 176014 - protein, 109 aa, Glycine max
  Coding DNA Sequence Number=SeqID_59236
MHSISFLLCQYLLAKVCDIYPCIGYANGQTKYAKYSDSKSIQMPKLRRISRMTRVMSKMTATATKSISLKPLGRDGTVRRHLVEEIPIVVPRYVVKPLVTVSLESTDQR

SEQ ID NO: 176015 - protein, 100 aa, Glycine max
  Coding DNA Sequence Number=SeqID_59237
  Homolog annotation: Hit_ID=UPI000034F3B5; Match level="QueryCoverage =84%, HitCoverage=9%, E-value=2e-13, Identity=40%"; Hit description =ATP binding / ATP-dependent DNA helicase/ ATP-dependent helicase/ DNA binding / ...
  Homolog annotation: Hit description=hydrolase, acting on acid anhydrides, in phosphorus-containing anhydrides / nucleic acid binding
MISASNPNPKNVYLIRGLDFHLNLAQKEGHCRTLLESPTGTAKSLSLLCSSLAWQHHYKSQQHHLKPVSEATTDPLAHGGRFVPDNCPAFSFRNSRPYAN

SEQ ID NO: 176016 - protein, 340 aa, Glycine max
  Coding DNA Sequence Number=SeqID_59238
  Gene Ontology: Mol. function=ARF guanyl-nucleotide exchange factor activity; Cellular component=intracellular; Biological process =regulation of ARF protein signal transduction
  Homolog annotation: Hit_ID=Q9SZM0; Match level="QueryCoverage=74%, HitCoverage=15%, E-value=1e-107, Identity=75%"; Hit description =Guanine nucleotide-exchange protein-like"
  Pfam annotation: Domain name=Sec7; Domain location=191-340; Score =193.3; E_value=5.9e-55; Accession=PF01369.11; Description=Sec7 domain
MSRKHSWNSPKRTGLCEPQSGEPDLANCVFEYTPEASAENLANYKSKNQIVAWQLKGDKHLTFKKKLLENFAYMVYLEHCLLPREAYRIVNGLLKTALGPPTGSTTALSPAQDITFRHESVKCLVSIIKSMGAWMDQQIRIGDLDLAKSPESSSAAENHLILNVEEGNASDHELHSDVNSEFSEAATLEQRRAYKIELQKGISLFNRKPPKGIEFLKSNKKIGSSPEQVALFLKNTAGLDETKIGDYLGEREEFSLKVMHAYVDSFNFKGMDFGEAIRFFLQGFRLPGEAQKIDRIMEKFAERYCKCNPSSFSSADTAYVLAYSVIMLNTDAHNNMVKDK

SEQ ID NO: 176017 - protein, 153 aa, Glycine max
  Coding DNA Sequence Number=SeqID_59239
  Gene Ontology: Cellular component=phragmoplast
  Homolog annotation: Hit_ID=Q10PE0; Match level="QueryCoverage=69%, HitCoverage=26%, E-value=7e-23, Identity=44%"; Hit description =Microtubule associated protein family protein, putative, expressed
MALVSAQALLALLCSENLSTTVEDEQDLSLRRLNEYKKEKTVGDVHRSLHGTQVEQSTNISNSTLEGLEQAILKLKIERKTIISEAEVDRLAKLKASRMKELVFKKRSELEEICRLIHIEPDPSTVAEKASALIDSGLVDPSELFSQNRRTDN

SEQ ID NO: 176018 - protein, 646 aa, Glycine max
  Coding DNA Sequence Number=SeqID_59240
  Gene Ontology: Mol. function=zinc ion binding; Cellular component =nucleus; Biological process=transcription
  Homolog annotation: Hit_ID=Q9ZVC9; Match level="QueryCoverage=73%, HitCoverage=55%, E-value=1e-148, Identity=52%"; Hit description =Mutator-like transposase
  Pfam annotation: Domain name=FAR1; Domain location=49-162; Score= -29.9; E_value=0.00018; Accession=PF03101.5; Description=FAR1 family
  Pfam annotation: Domain name=SWIM; Domain location=441-477; Score =46.5; E_value=8.8e-11; Accession=PF04434.8; Description=SWIM zinc finger
  Pfam module annotation: Pfam domain module=FAR1::SWIM; Domain location=49-162::441-477
MSIANLITVDLVQVKGGKNDPDTGTLIGILQTARPPPKSQPSLSLTPCSLSHREVSRQGRKPSRAHPADDHEATAVSHLVGTLPLVTHLRAHTVAIPPPTATVTRPLGGGGHHVLDYLKRMQAENPAFFYAVQDDNNLACGNIVWADATSRTNYSYFGDAVILDTTYKTNRYRVPFTSFTGLNHHGQPVLFGCALIFNESESSFIWLFRTWLHAMSGRHPVSITTDLDPFIQVTVAQVLPSTRHRFCKWSIFRETRSKLAHLCQSHPDFETEFKKCVHESETIDEFESYWHPLLERFYVMDNEWLQSMYNARQHWVPVYLRDTFFGEISMNEGNECLNSFFDGYVNSSTTLQVLVRQYEKAVSSWHERELKADYDTTNSSPVLKTPSPMEKQAASLYTRKIFMKFQEELVETLANPATKIDDSGTITTYRVAKFGENQKSHVVTFNSFEMKASCSCQMFEYSGIICRHILTVFRAKNVLTLPSHYVLTRWTRNAKTSTLLDEHASELPSTSCESVIVRYNNLRQEAIKYVEEGAKSIQVYHVAMRALQEAAKKVCAIKNHSSGTAEGATVTNGSRGELLVADEDAPSNQSVAEKEKKIRELTAELEVTNQRCEVYRANLLTVLKDMEEQKLKLSVKVQNARFSLKE

SEQ ID NO: 176019 - protein, 237 aa, Glycine max
  Coding DNA Sequence Number=SeqID_59241
  Gene Ontology: Mol. function=nucleic acid binding; Cellular component= intracellular; Biological process=regulation of transcription
  Homolog annotation: Hit_ID=O65499; Match level="QueryCoverage=63%, HitCoverage=60%, E-value=1e-46, Identity=54%"; Hit description =Putative zinc-finger protein
  Pfam annotation: Domain name=zf-C2H2; Domain location=120-142; Score =19.1; E_value=0.016; Accession=PF00096.16; Description=Zinc finger, C2H2 type
  Pfam annotation: Domain name=zf-C2H2; Domain location=173-195; Score =11.4; E_value=0.6; Accession=PF00096.16; Description=Zinc finger, C2H2 type
  Pfam annotation: Domain name=zf-C2H2; Domain location=47-69; Score =9.2; E_value=1.1; Accession=PF00096.16; Description=Zinc finger, C2H2 type
  Pfam module annotation: Pfam domain module=zf-C2H2::zf-C2H2::zf-C2H2; Domain location=120-142::173-195::47-69
MKRESDCGEAGSSSWCVGKKQKQKRLMEDAGGWKGKISSSSSSSEPRPCTECGKKFWSWKALFGHMRCHPERHWRGINPPPNVIRRQQQMTQEDHEVAACLLLLANAKDKDKDKEEDVHFECSSCNKVFGSHQALGGHRASHKNVKGCFANNAAIGTSSSTSDQENMMILHGHKCSICLRVFSTGQALGGHKRCHWDKGDNLGLLADSSSKSLSLVDLNFPPPSFSSPLALDLRLGL

SEQ ID NO: 176020 - protein, 165 aa, Glycine max
  Coding DNA Sequence Number=SeqID_59242
  Homolog annotation: Hit_ID=UPI0000162BB6; Match level="QueryCoverage =59%, HitCoverage=5%, E-value=7e-38, Identity=74%"; Hit description =guanyl-nucleotide exchange factor
MAFQMTKADFVRNNRGIDDGKDLPEEYLGAIYDQIVKNEIKMNADSSAPQNKQANSFNRLLGLEGILNLVNWKQSEEKAVGANGLLIRHIQEQFKSNSRKSDPLLVLSEHGLYELNSILQNRLDFNMAPFAHSYPPCGTFNTHPLSRADHNLGGFSNWSLSRGLK

SEQ ID NO: 176021 - protein, 178 aa, Glycine max
  Coding DNA Sequence Number=SeqID_59243
MLFAFMGCWSSFLVRARVAVRADVDCVLRADCRGCHGWVWLGAAGCGWVTVWTLGAGEGAAGAWERRAKLLNELSGRVGSGQPNSYRRQKTKKIRHFPPRRHDRHLQLATPPLFGGVFSKNHYAILPWRRHLTTLATRAMTCYPILPPLGFLLQEFGFSSIPPDLLHSRSNLNSSSWK

SEQ ID NO: 176022 - protein, 543 aa, Glycine max
  Coding DNA Sequence Number=SeqID_59244
  Gene Ontology: Mol. function=binding; Cellular component =intracellular; Biological process=protein amino acid phosphorylation
  Homolog annotation: Hit_ID=Q337S8; Match level="QueryCoverage=99%, HitCoverage=81%, E-value=1e-119, Identity=35%"; Hit description =Pentatricopeptide, putative
  Pfam annotation: Domain name=PPR; Domain location=136-170; Score =26.6; E_value=8.5e-05; Accession=PF01535.11; Description=PPR repeat
  Pfam annotation: Domain name=PPR; Domain location=237-271; Score =45.8; E_value=1.4e-10; Accession=PF01535.11; Description=PPR repeat
  Pfam annotation: Domain name=PPR; Domain location=272-306; Score=6.9; E_value=1.1; Accession=PF01535.11; Description=PPR repeat
  Pfam annotation: Domain name=PPR; Domain location=34-68; Score=23.1; E_value=0.00099; Accession=PF01535.11; Description=PPR repeat
  Pfam annotation: Domain name=PPR; Domain location=374-408; Score=7.0; E_value=1.1; Accession=PF01535.11; Description=PPR repeat
  Pfam module annotation: Pfam domain module=PPR::PPR::PPR::PPR::PPR; Domain location=136-170::237-271::272-306::34-68::374-408
MAENSTCTCFVLKTEVNEARRVFQIDDEKPPEEPVWVAMAIGYSRNGFSHEALLLYRDMLSCCVKPGNFAFSMALKACSDLDNALVGRAIHAQIVKHDVGEADQVVNNALLGLYVEIGCFDEVLKVFEEMPQRNVVSWNTLIAGFAGQGRVFETLSAFRVMQREGMGFSWITLTTMLPVCAQVTALHSGKEIHGQILKSRKNADVPLLNSLMDMYAKCGEIGYCEKVFDRMHSKDLTSWNTMLAGFSINGQIHEALCLFDEMIRYGIEPNGITFVALLSGCSHSGLTSEGKRLFSNVMQDFGVQPSLEHYACLVDILGRSGKFDEALSVAENIPMRPSGSIWGSLLNSCRLYGNVALAEVVAERLFEIEPNNPGNYVMLSNIYANAGMWEDVKRVREMMALTGMKKDAGCSWIQIKHKIHTFVAGGSSDFRCSAEYKKIWNELSNAVKNLGYVPNTGVVLHDINEEMKAVWVCEHSERLAAVFALINTGAGMPIRITKNLRVCVDCHSWMKAVSKVTRRLIVLRDTNRFHHFENGSCSCKDYW

SEQ ID NO: 176023 - protein, 364 aa, Glycine max
  Coding DNA Sequence Number=SeqID_59245
  Gene Ontology: Mol. function=transferase activity; Cellular component= cytoplasm; Biological process=spermidine catabolic process to deoxyhypusine, using deoxyhypusine synthase
  Homolog annotation: Hit_ID=Q4QZB4; Match level="QueryCoverage=92%, HitCoverage=98%, E-value=1e-170, Identity=81%"; Hit description =Deoxyhypusine synthase
  Pfam annotation: Domain name=DS; Domain location=69-357; Score=510.2; E_value=2.3e-150; Accession=PF01916.8; Description=Deoxyhypusine synthase
MAQTLKLKTRLSLFCGEKKRETDRTMGEAKGKEEEVLASVHSTVFKESESLDGKCVKIEGYDFNRGVNYPLLLSSMVTTGFQASNLGDAIQVVNQMLDWRLVDEPVAEDCSDQERDLEYRKSVTCKVFLGFTSNLISSGVRDTVRFLLQHRMVDVVVTTTGGIEEDLIKCLAPTYKGDFSLPGAYLRSKGLNRIGNLLVPNDNYCKFEDWIIPIFDQMLGEQNNENNIPVFCPGLTDGSLGDMLYFHSFRNPGLIVDIVQDIRAMNGEAVHASPRKTGMIILGGGLPKHHICNANMMRNGADYAVFINTAQEYDGSDSGARPDEAVSWGKIRDSAQTVKVHCDATIAFPLLVAETFASRVKPHH

SEQ ID NO: 176024 - protein, 114 aa, Glycine max
  Coding DNA Sequence Number=SeqID_59246
  Gene Ontology: Mol. function=caffeoyl-CoA O-methyltransferase activity; Biological process=lignin biosynthetic process
  Homolog annotation: Hit_ID=Q6YI95; Match level="QueryCoverage=80%, HitCoverage=39%, E-value=2e-20, Identity=47%"; Hit description=O -methyltransferase
  Pfam annotation: Domain name=Methyltransf_3; Domain location=1-113; Score=9.2; E_value=3.9e-13; Accession=PF01596.8; Description=O -methyltransferase
MYPLFIPQRIYPPMCWVQPANEGSYDFAFIDADKENYVNYHEKLIKLVKIGGLLVYDNTLWGGRVSWPEDKVPPHFRPGRDAAIEFNKTITNDSRVEFALTSVGDGLNICRRIA

SEQ ID NO: 176025 - protein, 288 aa, Glycine max
  Coding DNA Sequence Number=SeqID_59247
  Gene Ontology: Biological process=protein transport
  Pfam annotation: Domain name=Snf7; Domain location=87-259; Score =183.9; E_value=4e-52; Accession=PF03357.11; Description=Snf7
MFSRMFGKPKQETNAVATLDKLNELYFYISLLVAIRLVTNRHDSCKVSDSSLVDGKKHGWEGRPTKCCQSGFPYLQNYHTSWQNIIAILLSHGSTLEMLEKKEKVLLKKVAAEVEKAKEFTRGKNKRAAIQCLKRKRLYEQQIEQLGNFQLRIHDQMILLEGAKATTETVDALRTGAAAMKAMQKATNIDDVDKTMDEINEQTENMKQIQDALSAPIGAAADFDEDELEAELEELEGAELEEQLLQPATTAPAAPVQVPAGRQPTRPVPAKRTPEEDELAALQAEMAL

SEQ ID NO: 176026 - protein, 172 aa, Glycine max
  Coding DNA Sequence Number=SeqID_59248
MYINLPIYGSFWQKGAILKKFQRSHHAKGLKSVNFKECEAEQGAKFSSFREISEFLSDCEIPRGGGDIPTPLLFYVFTASIYAYCMHACRLITHLCVLLGTLALGNHRQDPNPYQLPTPKKFIAIVAWPEDRPNFQDEAHPTGAQGATQGDEGGAEEDGDMEDLLDFFIGGD

SEQ ID NO: 176027 - protein, 155 aa, Glycine max
  Coding DNA Sequence Number=SeqID_59249
MECSPRRKARVFPAWVCFTRKTHACTKQTASGTSEFVVRDGLAIPNGDITMHGEPPVKLASSSIRGTGGVGSGFSIGRRFGRLKGSRHCHWRVSLNWSCHWQWRVRQINWSCHWYWQVRHMGVANGIDDLESLCTSLIFKLASVCVENFQYFQNF

SEQ ID NO: 176028 - protein, 79 aa, Glycine max
  Coding DNA Sequence Number=SeqID_59250
MEEFDAQVAWPGDQLSSSGGGGASAAQEPDIEEPPAPAPAEEETTPEETQPSTPVVEPERASSTEDGSRQICPKFGGGT

SEQ ID NO: 176029 - protein, 78 aa, Glycine max
  Coding DNA Sequence Number=SeqID_59251
  Gene Ontology: Mol. function=ribonuclease H activity; Biological process=DNA integration
  Homolog annotation: Hit_ID=Q1SYR3; Match level="QueryCoverage=97%, HitCoverage=3%, E-value=1e-25, Identity=68%"; Hit description=RNase H, putative
MKNAFDKKVRSRKFHEGDLVLKKVSHAVKDNRGKWAPNYEGPFVVKRVFSEGALVLTNMDGEELPSPINSDVVKRYYA

SEQ ID NO: 176030 - protein, 91 aa, Glycine max
  Coding DNA Sequence Number=SeqID_59252
MKVKKRLSFELQKVEVGLSSVVPSARLCSRLALSPISFTRAKREGGTKCNTVISKPILCRIRVHNTQGIDSTSAIVPISHRAKRSSLCIEA

SEQ ID NO: 176031 - protein, 58 aa, Glycine max
  Coding DNA Sequence Number=SeqID_59253
MKTVQVEASIPAPSLLRLRTLSEQSEEKLEESQETARNAAVTVERHVSLLRGVLVPKL

SEQ ID NO: 176032 - protein, 880 aa, Glycine max
  Coding DNA Sequence Number=SeqID_59254
  Gene Ontology: Mol. function=protein serine/threonine kinase activity; Cellular component=integral to membrane; Biological process=protein amino acid phosphorylation
  Homolog annotation: Hit_ID=Q9M0D8; Match level="QueryCoverage=92%, HitCoverage=96%, E-value=0.0, Identity=48%"; Hit description =Serine/threonine-specific receptor protein kinase-like protein
  Pfam annotation: Domain name=LRR_1; Domain location=416-438; Score =6.7; E_value=16; Accession=PF00560.23; Description=Leucine Rich Repeat
  Pfam annotation: Domain name=LRR_1; Domain location=440-462; Score =16.8; E_value=0.076; Accession=PF00560.23; Description=Leucine Rich Repeat
  Pfam annotation: Domain name=LRR_1; Domain location=464-487; Score =11.0; E_value=2.5; Accession=PF00560.23; Description=Leucine Rich Repeat
  Pfam annotation: Domain name=Pkinase; Domain location=573-837; Score =93.3; E_value=7.4e-25; Accession=PF00069.15; Description=Protein kinase domain
  Pfam annotation: Domain name=Pkinase_Tyr; Domain location=571-833; Score=62.7; E_value=2.6e-16; Accession=PF07714.7; Description =Protein tyrosine kinase
  Pfam module annotation: Pfam domain module=LRR_1::LRR_1::LRR _1::Pkinase::Pkinase_Tyr; Domain location=416-438::440-462::464 -487::573-837::571-833
MASSIGCILLLTLCVVLVALVHAQQQIGFISIDCGSSPPNNEYTDDITKIRYTTDGAYIQTGVNKNISSEYAYPKNPNLPLPLSDLRSFPQGERNCYRLVAGRRGSLHLIRASFLYGNYDGVNKPPEFDLYVDVKFWSTVKFRNASEEVTMEIISVAESGVTHVCLVNKGAGTPFISGLELRPLNSSIYSTEFGESASLSLFKRWDIGSLNGSGRYEDDIYDRIWSPFNSSSWESVSTSTPINVNDDGFRPPFEVIRTAARPRNGSDTLEFSWTPDDPSWKFYVYLYFAEVEQLEKTQLRKFNISWNGSPLFDDSLVPRHLFATTLSNSKSLVANEHRISIHKTKDSTLPPILNAVEIFVARQLDALATFEQDVDAILSIKESYRIQRNWVGDPCEPKNYSWEGLKCNYSTSLPPRIISLNMSSSSLSGIITSAISNLSSLESLDLHNNSLTGTMPQFLEELKSLKYLDLKDNQFSGSVPTILVERSRDGLLTLRVDDQNLGDSGGNNKTKEIVIPIVVSVSVLVIVVAFILFWKLRRNERSDEEISTLSKGGTTVTTKNWQYSYSEVLDITNNFEMAIGKGGFGTVYCGKMKDGKQVAVKMLSPSSSQGPKEFQTEAELLMTVHHKNLVSFVGYCDNDNKMALIYEYMANGSVKDFILLSGLDYLHHGCKPPIIHRDVKSANILLSEDLEAKIADFGLSREFRTDNQDQQSQVIHSDATNEKSAVMGTTGYLDPEYYKLGTLNEKSDIYSFGIVLLELLTGRPAILKGNGIMHILEWIRPELERQDLSKIIDPRLQGKFDASSGWKALGIAMACSTSTSTQRPTMSVVIAELKQCLKLESPSDTSEKFVAPPKQVYGEFYSSSEAFSYDSQSITYPFPR

SEQ ID NO: 176033 - protein, 176 aa, Glycine max
  Coding DNA Sequence Number=SeqID_59255
  Gene Ontology: Mol. function=DNA binding; Cellular component=nucleus; Biological process=regulation of transcription
  Homolog annotation: Hit_ID=Q09GS3; Match level="QueryCoverage=96%, HitCoverage=65%, E-value=2e-61, Identity=77%"; Hit description =Transcription factor MYBJ6
  Subcellular localization annotation: CTP_CleavageSite=34; ConfidenceScore=5.30e-01
MTQVGWSLIAAQLPGRTDNDVKNHWNTKLKKKFLAGNTSSSIATTSNNIVTFSNTSYSHQVEGLVLDQKLNPANWFDSYDVNFELEQTPIPVPFPMPQELEAFNYTGSISCSTAPPPYKEVSLMLSNADKHTLWFGYDQASEDDPNLLEFVLDDLHQMNQGFVFQDKSSQVGPPSG

SEQ ID NO: 176034 - protein, 140 aa, Glycine max
  Coding DNA Sequence Number=SeqID_59256
  Gene Ontology: Biological process=protein transport
  Pfam annotation: Domain name=Snf7; Domain location=1-119; Score=-0.6; E_value=0.00021; Accession=PF03357.11; Description=Snf7
MTERSSDATVAAIQCLMREKLYENHIEQLRNFQMRIHDQMIMLEGAKATTKMIDALRTGATAMKAMQKAMKFDVVDKIMDEINEQTQNKRMIQETLSAPTGSTAYFDNVSVGRQPTRVVPVKATVLEEDELAALQAELAL

SEQ ID NO: 176035 - protein, 99 aa, Glycine max
  Coding DNA Sequence Number=SeqID_59257
MEAIKEQMATMMKTMMSMKKIMEANAVIVATISAVAKVNPMLPSGLKQMNHPTSNMVGKDLGNTDNPMMCKIKTSTPSHHMACLPNYTPPNVVYIPNED

SEQ ID NO: 176036 - protein, 118 aa, Glycine max
  Coding DNA Sequence Number=SeqID_59258
MAEEAILPMVTLEDHATYTGPLHFKTIARPDFTNMVQRLTRERLLYPSSKKLMMKSLGEDWQRFRYLLRQTPTRGFDEALQINMLLGGLRVQSKLMLDASVGGKISLKTPREAIEIDH

SEQ ID NO: 176037 - protein, 409 aa, Glycine max
  Coding DNA Sequence Number=SeqID_59259
  Gene Ontology: Mol. function=protein serine/threonine kinase activity; Cellular component=integral to membrane; Biological process=protein amino acid phosphorylation
  Homolog annotation: Hit_ID=Q1S6S4; Match level="QueryCoverage=93%, HitCoverage=38%, E-value=1e-117, Identity=56%"; Hit description =Protein kinase; Adipokinetic hormone
  Pfam annotation: Domain name=LRR_1; Domain location=105-127; Score =6.6; E_value=17; Accession=PF00560.23; Description=Leucine Rich Repeat
  Pfam annotation: Domain name=LRR_1; Domain location=129-151; Score =14.9; E_value=0.3; Accession=PF00560.23; Description=Leucine Rich Repeat
  Pfam annotation: Domain name=LRR_1; Domain location=199-220; Score =13.0; E_value=1.1; Accession=PF00560.23; Description=Leucine Rich Repeat
  Pfam annotation: Domain name=LRR_1; Domain location=222-242; Score =8.5; E_value=7.4; Accession=PF00560.23; Description=Leucine Rich Repeat
  Pfam annotation: Domain name=LRR_1; Domain location=245-267; Score =21.0; E_value=0.0044; Accession=PF00560.23; Description=Leucine Rich Repeat
  Pfam annotation: Domain name=LRR_1; Domain location=269-292; Score =6.4; E_value=18; Accession=PF00560.23; Description=Leucine Rich Repeat
  Pfam annotation: Domain name=LRR_1; Domain location=57-79; Score =14.8; E_value=0.31; Accession=PF00560.23; Description=Leucine Rich Repeat
  Pfam annotation: Domain name=LRR_1; Domain location=81-103; Score =9.3; E_value=5.2; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=105-127::129-151::199- 220::222-242::245-267::269-292::57-79::81-103
MAVVSPNLLTNSNILKLKPACYYFLPLIMLLICILERDFMWNNISGSIPKEIGNIKTLRLLLLNGNKLTGDLPEELGQLSVLNRIQIDENNITGSIPLSFANLNRTEHIHMNNNSLSGQILPELFQLGSLVHLLLDNNNFTGYLPPEFSEMPSLRILLCIDHLASLWLALPLKPPRNSQLDNNDFGGNSIPESYGNISKLSKLSLRNCNLQGPIPDFSRIPHLAYLDLSFNQLNESIPTNKLSDNITTIDLSNNKLTGTIPSSFSGLPRLQKLSFANNSLSGYVPSTIWQDRSLNGTERLILDMQNNQLTIISGTTNLPPNVTLLLEGNPVCTNNNTLVQFCGPEIDNGLNGNYSVNCPSQECPSPYEYTVECFCVAPLVVHYRLKSPGFSDFRTYERTFESFLTDGLN

SEQ ID NO: 176038 - protein, 206 aa, Glycine max
  Coding DNA Sequence Number=SeqID_59260
  Gene Ontology: Mol. function=DNA binding
  Homolog annotation: Hit_ID=Q1SFS3; Match level="QueryCoverage=74%, HitCoverage=29%, E-value=4e-18, Identity=33%"; Hit description =Lambda repressor-like, DNA-binding
MAEVSIEAIASLTQYYDQPLRCFTFGDFQLTPTVEEFEEILECPLGGRKPYPFSGFYPSLSRISKIVKISTQELDRGKQVENGVVRVPRKCLEAKARVLASQGECALFMDILALLIFGVVLFPNVDGLVDRAVIDAFLAFYDRKESPIVAILADLYDTFHRRCEKNNQTKKKRLSIGSPYTQDLDWLPSLRTTKGVEVEAPEEDEE

SEQ ID NO: 176039 - protein, 132 aa, Glycine max
  Coding DNA Sequence Number=SeqID_59261
AINSRGSRLDGGGRMNNARQSIHRSPNKIENGELANSARQSIRGAPDSMAINSRGSRLDGGGRMNNTRQSIHGSPNKIVGRTEQSTEEAECFGLFLLCGAGYRQSRKAIRKEETPKNGLPLPAVTYLADNSS

SEQ ID NO: 176040 - protein, 205 aa, Glycine max
  Coding DNA Sequence Number=SeqID_59262
  Gene Ontology: Mol. function=transcriptional repressor activity; Biological process=regulation of nitrogen utilization
  Homolog annotation: Hit_ID=UPI00005FA7D9; Match level="QueryCoverage =80%, HitCoverage=93%, E-value=3e-56, Identity=63%"; Hit description =COG1986: Uncharacterized conserved protein
  Pfam annotation: Domain name=DUF84; Domain location=40-203; Score =240.0; E_value=5.2e-69; Accession=PF01931.8; Description=Protein of unknown function DUF84
RRQAVERTLLQTAHIELAQAGIERHRTTAGISDNLRGAPATINPAKIRAIAQAFNDVFGEGSCHIEGVEVESGVAAQPLSDAETRTGARQRVANARHVRPQADYWVAIEAGIEGDCAFAWMVVENAQQRGESRSASFTLPPVVMAGLAAGHELGDEMARLTGVENIKHKGGAIGAFSHGLLSRSSVYHQALILALCPFTHPLYQQ

SEQ ID NO: 176041 - protein, 129 aa, Glycine max
  Coding DNA Sequence Number=SeqID_59263
  Subcellular localization annotation: CTP_CleavageSite=53; ConfidenceScore=5.64e-01
MDASLVNSPKARQTQGPPLVSFIGSQNPRSILGKPRCSSTCLSKPKANTTLVQSSLNESNTRISKTQGPPLVSTRTKPKAPNWSAHSLRTTMTTIKGPGSTRRTITTMVSKTFNQVKVILTPYNRGKAQ

SEQ ID NO: 176042 - protein, 197 aa, Glycine max
  Coding DNA Sequence Number=SeqID_59264
  Gene Ontology: Mol. function=RNA-directed DNA polymerase activity; Biological process=RNA-dependent DNA replication
MVACSCIRDNHGMTRTRDMVVCSCISVTCGMARTRDVVSYSFIHVTRGVARTRDVLGPSFPAQGSFLASPRTRHTRLLGRKGPKDDFVGCLCLTVGLRMLDRGPLAVWPQYVHSLHGKGPMGAQTVEIVRRGAWNVCKLLASPASLCEVKGVYTECWPIVANMHHLYCKGSSNCMETANSFVEFFHDIICLLALQAL

SEQ ID NO: 176043 - protein, 71 aa, Glycine max
  Coding DNA Sequence Number=SeqID_59265
MSKRCYDRYLPSWVHNIAREHFLDVFRNLLYLSNHFCNLPVDGRVRRKVKVCLLMKKNAWELLPTFIRGKI

SEQ ID NO: 176044 - protein, 205 aa, Glycine max
  Coding DNA Sequence Number=SeqID_59266
  Gene Ontology: Mol. function=nucleotide-sugar transporter activity; Cellular component=integral to membrane; Biological process =nucleotide-sugar transport
  Homolog annotation: Hit_ID=Q6ZL17; Match level="QueryCoverage=91%, HitCoverage=48%, E-value=2e-63, Identity=76%"; Hit description =Putative CMP-sialic acid transporter
  Pfam annotation: Domain name=Nuc_sug_transp; Domain location=17-175; Score=-90.1; E_value=1.7e-07; Accession=PF04142.6; Description =Nucleotide-sugar transporter
MVLQGQWVHLIFPVVFRLTTTLDEVIVYPIPAALYLVKNLLQYYIFAYVDAPGYQILKNFNIISTGVLYRIILKKNSDRVLQTPFQGWVMAIVMALLSGFAGVYTEAIIKKRPSRNINVQNFWLYVFGMCFNAVAILVQDFDAVMNKKTCVSLGGALSRTSLLLAFTIGRKKSSVSRPATRSYAKGILPWIFIHYSSDDFQPCTQ

SEQ ID NO: 176045 - protein, 117 aa, Glycine max
  Coding DNA Sequence Number=SeqID_59267
MSIYHETQSDIRVKSYCHRNLLRASVQNFECLDILRDSIGHPSKKASVFNYECLEILRDSFGHSSKRASVFNYECLDILRDSFGHPCKKILSFYFGQSFCSEFRASQYTTGHNGKSE

SEQ ID NO: 176046 - protein, 234 aa, Glycine max
  Coding DNA Sequence Number=SeqID_59268
MKSHKSTLMEMNVMNVKIVQKNPSNEHVGEEQTITLTTNQACSLSGSTIEFDSHLHKNTSPRRHWIQFNESRQVQSPSITKKREKEIMSSMGESQQRSLFGSTKASSLPVSTSRSDSEGGLRRRLSSLSLKIQLESPNSSSWSFPRSKSLSSMGDYARTWWDWSWAWILSRKLIFATDLEMNDQETKLLASHNRGTWRHVFYKLRSEIRRFINTSDHTTLPKTYHHKSTPQVFS

SEQ ID NO: 176047 - protein, 139 aa, Glycine max
  Coding DNA Sequence Number=SeqID_59269
  Gene Ontology: Mol. function=ionotropic glutamate receptor activity; Cellular component=membrane; Biological process=ion transport
  Homolog annotation: Hit_ID=Q9SES5; Match level="QueryCoverage=73%, HitCoverage=11%, E-value=5e-24, Identity=54%"; Hit description =Ligand gated channel-like protein
MGLRFWGINLLREAASCLSKHHCLLIQPPLQPMLLNGTVSFSNNTYLSGTKKETLDFGALSVFDGGKQLLDNILSIDMSGLTGPIQFGSDRSPLNPSCVILNVIATGYRGIGYWSNYSGLSVITPEKLHPKPANHSISS

SEQ ID NO: 176048 - protein, 870 aa, Glycine max
  Coding DNA Sequence Number=SeqID_59270
  Gene Ontology: Mol. function=RNA-directed DNA polymerase activity; Cellular component=chromatin; Biological process=chromatin assembly or disassembly
  Homolog annotation: Hit_ID=Q1SAV4; Match level="QueryCoverage=33%, HitCoverage=86%, E-value=6e-76, Identity=44%"; Hit description =Integrase, catalytic region
  Pfam annotation: Domain name=rve; Domain location=532-688; Score =81.9; E_value=1.9e-21; Accession=PF00665.16; Description=Integrase core domain
  Pfam module annotation: Pfam domain module=Retrotrans_gag::rve; Domain location=104-194::532-688
MANSTPPEPPLKLEEILTRLSIQQLSLGEKLDALLTHINPHHNPVSPVPSPNPIIPQPQPSSPAHSHKFKLDVPLFDGTNPNGWIFKINQFFDYHQTPPQERLTIASFYMEGRALAWFQWMQSNGQLTSWPVFLQALQLRFAQSPYDDPTGALFKLTQQGSVSTYLFEFEELANRVVGLPQAFLLTCFVAGLSPEIRREVQILQPLTLAQAAGLARIQEEKFLEQHHASRPRPSPVTTTPTLPSSSSFPRTHTAAPQPLTPNSNTLSPPFPPPLHPPPPTTKRLSPEEITSRREKGLCFTCDEKYHRDTTFQVEYLGHIVSHKGVEPVAAKVAAIQQWLVPKSTKALRSFLGLAGFYRSAFDNLKLSLSTTPVLTLPNFDIPFTLESDASGAGMGAVLTQNGHPIAFFSKPFSPKLLRSSTYVRELCAITTVIQTPEQHMYLARLMGYDYDIQYRSGSSNQVADALSRLPEPPATLHMILSVPSLTFLEELRHQLDTNDDYCRKQLANTHKLTHRISCNSYWGPPRPWLAYRRISTDLDLSLDFIVGLLAYQGNTVILVVVDRFSKGIHLGMLPTSYTAHMVASLFINIVVKLHGLPRSLVSDRDPLFISRFWQELFRLSGTLLRMSSAYHPQSDGQTEMLNRVIEQYLRAFVHRRPGLWGKLLPWVEWSHNSSWSVSTGSTPYEITYGRKPFSFPECIVSSSNIAAVDDMLAERDTTFQAIRRKLIKAQENMKKYADTKRRDITHQILERIGDVAYRLELPEGVRIHPVLHCSVLKAFQGSPDSVPQVQLPPEAINGQPLVVPLAILDHHRSSTDVDAPWEGWGSVSISEATSRTPGNRDTKQKKVQEVQIAKKPKRKVTRPAYLKDYA

SEQ ID NO: 176049 - protein, 256 aa, Glycine max
  Coding DNA Sequence Number=SeqID_59271
  Gene Ontology: Mol. function=ionotropic glutamate receptor activity; Cellular component=integral to membrane; Biological process=ion transport
  Homolog annotation: Hit_ID=Q93YT1; Match level="QueryCoverage=88%, HitCoverage=28%, E-value=3e-65, Identity=55%"; Hit description =Glutamate receptor 3.2 precursor
  Pfam annotation: Domain name=Lig_chan; Domain location=3-206; Score =45.8; E_value=6.8e-14; Accession=PF00060.17; Description=Ligand -gated ion channel
MSLGVAEGTYSYSSLKQISFFIIVSGENTVSSLGRVELIIWLFVVLIINSSYTASLTSILTVQQLCSPITRIDSLIFSSERIGFQVGSFAANYLTEQLNIPKHRLIPLGSSEEYAVAFQSRTLATVVDERPYAFPRDSPLAIDMTTAILTLSENAELQRIQEKWLSEKACGFHSTEEEQLQLNSFRGLFLICEITCFLALLTYFFLSMVRQFSKKSPQKVGPSNRCSSRSAHIQTFLHFVDEKEDVSPKKLKRKLV

SEQ ID NO: 176050 - protein, 711 aa, Glycine max
  Coding DNA Sequence Number=SeqID_59272
  Gene Ontology: Mol. function=sugar porter activity; Cellular component=integral to membrane; Biological process=carbohydrate transport
  Homolog annotation: Hit_ID=Q1T5Y7; Match level="QueryCoverage=96%, HitCoverage=97%, E-value=0.0, Identity=79%"; Hit description=Sugar transporter superfamily; Major facilitator superfamily MFS_1
  Pfam annotation: Domain name=MFS_1; Domain location=13-655; Score =106.0; E_value=1.1e-28; Accession=PF07690.6; Description=Major Facilitator Superfamily
  Pfam annotation: Domain name=Sugar_tr; Domain location=9-696; Score =206.8; E_value=5.1e-59; Accession=PF00083.14; Description=Sugar (and other) transporter
  Pfam module annotation: Pfam domain module=MFS_1::Sugar_tr; Domain location=13-655::9-696
MSGAGAVLVAVAAAIGNLLQGWDNATIAGSILYIKREFNLQSEPTIEGLIVAMSLIGATVVTTCSGPLSDFLGRRPMLIISSVLYFASSLVMLWSPNVYILLFARLLDGLGIGLAVTLVPLYISETAPPEIRGLLNTLPQFTGSAGMFFSYCMVFAMSLTKAPNWRLMLGVLSIPSLIYFALTLFFLPESPRWLVSKGRMLEAKKVLQRLRGRQDVAGEMALLVEGLGVGRDTAIEEYIIGPAVNEFSEAEQIKLYGTAEGVSWIAKPVTGQSSIGLVSRKGSMANQSGLVDPLVKLFGSVHEKLPETGSMRSALFPHFGSMFSVGGNQPRNEDWDEESIARDGEGDDYVSDANEDSDDNLQSPLISRQATSVDRDMPAPGQGSSMIGGGWQLAWKWSETEGVFKRIYLHQEGGPTGSSRRGSLISLPGGDGDGEIVQVAALVSQSALYNKELMHQQPVGPAMIHPSQTSAKGPSWSDLFEPGVKHALIVGVGIQILQQFSGINGVLYYTPQILEQAGVGYLLSNLGLGSTSASFLISSVTTLLMLPCIAVAMRLMDISGRRTLLLTTIPVLIVSLLILVIGSLVELDSTINAFISTSSVIVYFCCFVMGFGPIPNILCSEIFPTRVRGLCIAICALTFWICDIIVTYTLPVMLNSVGLGGVFGMYAVVCIIAWVFVFLKVPETKGMPLEVIIEFFSVGAKQAQVANNINT

SEQ ID NO: 176051 - protein, 1736 aa, Glycine max
  Coding DNA Sequence Number=SeqID_59273
  Gene Ontology: Mol. function=RNA-directed DNA polymerase activity; Cellular component=chromatin; Biological process=chromatin assembly or disassembly
  Pfam annotation: Domain name=Chromo; Domain location=1447-1501; Score= 45.6; E_value=1.7e-10; Accession=PF00385.14; Description='chromo' (CHRromatin Organisation MOdifier
  Pfam annotation: Domain name=RVP_2; Domain location=390-504; Score= -27.4; E_value=0.00014; Accession=PF08284.2; Description=Retroviral aspartyl protease
  Pfam annotation: Domain name=RnaseH; Domain location=889-1009; Score=- 25.2; E_value=0.013; Accession=PF00075.14; Description=RNase H
  Pfam annotation: Domain name=rve; Domain location=1144-1300; Score =131.7; E_value=2.1e-36; Accession=PF00665.16; Description=Integrase core domain
  Pfam annotation: Domain name=zf-CCHC; Domain location=327-344; Score =14.4; E_value=0.0042; Accession=PF00098.13; Description=Zinc knuckle
  Pfam annotation: Domain name=zf-H2C2; Domain location=1085-1126; Score=19.2; E_value=0.001; Accession=PF09337.1; Description=His(2) -Cys(2) zinc finger
  Pfam module annotation: Pfam domain module=Chromo::RVP_2::RVT _1::Retrotrans_gag::RnaseH::rve::zf-CCHC::zf-H2C2; Domain location =1447-1501::390-504::631-800::122-212::889-1009::1144-1300::327 -344::1085-1126
MDARVASLEEEIAGVKTTLSSMERNQALLISMMEKSLGKSILTEEEGEDGDGGLAESGGDGSGKKTASSASRKMPSDVISEFRQSAKRVELPMFDGEDPVGWISRAEVYFRVQDTTPAVKVDLTQLCMEGPTIHFFNSLLNEEEELTWERLKGALVERYGGHGEGDVYEQLTALRQVGTVDEYITEFEYLTAQIPPLPDKQFSGYFLHGLKADIKGKVRSLLAVGNLSRGKLLQVTRVVEREVRGDAGTGISKHPKSGHGSSKPGFGGSSKGGGADWVMVKGKENGPSGGSKGGGFGSRSEKGRNGPRDRGFSHLSYNELLERKQKGLCFKCGGPFHPKHQCPDKHLRVLITEEEETEEGGGKLLAVEVEDEEGGSEGEMSILSLLQLGQLGTDKPQSIQLKGAVNGVPVVILVDSGATHNFIDKRLVQKMSWAVDNSTSMCIKLGDGTKAQSIGVCPDLGVEVGEVQLAIRAHLFDLGGVDIVLGVDWLRTLGDIIMNWNKHTMSFWHNKKWVTLQGLNDNMETLNSIVGGTNRGGKGWMWSIEKKRGDENDLNIGQQKELEGLLSKYEDIFKEPRGLPPRRKKEHAINLKGGLEAVNVRPYRYPHHHKNEIEKQVKELLAAGVIRPSTSSFSSPVILVKKKDGSWRMCIDYRALNKATIPDKFPIPVIEELLDELHGATIFSKLDLKSGYHQVRVHEEDIHKTAFRTHEGHYEFLVMPFGLMNAPSTFQSLMNEVFRVHLRKFVLVFFDDILVYSRDWTTHLCHLEEVLRVLKLHGLVANKKKCHFAQKSVDYLGHVISGKGVAVDPNKVESVVKWPTPKNVKGVRGFLGLTGYYRKFIRNYGKVARPLTALTKKDAFTWNEETHKAFEALKESLTTAPVLALPDFTKEFIIECDASGVGIGAILIQEKRPIAYFSKALGVRNVAKSAYEKELMAVGLAIQHWRPYLLGRRFTVSTDQKSLKQLLQQKIVTVEQQNWAAKLLGFDFNIVYKPGKLNGGADALSRVHEGGEVCVMTSSLQWKDADILREEFAQDPHLQKIVNDLQQNKDSRPGFEFKQGVLLYDGRLVISSKSVLIPTLLKEFHETSQGGHSGFYRTYRRLAVNVYWVGMKNVVQEFVRSCDVCQRQKYLASSPGGLLQPLPIPDRIWEDISMDFITGLPKSKGFEAILVVVDRLSKYCHFIALKHPYTARTIAEVFVKEIVRLHGVPLSIVSDRDPIFMSNFWREMFKLQGTKLKMSSAYHPESDGQTEVVNRCLETYLRCFIADQPKTWVHWVPWAEYWFNTTYHASTGKTPFEVVYGRTPPTIIRWIQGEVRVEAVQKELLDRDEAIKQLKVHLLRAQDRMKQFADKKRCDRSFSIGEWVFVKLRAHRQKSVVSRICPKLAAKYFGPYPVVSRIGAVAYQLKLPEDSRVHPVFHVSLLKKAVGSYNGEETLPDDLDGEKDNTFEPDTVLAQRTVQVQGEEVRQVLVQWKGRNIEEATWEEAVMMTSQFPNFSLEDKAVISDGGVVRNEGNNGGPSGTMEPNESLLNHEVGPREWKVYSRREKRVTKGDHGGVQSVFSGDKNFDEPNWGTFDTNDDIDSVWGFNASSFTKEERELDRAGNNYFFDSGELGLNPIKTGSPQAGDPFQRSSGFSFDDSVPSTPLFSSSSSPQRPKEWLETAFDFSRFDSFRTHDSVPLPARETTEQFDSVRNSADFDHAHGFPAFDDSDPFGSGPFRTSSDNQTPRRGSDNWSAF

SEQ ID NO: 176052 - protein, 217 aa, Glycine max
  Coding DNA Sequence Number=SeqID_59274
  Gene Ontology: Mol. function=calcium ion binding
  Homolog annotation: Hit_ID=Q1SL41; Match level="QueryCoverage=66%, HitCoverage=20%, E-value=4e-29, Identity=52%"; Hit description=EPS15 homology
MGIFSLEVIVVPQPFILPETDVGPPSHPPFKVINKAVVVLLLKDDLQILPPLRSWQPGIQEGAADWDEDWDKLEDKELTLDVQNIIAPPKQKLLSAVNTKALNTEALNTEAVNTDSPTFAASPKSDDKSKKPQTTNEQGVGNGSVYNKSEDGSVKSAPNSPFASSAIGSPHGDFDSNIRKTAGEDSSPRDQDTIQETQRYGFLDLFTSFPNAGQVLI

SEQ ID NO: 176053 - protein, 145 aa, Glycine max
  Coding DNA Sequence Number=SeqID_59275
  Homolog annotation: Hit_ID=Q9XEE0; Match level="QueryCoverage=40%, HitCoverage=18%, E-value=8e-07, Identity=50%"; Hit description =Homoserine kinase
MEPCPFLRLTIDQPCTQNSRGFQNAHCCSSFFFSMLMQTQAQELYLNVKVEPNLDFQEYNRFCYFGRETPTHPQELRWRRRRKHGGCQEGCHSGWWFWLVAVIDNEQTGHLIAQHMIHSFLKDGYLKASANLKQLDRLGSRRILN

SEQ ID NO: 176054 - protein, 107 aa, Glycine max
  Coding DNA Sequence Number=SeqID_59276
MVVLTGDKGGESLPGKDNDDKGSTSMIVEDGDHCGDGMVGGIGLAMESIRVIMMGNIDIRRIMEASRCDAMVCEMMKSRYILLVIWVDEACGRGLPMRSSEYWNPCL

SEQ ID NO: 176055 - protein, 338 aa, Glycine max
  Coding DNA Sequence Number=SeqID_59277
  Gene Ontology: Mol. function=protein serine/threonine kinase activity; Cellular component=integral to membrane; Biological process=protein amino acid phosphorylation
  Homolog annotation: Hit_ID=Q1S6S4; Match level="QueryCoverage=99%, HitCoverage=35%, E-value=1e-131, Identity=69%"; Hit description =Protein kinase; Adipokinetic hormone
  Pfam annotation: Domain name=Pkinase; Domain location=8-280; Score =150.5; E_value=4.4e-42; Accession=PF00069.15; Description=Protein kinase domain
  Pfam annotation: Domain name=Pkinase_Tyr; Domain location=8-277; Score=142.7; E_value=1e-39; Accession=PF07714.7; Description=Protein tyrosine kinase
  Pfam module annotation: Pfam domain module=Pkinase::Pkinase_Tyr; Domain location=8-280::8-277
MALASNNFSESAQIGEGGYGKVYKGHLPDGTVVAIKRAQEGSLQGEREFLTEIELLSRLHHRNLLSLIGYCDQGGEQMLVYEYMPNGALRNHLSANSKEPLSFSMRLKIALGSAKGLLYLHTEANPPIFHRDVKASNILLDSRYTAKVADFGLSRLAPVPDIEGNVPGHVSTVVKGTPGYLDPEYFLTYKLTDKSDVYSLGVVFLELVTGRPPIFHGENIIRHVYVAYQSGGISLVVDKRIESYPSEYAEKFLTLALKCCKDEPDERPKMSEVARELEYICSMLPEYDTKGAEYDTSNYSGTVCSSQPSSSTIKTPFISEDVSGSDLVSGGMPTIRPR

SEQ ID NO: 176056 - protein, 83 aa, Glycine max
  Coding DNA Sequence Number=SeqID_59278
MDQLQGQAFRKAYVKIWDLAMIEVFVEAIASLTQYYDQLLRVVLFPNMDGLLDLAAIDAFLAYHHSKESMVVAILANAYDTFD

SEQ ID NO: 176057 - protein, 54 aa, Glycine max
  Coding DNA Sequence Number=SeqID_59279
MIDGGVDAKRVVGAEEVETAVSRLRRKGLDFGYYLHREKESGAASQLLHMFLSA

SEQ ID NO: 176058 - protein, 66 aa, Glycine max
  Coding DNA Sequence Number=SeqID_59280
MEGLSLANDEDGLTFDIEGEQGNLEDVKLCMVGRLVIDKSILAHNMKERLATLSCLVMGVSIIEVA

SEQ ID NO: 176059 - protein, 392 aa, Glycine max
  Coding DNA Sequence Number=SeqID_59281
  Gene Ontology: Mol. function=cation transporter activity; Cellular component=membrane; Biological process=cation transport
  Homolog annotation: Hit_ID=Q1S6S2; Match level="QueryCoverage=97%, HitCoverage=99%, E-value=1e-153, Identity=71%"; Hit description =Cation efflux protein
  Pfam annotation: Domain name=Cation_efflux; Domain location=103-370; Score=165.8; E_value=1.1e-46; Accession=PF01545.11; Description =Cation efflux family
  Pfam annotation: Domain name=ER_lumen_recept; Domain location=101 -272; Score=-147.4; E_value=0.071; Accession=PF00810.9; Description =ER lumen protein retaining receptor
  Pfam module annotation: Pfam domain module=Cation_efflux::ER_lumen _recept; Domain location=103-370::101-272
MDENWGSRALLGNQNHDGNSFNSDKVRSGLHSESPFQFDHQVSSTSHLIKSRSLSDFSLEREKEYYERQFATLKSFEEVDSIATSDCADVEDIGKQAEHELAMKISNYANAALLALKIYVTIRSGSIAVAASTLDSLLDFMAGGILWFTHLAMKEINMYKYPIGKLRVQPVGIIIFAAVMATLGFQVLVTAVQQLIENNPPEKMSVDQLVWLYSIMIFATVVKLALWLYCRSSGNKIVRAYADDHHFDVVTNVIGLVAAVLGDKFYWWIDPVGSILLSIYTITNWSGTVMENAVSLVGQCAPPEVLQKLTYLVRAYTFGVLYFVKVDIELPEDLPLKEAHAIGESLQIKLEKLPEVARAFVHLDFECDHKPEHSVLTKLPDHKSDHKPEQLL

SEQ ID NO: 176060 - protein, 501 aa, Glycine max
  Coding DNA Sequence Number=SeqID_59282
  Gene Ontology: Mol. function=RNA-directed DNA polymerase activity; Cellular component=chromatin; Biological process=chromatin assembly or disassembly
MAVVSAKSNFRDVTEIHMNLVIALEQIQLREATSSPQFIQKLINNGNWKSVLNGPFATLFQLGFQSLVSGSGGNSKGVHLPAWPGEGGEFDGLCLVMGVEFVGAQKALAHGGTGFQVGGDRDYGIAKKRVNSRTGPRDFNHWTPKMTFAPAMVRDELQLDEVVGTPTIHQEDHGVVIDEAHEAESFQRHVTSQGVKTDLGRVWVIRQGFVLLCNEEKYPRGATMPSVVFLIAGGGNSGGLGTEQRGVGEVVTAGGGGWEGYGRQGASPPGAGQGLPLGRALRAGRLCNLQGPQSQRGIAPPYLAEEQSGSATLEGTPTMNCMIFKKLGDLKDPTQGISPIKTRDIEFDFVCNYRCSGGGAGEGDGELVRDSILKGGRDFGWISYGNESTKMIGILREVWFSRNQGPPETKRRKGNFLIFIDDAQPIRSIIPQDCRIFQNHSSDVISQGDITVLSIDDDVAAKHLGQAHFDGEKGLFGLVRREDTRRKALLLCGEDEQCPWQ

SEQ ID NO: 176061 - protein, 721 aa, Glycine max
  Coding DNA Sequence Number=SeqID_59283
  Gene Ontology: Mol. function=RNA-directed DNA polymerase activity; Cellular component=chromatin; Biological process=chromatin assembly or disassembly
  Pfam annotation: Domain name=rve; Domain location=316-442; Score =23.6; E_value=6.4e-05; Accession=PF00665.16; Description=Integrase core domain
  Pfam annotation: Domain name=zf-H2C2; Domain location=257-298; Score =18.5; E_value=0.0013; Accession=PF09337.1; Description=His(2)-Cys(2) zinc finger
  Pfam module annotation: Pfam domain module=rve::zf-H2C2; Domain location=316-442::257-298
MPFGLCNATSSFQATMNALFRPYLRRFVIIFFNDILVYNGSLAEHLTYLEVAFQVEYLGHVVSHEGVKPVASKGCSQLLRTCRLLSAFHQRLCHHCCTPGPPYYTGTFCSPSAPVLALPDFDLLFTVETDAFDLFAITTAFKKWRQYLLGHHFIIITNHRSLKELLTQVIQTPEQHTNLTRARPFFSNDPVPCLTFMEELRRQLEACAAYVMHHRDISQSPEAHPEFTIANNLILHQKRIWLPRDFQMIPTPLTEFHSSPTGGHMGVAKTFARISDNFSWPGLWNDVTKFIAQCVDCQLTKYETKKSVGLLCPLLVPQRPWEDLSLDFIMGLPLYHGNSVILVVVDQFSKGIHLGMLPAAHTAHTVASMFMEIVGKIHGLPRSLHPQSDGQTEVMNRIIEQYLRAFVHRRPKTWGKLLLWVEWSHNTSWNVATGTTPYEITFGHKPFNFPNYITGSSKLDAVEDMLKDRDDTFQVIRKKLLKAQATMKRFADTKRREVMYEPGDWVLLKLRPCWQTSAKGVSEVQGKLSKRFYGPFKVIERIGPVAYRLQLPEGARIHPVFHCSVLKPFQGTPELEVAAQLPDHFLQDQPIISPLAILDYRRSTSTDPWQVLVQWNGLLPNDTSWEDGKNYRRIITLRTRMILEDSTILRDDAAYRLPENLTTHVRRKTSDAREMQTFYGQYYEKYIQALDKAADKGLKEVNRTEYIPVSDEIMEAHIKVD

SEQ ID NO: 176062 - protein, 156 aa, Glycine max
  Coding DNA Sequence Number=SeqID_59284
MDFLEAKEKGNQASYPMQDPLRSSEHLTVHDILVQREKWDENVDVIATRMRLEDKGVDCPSLCSICRARIENPFHLFFCCQEMLGNPLPMVSQNAILMQPFMKPWAKLVGVYVVEISKGALRGVKIEWQQVMLPVDVGEALSLLKALHWIVDKGCS

SEQ ID NO: 176063 - protein, 228 aa, Glycine max
  Coding DNA Sequence Number=SeqID_59285
  Gene Ontology: Mol. function=RNA-directed DNA polymerase activity; Cellular component=extracellular region; Biological process=RNA -dependent DNA replication
  Homolog annotation: Hit_ID=Q1SP50; Match level="QueryCoverage=94%, HitCoverage=27%, E-value=5e-41, Identity=38%"; Hit description=RNA -directed DNA polymerase
MVEEVFLNSWDSNSNANIVRKLEFYVVDLDKWGKKLKSKFRSNIESCKRNLEELREKRDPDFVATFNKLKDELTNLLVQEEGFWKKRSKIFWLYEGYQNTKFFHTSASSTKRQNKLCPLTNEDGTIVTAQRELTNLANEYFGNLFTHQDCELGNVIFVIPNFITDEDNGYLIAHFIVAKFKEALMEMDPKKSLGPDNLNSVFHRRFWDIYGQEVVDACTSWLESGNMP

SEQ ID NO: 176064 - protein, 150 aa, Glycine max
  Coding DNA Sequence Number=SeqID_59286
MVEERKIRNNMKEELQVAMTGAPEIGSKMPENNSTNEEDRANQLLGTINHYQLVGQPHLDDTEAKLGDRKRRRIEADQNKWHGESIGQITDQEMVGASIVGGLDNLQAIPVLKDLLRAHRPEGFWEVMALGTSTSKVIPSLGPKVGILKQ

SEQ ID NO: 176065 - protein, 67 aa, Glycine max
  Coding DNA Sequence Number=SeqID_59287
MQRRRWKQDLGVKEENKKGEDESLDGVSIGVEDSCAKKLEEGVNLCLIVNGENKDKEGRVDVWKGKG

SEQ ID NO: 176066 - protein, 101 aa, Glycine max
  Coding DNA Sequence Number=SeqID_59288
  Gene Ontology: Mol. function=RNA-directed DNA polymerase activity; Biological process=RNA-dependent DNA replication
  Homolog annotation: Hit_ID=Q2HS45; Match level="QueryCoverage=92%, HitCoverage=14%, E-value=5e-23, Identity=48%"; Hit description=RNA -directed DNA polymerase
MTTIFSSELRSRKLDRVGREILLKSVADALPNYCMSIYLFLESMTDELQWMMNSYWWGAQRNDTKGIHWLSWEKLVMAKEVGGMGLRPTYGCNLVLLGKQG

SEQ ID NO: 176067 - protein, 291 aa, Glycine max
  Coding DNA Sequence Number=SeqID_59289
  Gene Ontology: Mol. function=sugar porter activity; Cellular component=nucleus; Biological process=nicotianamine biosynthetic process
  Homolog annotation: Hit_ID=Q1S6S0; Match level="QueryCoverage=85%, HitCoverage=98%, E-value=3e-83, Identity=64%"; Hit description =Facilitated glucose transporter; KH, type 1
  Pfam annotation: Domain name=KH_1; Domain location=153-208; Score =9.7; E_value=0.079; Accession=PF00013.19; Description=KH domain
  Subcellular localization annotation: CTP_CleavageSite=20; ConfidenceScore=5.10e-01
MSGLYNQISSPSTARANSPNINMRSNFEVERISINFWVDVLIHVFIYPSCSYFTVCSRKVSFFIVVLIFSVTLLSEILRVSGKNGLMQNQGLSDYDRVQFGSPKPNLMPSLDIQPNFTGWNSLSHEGLAGVQGLNVDWQTSPGVPSSHIVKRTLRLDIANDSYPNFNLVGRLLGPRGNSLKRVEATTGCRVFIRGKGSIKELDKEELLRGRPGYEHLNEPLHVLIEAELPVNVVDIRLRQAQEIIEELLKPMDESQDLHKRQQLRELAMLNSNFREDSPQLSGSPSTFNSN

SEQ ID NO: 176068 - protein, 58 aa, Glycine max
  Coding DNA Sequence Number=SeqID_59290
MSKIGAVIELKLAAVILWRCGVEAVCSKLPGKGEAGSQWAYLRSCTGSTNKCPIYLSG

SEQ ID NO: 176069 - protein, 37 aa, Glycine max
  Coding DNA Sequence Number=SeqID_59291
MFMDEIVDDSCCCNGRVQAFQDKTRAQPKAVKYPVEC

SEQ ID NO: 176070 - protein, 68 aa, Glycine max
  Coding DNA Sequence Number=SeqID_59292
MSRGSGDLGDVRRAPGSQPIKEQSPQRKEACVAAGQLCILGGIWKLASGNRLPFVGNRLQGLKMEIGS

SEQ ID NO: 176071 - protein, 114 aa, Glycine max
  Coding DNA Sequence Number=SeqID_59293
MVIALDGAHVRYVGCCVCSWGAKCIDLVGWPIHGGQAWLKNLSISEGMLRHFNWSMCMFMGGKCIDLVEWLIRGGQAWLKNLSIFERMLRRFNWSMGGSALTLSNDPFVGDKRG

SEQ ID NO: 176072 - protein, 70 aa, Glycine max
  Coding DNA Sequence Number=SeqID_59294
MAVSKLRNDAKRTMAVYGGYWWPWVMEKNLDTLEMAQNAKVTNALGNGNFADTPDVFLKIPTVKSWTSVL

SEQ ID NO: 176073 - protein, 134 aa, Glycine max
  Coding DNA Sequence Number=SeqID_59295
NIIEVPLSYHRQWRPHYPTLHRYGSRYFFSDGLKEFRRTHRIDDSVILQFFGGNKNTTFEVDVIGPIFGQRRPRSVQTTRRHIFTADVTEHMMQQSLPLVLPPAAFTFLFGSQKIFLFREAMANVNNGKSPCTM

SEQ ID NO: 176074 - protein, 393 aa, Glycine max
  Coding DNA Sequence Number=SeqID_59296
  Gene Ontology: Mol. function=coproporphyrinogen oxidase activity; Cellular component=cytoplasm; Biological process=porphyrin biosynthetic process
  Homolog annotation: Hit_ID=Q2L0C8; Match level="QueryCoverage=97%, HitCoverage=94%, E-value=1e-175, Identity=79%"; Hit description =Putative oxygen-independent coprophorphyrinogen III oxidasee precursor
MGHDCPILVVQEAPAQGRGPQPGGIGVQQALGGRCLQLVRNGGQRQAGALVEQGGGHPVLEPQGIEHELERQFVRADLAALGQVAAVARGGGPQPGLRAAQARLAHDAVVERQLAVRARPQAEVVAEFPVIQVVAAARAGPRVRRDLVARQAGRGKFGLDRVLHRGAGVVVRQVFGGKLGEYRVRLHRQVIERQVLGAEADGLAQIVHAGRQGLPGQREHHVQIDARRGALGHLDGGAGLGRIVDAAQLLQLGVVEALDAQRKARHAAGGVVAEPAGLGGAGIGLHGDFGVGPYVQTGAQHRQQLVQAGGREQAGRAAADEYRNHLAAPDRRQRLLQVAAQCVQVGAFGNLAAGRRMRVEITVRTLAHAPWHVHIDRQRRQAGQRGAGRGDQA

SEQ ID NO: 176075 - protein, 101 aa, Glycine max
  Coding DNA Sequence Number=SeqID_59297
  Gene Ontology: Mol. function=hydrolase activity, acting on ester bonds; Biological process=lipid metabolic process
  Homolog annotation: Hit_ID=Q1SEL6; Match level="QueryCoverage=96%, HitCoverage=26%, E-value=6e-22, Identity=53%"; Hit description =Lipolytic enzyme, G-D-S-L
MTINSIRGLQHQASIPYPFYSNIYTPILDMAQNPTKYGFAQTLQGCCGTGLLEMGPVCNAHDLTCPDSSKYLFCDAVHLTEAGNYVLAESGRQNVLRYLGS

SEQ ID NO: 176076 - protein, 194 aa, Glycine max
  Coding DNA Sequence Number=SeqID_59298
  Gene Ontology: Cellular component=outer membrane
  Homolog annotation: Hit_ID=Q9FFG3; Match level="QueryCoverage=90%, HitCoverage=33%, E-value=2e-57, Identity=57%"; Hit description =Arabidopsis thaliana genomic DNA, chromosome 5, P1 clone:MOP10
MAPYLSFVIMEFDVRFSVPFGFYNTALNLGISAGAVFPWGNGFKTKPSPLPERFYLGGDFSPVCTLGGPTTLWGFKTRGLGPTEPRRQNRDGSNDDNVDSSGWDFIGGDFAVTAFADLSFDLPIMWLREHGIHGHVFAGSGNAAKLTQNEYTHFSPRKFLESFRMSVGCGVVIPTRLFRLEKLRLTKSWEIEWS

SEQ ID NO: 176077 - protein, 268 aa, Glycine max
  Coding DNA Sequence Number=SeqID_59299
  Subcellular localization annotation: CTP_CleavageSite=55; ConfidenceScore=5.27e-01
MAHGYRGAAGHGGAAGVVAAAARTHRAACGRVSGTGVRCQPAYRTASGNIARPLPAGAGGAAGAHGQSCIAAGAGGSQRGDPAGPIAGPADLPVHPAPRRCDAVRAAAADAVGRWAQHGRGHRTVCAHVSGQLLRPATQQRTAGFWWTVAAAACRQRLQQRGVFGAAAGWRRLAVQQPARECPCAGARPVRGRAAAPAWGNWRGTGHGRGEGHAGGGGIGDCRTAGRLPVMIPDTGHDPARGARQHEHCPGPNLNWWRCFHNYTGHPV

SEQ ID NO: 176078 - protein, 84 aa, Glycine max
  Coding DNA Sequence Number=SeqID_59300
  Gene Ontology: Mol. function=protein serine/threonine kinase activity; Biological process=protein amino acid phosphorylation
  Homolog annotation: Hit_ID=Q67UT0; Match level="QueryCoverage=72%, HitCoverage=15%, E-value=6e-19, Identity=67%"; Hit description =Putative serine/threonine protein kinase
MASEVIRCESYNEKCDVYSFGVILNELLTGNYPYVEMKYGPTKIVMEVVEGKLRPKLPCDDVGQFGTREIEGALYPVGKILFES

SEQ ID NO: 176079 - protein, 124 aa, Glycine max
  Coding DNA Sequence Number=SeqID_59301
MQSSRRDVYLGAYLNGFHYSGHWQMVVILPKEHLSCLCVKRFLMNAPQPKSKASARWIVVKCNRQKGSTECGYYVMHWMSTIILGTFRNNWEAYFNDPRPLEPERLKALRIQWAQFYLRVRDQA

SEQ ID NO: 176080 - protein, 129 aa, Glycine max
  Coding DNA Sequence Number=SeqID_59302
  Subcellular localization annotation: CTP_CleavageSite=33; ConfidenceScore=5.21e-01
MAGHSSYTSGRCHTGHRHGLSHVLTARAPLHTMGVAERARFRQTFRGLRWVSRERERAKGTSERVVRVRAQQREGREQGSAERGERAKGTTLWKERVRFSRERGQCMGHAGTKTGYFKGPLLSCIKITF

SEQ ID NO: 176081 - protein, 95 aa, Glycine max
  Coding DNA Sequence Number=SeqID_59303
  Gene Ontology: Mol. function=catalytic activity; Biological process =trehalose biosynthetic process
  Homolog annotation: Hit_ID=Q9FJQ1; Match level="QueryCoverage=86%, HitCoverage=21%, E-value=2e-31, Identity=77%"; Hit description =Trehalose-6-phosphate phosphatase
  Pfam annotation: Domain name=Trehalose_PPase; Domain location=1-94; Score=-62.3; E_value=0.0085; Accession=PF02358.7; Description =Trehalose-phosphatase
MDFVSRMLKVYQQLVEKTKSTPGALVENNKFCLSVHFRCVDEKKWSELARQVKSVLKEYPKLRLTQGRKVLEIRPTIKWDKGKALEFLLESLGEF

SEQ ID NO: 176082 - protein, 169 aa, Glycine max
  Coding DNA Sequence Number=SeqID_59304
  Gene Ontology: Mol. function=transferase activity, transferring glycosyl groups; Biological process=metabolic process
  Homolog annotation: Hit_ID=Q9LXV0; Match level="QueryCoverage=47%, HitCoverage=19%, E-value=2e-14, Identity=38%"; Hit description =Glucosyltransferase-like protein
MERMRKRQPMKEPMAKPTMSSLRALSVAGGVILEAALGRGGEGEAHEDEDREEGVHAYQAATAQRTLKGAGGVKEREAQETVGEVEPEGIVAGEAIATEDDVEDAEFLGNSGSPAEEDVKDDKKFMFMVLDEDAGAGFDEANDEEVRDGIGVLCVGREAVVRGVGFGRG

SEQ ID NO: 176083 - protein, 151 aa, Glycine max
  Coding DNA Sequence Number=SeqID_59305
  Gene Ontology: Mol. function=unspecific monooxygenase activity
  Homolog annotation: Hit_ID=O04892; Match level="QueryCoverage=56%, HitCoverage=21%, E-value=9e-16, Identity=51%"; Hit description =Cytochrome P450 like_TBP
  Subcellular localization annotation: CTP_CleavageSite=50; ConfidenceScore=5.11e-01
PCPTPWENGLQGAGGVRVPSGLGRSTPHRSRWVFRWRPPGGPLKNPEDPSASHRPGRTHNRIRSPRAGHGGPSPEPVGCRWTARAASAARAGRRVPVGGRIGNGPFGASSPGVEQSTQNCALNVKVKKFNQARVNGGSNYDSLKVAKCLVI

SEQ ID NO: 176084 - protein, 235 aa, Glycine max
  Coding DNA Sequence Number=SeqID_59306
  Homolog annotation: Hit_ID=Q5XM22; Match level="QueryCoverage=48%, HitCoverage=80%, E-value=9e-30, Identity=48%"; Hit description =Resistance-like protein HAAS-2
MTITLDDVASLLHLPITSALHTFEPLVTSDMVMLLTELLESRCRARRWVVAAHAYLLHLVGCTLFANKSATHVHVMHLEAFRDLAQAGGFSWGATTLVHLYDHLNEASQTPTRQMAGYMTLFQICEYFPMVHQCVVDDAYVEASPRASRWLTSKAHMTGIKGAPYRVRIEALTVTDAYWMPYAEHRGVKGFDLISFYTGQLIWGQIVVYVRPEWVLRQFGYIQTVPLPPVRDSLT

SEQ ID NO: 176085 - protein, 322 aa, Glycine max
  Coding DNA Sequence Number=SeqID_59307
  Homolog annotation: Hit_ID=Q8LBT1; Match level="QueryCoverage=92%, HitCoverage=99%, E-value=1e-116, Identity=70%"; Hit description=Gda -1, putative
MENMQSFWQLGDELRGHSKASEDHKWLMVASKLAEQTRLKGERVNNLDLSKGPIETRSRDKFGFQEENKFDSLNLSMLNLDSKFTENVSKSSLRNGVYGMNAVYQKNNANLVSNVISNKYNGSIQHNKEINNNTGNNINTNESNNTNATDKRFKTLPAAETLPRNEVLGGYIFVCNNDTMQEDLKRQLFGLPPRYRDSVRAITPGLPLFLYNYTTHQLHGIFEAASFGGSNIDPTAWEDKKCKGESRFPAQVRIRVRKLCKALEEDSFRPVLHHYDGPKFRLELSVPETLDLLDLCEQAGATTSGGLPGAISSGGAPDATTS

SEQ ID NO: 176086 - protein, 165 aa, Glycine max
  Coding DNA Sequence Number=SeqID_59308
MAGNLKFTMDQKDIVRFLTTTIDSFIQDRLFNKEQRTQHKEQCAERLAIEDGSYDKDTEVEYSNQAILAYLDWGIEALEEAINTYNMETKLARLDYAKKMLQLWKLRNNVQNCVFHALEMFIVDPFFFLRIDFAPKLWKNLFLPHMSSIMGSYSEERHELLWPGS

SEQ ID NO: 176087 - protein, 95 aa, Glycine max
  Coding DNA Sequence Number=SeqID_59309
  Gene Ontology: Mol. function=structural constituent of ribosome; Cellular component=ribonucleoprotein complex; Biological process =translation
  Homolog annotation: Hit_ID=Q8S6I4; Match level="QueryCoverage=82%, HitCoverage=25%, E-value=3e-29, Identity=78%"; Hit description =Putative 40s ribosomal protein S23
MDERLTLTRRSKKEKSSSSPTTGGKSGQTSHTRNPILEMIGRILLLVHPMPRELFLKRFEVLRLSSPTLPFVSVPGFNLSRIGRRLPLLSLMMVA

SEQ ID NO: 176088 - protein, 133 aa, Glycine max
  Coding DNA Sequence Number=SeqID_59310
MMDNDALCQHQTRIVEIERHHEEKFKKLKADHNKLEARIRSPQGDKYSAHTINEQTQGESHPRQTNNTVDDNNNLHAHRHEEQMTRKTYFHRSNHGGRPTSRLEPTQPERYDGTTDPNEHMDVFLTQTNLYTN

SEQ ID NO: 176089 - protein, 228 aa, Glycine max
  Coding DNA Sequence Number=SeqID_59311
  Homolog annotation: Hit_ID=Q6YZF2; Match level="QueryCoverage=83%, HitCoverage=61%, E-value=2e-65, Identity=62%"; Hit description =Translation factor-like
  Pfam annotation: Domain name=Sua5_yciO_yrdC; Domain location=87-228; Score=21.2; E_value=1.5e-08; Accession=PF01300.8; Description=yrdC domain
  Subcellular localization annotation: CTP_CleavageSite=44; ConfidenceScore=5.51e-01
MQTVCVCGDKLWRYDAVSFFGSHVSFTSTRVSFCPPRRRSGLVSMVAKRSPKRLKYTSASRFTKEDGLVYIEADPSASDSWKLEPIANLLKQGAVGVIPTDTMYAIVCDLRSQSAIERLRRIKNIEASKPLSILCHSFRDIDKYTAGFPRGDGQGHANLFKAVKHYLPGPYTFILIASKELPKQCIRFGTSSAKYASRKNVGVRMPDDAICQAILKEMDAPLICTRFV

SEQ ID NO: 176090 - protein, 457 aa, Glycine max
  Coding DNA Sequence Number=SeqID_59312
  Gene Ontology: Mol. function=RNA-directed DNA polymerase activity; Biological process=RNA-dependent DNA replication
MDKLWERAKGYIQMKEMSRFQNKDKIEELIQAGYLAQFMKKLDNNQTGGRPKGHNKEHHRRRDNGQDRRGDKIKDRRRLRHHQQRHEHQPQQEQEDEPVQQRGVINTIAGGFSHRGLSNQSRKCHLHAIKDLDVNCVDVKPLRSLPPITFTNKDFKAINPINQDDLMVVSIVIANFMVAKVLIDQGNSGNQRLCGPDDHLWLGKALKDHSINTTPENEVPYLDGRNLHYQGRPKASLTMLCEKPEDDPLSFCQRVEQALFPFWTLTIYKTTEGNPGDTFDVDPWDDTMDKGPKPIEELVKLQLGPKPRQCTQLRKDLTSHEHRHIVEAFIPASYAINWPSALRPNQSHRRKGRWEKNYANKKWHMCTNYANLNKACSKDSYPLPGIDKLVDSVSDFQLLNFLDSYSGYNQIRMHPLDEEKIVFITEDANFCYRVMPFGLKMLELQTRCSWTGSSNIR

SEQ ID NO: 176091 - protein, 91 aa, Glycine max
  Coding DNA Sequence Number=SeqID_59313
  Homolog annotation: Hit_ID=Q6YZF2; Match level="QueryCoverage=79%, HitCoverage=23%, E-value=7e-19, Identity=60%"; Hit description =Translation factor-like
MKFQPSTFIKFQKEDEWMIDPVMIADTYGPEGLDFVVDGGVRVADPSTVVDMTKLPPKVLRQGKVGPILHWMELEDDQKTDVDKDLIPAGI

SEQ ID NO: 176092 - protein, 432 aa, Glycine max
  Coding DNA Sequence Number=SeqID_59314
MATLLKFLQLYCAYCVGLMVVGVLFVSAESTLLVYFKRAPSPRSRSSNAVFQYLVERLDGSNACKRNTCSFSCELDGKVYPCQSNGIVLTNLTLNHEHRFLLNVSTITGERNSSVYSWFIDTIPPTAAISSEQTHTNEQKIAIDVTFSEPCTGLGGFHCLNSSNCDIMVAGPAQVDASSLQIIRPGAKYSLEVIISSEVTYGRVVITMAENTCTDQAGNQFRRTNGSTLITHFGEVLVAKPVMVDFWTSVPSYELKINGIPRTVVATSKPEDLIIFLDFSIPITNSTEQVLNALHVNSGVLIPLHGRSNGTRGFSFKLKNISGTEIITIELQAASILGKTGTPVSPVAPITFLYDPMKPNVVLRTSSLTETRDFNINIMAEFTKPVFGFGTSIVEVSGGRLIRQGKGTIKSFILVDCPSSDKGGVSYHSCRE

SEQ ID NO: 176093 - protein, 717 aa, Glycine max
  Coding DNA Sequence Number=SeqID_59315
  Homolog annotation: Hit_ID=Q1T393; Match level="QueryCoverage=69%, HitCoverage=65%, E-value=5e-50, Identity=28%"; Hit description=IMP dehydrogenase/GMP reductase
  Subcellular localization annotation: CTP_CleavageSite=47; ConfidenceScore=5.13e-01
MNDTCMDLRIFSMFDSNSNMVCSDSTPAISIALDSFISAGTIATSLVAAMVSLSSANLEALSILALGGASSPASNPSINLHGMIGHLQVFALTSWFSTNQFIKYSETTRGLRWLIPHHKLPWKKIDTWKKLGWRSNGQSAGERDQQQTDLMSLSYIDPKLSFQTENTTNFGRFHNQHDLSKTSTLYGLPLNSIEYFTYFLRGEPLSASNVIKGMESYKGWQDMEMNLFWLGVGGGCLLLFHVFMIFFLRHRTGRSPQGSLSVPRFELFLLILMLPCLSQSSTFVIKGRTTGGIITGVLLLAIPVAFILSALLFLIIAIYAGSFAQYKQFKKITNEEKWYTKLLFCFIGRSTTGKWFNREGLPSSFLSRFGILFDDWKGPPVLILGDQNEQNNTITKWSESGKSGNGRTKTVCSEDSNEEIKISTFKKVLGCMRASYIILDLLRRVGLGIISVAYPSESSNKSLFALIITSMQFIYLFTTKPYINRGVHVVESVSLLCETGVFSILVLHNGSHSVESKTWELVMLFLLMFTFIAQLTNQWYAMVNSLWKLSQTQNNSLRDGVKLAAKGLILPFLPSKHWSSVISTFSQPETNQLSVNPTCSGIDFERRNRNGYMDPISTMTATVVPVQSPSTPNHNVVERRDPTTWETGASSHIEVEGKWLKGHKAGLKKELRMLRELAKASFSGDTRFDEASTSYTLGEQQHSSGEIYLGNPKRRYC

SEQ ID NO: 176094 - protein, 249 aa, Glycine max
  Coding DNA Sequence Number=SeqID_59316
ADEGKAEKKVEEHKQQLAAEPALEPVSDFVELEEVVEDEDDQQERETPIKDSQEGIKMKEEQGKEKEKREITSAEGKEVPYPLVPSKKDKERNLARFLDVFKKLDEHEVCHKEFGSPSGTTGKRADEGKAEKKVEEHKQQLAAELALEPVSDFVELEEVVEDEDDQQERETPIKDSQEGIKMKEEQEKEKEKVEKEKKSKNAKEKEKVDDEKKKSKSEVSREKRERLLQLKAKKYHIRWYLPRSIKSDT

SEQ ID NO: 176095 - protein, 79 aa, Glycine max
  Coding DNA Sequence Number=SeqID_59317
MPFRDLKSARKRTAFSGKRDELAKRACCAKRVHQYSFCIKVFSEELAKRTHRAKRVCPVRMTLILLLDYLWLSDAESLT

SEQ ID NO: 176096 - protein, 163 aa, Glycine max
  Coding DNA Sequence Number=SeqID_59318
MAINQTHCPRSLRVLTGRMGLHVFLAKISSSSPHIPPPTSISDNVEAVLGEARGRALVGGRGVVLDDRILLPENGIQVRASELGGATRVELYSRVAKVGGRRQQCNDGEPDLKKDGDGGCKLQHRVRACEQGHDDNVCVSCLRRGGCSLVSESVPDRTSSIKR

SEQ ID NO: 176097 - protein, 73 aa, Glycine max
  Coding DNA Sequence Number=SeqID_59319
MEDESSEATIPEPFDIGEEAEETQPSAPMVNLPSPQPAADPFTPLLQMPEDPTTPVLAVDTSPPTTPVLQLTD

SEQ ID NO: 176098 - protein, 86 aa, Glycine max
  Coding DNA Sequence Number=SeqID_59320
  Subcellular localization annotation: CTP_CleavageSite=59; ConfidenceScore=5.42e-01
AKVDVSLSKLNALSECHPISKVSTRLTDRRNLEGNRSRRHALNASSARLASRLSPSRLSASLALSGNSLTRANHDVEVNEPFLSLE

SEQ ID NO: 176099 - protein, 273 aa, Glycine max
  Coding DNA Sequence Number=SeqID_59321
  Gene Ontology: Mol. function=5-oxoprolinase (ATP-hydrolyzing) activity; Cellular component=nucleus; Biological process=electron transport
  Homolog annotation: Hit_ID=Q7W6A6; Match level="QueryCoverage=91%, HitCoverage=22%, E-value=1e-104, Identity=75%"; Hit description=5 -oxoprolinase
MTIPGSPRPHATDSAGAVAPASRRLHHEHVARMQLGAILRTEFLDRAVQPFDIVAAHRARLATGQAERRITAVVGQDRGGHVFQEADAAHAAVAARIAPRPARTVADLVRLQPHREAELQHFGVAFVVGTGGIDAHGTGAGAARNGLVVLVTRVAEGEVVHGALAGGQHAERAVQRVDYAHGRFDVARHHRGRRVRAHHLAFWQDDRQRHQAAVVQRDVVVDHGAEHVQHRDHGDGARGVEVVVQLVRGAGEVDHCAARLVVHPHRDTDDCAV

SEQ ID NO: 176100 - protein, 241 aa, Glycine max
  Coding DNA Sequence Number=SeqID_59322
  Gene Ontology: Mol. function=carboxypeptidase activity
  Homolog annotation: Hit_ID=UPI000068E8CE; Match level="QueryCoverage =97%, HitCoverage=86%, E-value=1e-29, Identity=30%"; Hit description =putative carboxypeptidase
  Pfam annotation: Domain name=Peptidase_S66; Domain location=2-232; Score=69.4; E_value=1.1e-17; Accession=PF02016.6; Description=LD -carboxypeptidase
MIKAKGFEPVLGKHLYTRFSNGYNYAGTEKERLKDINWAFNDSEISAIWASRGGYGCQHLIQHIKLTQFLKDPKWYIGYSDNTVIQSYLLKKGFVSIHGQTIKTSSFGVTEESYDLVFDILKGKAPKYGLQTNQLNREGNIEGELIGGNLALIYALLGTPYSFDFKGLIVGGMTNMGDEKENKNYEESFDEFAYKLISERISKYKFPVIFGFPNGHIKDNRPLIIGGNVKMKVGSKVKIEF

SEQ ID NO: 176101 - protein, 63 aa, Glycine max
  Coding DNA Sequence Number=SeqID_59323
MGLSHEVLKVTVELNSSRNSCLQPGSVHDWHEAQILLLALSARAALSTTSQIQSLFKACLVQN

SEQ ID NO: 176102 - protein, 283 aa, Glycine max
  Coding DNA Sequence Number=SeqID_59324
  Gene Ontology: Mol. function=protein serine/threonine kinase activity; Biological process=protein amino acid phosphorylation
  Homolog annotation: Hit_ID=Q2R441; Match level="QueryCoverage=60%, HitCoverage=70%, E-value=6e-49, Identity=47%"; Hit description =Uncharacterized plant-specific domain TIGR01627 family protein, expressed
MSNITSINNGWNNKVPKFPNPPNPIFHAQELLGILLLNLPIHVMKKHVRHTRSLSPTRHHRGGVYDRHSTGRGRKIPSRPIDHDHIPITIVHLIRQIVQCQLTQAVTLEWDGEALEGREGPLGILLEKQRGATWIERVPHKRVVAESEHKEVAWREGLKHVEGSPDLALGLLREHTRRGVVEDGDEGERGGVELGGDGGLGGREGNDGGGGDAEVGRGGGVEEGLAEEEEEEDGGGEGGSEEGEETRVGGGRVFLPLGGGLEGLENPRLHGGECVLVDVKDAT

SEQ ID NO: 176103 - protein, 83 aa, Glycine max
  Coding DNA Sequence Number=SeqID_59325
  Homolog annotation: Hit_ID=Q9FMT7; Match level="QueryCoverage=40%, HitCoverage=7%, E-value=9e-09, Identity=73%"; Hit description =Arabidopsis thaliana genomic DNA, chromosome 5, P1 clone:MUA22
MAMEVEQNQNHQLGFPFWKPLRHRFGPESPFFAPGNLERELLAKQKKSNSLRNGCKRKKEGTDPYIVGFILFTIREIQINAGT

SEQ ID NO: 176104 - protein, 133 aa, Glycine max
  Coding DNA Sequence Number=SeqID_59326
  Homolog annotation: Hit_ID=Q9LSD1; Match level="QueryCoverage=64%, HitCoverage=50%, E-value=1e-09, Identity=34%"; Hit description =Genomic DNA, chromosome 3, P1 clone: MOJ10
MTFGREEVACDEAELGEEEFTEKMLNQQKLQEQQLEMLKYMRKFHLDDQSAILEKLHQQMENGNYESETSILSAEQIDEIVPRKVSPLYTPSCCKANIFTQWLALAAFSRLGFPTSVVSTERPIRKITYYMVH

SEQ ID NO: 176105 - protein, 187 aa, Glycine max
  Coding DNA Sequence Number=SeqID_59327
  Gene Ontology: Mol. function=oxidoreductase activity, acting on the CH-CH group of donors; Cellular component=mitochondrion; Biological process=electron transport
  Homolog annotation: Hit_ID=Q9M7Y7; Match level="QueryCoverage=80%, HitCoverage=35%, E-value=2e-68, Identity=79%"; Hit description =Acetyl-coA dehydrogenase, putative
  Pfam annotation: Domain name=Acyl-CoA_dh_M; Domain location=48-102; Score=68.3; E_value=2.5e-17; Accession=PF02770.9; Description=Acyl -CoA dehydrogenase, middle domain
MGRSLWAPQVFNCGALDTGNMEVLLRYGNIEQLQEWLIPLLEGTIRFGFAMTEPHVASSDTTNIECSIKRQGDSYIINGTKWWTGSAMDPRCRILIVMGKTDFNAVKHKQQSMILVDVKTPVIHIKRPLIVFGFDDTPHGHAESFNFHVLLPPMAGRSVYGYCISRLMVPISCSWLFSVCLAHILHC

SEQ ID NO: 176106 - protein, 84 aa, Glycine max
  Coding DNA Sequence Number=SeqID_59328
MRVWELFMHGEGGLVGACALSTNLDRLACISEFRLSVRLLAQRVDSSGALSRITACSENMHSSSFLQILPCAQPKECCTQRMAR

SEQ ID NO: 176107 - protein, 173 aa, Glycine max
  Coding DNA Sequence Number=SeqID_59329
  Gene Ontology: Mol. function=RNA-directed DNA polymerase activity; Cellular component=intracellular; Biological process=RNA-dependent DNA replication
MVKKFHGKWRLCTDYIDLNKACPKDSYPLTSIDRLVDRASRFLILIFLDTYSGYNQISMFKQDEEKTVFMTNMVNYYYSVMSFILKNARATYQRLMEKIFTNQLKRNLEVYVDDVVKYNIRLNPKKCIFRVQGRKFLGFMLTHRGIEANPNKCKTIIAMRSPNTLKRVQRLIG

SEQ ID NO: 176108 - protein, 137 aa, Glycine max
  Coding DNA Sequence Number=SeqID_59330
MERRDTIGHSTCPKSNKCREPISSFHRWNHGSTTITRMEDIDHRLFNRLLNLDEHMDAFLKQMNLFANDDALMTPSMIKIESKKGVKSIVKLKKLLRHNSTMIIPYSKLGCEVEAKKKLTRCMPPISFTDEDFGDIE

SEQ ID NO: 176109 - protein, 106 aa, Glycine max
  Coding DNA Sequence Number=SeqID_59331
MEVKYLEAVKRRLHATKQWSPDEIRVSRSMDTPLKQQPSLGENLENFLAPAGVINVGDHQDHNVNVVIGGDTHHQDLMGMDPMVMPSQQEHWLQMQIPAAINIHQH

SEQ ID NO: 176110 - protein, 53 aa, Glycine max
  Coding DNA Sequence Number=SeqID_59332
MSKCRYRYTPPTFVEELTEECLSQPSFSPKGVQTWLTYLIGEMTMCNGLGGDW

SEQ ID NO: 176111 - protein, 197 aa, Glycine max
  Coding DNA Sequence Number=SeqID_59333
  Gene Ontology: Mol. function=RNA-directed DNA polymerase activity; Cellular component=mitochondrion; Biological process=RNA-dependent DNA replication
  Pfam annotation: Domain name=RnaseH; Domain location=5-121; Score= -28.4; E_value=0.025; Accession=PF00075.14; Description=RNase H
MVHPMKKGSRAGVILESIGEVILEQSLRFEFEMTNNKVEYETLLAHLRLAKEVGVKYINCWSDSKLVSGQLNGEYQTKDPQMTRYYHMATQLKEAFTKFELQRVVRENNERADLPLKLDSIKKKDNIERHPRNKVVARVAPVDLEWMTKIRDFLEKGSLPKNPTTTRNIKRYAIYYVIEGGDLYEKGFTATLLKCLT

SEQ ID NO: 176112 - protein, 450 aa, Glycine max
  Coding DNA Sequence Number=SeqID_59334
MIASFEFRNIDGMGKGCVSPEPLICGSGESSFLSSVIFLFSGILLFLFFTIQGKVQMMTLLISTTTLTLLVTKIPTFMLVILPLVAHPDTGGVAAMERLCLYSDMHVTHVENEAKSSSKCHGPGFRGYSRPSDFSSTIQSPPPRKPNMAKEYPSIILLGYFLVHEEESKHDFVRVFSCETLFVYMYSSSFSTLHLIVPFDKFEVDVLRELNVAPTQLHLNVWVTMKTKKVDWISLTDILDKAVIGPYTTSYKNFKGYFFQVPSKLEFMPIDFTRQRGKYFNHQALIQASMLSQPNRDILRERANAVCQKVQSEYAKAEQALVEESQKSLMDTKTKLKEAESQEKALKIKLTTAKDSAKALQEEINHLNKEFVLIKVNAKKVEEKLKTDLEEAEAKILKTHEAGPNKAFHLVKYFFKDANTSFFDVDKDVTQQGELVGENNMPTKEVLDLA

SEQ ID NO: 176113 - protein, 50 aa, Glycine max
  Coding DNA Sequence Number=SeqID_59335
MEKLGKIQEKKNLPQTGKSFSKLLKHSEKIRVELTVPSTKDLIQGIDKTK

SEQ ID NO: 176114 - protein, 123 aa, Glycine max
  Coding DNA Sequence Number=SeqID_59336
MQSLQELAQQRPIMSEDQFIKKAPQQHELEPENDHSSEAIIPGVVDFSKIKLETRSNEVAHPGPVPVPADHTADSSTPILEIPEGQTIPILALDTSPPTTPVLHLTDKEDVQAQDIQDQSHEF

SEQ ID NO: 176115 - protein, 64 aa, Glycine max
  Coding DNA Sequence Number=SeqID_59337
MDPIKIAQNDACTDSTLRCNVVRTNNNQISGNNLSVSTGNISMQQGQADVLIARFPDPNYGVKM

SEQ ID NO: 176116 - protein, 459 aa, Glycine max
  Coding DNA Sequence Number=SeqID_59338
  Gene Ontology: Mol. function=protein-tyrosine kinase activity; Cellular component=integral to membrane; Biological process=protein amino acid phosphorylation
  Homolog annotation: Hit_ID=O22938; Match level="QueryCoverage=86%, HitCoverage=59%, E-value=4e-89, Identity=36%"; Hit description =Putative receptor-like protein kinase
  Pfam annotation: Domain name=LRR_1; Domain location=100-119; Score =1.0; E_value=1.8e+02; Accession=PF00560.23; Description=Leucine Rich Repeat
  Pfam annotation: Domain name=LRR_1; Domain location=139-161; Score =10.1; E_value=3.6; Accession=PF00560.23; Description=Leucine Rich Repeat
  Pfam annotation: Domain name=LRR_1; Domain location=163-191; Score =2.9; E_value=82; Accession=PF00560.23; Description=Leucine Rich Repeat
  Pfam annotation: Domain name=LRR_1; Domain location=193-215; Score =14.9; E_value=0.3; Accession=PF00560.23; Description=Leucine Rich Repeat
  Pfam annotation: Domain name=LRR_1; Domain location=217-239; Score =15.4; E_value=0.21; Accession=PF00560.23; Description=Leucine Rich Repeat
  Pfam annotation: Domain name=LRR_1; Domain location=241-263; Score =9.2; E_value=5.4; Accession=PF00560.23; Description=Leucine Rich Repeat
  Pfam annotation: Domain name=LRR_1; Domain location=265-284; Score =9.5; E_value=4.8; Accession=PF00560.23; Description=Leucine Rich Repeat
  Pfam annotation: Domain name=LRR_1; Domain location=52-74; Score =15.6; E_value=0.18; Accession=PF00560.23; Description=Leucine Rich Repeat
  Pfam annotation: Domain name=LRR_1; Domain location=76-98; Score=6.9; E_value=14; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1; Domain location=100-119::139 -161::163-191::193-215::217-239::241-263::265-284::52-74::76-98
VSGTLCHMHLRSSQKGASLSLKMLIGDVALLSYMEHTILLAKFSAKFCALRSLKTVNLSNNSLVGEIPNELQGIESLQDFQIFNNHLSGLIPSWVGNWTNLRVFAAYENNFNGRIPEVMILTQNNLSGNLPVEIGNCQTLYSVRIGNNNVEGNIPKSVENLSSLVYFEANHNYLYVSNGFTGKIPPEFGQLMNLQVLMLSGNRLFGDIPESILQCKNLSMLDLSNNRFNGTIPNEICNIFQLQNLLLGQNSIRGVIPHEFGRCRKLRELQLGSNHLNGTIPSQIGYKYNLEIALNLSYNHLHGPLPPQLAIGVEIGQLCGPLPQFGSFQKNPSSYLGNQGLCGKPLNTTCEDHPDDYEPTKDQYHHDIVYETIVTIFVACFAGFIALTVFLVIIRDWKEQVENDAAIEGIPALWDSLTCKETDLYGHDYNVVPEQDNYRALKDECRNLPFSGRATRDTR

SEQ ID NO: 176117 - protein, 121 aa, Glycine max
  Coding DNA Sequence Number=SeqID_59339
MQRNVKLSQLYQNMKEAYDEIQTPLVPQMPTTFSKVSIIQELDATAYEEAPAIAFNMSFEISIKMRKHTVFLPYLSELVGLIDATLPPRALDRRFQKDWAEDAREGPRIFMSLMVDFGSMS

SEQ ID NO: 176118 - protein, 87 aa, Glycine max
  Coding DNA Sequence Number=SeqID_59340
MNVLSGATLFCKITHSSNIFMIHIHRDSLGSDQGVPTDLKRIKVIPEWLTPPSVDGRSPEFQEPLDLRSNPFQGGRDDAILPPKGIG

SEQ ID NO: 176119 - protein, 56 aa, Glycine max
  Coding DNA Sequence Number=SeqID_59341
MMNGCSLRTLIEGGHKNKVIMDRVAHFVPGVVYKPCVIAYNGSFVNNTKDFKDVTL

SEQ ID NO: 176120 - protein, 135 aa, Glycine max
  Coding DNA Sequence Number=SeqID_59342
  Homolog annotation: Hit_ID=Q1S1T3; Match level="QueryCoverage=44%, HitCoverage=9%, E-value=1e-12, Identity=62%"; Hit description =Phosphatidylinositol-4-phosphate 5-kinase
MDYNLLIGLHFRDDSSVDEMKSSPRSSHSGNRDMFDNEMLTCWGPLIQLDHGTCLPQLRVCKAGLDHQTTSGSSNSQISDSNQKELSKKEEFQEAPPCSPQLMCIQTANYFEKSKCNPCSQLSAILCYSFGFGVV

SEQ ID NO: 176121 - protein, 125 aa, Glycine max
  Coding DNA Sequence Number=SeqID_59343
  Subcellular localization annotation: CTP_CleavageSite=39; ConfidenceScore=5.31e-01
MAQGISMRGVPRSLLKSGPLATSSTVSCDQCCCMVLFVTAMKIANTTANGTNNQATPKWIEVKSHVQSGGYECGYCMMHWMWNIVSGGLKNDWSMWFLDGTTLDKETNVQHIFLKFKAINVQSLS

SEQ ID NO: 176122 - protein, 178 aa, Glycine max
  Coding DNA Sequence Number=SeqID_59344
  Homolog annotation: Hit_ID=Q1S1Q1; Match level="QueryCoverage=19%, HitCoverage=5%, E-value=2e-08, Identity=85%"; Hit description =Generic methyltransferase
MQELLVQEQIELELHVYVLVQMTLLICHVTEDRCRNLPFGGRATRDSRENRGGACHPARPGEQDCFLQKQPPSGGTSWKAQVGLVAICTPIFTKTPRIVQRCFLLISDMSQNFTNFLTMGAKYLEVVKRKLHATKQWSSDEIRLKTFYTTQTASRLSTLDRSQLVLKELCSCPPHDPL

SEQ ID NO: 176123 - protein, 126 aa, Glycine max
  Coding DNA Sequence Number=SeqID_59345
MGTSEVISSGVLALQILVSEVLDALFGVDVEPEEGELEVEIKEHNAALVVDGGKEKMVGEGFGGEEVPTGRGDQRREVMKGVVKEAGVNDGDGAVKGECHEAMRAQISESVEGGEPHALWNTVWVR

SEQ ID NO: 176124 - protein, 114 aa, Glycine max
  Coding DNA Sequence Number=SeqID_59346
MGVGESGYGRSEREEFNAFIKDIELEDVSLIRRKFTRYRSNGRANCRIDRVLVSKKWLDVWQEKIFRKLVEEEWCEIEEGRWVENPNEIKKEVKAFFGNRFKEVRSHRPTLDGA

SEQ ID NO: 176125 - protein, 300 aa, Glycine max
  Coding DNA Sequence Number=SeqID_59347
MKDTQVTKQGEMWCGRVDIISLDLGCSFYEEADEETIVQDTLDKSVVIGSQVCVVEKEHCEKDTTEEDLKVEDHYRFTIRKAMDLYDNVGGDKGLMRREGVARHGGREARCGEEAKGPRHAALTLKLTRGRAMAMKEVVVLWRIGGWSGGSATVRRRWHMKDLLLQIVNPYDSYGSIRIIWIMNPYESFIRICNPKMLGAQSNPPEGKVASMLEVYEWQHGVGGLSVNSVCNMNSLEMVEEPKSLQNKVLHGQLRCGGSMYLQVLEASIFKKTSEGPGVTRGKIRVSSSEAHTSKVVRGN

SEQ ID NO: 176126 - protein, 69 aa, Glycine max
  Coding DNA Sequence Number=SeqID_59348
  Gene Ontology: Mol. function=peptidyl-prolyl cis-trans isomerase activity; Cellular component=membrane; Biological process=protein folding
  Homolog annotation: Hit_ID=Q8W171; Match level="QueryCoverage=98%, HitCoverage=40%, E-value=1e-22, Identity=73%"; Hit description =Cyclophilin
  Pfam annotation: Domain name=Pro_isomerase; Domain location=5-69; Score=-40.6; E_value=0.00082; Accession=PF00160.11; Description =Cyclophilin type peptidyl-prolyl cis-
MPNPKVFFYMTIDGKPVGRIVMGLYTNVTPHTAKNFGAFCTGEKGVRRSSKPLHYKGLSFHDMISSFMC

SEQ ID NO: 176127 - protein, 123 aa, Glycine max
  Coding DNA Sequence Number=SeqID_59349
MERGHGMYYTPATFSEYPSQMYQYPFVGHDTDTSETSHSFGGVAETQAHFSWPTMTPSQQHDASMATPNAPFAPQWNRLSKQKRGDNAAEEEILIVKREDGIDHVAHPHDITDTIMIDFDVSV

SEQ ID NO: 176128 - protein, 345 aa, Glycine max
  Coding DNA Sequence Number=SeqID_59350
  Gene Ontology: Mol. function=chitin binding; Cellular component =extracellular region; Biological process=chitin metabolic process
  Homolog annotation: Hit_ID=UPI000044A8F0; Match level="QueryCoverage =64%, HitCoverage=99%, E-value=8e-27, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSSPSEDYKSSPSEWLHALAFKGLHVFAFRGLHVLTFRGLHALAFRGLHVLTFRGLHVLTFKGRHALAFGGLHILAFKGLHALASRGLDILTFRGLHVLTFRGLRILAFRGLHVLAFRGLHVLAFRGLHALAIRGLHILPFRGLQVLTFRGLHPLAFRGLHVLTFRWLHALAFKGGLHVLAFRGLHICAFEGLKFLGHPPDLEGGPTVRAQPEREAIVQLLCIPGQDFTQSLQGDEWIMPARHLVDPEKSNRVLGFPALITGLYQFYGVSVAPSKVIRPPTNRAFIKKYCVTRQAQDKAPQQSRDGRQRAIDAPPPPPEPLSSSTKVGALPTTCGRSAGDQVQSR

SEQ ID NO: 176129 - protein, 226 aa, Glycine max
  Coding DNA Sequence Number=SeqID_59351
MGDKLHRREGNSPDHQLRPLNDRSVIKEMNGAKRSAEAVGCKKESVGERSALEGRTRASSAGRSGSENVGLSNANVGENPMPRKPKGSSARSSTEGESGPKISRRRSRWTTGEYSCTTLCWSRGTEEARVIRGRENASSQSSSTRRYSAEVIHAILPGKARTTFNKWVPVPETDTGVPPHKGGRSDQARATVYQKHRSPQSREPTTEAPVNGGRNYNGPKVAKFLV

SEQ ID NO: 176130 - protein, 84 aa, Glycine max
  Coding DNA Sequence Number=SeqID_59352
MSEEVDMDDQNEQECGVNERQVDCLDAFNTSQMMFCSGLDPLLMKMDLSGEYRCRKKEFVRRDTGTRKCGCPFKLCGKPVVGGQ

SEQ ID NO: 176131 - protein, 165 aa, Glycine max
  Coding DNA Sequence Number=SeqID_59353
MWDSTIFGVFNQNFPLYIKHEDLSEITHGGQCLSICVIQLWILHLTETSVRAGNSDVYGCLEPQSIQRSGHSQFESESYIKSWIQSSKRDVYLGAYLNRPDNYLKGIINRQKGITECGYYVMNWMSTIILGSFRNNWETYFNEVRPLEAERFKALRIQWAQYYLK

SEQ ID NO: 176132 - protein, 77 aa, Glycine max
  Coding DNA Sequence Number=SeqID_59354
  Gene Ontology: Mol. function=ribonuclease H activity; Biological process=DNA integration
HGIEAALVSLDNQGIPFTARLGFDCTNNMAEYEAYGLAIQAAIDFNVKLLKVYRDSALVIHQLRGEWETRDHKLITY

SEQ ID NO: 176133 - protein, 124 aa, Glycine max
  Coding DNA Sequence Number=SeqID_59355
  Pfam annotation: Domain name=zf-CCHC; Domain location=94-111; Score =22.9; E_value=0.00016; Accession=PF00098.13; Description=Zinc knuckle
MSLDTLFGKLQEHKMELLRLNQHEENDKKKKGIALKASSSIQEESDKEDLIDLDEDDDLSLFVKRFNKFLRIRGNQRRPNFKPKRRIEDLPSTPKCYECNQPGHLRVDCLIFKKRMEKSEKKNF

SEQ ID NO: 176134 - protein, 47 aa, Glycine max
  Coding DNA Sequence Number=SeqID_59356
MAVHIQDLVAALVKRMQSAQNCILLSSLLIVFARLRLKASTTGNGHL

SEQ ID NO: 176135 - protein, 114 aa, Glycine max
  Coding DNA Sequence Number=SeqID_59357
MSSVIYAFKRRQYLHLHFKRLQCLQSFTLSKDDNVFIYFSKDFNVFSHLRFQKTTTSSFTFQRLQRLLSFIGLNDAILPRKGPVTRAMSKRLQEDWARAAEEGPRVLMNLRVDF

SEQ ID NO: 176136 - protein, 125 aa, Glycine max
  Coding DNA Sequence Number=SeqID_59358
MTGHDWPRILFPTCRYMGMDASGDRVTTDRSLPFPGAKQAENIAARQPSSRRKTLARKGGGDMVNVPLKKKMWQVSSPGRATNPCTQIIKNEGGERFGIQKLPPPPHSKDKEHKGLRFLVPLSHF

SEQ ID NO: 176137 - protein, 99 aa, Glycine max
  Coding DNA Sequence Number=SeqID_59359
  Gene Ontology: Mol. function=chitin binding; Cellular component =extracellular region; Biological process=chitin metabolic process
  Homolog annotation: Hit_ID=UPI000044A8F0; Match level="QueryCoverage =68%, HitCoverage=98%, E-value=5e-08, Identity=35%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=67; ConfidenceScore=5.67e-01
MARTCSPLKVRVCSPLKVRTCSPLKARTCSPLIARMCSPLKMRTCSPLNARTCSPLKASTCRPLKARACSLSYPNFVRGPLLDDMRPFFGPCEVLGTHH

SEQ ID NO: 176138 - protein, 57 aa, Glycine max
  Coding DNA Sequence Number=SeqID_59360
MDRNKGPYECGYYVMHWMWCIVNDGLKNEWNKWFPDGTPLDKDTITTPRLPLDFGRA

SEQ ID NO: 176139 - protein, 150 aa, Glycine max
  Coding DNA Sequence Number=SeqID_59361
MDGLSLQLFPSALHVKLKARLCFLDYIKGSKNPFDFISLINRINQSDSMYIPTSVFIIHIINHISSVVAVVAAQYSTSVDEPATVCCLFESHEMGLPPKEYKARRLKEALLENEDSTSVILDKLHRLLIVVVGDFVKWGSQFYNSCQRPS

SEQ ID NO: 176140 - protein, 156 aa, Glycine max
  Coding DNA Sequence Number=SeqID_59362
  Homolog annotation: Hit_ID=P57997; Match level="QueryCoverage=37%, HitCoverage=5%, E-value=3e-19, Identity=83%"; Hit description =Translation initiation factor IF-2, chloroplast precursor
MQIYCMLGLMFAIAVRKALDILPQDNVTLKFLLEATGDVSTSDVDLAVASKAIILGFNVKALGSVKSYAKNKDFHYSSSVILSKTLEFVLFHELLQLGVATIDPDDPILSADDLANQIAEVLNYFGLWYKVLEILEQNKRKGKVVQLRLEADVASP

SEQ ID NO: 176141 - protein, 187 aa, Glycine max
  Coding DNA Sequence Number=SeqID_59363
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=3e-25, Identity=33%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
VHAFKGLHALAFTGLHVLTFRGLHALSFRGLRVLAFRGLHALAIRGLHILAFRGLHAVAFRGLHALAFRGLQVLAVRGLNALAFTGLHALAFTGLRALSFKGLHVLAFRGLHALSFRGLHALAFRGLQVLAFRGLHTFTFTGLHALAFRGLHALAFRGLHVLTSKGYTPSPSEGCTPSPSEDYTSSP

SEQ ID NO: 176142 - protein, 168 aa, Glycine max
  Coding DNA Sequence Number=SeqID_59364
  Gene Ontology: Mol. function=unspecific monooxygenase activity
  Homolog annotation: Hit_ID=O04892; Match level="QueryCoverage=50%, HitCoverage=16%, E-value=1e-22, Identity=76%"; Hit description =Cytochrome P450 like_TBP
MSRRARRSLQNPGREPGRSGRRCRSWCLPTLETAQPEVGSSGWKSTARRVVSGAPPAALENPEDRVPPTPGKGSRQNGSVTSGKGLALRAGHGGPSPEPVGCRWTARAASAARAGRRVPVGGRIGNGPFGASSPGVEQSTQNWYGQGESDCLIKTNALRWSPADVDAM

SEQ ID NO: 176143 - protein, 134 aa, Glycine max
  Coding DNA Sequence Number=SeqID_59365
MQTKNECHDPAFKRRTTQNANELASAPRLLHCYCSDGTSHSRLKAPTVLALPTSCGLKSPSSLARPSRPRHVSSMHEVATPTCDLHTGYVQKQHPLGNSLERAPIWEKVCNSVPNWEICQVAMPMVLEVEMSMV

SEQ ID NO: 176144 - protein, 84 aa, Glycine max
  Coding DNA Sequence Number=SeqID_59366
MKNKKVVMAGVSLSEACPLSENHPLSEALSLLSKLGESGGEYAKHLDVQRIISSLSESFVFSRAKRTQLTQQKITYSRLAQKWR

SEQ ID NO: 176145 - protein, 160 aa, Glycine max
  Coding DNA Sequence Number=SeqID_59367
  Gene Ontology: Mol. function=cysteine desulfurase activity; Cellular component=mitochondrion; Biological process=cysteine metabolic process
  Homolog annotation: Hit_ID=Q8ZN40; Match level="QueryCoverage=96%, HitCoverage=38%, E-value=8e-63, Identity=75%"; Hit description =Cysteine desulfurase
MHGGGHERGMRSGTLPVHQIVGMGDAYRIAREEMADESARLATLRHRLWQGISTLRDVQLNGSLEQGAPNILNISFAHVDGESLIMALKDLALSSGSACTSASLEPSYVLRAMGVDQQLAYSSLRFSLGRFTTQEEIDYAIGVVHKAVTRLRALTPATSR

SEQ ID NO: 176146 - protein, 393 aa, Glycine max
  Coding DNA Sequence Number=SeqID_59368
  Gene Ontology: Mol. function=protein dimerization activity; Cellular component=nucleus; Biological process=regulation of transcription, DNA-dependent
  Homolog annotation: Hit_ID=Q8S7E7; Match level="QueryCoverage=82%, HitCoverage=33%, E-value=6e-78, Identity=39%"; Hit description =Putative transposase
MELWGSPRLLCGIAIQLSHVGICVPSSVVDFFKERKRRWCLEGVMVNKGTQWRTHVYPRMGRHDFGKQSGGDTFVIEGFTNWNKKERLSSHVGGPNSAHNIGSQGLAFRGHDESTNSANQGNFLELLRFLAKHNESINHVVLENAPENHQLIAPKIQKDIVNAAALETTNAIITDLEDELFAIIVDEARDISNKEQMAIALRYVNKKESIVERFFGMVHVKDTTTLSLKMAIDELFCKHGLSISRIRGQGYDGASNMQGEFSGLKSLILKENSSAFYALGKGEIPSGQGLNQETSLKRVFDTRWGSHYATLINLILMYSSIIDALEIIKEDGSNADQRAEANGLLHLLEDFDFAFTLHLMENVLGISNELSQALQRKDQDIINVMNLVNITKL

SEQ ID NO: 176147 - protein, 58 aa, Glycine max
  Coding DNA Sequence Number=SeqID_59369
HVRWSRELKISFNLVFSLGVVKKAVELGGWHWLVLTNGIEVKLQRNDLSVIEAQNLFD

SEQ ID NO: 176148 - protein, 93 aa, Glycine max
  Coding DNA Sequence Number=SeqID_59370
  Subcellular localization annotation: CTP_CleavageSite=22; ConfidenceScore=5.12e-01
MRNRISSFLSLSLSLSSSIVALLSTVVPQPFQAYAKALEAKLLRTREALRQALEDKNSMAAEGRRKKDDWRRHFKEKMSQEEAHHHKKPWIRA

SEQ ID NO: 176149 - protein, 139 aa, Glycine max
  Coding DNA Sequence Number=SeqID_59371
MAQKLTKYHSKSGLLEVFPINVRNKKEMEFLELKFMMRIVGQELHNYKSVGLVKDKKFGAQNRTKPYLALVNQPNHHYNSQKTTINHPSGGGSVGSALSTPWRCRKCGCTNHATWDFKDKEVHWKRLSQFQVGYEKWRT

SEQ ID NO: 176150 - protein, 54 aa, Glycine max
  Coding DNA Sequence Number=SeqID_59372
MVTSLSTFIGNKNGGGGAIEFHGLDQFQRNNPSTFKGTYNLEVLAQGQVYSTQY

SEQ ID NO: 176151 - protein, 187 aa, Glycine max
  Coding DNA Sequence Number=SeqID_59373
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=O22613; Match level="QueryCoverage=77%, HitCoverage=27%, E-value=6e-32, Identity=75%"; Hit description =Plasma membrane proton ATPase
MTISKDRVKPSPFPDNWKLNEIFATGVVLGGYLALMTIIFFWAIKETTFFLKDYSKKDREAQWALSHKTLHGLQPPKISNIFNEKNSYKELIKSSYRELSEISKQAKRRVEVARLRELHKLKRHVEFVVKLKGLDIDTIQQHYTVNLPNQDSWMNTFHNGGIKDSSGTIVECVLKSTLKAFFSSSDV

SEQ ID NO: 176152 - protein, 91 aa, Glycine max
  Coding DNA Sequence Number=SeqID_59374
MTSMNVATIFGKLREHGLELGRLKEDEEIDQKRKGLALKPTTSNHGERHIKVDFPIYLKKQQGGDKKPKKSSKKRRAYVAWEDNDESSSSC

SEQ ID NO: 176153 - protein, 40 aa, Glycine max
  Coding DNA Sequence Number=SeqID_59375
MKRVNSRKRLARVTSLIGKKCVDVIANLKQEVLLEQLQWK

SEQ ID NO: 176154 - protein, 119 aa, Glycine max
  Coding DNA Sequence Number=SeqID_59376
MKKKELLILKVCVEEFMAYHASSKANQNSMKNHEIHFEVEAQEKSLVKEQESREKDEEKDELYYMKFMEFLAKSPFGKRKPHAKRIIVHALSRESQALSAQPLHLRLIWSAKLAKVELS

SEQ ID NO: 176155 - protein, 235 aa, Glycine max
  Coding DNA Sequence Number=SeqID_59377
  Gene Ontology: Mol. function=transcription factor activity; Biological process=regulation of transcription, DNA-dependent
  Homolog annotation: Hit_ID=UPI0000E68DAF; Match level="QueryCoverage =68%, HitCoverage=65%, E-value=5e-25, Identity=43%"; Hit description =transcriptional regulator, TetR family
  Subcellular localization annotation: CTP_CleavageSite=47; ConfidenceScore=5.76e-01
PGTGPSTIGPRLRPTPSGWTAAGPRRSCWAISPMPMSGNCRTAGACCASPAGPTRRLFRRAWAPCRRCCPAVLRGARLSLHQHARHRAGCLGEPGQPVQPLRQQGGLDCRGRHAGADRAAALAAGAGAGRSPFAAGGGAIPGRLPGAVPPAGMGRTQRRMPVRDRAFARAGAGLRGQPQAHARRTGRLHGARGAAGPLAARRARAPGRAIAAGCRGKRCAALCAGGDAARRRGGG

SEQ ID NO: 176156 - protein, 273 aa, Glycine max
  Coding DNA Sequence Number=SeqID_59378
MEVQAKEGQCDDAILPRNGPVTRAMSKRLQEDWARAIEEGPRVIMNLRGSIIPSELTDKFRHYHFGVFKEVVDATQQKLGEQIYPPKDRRSDQGKLLFSESKGSTLTSLSCPMLQGKELLIEDDDDAKSVKFVKARPSRLFKHELEALKNKFDLITLNGYDIRRLCRLQKCCSDLEPEEKPFVDAYHHEFDHTFSFMVSIPFSRFFFTHLVDPIIKEVEFDVEVASASLIVQVYYPSPSRAYVCLLEVELIRTREALTQVLKDRSHAKKEAHK

SEQ ID NO: 176157 - protein, 172 aa, Glycine max
  Coding DNA Sequence Number=SeqID_59379
  Gene Ontology: Mol. function=zinc ion binding; Cellular component =intracellular
  Homolog annotation: Hit_ID=Q655W8; Match level="QueryCoverage=93%, HitCoverage=68%, E-value=4e-21, Identity=35%"; Hit description =Putative zinc-binding protein
  Pfam annotation: Domain name=PLATZ; Domain location=2-59; Score=30.0; E_value=1.6e-08; Accession=PF04640.4; Description=PLATZ transcription factor
  Subcellular localization annotation: CTP_CleavageSite=30; ConfidenceScore=5.62e-01
MVGFSLSLSLQSYTTNSAKVVFLNQRPQTRNFRGSGNFCGTCDRSLQDPYHFCSLSCKINYLVRTTGSLCNYLFECNYLPLPESGLDDGLMTPDSVLEPAGSARTSSGSGGYGGVDCRTTLACTATTEIVRKKRTGGSTFRPPCRPACSPVSEISAGLMNRRKGNPQRAPLY

SEQ ID NO: 176158 - protein, 62 aa, Glycine max
  Coding DNA Sequence Number=SeqID_59380
MQVALWRHGETMTTTMIMTVKVKVMVADKGDDDNDNHDSSYNNDHGSGNNDDEGPNGGSDDG

SEQ ID NO: 176159 - protein, 78 aa, Glycine max
  Coding DNA Sequence Number=SeqID_59381
MEGDGLKSLIIHDQYIDDAHVSYFILHGSSINFITHGPEIYPKTHKNPRAFSCISGPIYLESSIQYPCGVGLHQLVTF

SEQ ID NO: 176160 - protein, 182 aa, Glycine max
  Coding DNA Sequence Number=SeqID_59382
  Gene Ontology: Mol. function=nucleic acid binding; Cellular component= nucleus; Biological process=DNA integration
  Homolog annotation: Hit_ID=Q1RVB5; Match level="QueryCoverage=92%, HitCoverage=17%, E-value=5e-28, Identity=32%"; Hit description =Peptidase, cysteine peptidase active site; Zinc finger, CCHC-type; Peptidase aspartic, ...
  Homolog annotation: Hit description=catalytic; Polynucleotidyl transferase, Ribonuclease H fold
MESEEKQKWLDAKKDEIKSLHYNYTFDLVKLPKGMRALNNKWIYKVKHETNSMSPRIVLSLPTTLDLEVVQMDVKTAFLHGDLEEEIYMKQPNGFQVEGNEDYDQRQWYKKFEFDMCEQGYNKTTSNHCVFIIKFSNDDFIILLLLKKQLGKSFAMKGLGVVKQILGKQEEEEVVVVTRTLH

SEQ ID NO: 176161 - protein, 70 aa, Glycine max
  Coding DNA Sequence Number=SeqID_59383
MPLLVYLVVGQLVVGHLVGHYVVVAGHLVGHYLVVVDGPDVDGEEVGTKGHLTEIHASLSLIDKAPPLVN

SEQ ID NO: 176162 - protein, 90 aa, Glycine max
  Coding DNA Sequence Number=SeqID_59384
  Gene Ontology: Cellular component=mitochondrion
  Homolog annotation: Hit_ID=Q39818; Match level="QueryCoverage=70%, HitCoverage=32%, E-value=2e-12, Identity=58%"; Hit description=Heat shock 22 kDa protein, mitochondrial precursor
MNLVGATTIPTALSDAPLQHLVATTTRNTVIVKGEGDKKESAPCYNCKIDLPPDNLYKFDHIKAKMKNGDVFVPKIKDKERKDAINVKVE

SEQ ID NO: 176163 - protein, 122 aa, Glycine max
  Coding DNA Sequence Number=SeqID_59385
MVDADAEPSATSLDRLEAAMTQLAAVQASMDFNLYASQLRFTATQTSMIFKLDLIILKLDTMISLQRSPFCSSVQPPSLPPPPAPPSNAYSYHPSQYPPPPRPHVPPSQFTPHSHVPPQPYP

SEQ ID NO: 176164 - protein, 53 aa, Glycine max
  Coding DNA Sequence Number=SeqID_59386
MTPLKTGLVFGFGAMFGILMSLGAQCHKTGHHHPWSCHTKARTKEIAEVILMI

SEQ ID NO: 176165 - protein, 119 aa, Glycine max
  Coding DNA Sequence Number=SeqID_59387
  Homolog annotation: Hit_ID=Q1S0A6; Match level="QueryCoverage=80%, HitCoverage=9%, E-value=4e-10, Identity=31%"; Hit description=Zinc finger, CCHC-type; Peptidase aspartic, catalytic; Polynucleotidyl transferase, Ribonuclease H fold
MALAAQTGARMKGFENKNKSIYTNCNKSGHDEAGCFLLIRYPKLWGDYPKNNDKNLGFNISGDVENSGMTGLSKEQLKTLVELLNNLKDRTLKMLIGVGEQRDGLYFFQEIRKVKACRV

SEQ ID NO: 176166 - protein, 96 aa, Glycine max
  Coding DNA Sequence Number=SeqID_59388
MLEIEGGIPVWLKLENLVARRSEYLYLGGLLSSGLSTSIILFKFEIQLNPYFGSAPSLRGLASSAVGLRNGLRISHKYIVPLSENYKQLGLDPELG

SEQ ID NO: 176167 - protein, 108 aa, Glycine max
  Coding DNA Sequence Number=SeqID_59389
  Subcellular localization annotation: CTP_CleavageSite=78; ConfidenceScore=5.47e-01
MTFMPTLQKTQPNMATIGMFNIVQSISSLVGICPRPALANMSNMLANVGLARRLTDAIGQICLPCVTSFVSPLGSNSQAMTMGNTNGKVSYVNNDASIGANAMSQIGY

SEQ ID NO: 176168 - protein, 139 aa, Glycine max
  Coding DNA Sequence Number=SeqID_59390
  Gene Ontology: Mol. function=nucleic acid binding; Biological process= DNA integration
  Homolog annotation: Hit_ID=Q1S0A6; Match level="QueryCoverage=93%, HitCoverage=11%, E-value=2e-36, Identity=48%"; Hit description=Zinc finger, CCHC-type; Peptidase aspartic, catalytic; Polynucleotidyl transferase, Ribonuclease H fold
MGGDDQSQKNRPLSYDLNSNDNPESVITQVQLWGENYDEWARAMKNSLRARRKLGFIDRTITKLEEGSSVMEDWLTIQAMLLKSNLTQRKQGCLSMVAYYGKLKALLDDLTNYEQLPTCNCKGFTCGVAAILEKHREEE

SEQ ID NO: 176169 - protein, 175 aa, Glycine max
  Coding DNA Sequence Number=SeqID_59391
MTTMANTTVTIISGREVTRVGERKSRGEKRVFDECGEKSKVNFHKSQVAGVGVSKGDIQRFVVVLNCMLSDCEDNKKEALWVKVVIARSKSREDPVQNPSTSSWWMNIWKICQRGNQGVWFWSNYRRILGDGRDTLKQSYPPKALDRRLQEDWARDAREGPRVVMSLMVDFELVG

SEQ ID NO: 176170 - protein, 64 aa, Glycine max
  Coding DNA Sequence Number=SeqID_59392
  Subcellular localization annotation: CTP_CleavageSite=28; ConfidenceScore=5.11e-01
MYKDKWVHTEPMGAKSTLRPMRNLWPSPASLAQSSWSLLSNVLGGFSMAETHLNCLKAPLFLQQ

SEQ ID NO: 176171 - protein, 75 aa, Glycine max
  Coding DNA Sequence Number=SeqID_59393
MAKLAILARKVYEEITKYVVLESLKTLSIEEVQRKAVEEATMMDVYNELVLEEMKELKRVQSTVEHGPILLSVDN

SEQ ID NO: 176172 - protein, 64 aa, Glycine max
  Coding DNA Sequence Number=SeqID_59394
MLLKILPLPRLYRNKELLKRDWLVVSMHNYREASKSADSLLFLFMADSAPYFHSKKNAFAELTE

SEQ ID NO: 176173 - protein, 102 aa, Glycine max
  Coding DNA Sequence Number=SeqID_59395
  Gene Ontology: Mol. function=hydrolase activity, hydrolyzing O -glycosyl compounds; Cellular component=cell wall; Biological process= carbohydrate metabolic process
  Homolog annotation: Hit_ID=Q8L9A9; Match level="QueryCoverage=60%, HitCoverage=21%, E-value=4e-25, Identity=79%"; Hit description =Probable xyloglucan endotransglucosylase/hydrolase protein 8 precursor
  Pfam annotation: Domain name=Glyco_hydro_16; Domain location=11-102; Score=-72.1; E_value=0.029; Accession=PF00722.11; Description =Glycosyl hydrolases family 16
MWGFDRGSNHTSRRFRRVQAKHRAMNNINDYAESLFQMCSENGAGPERYELDFEFLGNKTGEPYLIQTNVYKNGTRGRKMRHMLWFDPAEDYHTYSIKQELE

SEQ ID NO: 176174 - protein, 59 aa, Glycine max
  Coding DNA Sequence Number=SeqID_59396
  Gene Ontology: Mol. function=cysteine-type peptidase activity; Cellular component=cytoplasm; Biological process=fucose metabolic process
MGMEYQKIQTCPNDCILYRHEFQEMPKCPRCGVSRYKVKDDEECSSDGNSKKGPPAKVL

SEQ ID NO: 176175 - protein, 70 aa, Glycine max
  Coding DNA Sequence Number=SeqID_59397
MSQAMKDQKEKANTICNSHVISKYASMIVVEKTMSKPHSLSLIIKQSIVYRYRNLKQRIMIHNNIQSCFQ

SEQ ID NO: 176176 - protein, 94 aa, Glycine max
  Coding DNA Sequence Number=SeqID_59398
VKGLCGGVEATVALEGWRFQEFAVERVADDGLDQTVLFDVRYERACGGVAGSCGCVRGGPTRRLKLLGGGVVNYPLVVGGSGSHQYLYNKREGN

SEQ ID NO: 176177 - protein, 86 aa, Glycine max
  Coding DNA Sequence Number=SeqID_59399
  Gene Ontology: Mol. function=NADH dehydrogenase (ubiquinone) activity; Cellular component=membrane; Biological process=electron transport
MMELEARRERVRQNVARKVSGPDLKSFIQQLPVSSEGKEVEEPPSAMGGLRNPQESLAEKEKDESESSEPTGSGASFRPGTWQPPT

SEQ ID NO: 176178 - protein, 178 aa, Glycine max
  Coding DNA Sequence Number=SeqID_59400
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=Q01909; Match level="QueryCoverage=54%, HitCoverage=27%, E-value=3e-13, Identity=47%"; Hit description=ATP synthase gamma chain 2, chloroplast precursor
  Pfam annotation: Domain name=ATP-synt; Domain location=2-177; Score= -181.3; E_value=0.1; Accession=PF00231.9; Description=ATP synthase
MASSKQQQSPINIERRITYLEGETKKEKEEDAPSRRRNKKQEAKEEGRKNKHLRGRGIVTRTDESLFDYIPKGEGHFSLFTRVVGCPKQLPSFFKIDEEVDQVELVYTKFVSLVRFEPVIQNLLPLGEVCDVKDEIFRLSSKEWKLAVEKDVDPVMVLLTVIVFRISLDTLWMDFAQS

SEQ ID NO: 176179 - protein, 107 aa, Glycine max
  Coding DNA Sequence Number=SeqID_59401
MENMMQNVTVPPETILQTVHARGQIFGEVSKNIPSSMYYFLKDKGWTHLHLENVAEYRLVFNHWRKTLKIRVGWKHLCETLSLIADMEIVFEFIDLTLNRVLYWPCL

SEQ ID NO: 176180 - protein, 147 aa, Glycine max
  Coding DNA Sequence Number=SeqID_59402
MGRRLLLPADLLERIAADAPLPDAVVDLPLEQGGFGPAPFSGVSSGAPQAGGRSSGMAAGGPPERLEIGVRRGGCNGRREWTQRAGGVAGDLHRQRKNEAERGGVYFYGQRIFLLPSILLCLKKQHFCTIACYFGKMAIISIFKKLK

SEQ ID NO: 176181 - protein, 123 aa, Glycine max
  Coding DNA Sequence Number=SeqID_59403
  Gene Ontology: Mol. function=protein-methionine-S-oxide reductase activity; Biological process=protein metabolic process
  Homolog annotation: Hit_ID=Q84L12; Match level="QueryCoverage=70%, HitCoverage=34%, E-value=4e-36, Identity=80%"; Hit description =Peptide methionine sulfoxide reductase
  Pfam annotation: Domain name=PMSR; Domain location=22-110; Score =13.1; E_value=4.1e-09; Accession=PF01625.11; Description=Peptide methionine sulfoxide reductase
MSFFPLLHTIAPYICDFTVHKTLGCGKELVAKLDLTHNRYTSQTRTQYRSGIYYYTPEQEKAAIESLEQQQKKLNRKIVTEILPAKKFYRAEEYHQQYLEKGGRFGSKQSASKGCNDPIRCYG

SEQ ID NO: 176182 - protein, 86 aa, Glycine max
  Coding DNA Sequence Number=SeqID_59404
MVVVTLTTVVGGIVVMMKVVRRQKRGVVVMTIVVEWWWRRKWRGGDGGDNGGMIAMEAITTAMVGAMMVVVMLSGALDYESNAKIV

SEQ ID NO: 176183 - protein, 1725 aa, Glycine max
  Coding DNA Sequence Number=SeqID_59405
  Gene Ontology: Mol. function=DNA-directed RNA polymerase activity; Cellular component=mitochondrion; Biological process=electron transport
  Homolog annotation: Hit_ID=UPI00006A0736; Match level="QueryCoverage =18%, HitCoverage=38%, E-value=4e-21, Identity=25%"; Hit description =Nucleolar preribosomal-associated protein 1
HADLTERLGGSYECDEVFPEWKPLEDLLDFVESILHQQNYCIFSKNEESVLPDSSLGSALGSVNRLLNSGSGHEIAETTIAFISSIILEGTNKILTNMPSHAVIPHDLVGVPFSLLLSVLFLDYSVLHHASKLWPAMFYAGLDMAMSDLGIDGRNAAPVGTSDLALHPDSLTCSQLLDASEVDAVTFSIFLKQVPFHVIFPAMMCMSGPYISKLSKIQEFLLHKLSESNDSSLLPNLRLILFWTHRIRSCYDVKPIAEIEQLLNLCVILVGSLLAQLLVPESGYDWSINSAFYSSRRNIQVIKTIFCHPCVLISLSFSLGSCQNLANGNVENDFNMLNVVSNEGFHNFGNPILKILTMTLEYMWSLFGAHLCASTAEDVANNFVKAFKGLQQKLFLDVRDRFELYICTKDVMPLLPTLYASHTLHRFLSPFQLLELVDWMFSRDKVDDLPIKKSSLFVGCSLAADAFSALSIYFQQSTENRAPYDLFWEMSQKNMKTDIFEQIYSKVVDFSVCFEIDSADRCLLEAVNLLYKQKIVQQETFHPLTSVMWKIIMVTPLKVLFHCIYKTNAKKAAFLHILTELSSLHSLIFGHLFLGTVNKSIHHDIGVMEHTFDPTFSEDQFLLLLPASLSYFSLISKRLREQSHKDFEHIPYFYSKILVKGFSQWKSFSSKDIFEEQYGEFFPSSAQELLRLIDLSLLGKSIHMLKYHFALNGAMKLKKRLNLFKSICPKFASHDDLMDCDCQVIDSYSLHQSLNIINRVVAKISLCKVLLFHEEAGGNFKDVAVKMKSKLGRSRIRFINILVDIWQFIVKKFSLASDQSRTPKGTNISLLYNHLEGFLLKNILELAGEMQNDLIQLQAISFLEQLIRSALLYRFGDFTTMKTLRVILSQLSKGRLSYDLYLQLLLAHSQFAPTLHSVCKQAGSFLKPVSSILKCLVIPSLDHCENDVKHRGLMTELSSGPLEIVKMLWILLRVKAHQIDLDNGNDINVNLKELHALLCHSYGATVNWIDLEIYNLMQHIESMSGLLSQNVKLDSETIEKWYRSQHSDSFPIDPDICVSTVLYFPYDRTIFDELPSVNKIEPDTVRKKVLHSQVEDKERYDPVFILRFSIHSLSKAYIEPVEFAGSGLLAIAFVSMSSPDQGIRRLAYGTLDKFKNALECQKKKDVLGLRLLLNSVQNSIEEPWQRIPSVIALFAAEASCVLLDPAHGHYAAISTFLTHSSKLNMRYLCQFQAERSWMLRLVYAGMNSDDDVALYIRNSILEKLMSFYVSPLSDFLSKNLIIELVIKKSVKLHKITRHLVKHCSLFSWFSSLISVARQRLNVDEHKLFLKHVLVALKTCLTYVARYWFPLDYIKSAVEPIIWHIFCILLSGTSGSISKWLQNHGLEQLMELSSNLFNFLFHDATLANETVVLVNPFLQMIASVLKLSQKRKIYQPHFTLSIEGLYQMYQAGSACNQATKSIKPELALEAIIMSAPPASIFLMNQERLQSFLIWATTTALQSKSLQRLGSTESQILRNNLREDFQENSVVSTFLRWLIASVIIGKLHKKSYNWDSEYAETHNLESLHSLLVHVKNTSGQRNDIDIGAEEVLASTIFHLQLRLGVNHEVLPSVVCALCLLMFGASKFAVSRTDLLKDYNALIASHSSRVQCPPEANPTWRWSFYQPWKDDSLELTDSQKMEEYHACLTLLVIVSNVLGGKKLESASLSPVDLEKSGLFQWERSLLRN

SEQ ID NO: 176184 - protein, 59 aa, Glycine max
  Coding DNA Sequence Number=SeqID_59406
MAEELEQLAQCVNNRSTRGANLEPASYGLMCICGLACSLRLSAQSLMLVGLRLSEHMLA

SEQ ID NO: 176185 - protein, 777 aa, Glycine max
  Coding DNA Sequence Number=SeqID_59407
  Gene Ontology: Mol. function=DNA-directed RNA polymerase activity; Cellular component=mitochondrion; Biological process=electron transport
  Homolog annotation: Hit_ID=Q01H01; Match level="QueryCoverage=41%, HitCoverage=16%, E-value=3e-36, Identity=29%"; Hit description=[S] KOG1791 Uncharacterized conserved protein
MEEPAAVPNFQPKVSHEAKLKELLHRITSLEIKLCSDAAKEFAKLLKSETGADLLLEYVRGSPKCSELLEAWKLREGKQGMNYVFDLISAILSQSKGKYNPSDIESVNITKDLDKFARLLISERLSDIHKEVNSKEWRRQKAALLLMASIARRGASLASEVAKSFDFKLAEFGRIASEHRRRKPEARVGLLRKSFVGFAMSFLEVGKPWLLRWVLQQKQMYSGVLRGLGNDDDETVVFVLTVLRDRVLVEESLVQPWLRSVLFGSATLEQLAEVCGREGGGDAAEVAFGVLVRVCTDPSNGLMPDSRMGLTGNTKRVLDLMKKLRVTEVQYHKDLLLAIVEAKASFGLSYLKEFPYNIDNFKSSSWISALSVAAQLVSLVGNGISKESVNFQSNGPRLFDNMDLHSIVKCLFPRPFSRSLFNKGLPHIEPYVKHGTLRLLLELLKLLDSIFGGLYCNSNSNNPFMQHMMSIKVEIQNYVQAFLPDLQVLLNLLSSLDANSEARNSSLKRNACHHEHNSSSRKKLKLDTSESGDIDIVVAGISSTPDIDLTGNSETVDGGAREDALDDEEDLKNSIGEIWGVDLCSMEINTLEEMESYLLSKLLDALRYYRRALPYALDNSFETFKGLLKSPLELTSHLQVSVLSLLVEYIEWCPDDVIPIRTPPMLYKYLQPFIKLLMFSPYNETRDLAYKLALAAMFSTGAFDGNLHEIAAWFLFLPGYHGKKPPVKILEVDVLQSLTLFVISFLCDAVSTLGNNLIKYWDILKNHAHCLEGGEGN

SEQ ID NO: 176186 - protein, 199 aa, Glycine max
  Coding DNA Sequence Number=SeqID_59408
  Homolog annotation: Hit_ID=Q1SP02; Match level="QueryCoverage=89%, HitCoverage=47%, E-value=1e-11, Identity=28%"; Hit description=IMP dehydrogenase/GMP reductase
  Pfam annotation: Domain name=DUF1723; Domain location=36-83; Score =43.1; E_value=9.3e-10; Accession=PF08330.1; Description=Protein of unknown function (DUF1723)
MTQLKRSSNSMKKQLLMPKVFQAGRLSHLVTCSLDTDDRVLILAFAERWHKETSSFHLPVGDVTLDDMAFLLHLPITGAFYIFETLHVDEVVLMLVELLKVSGHEARTEAEQCHGAYSGHYAWGVATLVHMYNNLNDASKSSSRQLAKYITLLQCWIYDHFSSLAEAFTDEDYDERSPHAYSWTSTKALPVSTYRKHID

SEQ ID NO: 176187 - protein, 77 aa, Glycine max
  Coding DNA Sequence Number=SeqID_59409
MVMTTATTIIIIMDDNSDEDNNYNKDNNHDGVITMVITITMAVTILVVVAVMMRLGLKDFLSRALLGAPGILLVHQA

SEQ ID NO: 176188 - protein, 51 aa, Glycine max
  Coding DNA Sequence Number=SeqID_59410
MGYQRKKLHCTFRRCCNKVHALNGRWTCYEGLCQGPCIVDPFPFDEYTSTI

SEQ ID NO: 176189 - protein, 195 aa, Glycine max
  Coding DNA Sequence Number=SeqID_59411
  Gene Ontology: Mol. function=nucleic acid binding
  Homolog annotation: Hit_ID=Q1SKZ9; Match level="QueryCoverage=58%, HitCoverage=25%, E-value=1e-08, Identity=32%"; Hit description=Zinc finger, CCHC-type
MVTFRVLHNLTKELDHLDCSKKKGKVGGVNVSGLSKGHESQGIVDDYVSKDKEVLLSVDMALEPKSILRPRVKVPKDQIKEACRPWKKAIVVKLLRKKLSMRFLRVRLPKLWQPLGEMEMIDLESDYFLIRWSMNGHGPVFVGSEMDPDFFPYERQMRKVAIYRHKKKYASWKAMRLMVWELGALLCHFKKVLSE

SEQ ID NO: 176190 - protein, 514 aa, Glycine max
  Coding DNA Sequence Number=SeqID_59412
  Gene Ontology: Mol. function=protein dimerization activity; Cellular component=chromatin; Biological process=DNA integration
  Homolog annotation: Hit_ID=Q1S5N2; Match level="QueryCoverage=58%, HitCoverage=67%, E-value=4e-59, Identity=38%"; Hit description=Viral capsid/hemagglutinin protein
  Pfam annotation: Domain name=DUF659; Domain location=157-283; Score =108.9; E_value=1.5e-29; Accession=PF04937.6; Description=Protein of unknown function (DUF 659)
  Pfam annotation: Domain name=zf-C2HC_plant; Domain location=13-65; Score=57.7; E_value=3.8e-14; Accession=PF07567.3; Description =Protein of unknown function, DUF1544
  Pfam module annotation: Pfam domain module=DUF659::zf-C2HC_plant; Domain location=157-283::13-65
MANEGSSNPSSTDSGWKYCTRGQGNSCVCNFCGKVTKGGITRAKEHLMAKPGNVAAYAKCPKEVREELWGYLKDTKKQESETFQRMRQHFLEDYGDSDEERALDEGQSCDKEATARVHQYIARFWYQAGLSFNLVKLQSFHKMLTNVGAFGPNLRPPSYHEIRVPLLAKELENTEILLKDQKELWGRFGCSIMSDVWTDRKQRSIINFLVNCTAGTMFYKSIDPSNFVKSGEKTFELLDSIVEEIGEEKVVQVITGNGSNYVLADIGKLPLIKKTILRAISLVGFIYSHSSTLSLLRFATSFLTLERLHKEKGNLRKMFVSDDWTNNKLSKEAKGKEATKTVLMSAFWNNVLYILKVMAPLVKAMEKAKEAIRKSFEYNESKYKEVFEIIDSRWTCQLHHPLHAAGHFLNPDLFFSNHSMEFDFEVVNGLYVCLEKLVPDQEPMTYTRQKTKKKKEPESLGVEDATPKTKRGQVRGSSSLRGKEQMIKVEDNAVLEESEELQGIDFGDSEEVSF

SEQ ID NO: 176191 - protein, 53 aa, Glycine max
  Coding DNA Sequence Number=SeqID_59413
MQKKMVEEGQGVERERRSRHMSQANFVLITGNRFKIILGVFLSIFANSGYQDA

SEQ ID NO: 176192 - protein, 453 aa, Glycine max
  Coding DNA Sequence Number=SeqID_59414
  Gene Ontology: Mol. function=nucleic acid binding; Cellular component= cellular_component; Biological process=biological_process
  Homolog annotation: Hit_ID=Q7X7W8; Match level="QueryCoverage=96%, HitCoverage=98%, E-value=1e-162, Identity=62%"; Hit description =Makorin ring-zinc-finger protein
  Pfam annotation: Domain name=zf-C3HC4; Domain location=188-251; Score= 24.2; E_value=0.00046; Accession=PF00097.15; Description=Zinc finger, C3HC4 type (RING finger)
  Pfam annotation: Domain name=zf-CCCH; Domain location=1-26; Score =21.6; E_value=0.0018; Accession=PF00642.15; Description=Zinc finger C-x8-C-x5-C-x3-H type (and similar)
  Pfam annotation: Domain name=zf-CCCH; Domain location=27-51; Score =26.6; E_value=8.8e-05; Accession=PF00642.15; Description=Zinc finger C-x8-C-x5-C-x3-H type (and similar)
  Pfam annotation: Domain name=zf-CCCH; Domain location=282-309; Score =4.6; E_value=0.33; Accession=PF00642.15; Description=Zinc finger C -x8-C-x5-C-x3-H type (and similar)
  Pfam module annotation: Pfam domain module=zf-C3HC4::zf-CCCH::zf -CCCH::zf-CCCH; Domain location=188-251::1-26::27-51::282-309
MSNRFCKFYARGACLKGDQCDFAHEKKDDICSYYQKGFCAYGSRCRYKHVKASQPSSSANGRHSPVLDPVVNHITKGTSSWVLKAVKSSSSDKRARSSQKKNPASLGNDVGQSSTSSAIPSEHLFCAFAAANCPLEDKCSRIHGNQCLYCRKFCLHPSDWKEKENHLRTCEKKGKYLKALEDSQEVECNVCLERVLSKPKPADCKFGLLPECDHAFCLSCIRNWRNSAAPTSGMDIGNAGTANTVRTCPVCRKLSYFVIPSGIWYSTKEEKQEIINNYKANCKLIDCKHFNFGNGNCPFGASCFYKHTVKPGSYTWIHHRPPPQCRQNHFDMYDMLDMLQDVDLTSAEYFSIMRGSDFFDDMDPFEMMDISHRLAGDSGPCLGLFDSDEEDLDIFQMAALSEALASGVDDFGPEDIGNEDFNPMEAALLPMMMHSNMEDEDDDEEEEYSDEDY

SEQ ID NO: 176193 - protein, 70 aa, Glycine max
  Coding DNA Sequence Number=SeqID_59415
MDVSHMDLPGHQRPTPRGIRSQKAIAEVCRQRSHEVCPGQARYTEEFAKCTQEVGAWQLESSASVTFGRP

SEQ ID NO: 176194 - protein, 33 aa, Glycine max
  Coding DNA Sequence Number=SeqID_59416
MGYKFVYSLLMEQPIMRTLIYWYLLVDALSEAI

SEQ ID NO: 176195 - protein, 88 aa, Glycine max
  Coding DNA Sequence Number=SeqID_59417
MAAAAVKVVKGCLKGSRRGCLHDGECGAAEDGFGVVVVAAEERIADGDENMVVVAMKIEEVEDWAYVEPDPLKSLGATNRSMPCKKSE

SEQ ID NO: 176196 - protein, 109 aa, Glycine max
  Coding DNA Sequence Number=SeqID_59418
MEGYLNKESPLRLKAFLGSDLTRKKNPGRERSIIHWYTQLSLELLSKENFEQKLGGGVGRGTIHRPFGIPANPESTVGLDTPLCKLCWDEQVKGKFSLLVSFMYDEWVD

SEQ ID NO: 176197 - protein, 207 aa, Glycine max
  Coding DNA Sequence Number=SeqID_59419
  Gene Ontology: Cellular component=chloroplast
  Homolog annotation: Hit_ID=P82658; Match level="QueryCoverage=66%, HitCoverage=63%, E-value=2e-57, Identity=80%"; Hit description =Thylakoid lumenal 19 kDa protein, chloroplast precursor
  Subcellular localization annotation: CTP_CleavageSite=10; ConfidenceScore=5.21e-01
MAPPPAPRTTAGMVATPARRTLLSMSTTCLLAGRNGTNGTDSEFYNPRKKAEKEYLTFLAGFRQLAPKDVILNNLALSDVDLQDLIGNADSVTSEEVKDDKGQLYYVYEIDGVGTHSLISVTCAKNKLYAHFVNAPTPEWNRDKDVLRHVHESFKTSVAVARCKSRLFVVELASVLVVELGTDYLFYAEDGVLRMASFDKFGIFTVC

SEQ ID NO: 176198 - protein, 102 aa, Glycine max
  Coding DNA Sequence Number=SeqID_59420
MQRTKGNLLEANLDHNPSFIWRSIYSSQVVVKHALGGVWEMVKASLHGMILGYAILTTRDSLEDLRVCELIEPTTKTWPNDDIQHNFNSSDAARFYPCQSIL

SEQ ID NO: 176199 - protein, 1237 aa, Glycine max
  Coding DNA Sequence Number=SeqID_59421
  Gene Ontology: Mol. function=RNA-directed DNA polymerase activity; Cellular component=chromatin; Biological process=chromatin assembly or disassembly
  Pfam annotation: Domain name=Chromo; Domain location=1156-1204; Score= 22.8; E_value=0.0012; Accession=PF00385.14; Description='chromo' (CHRromatin Organisation MOdifier
  Pfam annotation: Domain name=RVP_2; Domain location=236-364; Score= -41.5; E_value=0.0017; Accession=PF08284.2; Description=Retroviral aspartyl protease
  Pfam annotation: Domain name=rve; Domain location=854-1004; Score =49.2; E_value=1.4e-11; Accession=PF00665.16; Description=Integrase core domain
  Pfam module annotation: Pfam domain module=Chromo::RVP_2::RVT_1::rve; Domain location=1156-1204::236-364::498-667::854-1004
  Subcellular localization annotation: CTP_CleavageSite=38; ConfidenceScore=5.05e-01
MTHKLDTLISTLATKSPEPSPTSPHHASPSSPPSHPPRVKLDVPRFDGSDPLGWIFKITQFFEYHHTPDHDRLTIASFYMDGRALAWYQWMAALFKLTQKTTVQAYLSEFEDLANRIVGLPPHFLLSCFVSGLNADIHREVQPLQPLTVTQAAGLARLQEEKLFEARRAMRPRSTPFPSQPPPSGPPPISLPLSPSGSTAKPLSIIPLKRLTPEELISRRERGLCFNCDERYHRGHRCNSRVNLLVADEDEQPAEEYNVLGLEPDSPDPSVLILVDGGSTHNFIQDSMVAGLGLIPRPTMPLKVMVGNGQFLHCHQVCQAVPLTIQNIVFLVDLHMLPLCGANVVLGVQWLRFLGPILTDYTSLSMKFMHNGRIIEFTGEDTSTLQPLTSNQVRRLVRTAEASIDFHLSVIPLDTSPSDTSNPPCPPAIQSLLTKFASLFQPPTTLPSSRPTDHHIHLTSNSQPVNVRPYRYPHYQKAEIESQVASMLQRGIIRPSTSPFSSPVLLIRKHDATWRFCVDYRALNALTIKDRFSIPTIDELLDELGGASWFSKLDLLQGYHQILMSEEDICKTAFRTHHGHFEFRVMPFGLCNAPSSFQATMNTIFRPYLRQFIIVFFDDILIYSATLEDHVLHLEQAFQILLQEQFVLKLSKCMFSQPQVEYLGHVVSAQGVEPVMAKVQAIQQWPESQSARTLRNFLGLAGFYRRFIRGYATIATSLTKLVTADPFQWTEEAHAAFVHLKQMLTSTPVIQTPEQQMYLARLMGYDYTIMYRSGSSNKAVDAFSRTYLASPSSTFYFNTALGVPFYPNRRPHGHSQDLSTIDGELLLEGNSPGLRNSQAGGIALPLTDTLAPMGGLIPRLHHRAPGVPRPYRYSRGLDRFSKGIYLEMLPTRHTAYTVVVLFMDLVEKLHGMPRSLVFDRDPLFLSRFGQELFHLSGTKLRLSSAYHPQSDGQTEILNRVIEQYLRTFVHKKPSSWGKLLRWVEWSYNTSWNSSSGLSPYEITFGKKTVNFPRYLEGDSTIATVEDMLTDRQAIFEEIKKKLEKAQSRMKHFADARRRDVHFNVGDMVLVKLRPHRQKSVTGQPSGFSKHDKTFYGPFRVIEHIGPTTYRLKLPEDAHIHPIHHSSLLKPFRSPEPDNDQYCSTLPARYENDHLVITPLAILNTLNSADSKLEVLVQWQGLSPDDTTWENWDQLREAYHLEDQVLPEGVKDDSKAAAAREIRPRRKNRAPTSLKDFV

SEQ ID NO: 176200 - protein, 757 aa, Glycine max
  Coding DNA Sequence Number=SeqID_59422
  Gene Ontology: Mol. function=4-hydroxy-3-methylbut-2-en-1-yl diphosphate synthase activity; Biological process=terpenoid biosynthetic process
  Homolog annotation: Hit_ID=Q84XR5; Match level="QueryCoverage=99%, HitCoverage=100%, E-value=0.0, Identity=81%"; Hit description=GCPE protein
  Pfam annotation: Domain name=GcpE; Domain location=101-458; Score =211.3; E_value=2.3e-60; Accession=PF04551.5; Description=GcpE protein
  Subcellular localization annotation: CTP_CleavageSite=30; ConfidenceScore=5.53e-01
MASGAVPTTFSTLKTWDSSLGFAKSMDFVRVSDLKSMKSSARKRVSIIRNSNPGQDIAELQPASPGSPLLGMLAFFLSFGLLFVEPFKALIAFSVFGPVEKRKTNTVMVGNVAIGSEHPIRIQTMTTTDTKDVAGTVEQVMRIADKGADIVRITVQGKKEADACFEIKNTLVQKNYNIPLVADIHFAPSVALRVAECFDKIRVNPGNFADRRAQFETLEYTEEDYQKELEHIEKVFTPLVEKCKKYGRAMRIGTNHGSLSDRIMSYYGDSPRGMVESAFEFARICRKLDYHNFVFSMKASNPVIMVQAYRLLVAEMYVQGWDYPLHLGVTEAGEGEDGRMKSAIGIGTLLQDGLGDTIRVSLTEPPEEEIDPCRRLANLGMIASELQKGVEPFEEKHRHYFDFQRRSGQLPVQKEGEEVDYRGVLHRDGSVLMSVSLDQLKMPEVLYKSLAAKLIVGMPFKDLATVDSILLREVPPVDDADARLALKRLIDISMGVITPLSEQLTKPLPNAMVLVNLKEISSRAYKLLPQGTRLVVSVRGDEPYEELDILKGIDATMLLHDLPYTEDKISRVHAARRLFEYLSDNSLNFPVIHHIQFPNGIHRDDLVIGAGSDAGALLVDGLGDGLLLEAPDKDFEFIRNTSFNLLQGCRMRNTKTEYVSCPSCGRTLFDLQEVSAQIREKTSHLPGVSIAIMGCIVNGPGEMADADFGYVGGTPGKIDLYVGKTVVKRGIAMEHATNALIDLIKEHGRWVDPPAEE

SEQ ID NO: 176201 - protein, 67 aa, Glycine max
  Coding DNA Sequence Number=SeqID_59423
MPWCCCVPVPFSSREEKNRCSSISCLTLATLELEPQQVTTLVMERNRKESSDEWRRTKMGNGTTASH

SEQ ID NO: 176202 - protein, 360 aa, Glycine max
  Coding DNA Sequence Number=SeqID_59424
  Gene Ontology: Mol. function=zinc ion binding
  Homolog annotation: Hit_ID=Q1EPH4; Match level="QueryCoverage=67%, HitCoverage=89%, E-value=5e-59, Identity=48%"; Hit description=Zinc finger (C3HC4 type RING finger) family protein
  Pfam annotation: Domain name=zf-C3HC4; Domain location=152-199; Score= 53.5; E_value=7e-13; Accession=PF00097.15; Description=Zinc finger, C3HC4 type (RING finger)
MQADEDVGKIALAVPVLVCCWLFVCHIHVVDIALECITAKALELFLQDLCDRTYEITLQRGAKTMNSLHFYKWKLNVKQESSHILSFGRETQGMIARSRSVPVNTKEKGIRRMDSVFRIIPSTPRVIEVNETTKDTENGDDGEDIAEEEAVCRICLVDLCEGGETLKMECSCKGELALAHQECAIKWFSIKGNKTCDVCKDEVRNLPVTLLWIRSVRTQNTRARSEQGDDFRAWQELPVLVIVNMLAYFCFLEQLLVGRMRTKAIFISLPFACALGLLSSVTSSTMVKGIRISHRGLVQILVGKHAVLAILLATFAGFGVVMSGSSILLESSRWRRRWQALSELQRGSSAMTQEGISSQS

SEQ ID NO: 176203 - protein, 95 aa, Glycine max
  Coding DNA Sequence Number=SeqID_59425
MIACKVAEKPASLCSSPYLKQEIEPGGVRGRLGIVDGDLLNFVVEDVIDLGDACGGAAAAPFSGVTAAGGTGGVGGGSGGGSVRELRWFGIEEAR

SEQ ID NO: 176204 - protein, 317 aa, Glycine max
  Coding DNA Sequence Number=SeqID_59426
  Gene Ontology: Mol. function=protein binding; Cellular component =membrane; Biological process=transport
  Homolog annotation: Hit_ID=Q1SNX4; Match level="QueryCoverage=93%, HitCoverage=77%, E-value=1e-144, Identity=85%"; Hit description =Yeast 73.5kDa hypothetical-related protein
  Pfam annotation: Domain name=DUF254; Domain location=3-317; Score= -44.5; E_value=2.3e-08; Accession=PF03164.5; Description=SAND family protein
MAIFYVFRGDHVKLVRAGKHQVVFLVKGPIYLVCISCTEEPYESLRGQLELIHGQMIVILTKSVNRCFEKNPKFDMTPLLGGTDIVFSSLIHSFSWNPATFLHAYTCLPLAYATRQAAGAILQDVADSGVLFAILMCRHKVISLVGAQKASLHPDDMLLLANFVMSSESFRTSEAFSPVCLPRYNALAFLGHRALHVWQDDTYLMLLTTSSDAFYHLKDCRIRIEMVLLKSNVLNEVQRSLLDGGMHVEDLPPLPRSGSSPHLSQHRLPSDSPEREPTCRIGGVAGLWHFIYRSIYLDQYISSEFSSPINTPKQQKR

SEQ ID NO: 176205 - protein, 201 aa, Glycine max
  Coding DNA Sequence Number=SeqID_59427
MVSPQRRNTWTVVDLVPYVEKISILSKEQERITELVSHGQATEHPQEFHILPSSVETQGIGKRREAVEAEPYFYPQMEERGHGMYYTPPTFSQYPTQMYQYPFEGHQSDTSASEHSLGGVAETHPNFSWPTMTPSQQHDAPIPTLNAPFGTQWNVPGTIPNMDDLLGVDLRHKFSIEADQVEAGRHRGKKRYICAIWCQQH

SEQ ID NO: 176206 - protein, 151 aa, Glycine max
  Coding DNA Sequence Number=SeqID_59428
  Gene Ontology: Mol. function=RNA-directed DNA polymerase activity; Biological process=RNA-dependent DNA replication
  Homolog annotation: Hit_ID=Q1S7B8; Match level="QueryCoverage=97%, HitCoverage=19%, E-value=1e-19, Identity=35%"; Hit description=RNA -directed DNA polymerase
MYIGVKGVTVVNLLQYADDTIFFGKENTQNMLVIKSLMHCFKVASELKGGNEDRRKIAWVSWDQIFRPKECGGLGIKNIRRFNEALLGKWRWNLFHEENALRKEILVSKYNGWSGLVSEVESERDFSIWWRDLRLVCGSRSEVTWFDDNVE

SEQ ID NO: 176207 - protein, 116 aa, Glycine max
  Coding DNA Sequence Number=SeqID_59429
  Gene Ontology: Mol. function=calmodulin binding; Cellular component =integral to membrane; Biological process=cell death
  Homolog annotation: Hit_ID=Q2HSW1; Match level="QueryCoverage=82%, HitCoverage=16%, E-value=6e-21, Identity=58%"; Hit description=Mlo -related protein
MCIYVHARSGLSRSTKELYTSHLKRSNQLMLLGFISLLLTVGQGLISRICISEKVAGTFHPCSTKRVKHSTPPLDHDDDETNGRRLLAAILSSDDESHRRILALGARDKCAAQVCM

SEQ ID NO: 176208 - protein, 160 aa, Glycine max
  Coding DNA Sequence Number=SeqID_59430
MEKSDKMNFKEKKEKKGYITWEDNVLNYSSDSEKKIISLGIMMKDYENGEEQSRYIDSNFSKHMACIKLEVGSSYWKLKVKNGSWKLEVEVYWKLEVGNESYWKLKVENGGWKLEGEVVVIIKKGENVNHEDFDDIKKNLLEKEGDVNHASFDGVEKKSH

SEQ ID NO: 176209 - protein, 259 aa, Glycine max
  Coding DNA Sequence Number=SeqID_59431
  Gene Ontology: Mol. function=aminopeptidase activity; Cellular component=intracellular; Biological process=sporulation
  Homolog annotation: Hit_ID=Q2NRQ4; Match level="QueryCoverage=55%, HitCoverage=84%, E-value=8e-41, Identity=61%"; Hit description =Putative transport protein
  Pfam annotation: Domain name=Peptidase_M55; Domain location=1-249; Score=158.3; E_value=2e-44; Accession=PF04951.3; Description=D -aminopeptidase
MRPEQCNPAHADYAAARELMEQEVNAAIDGAFAGGATAVTVADSHAMMQNLRADRLDGRARLVQGKPRGLSMVEGLQHQRYDGLMFIGYHSAAGEHGVLAHTINGRAFYRVSLNGEAVGESDLYAAAAAELNVPLWLVSGDDELQRWVAERYPHVGYACVKRAISQTAAESLSPQRARAEIRERAMQQVRQGGKLPVERRFMPPYRLTLMAAKPVLADLFSLVPGVERQDALTVAFDSDNMAAPIRLLSVFSYLATTQN

SEQ ID NO: 176210 - protein, 394 aa, Glycine max
  Coding DNA Sequence Number=SeqID_59432
  Gene Ontology: Mol. function=oxidoreductase activity; Cellular component=integral to membrane; Biological process=electron transport
  Homolog annotation: Hit_ID=Q07KK1; Match level="QueryCoverage=99%, HitCoverage=53%, E-value=1e-100, Identity=46%"; Hit description =Aldehyde oxidase and xanthine dehydrogenase, molybdopterin binding precursor
  Pfam annotation: Domain name=Ald_Xan_dh_C2; Domain location=72-394; Score=-295.0; E_value=0.044; Accession=PF02738.8; Description =Aldehyde oxidase and xanthine dehydrogenase, molybdopterin binding domain
KPPRFGGKVAAFDAERVLAVPGVVAVKQVATGVAVYAKNTWAAIQGRERLKVTWDDAQAERRNTEEIYAEFRQVAQKTGVVAKSHGKPDEVFDKADKVIEAEYTFPYVAHAPMEPLDGYLFWDGESVKARYGCQIQTLDHKQLCDLFELPPDKVQIETILAGGSFGRRIDLGNPTLGPDLAADMAAAAKGIGPGHGVKVVWTREDDIRNGWYRPMILHRLRGAIRGGKVVGWTDTVVGHSWTRHSAMDALVVNGLDQMMVEGASEVSYTFEAFRCDAHIVPGKVPTTSLRSVASTHTGHAVESFIDQLLQETGQDPVEGRLALMGDAPRAAGALRAVAKAADWQGAKVVDGRARGVGVAKAFDTYVAQVAEVSIGEGGIPKVHKVWCAVDCGVA

SEQ ID NO: 176211 - protein, 145 aa, Glycine max
  Coding DNA Sequence Number=SeqID_59433
  Gene Ontology: Mol. function=chitin binding; Cellular component =extracellular region; Biological process=chitin metabolic process
  Homolog annotation: Hit_ID=UPI00006A17C9; Match level="QueryCoverage =93%, HitCoverage=100%, E-value=1e-18, Identity=33%"; Hit description= UPI00006A17C9 related cluster
  Subcellular localization annotation: CTP_CleavageSite=16; ConfidenceScore=5.25e-01
MRTRSPLKVRACNPLKVRMYSPLEVRACSPLKVRACSPLLARTCSPLKVRACSPLLARTCSSLKVRACSPTKVSTCSPLMARACSPLKVRTCGPLNDEVPRVRACSPLKARTCSPLEVRACSPLKVRTCSPLKARTCSPLNGEGN

SEQ ID NO: 176212 - protein, 130 aa, Glycine max
  Coding DNA Sequence Number=SeqID_59434
MVEKTKKRLEEAAQSGSTEGIIDPPSPIRRHDSLEEQVSQGSFVPHGRQDVLTVAIGQPEYPGRVRAVGAGVTIKQYFGSAPRTSRSSSSMPPEDLQQLTQQIRDQLEESITEKVTRQLMASFSQMQSQF

SEQ ID NO: 176213 - protein, 317 aa, Glycine max
  Coding DNA Sequence Number=SeqID_59435
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=7e-41, Identity=30%"; Hit description= UPI00006A17C9 related cluster
FRGLHVLAIRGLHALTLEGLLFLPIKGLQALTFRGLHVLAIRRLHALTIRRLHVLAIRGLHALTFRGLHVLAIRGLHDLAFRGIHVLAIRGSHALTFRGLHVLTIRELHVFTIRGLHVLTFRGLHVFTIRGLHALTIRGLHVLAIKGLHVLAIRGLHSHTLRGLHALTFRGLHVLAIRGLHAITFRGLLIVDIRGPHYLTFRGLHVLAIRGSRVVTFRGLHVLTIIGLHALIFRGLHVLTITGLQALTFRGLHVLAIRGLHALTFRGLHVLTFRELDVFTIRGLHVLAIRGLHALTFRGLHALTIRGLHALTFRGLH

SEQ ID NO: 176214 - protein, 94 aa, Glycine max
  Coding DNA Sequence Number=SeqID_59436
MEGVLGASTFLEIFGERERAKKGNIGSKGLSKELIQGRLIWLEAYKNKMPKSSPNMHVKQEVSTRVKPRLLCKQSMRQNTPNKIEDEGSNSHQG

SEQ ID NO: 176215 - protein, 72 aa, Glycine max
  Coding DNA Sequence Number=SeqID_59437
  Subcellular localization annotation: CTP_CleavageSite=62; ConfidenceScore=5.24e-01
MYAVMNKSQGSPIRFAKYSFSVTTKVDALPPAIPPSSTQPQPFIPLLAPSPLIPFTNNSVPKLSGIKGGRER

SEQ ID NO: 176216 - protein, 97 aa, Glycine max
  Coding DNA Sequence Number=SeqID_59438
MHGASKPPVGLAGLLLVTGLATDSGDMHMQMKDSPLRVAIYTWSGNRQSNWRVPGCFVGLLFQPFSGGRGCFSFFSQKASCNCHWRVKGKLQLPLAI

SEQ ID NO: 176217 - protein, 139 aa, Glycine max
  Coding DNA Sequence Number=SeqID_59439
  Gene Ontology: Mol. function=protein binding; Cellular component =integral to membrane; Biological process=response to DNA damage stimulus
  Homolog annotation: Hit_ID=Q8GTD6; Match level="QueryCoverage=84%, HitCoverage=65%, E-value=5e-31, Identity=47%"; Hit description =Polygalacturonase inhibitor-like protein
  Pfam annotation: Domain name=LRR_1; Domain location=32-54; Score=6.7; E_value=16; Accession=PF00560.23; Description=Leucine Rich Repeat
  Pfam annotation: Domain name=LRR_1; Domain location=80-102; Score =21.8; E_value=0.0024; Accession=PF00560.23; Description=Leucine Rich Repeat
  Pfam module annotation: Pfam domain module=LRR_1::LRR_1; Domain location=32-54::80-102
MEDWKDTLTTLIIADWKDIAGEIPTCVTALPSLRLLDLINNKLSIEILADVGKLSRLTVPKLANNALSGKIPASITRLGSLKHLDLNNNQLCGEIPKDFGNLAMLSCMLLSRNQLNGTPLRESYGEYVWLREGEKAGVR

SEQ ID NO: 176218 - protein, 95 aa, Glycine max
  Coding DNA Sequence Number=SeqID_59440
MWDTLQLTHEGTTDVKREWQPKEHEMELQQLNQNEENDKKKRSIALKASSSMQEENEEEDSDDEEDFSFFVKKFHKFIKKRRIDRRQNFNNGRKS

SEQ ID NO: 176219 - protein, 113 aa, Glycine max
  Coding DNA Sequence Number=SeqID_59441
MLEDDCRYLMVSKIPTVGISLKAQTEINGLLEGYLRHFSANQPEGLELLDVAQCCYKLTTKKLCVELQPLRVGHGATASDAPDHCGRRRLAHQPTFLPRRGRSATNLAQTYLN

SEQ ID NO: 176220 - protein, 268 aa, Glycine max
  Coding DNA Sequence Number=SeqID_59442
  Gene Ontology: Mol. function=transcription factor activity; Cellular component=intracellular; Biological process=regulation of transcription, DNA-dependent
  Homolog annotation: Hit_ID=Q0LGJ0; Match level="QueryCoverage=96%, HitCoverage=65%, E-value=7e-33, Identity=36%"; Hit description=ROK
  Pfam annotation: Domain name=ROK; Domain location=77-261; Score=82.3; E_value=1.5e-21; Accession=PF00480.10; Description=ROK family
MLNKLHQQLIHLVCSEEGASRADLARLTGMSKAAIGALVKEMLADGLLQESDMAASGGQGRPSVTLSLAPDAAYAIGISLIDNQLVLVLMNASGEKIAERLLTPQLEIPDVIQQLAGEIRSLLNDTLIERQRLVGIGFALSAFVDAAQAVCVQSALLGWHQVPLAELLSHATGGIPVFIENDTRALANWEKTFGHLRKLESAVVISHGSGIGSAAVIYDRIWRGAHGGAGEIAHCTIVPAGTPCRCGKRGCLDTIASLTGIFEQARMA

SEQ ID NO: 176221 - protein, 92 aa, Glycine max
  Coding DNA Sequence Number=SeqID_59443
MQGLQLQQAGFANEDGGMRFTGIVKLADDFLCFKFVHYKSGNSSTLALLSSSSSYYSSSSYYYTTLMTVLVPVTITWFLLLRAITWFFYLIC

SEQ ID NO: 176222 - protein, 156 aa, Glycine max
  Coding DNA Sequence Number=SeqID_59444
MSILKAFIHLKLRPPLDFASVNLFQLIQCVPEESLSHTFKLIAQRGKELVTTHDVIFGHHLKDNWDLHFTISDEISQENDLLAIFSYSNLLKLPTSDRIFRKAIARDIENQQQYMITLVNQGRNLPHTIALNVQNLKNAGTHGGLRPREICEPIKP

SEQ ID NO: 176223 - protein, 774 aa, Glycine max
  Coding DNA Sequence Number=SeqID_59445
  Gene Ontology: Mol. function=sequence-specific DNA binding; Cellular component=nucleus; Biological process=regulation of transcription, DNA-dependent
  Homolog annotation: Hit_ID=Q40988; Match level="QueryCoverage=99%, HitCoverage=99%, E-value=0.0, Identity=71%"; Hit description =Homeobox protein
  Pfam annotation: Domain name=Homeobox; Domain location=89-145; Score =84.5; E_value=3.3e-22; Accession=PF00046.19; Description=Homeobox domain
  Pfam annotation: Domain name=START; Domain location=280-513; Score =306.7; E_value=4.2e-89; Accession=PF01852.10; Description=START domain
  Pfam module annotation: Pfam domain module=Homeobox::START; Domain location=89-145::280-513
  Subcellular localization annotation: CTP_CleavageSite=51; ConfidenceScore=5.32e-01
MQAGIMMIPARNMPSMIARNNNVVGFFGSSALFTLAQPNLMDALEMGQNTSESEVPRILEDEFDSATKSGSENHEGASGEDQDPRPNKKKRYHRHTQHQIQEMEAFFKECPHPDDKQRKELSRELGLEPLQVKFWFQNKRTQMKTQHERHENTNLRTENEKLRADNMRYREALSNASCPNCGGPTAIGEMSFDEHHLRLENARLREEIDRISAIAAKYVGKPVVNYSNISPSLPPRPLELGVGGAGFGGQPGIGVDMYGAGDLLRSISGPTEADKPIIIELAVAAMEELIGMAQMGEPLWLTTLDGTSTMLNEDEYIRSFPRGIGPKPSGFKCEASRETAVVIMNHVNLVEILMDVVSSLERKRKKMFKNQWSTVFSGIVSRAMTLEVLSTGVAGNYNGALQVMTAELQLPTPLVPTRESYFVRYCKQHADGTWAVVDVSLDNLRPGPSARCRRRPSGCLIQEMPNGYSKVTWVEHVEVDDRGVHNLYKQLVSSGHAFGAKRWVATLDRQCERLASAMATNIPTVDVGVITNQDGRKSMMKLAERMVISFCAGVSASTAHTWTTLSGTGADDVRVMTRKSVDDPGRPPGIVLSAATSFWLPVPPKRVFDFLRDENSRNEWDILSNGGVVQEMAHIANGRDTGNCVSLLRVNSANSSQSNMLILQESCTNSTGSFVIYAPVDIVAMNVVLNGGDPDYVALLPSGFAILPDGTTSHNGSGGIGETGPSGSLLTVAFQILVDSVPTAKLSLGSVATVNNLIACTVERIKASLSGEPA

SEQ ID NO: 176224 - protein, 203 aa, Glycine max
  Coding DNA Sequence Number=SeqID_59446
  Gene Ontology: Mol. function=nucleoside-triphosphatase activity
  Homolog annotation: Hit_ID=Q9LXT8; Match level="QueryCoverage=28%, HitCoverage=4%, E-value=3e-23, Identity=91%"; Hit description=Pre -mRNA splicing factor ATP-dependent RNA helicase-like protein
VPPVQLLTGWCVTAKAPPDISAGKCSGHAARRVPFAIQAAQLLGRAIGAGLFAITPAGERGMCCKAIKLGNARVFPYLHEDGYTIGGIVGCTQPRRVAAMSVAKRVSEEMDTELGDKIGYAIRFEDVTGPNTIIKLTHINCVALTARFPVGKPVVPAALMNRPTRGERRFAYWALAECILAYYVGTDEGVSEVLHVAEKKAAP

SEQ ID NO: 176225 - protein, 265 aa, Glycine max
  Coding DNA Sequence Number=SeqID_59447
  Gene Ontology: Mol. function=nucleic acid binding; Cellular component= nucleus; Biological process=DNA integration
MVLALVAQEDMELEQLDVRIAFLHIELEEETYMTQAEGFVKIGEEGKKIEHDVIVYLLLYVNDMLINCNNKEEIKKVKVMLENEFEMKDIGASSKILGMQILRDKTMGTLFITQKSYIAKILKKFNMDMSKAVSTPIAQHFKLLHQDSPKTEDEFPKKLQTESYNSFSASRFDAEGASSLANLSPWPIAAHFNFPLAQVMLPVIGGKGIIVWDHKHDLDLSEQLQFAKVKMMERFAKLLLGEDMFGGGKGVYTTLTISNAITNLP

SEQ ID NO: 176226 - protein, 140 aa, Glycine max
  Coding DNA Sequence Number=SeqID_59448
  Gene Ontology: Mol. function=nucleic acid binding; Biological process= DNA integration
MSWVQIFPTNILTKTNKLKEALEGENKFSTTLSNKDKKDILDKAHDALIMYLGDKALLLLRSLPSEFDNLSNTLIHGRDTISLKEAQAALSSKELKQRSQGRGNQTGEELYTRGKSEKRDSKNKKGLRSKSRNGKKECPD

SEQ ID NO: 176227 - protein, 94 aa, Glycine max
  Coding DNA Sequence Number=SeqID_59449
  Gene Ontology: Mol. function=zinc ion binding; Cellular component =nucleus; Biological process=ubiquitin cycle
  Homolog annotation: Hit_ID=A0ELV2; Match level="QueryCoverage=86%, HitCoverage=70%, E-value=1e-28, Identity=73%"; Hit description=RBX1 -like protein
MATLDSDVPMVPAGEPSSSAGPSSKKPKRFEIKKWNAVALWAWDIVVDNCAICRNHIMDLCIECQANQASATSEECTVAWGMVRTPLVLYFDFM

SEQ ID NO: 176228 - protein, 295 aa, Glycine max
  Coding DNA Sequence Number=SeqID_59450
  Gene Ontology: Mol. function=GPI anchor binding; Cellular component =anchored to membrane
  Homolog annotation: Hit_ID=Q8GUI4; Match level="QueryCoverage=95%, HitCoverage=63%, E-value=2e-94, Identity=57%"; Hit description =Uncharacterized GPI-anchored protein At1g61900 precursor
MVAWGHCSLNFSAAQDIMTTTATDCWTSFAPYLANVVCCPQFDAMLVTLIGQSSKYSGVLALNTTHAHHCLSDVQKVLASQGANRDLKKICSVHPTNLTEASCPVVFVDEFESIVDTSRLLTACRKIDPVNECCDQVCQNAIHYAARKIALNDLSNSDGNHSLPWPTTRINDCKNIVLRWLANKLDPSTANSVFRGLSNCNLNRVCPLVLPNVTSVVKECGNLINNQTACCKAIKSYVSYLQEQSFVTNLQALKCATSLGKKLQQENVSKNVYNLCRISLKDFSLQGWHCHISLA

SEQ ID NO: 176229 - protein, 75 aa, Glycine max
  Coding DNA Sequence Number=SeqID_59451
  Homolog annotation: Hit_ID=A0ELV2; Match level="QueryCoverage=31%, HitCoverage=20%, E-value=1e-08, Identity=100%"; Hit description=RBX1- like protein
MVSSPYFCDFGIRYSALVCRSLPHEASVVVTILLSLHWITQTVNFSGFHFIQEFVTMLFTSIASVDGSRLVKFVL

SEQ ID NO: 176230 - protein, 144 aa, Glycine max
  Coding DNA Sequence Number=SeqID_59452
  Gene Ontology: Mol. function=phosphoglycerate kinase activity; Cellular component=chloroplast; Biological process=glycolysis
  Homolog annotation: Hit_ID=UPI000068E913; Match level="QueryCoverage =91%, HitCoverage=37%, E-value=2e-42, Identity=61%"; Hit description =phosphoglycerate kinase
  Pfam annotation: Domain name=PGK; Domain location=1-144; Score= -182.8; E_value=1.4e-08; Accession=PF00162.9; Description =Phosphoglycerate kinase
MKTVNDFNFKDKKALVRVDFNVPQDDQLKVTDNTRIAAVKPTIDKILNDGGSVILMTHLGRPKGEVKDEFSLKHILEEVSNVLGKEVKFVEESVGPKAEQAASELKPEKGDEGFAEQLSKLGDAYVNDAFGTAQPCTCFYSGNR

SEQ ID NO: 176231 - protein, 195 aa, Glycine max
  Coding DNA Sequence Number=SeqID_59453
  Gene Ontology: Mol. function=metal ion binding; Cellular component =nucleus; Biological process=red or far red light signaling pathway
  Homolog annotation: Hit_ID=P93471; Match level="QueryCoverage=93%, HitCoverage=26%, E-value=4e-70, Identity=74%"; Hit description=E3 ubiquitin ligase protein COP1
  Pfam annotation: Domain name=zf-C3HC4; Domain location=50-87; Score =35.7; E_value=1.6e-07; Accession=PF00097.15; Description=Zinc finger, C3HC4 type (RING finger)
MEELSAGPLVPAVVKPEASKGAAVAADTSAAASGGTFPASTSEPDKDFLCPICMQIIKDAFLTACGHSFCYMCIITHLRNKSDCPCCGHYLTNTNLFPNFLLDKLLKKTSARQISKTASPVEHFRQALQKGCDVSIKELDTLLSLLAEKKRKMEQEEAERNMQILLDFLHCLRKQKVDELKEVCLLQSLSLYSKV

SEQ ID NO: 176232 - protein, 70 aa, Glycine max
  Coding DNA Sequence Number=SeqID_59454
MHFPRHPYLNHPLGATPTKISNGLKMESVESRWLSAEGKCHVGRGKGPTPQPQHHTNKIYGPNNCKDILE

SEQ ID NO: 176233 - protein, 296 aa, Glycine max
  Coding DNA Sequence Number=SeqID_59455
  Gene Ontology: Mol. function=nucleic acid binding; Biological process= RNA-dependent DNA replication
  Homolog annotation: Hit_ID=Q1RVK6; Match level="QueryCoverage=78%, HitCoverage=53%, E-value=5e-67, Identity=44%"; Hit description=Zinc finger, CCHC-type
MEPLKGYIFSTDTSGYHGLGEEPPDGCGSFVQSNVSFKDKMMENKERAPSRTRRDLLRENMTKIEFENGNSLKKMVHIDDSVFDGLRFPWQDVLVVKLLGKSIGNNFFMLKFNLGEDKNLVMDGGPWMVFDHYLAVQLWTPEFVAMTATINKTMTWIRFPGLNLYFYDESVMLSLATTVGRPIKVDANTLDVKRGKFARVCVEVDMNKPMIGKVWMRGHWYMMEYEGLHCICSDCGCSGHFSHECMSPKPMKVVVPPPCMSEEKMTTTVTSQPQDASSLNKQSLAIFKFQFKIFGY

SEQ ID NO: 176234 - protein, 232 aa, Glycine max
  Coding DNA Sequence Number=SeqID_59456
MVIWDCCGKDVGVQDPCAEAVVVHDNAMVKRVAKGNDIDSQGGGRRHAVVVCVDIDSDSAAAASPPVLFQLSSHGSSVFPRYASAISFILVRIKALIITKAPNNQPLGIKESVWWVGYSLRHSWVLYLEHKRRKTITAMEVVYALKRQGTVTWCYKLHRSVAFAARVCNIYAEIAFHFRGCSQNQSQGIELDVHKEKVCVEMKGMGPTKMVVGGWLCGEDAMERGGLAGGVG

SEQ ID NO: 176235 - protein, 194 aa, Glycine max
  Coding DNA Sequence Number=SeqID_59457
GVSRFRYCTGIGMGWVQAGDVIDLLGATNQDGDNRFILWGRIRNDIGFRIQRRNEVRGTGSKLDAKTDDELLQVDVMATEVELGGEPLFDDEGSGLDGDRDFSSDDLDGVDVMIEIGFMADDFGHALETFCIHNNPRLLSRNSNQYENEKTKMWDVGGDAFDSMRDVGFLEFAELSLNEPKLENELVTENVDNA

SEQ ID NO: 176236 - protein, 883 aa, Glycine max
  Coding DNA Sequence Number=SeqID_59458
  Gene Ontology: Mol. function=ionotropic glutamate receptor activity; Cellular component=integral to membrane; Biological process=ion transport
  Homolog annotation: Hit_ID=Q8GXJ4; Match level="QueryCoverage=95%, HitCoverage=85%, E-value=0.0, Identity=64%"; Hit description =Glutamate receptor 3.4 precursor
  Pfam annotation: Domain name=ANF_receptor; Domain location=8-387; Score=304.8; E_value=1.6e-88; Accession=PF01094.18; Description =Receptor family ligand binding region
  Pfam annotation: Domain name=Lig_chan; Domain location=569-832; Score= 324.6; E_value=1.7e-94; Accession=PF00060.17; Description=Ligand -gated ion channel
  Pfam annotation: Domain name=SBP_bac_3; Domain location=451-793; Score=-16.7; E_value=5.8e-07; Accession=PF00497.10; Description =Bacterial extracellular solute-binding proteins, family 3
  Pfam module annotation: Pfam domain module=ANF_receptor::Lig _chan::SBP_bac_3; Domain location=8-387::569-832::451-793
MDTVIGRSALPAIMAAVKDVNSSTSMRPGIDLQVILHDTNCSAFLGTMEGTFGAVFQSKLEFHLGHLHIEALQLMENDVVAVVGPVSSGIAHVISHVVNELHVPLLSFGATDPTLSALQYPYFVRTTQNDYFQMYAIADFVDYYRWKKVIAIYVDDDNGRNGVSVLGDAMSKKRAKISYKAAFPPEAKESDISDLLNEVNLMESRVYVLHVNPDHGLAIFSIAKRLRMMDSGYVWIATDWLPSVLDSLDSPDTDTMDLLQGVVAFRHHIPDTDLKKSFLSRLKSQRDNETVSFNSYALYAYDSVWLAARALDAYLNEGGNVSFSSDPKLRDTNGSMLQLASLRTFDGGPQFLKTILGMNFTGLSGQVEFDMDKNLVHPAYDILNIGGSGSRRIGYWSNHSGLSVIAPEVLYEKKSSKTSLKSNQELYSVIWPGEATTTPRGWVFPNNGQPLRIAVPNRVSYTDFVSKSKNPPGVQGYCIDVFEAALKLLNYPVPRQYILFGNGERNPSYNELVEQVAQNNFDAVVGDVTIVTNRTRIVDFTQPFMPSGLVVVVPVEKKSSPWSFLEPFTAQMWLVTGAFFLFVGTVVWILEHRHNPEFRGSPRKQLITVFWFSFSTMFFSHRENTVSGLGRLVLIIWLFVVLIINSSYTASLTSILTVQQLSSQIEGIDSLISSTQPIGIQDGSFARKYLIDDLNIAESRIVTLKNMEDYIDALQRGPKAGGVVAVVDELPYIEVLMSRTDCKFTTVGQEFTKSGWGFAFQRDSPLAVDLSTAILQLSESGDLQRIHDKWLNKKECATVDANSNKLALTSFWGLFLICGIACVIALIIFFARIFCQYNKFSPEPEKTDKEMQPIEEKQISKRYLGKTKKGDTALDKHSVSSAT

SEQ ID NO: 176237 - protein, 510 aa, Glycine max
  Coding DNA Sequence Number=SeqID_59459
  Gene Ontology: Mol. function=nucleic acid binding
  Homolog annotation: Hit_ID=Q8W486; Match level="QueryCoverage=99%, HitCoverage=99%, E-value=0.0, Identity=73%"; Hit description=Similar to auxin-independent growth promoter
  Pfam annotation: Domain name=DUF246; Domain location=93-439; Score =462.6; E_value=4.9e-136; Accession=PF03138.5; Description=Plant protein family
  Subcellular localization annotation: CTP_CleavageSite=58; ConfidenceScore=5.23e-01
MRRTGFHRRQSGGGSGFKGMIVKLSVAAVVLLICTLSLFFSSTGTSSNLQSNYRSEIRLEELWSNADSGGWRPSSAPRTHWPPPPNESNGYLRVRCNGGLNQQRSAISNAVLAARIMNATLVLPELDANSFWHDDSGFHGIYDVEHFIKTLRYDVKIVESIPENQKNGKKKKIKPFQLRPPRDAPISWYTTDALKKMKEHGAIYLTPFSHRLAEEIDNPEYQRLRCRVNYHALRFKPHIMKLSQSIVEKLRAQGPFMSIHLRFEMDMLSFAGCFDIFTPEEQQILKKYREENFAPKRLVYDERRAIGKCPLTPEEVGLILRALGFDNSTRIYLAAGELFGGDRFMMPFRSLFPRLENHSSVENSEELAENTRGLAGSAVDYMVCLLSDIFMPTYDGPSNFANNLLGHRLYYGFRTTIRPDRKSLAPIFIDRENGRTAGFEEAIRKVMLKTNFGEPHKRVSPESFYTNSWPECFCQTSTQNPADKCPPNDILNIMNDELQKTETDANSTIS

SEQ ID NO: 176238 - protein, 140 aa, Glycine max
  Coding DNA Sequence Number=SeqID_59460
MVGNLDLEEGGGCCCGLEVEGSRSFQSKGWSIRNALTLQIDQFVIHHEGVLACAKVVDGGAIVASVTEDMDMGWMGRERVVRSWLVMVPRGVVVVSATNGSGGREEEEENEQGKNKDRPEQKIGREWKIGGSVMKKMGMC

SEQ ID NO: 176239 - protein, 237 aa, Glycine max
  Coding DNA Sequence Number=SeqID_59461
  Gene Ontology: Mol. function=RNA-directed DNA polymerase activity; Cellular component=intracellular; Biological process=RNA-dependent DNA replication
IYEPVEHNNPALSPNYESPVYEAEEEEDDEIPKELARLLEYEKKTIRPHEEVVEVINLGTEEDKKEVKIGASLEATVKRRVIELLKEYVDVFAWSYQDMPGLDPRIVEHRLPLKPECPPVKQKLRRTRPDMALKIKEEVQKQIDAGFLVTSEYPQWLANIVPVPKRDGKVRMCVDYRDLNKASPKDDFPLPHIDVLVDSAAKSKVFSFMDGFSGYNQIKMAVEDREKTSFITPWGTF

SEQ ID NO: 176240 - protein, 63 aa, Glycine max
  Coding DNA Sequence Number=SeqID_59462
MKCGGEYQLDGAQRFLLDALNAQMQRLLREKNEELYERIERLDPRERHEDERRGGNGGGPRPN

SEQ ID NO: 176241 - protein, 168 aa, Glycine max
  Coding DNA Sequence Number=SeqID_59463
  Homolog annotation: Hit_ID=Q1SWX1; Match level="QueryCoverage=99%, HitCoverage=39%, E-value=2e-15, Identity=28%"; Hit description=IMP dehydrogenase/GMP reductase
VKIKSLGVASLKELGQLMGQLQRQAFRKAYGKIWDLTMVEVSTEAIASLAQYYDQPLRCFTFGDFQLLPTVEEFEEILGCPLGGRKSKCLEAKARTLASQDEWAPFMDVLALLIFGVVLFPNVDRLVDLAMIDAFLAFHDRKESPVVAILADLYDTFDRRCEKNSARI

SEQ ID NO: 176242 - protein, 83 aa, Glycine max
  Coding DNA Sequence Number=SeqID_59464
MLSSISDQNCHSLGDGVEPSSCFYEKVHQVKLKHGSNHLAKIGAKDGSSYIAASSTANIFRIVDVLVTSSFTLTKMSWTMLKI

SEQ ID NO: 176243 - protein, 91 aa, Glycine max
  Coding DNA Sequence Number=SeqID_59465
  Subcellular localization annotation: CTP_CleavageSite=44; ConfidenceScore=5.45e-01
MKLASTSASLHQSDFGPYMFQGHTMFNGMSLNSPMRSTCHVGVVSSGKWRLRNLCWAYDCHCIIEHIRELLLWKTPSLVGVLVRAKGGVWY

SEQ ID NO: 176244 - protein, 51 aa, Glycine max
  Coding DNA Sequence Number=SeqID_59466
MNAKEKRIIDMREKSRVQGRDFRNFHVEERMKEGVNILVVSYGAPGACPYP

SEQ ID NO: 176245 - protein, 137 aa, Glycine max
  Coding DNA Sequence Number=SeqID_59467
MEKVIEEALCLPSRGIRRNPKNKAIKINKENMTTLAQFWIAIVLENVAPNSHKSGIPLSRAQLIFAIIKAPQRRYAHWPALSILGGDGARVEDAKGDDVSAKTKNDGVIVVVATEEEKTKLIVGGVKEPQLMEEGND

SEQ ID NO: 176246 - protein, 473 aa, Glycine max
  Coding DNA Sequence Number=SeqID_59468
  Gene Ontology: Mol. function=oleoyl-[acyl-carrier-protein] hydrolase activity; Cellular component=chloroplast; Biological process=fatty acid biosynthetic process
  Homolog annotation: Hit_ID=Q42562; Match level="QueryCoverage=97%, HitCoverage=99%, E-value=1e-152, Identity=61%"; Hit description=Acyl- (Acyl carrier protein) thioesterase
  Pfam annotation: Domain name=Acyl-ACP_TE; Domain location=134-452; Score=466.6; E_value=3.2e-137; Accession=PF01643.8; Description=Acyl- ACP thioesterase
MVATAATASFLPVPSPDAGKGKPKGGGGGGVSVNLGGLKEKQGLCGCLQVKANAQAPPKTMEKVENDLPWLPSSSISHAPRTFINQLPDWSMLLAAITTVFLAAEKQWMMLDWKPRRPDMLIDPFGIGKIVQDGLVFRQNFPIRSYEIGADKTASIETLMNHLQETALNHVKTAGLLGDGFGSTPEMCKKNLIWVVTKMQVVVDKYPTWGDVVQVDTWVSASGKNGMRRDWLVRDAKTGEILTRASSVWVMMNKVTRRLSKIPEEVRAEISSYFVDSAPVVPEDNRKLTKLDDSANFIRTGLSPRWHDLDVNQHVNNVKYVGWILEQGSSDLLQGRLNGDSVILQHPLSFQKTLKNPLGLYDSVPKQLPLCQCFLLRGIWSAPQPLLESHELCAMTLEYRRECGRNSVLDSLSDLSGADVGNLADDGFFECKHLLRLDDGAEIVRGRTEWRPKPLNRNFGHVLSQVPVPAEST

SEQ ID NO: 176247 - protein, 85 aa, Glycine max
  Coding DNA Sequence Number=SeqID_59469
  Homolog annotation: Hit_ID=Q2HTU1; Match level="QueryCoverage=66%, HitCoverage=7%, E-value=3e-14, Identity=68%"; Hit description =Tetratricopeptide-like helical
MSEYLIHRLHNKLKLQGLFGEADAKQPANENTKSELVGVASFLVHFIKQFKCVVEGVRFAKGIDEEVESVGSRRWCWRVERMWRL

SEQ ID NO: 176248 - protein, 71 aa, Glycine max
  Coding DNA Sequence Number=SeqID_59470
  Gene Ontology: Mol. function=hydrolase activity, hydrolyzing O -glycosyl compounds; Cellular component=peroxisome; Biological process=carbohydrate metabolic process
  Homolog annotation: Hit_ID=Q1RTS3; Match level="QueryCoverage=88%, HitCoverage=13%, E-value=2e-15, Identity=60%"; Hit description =Glycoside hydrolase, family 1
MKRVYTQYEGGANEGGKGPSIWDTFTHKYPDKIVDRSNGDVANDQYHHYKVSPKNPDDGRESIKELSMIPF

SEQ ID NO: 176249 - protein, 52 aa, Glycine max
  Coding DNA Sequence Number=SeqID_59471
MAEEKGLVVDFKGFDSAMEAARERSRSAQTKQAGGAIVMEADATSACVLGGW

SEQ ID NO: 176250 - protein, 281 aa, Glycine max
  Coding DNA Sequence Number=SeqID_59472
MASRKRKSATSRPQAQYDTKRFQSLEAWNRYTDNILDWRILPEKNVKIYHTEFDEFKAEMERRNLHKRLANLQDGSIDVAVVKEFYANLYSPEDQTPKQVRVRRHLIKIDADSLNTFLETPVVLEEGETQPTYSRFTRMRIDPQEFSTCLYIPGRGFVLNVEGHPWKLLRKDLTTLAQTWSVFSYNNLTPTSHTSDLNMDRARLVYSLVTGMDMNIRAQISGQISTTVQSNSSRFRFPTLNTMPFPFRPKPLLGSYPCPNITQATINAAPDEGGYTGGDSI

SEQ ID NO: 176251 - protein, 389 aa, Glycine max
  Coding DNA Sequence Number=SeqID_59473
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1RYZ9; Match level="QueryCoverage=99%, HitCoverage=83%, E-value=0.0, Identity=79%"; Hit description =Glycoside hydrolase, family 1
  Pfam annotation: Domain name=Glyco_hydro_1; Domain location=1-388; Score=458.8; E_value=7e-135; Accession=PF00232.9; Description =Glycosyl hydrolase family 1
GKLNGGINQEGVKYYNNLINELIANGLQPFVTLFHWDLPQALEDEYGGFLNPRIINDFQDYAELCFKEFGDRVKYWVTLNQPYTYSTGGYANGVKAPGRCSKWLNPKCTAGDSGTEPYLVSHHQLLAHAAVVQVYKRKYQASQNGVIGITLVSHWFVPISNNKLDQNAAERAIDFMLGWFLEPLTTGNYPQSMRSLVGKRLPKFSKQQTKSILGSFDFIGLNYYTSNYAIHEPQLRNAKPNYLTDFQAKLTTQRNGIPIGSNAASSWLYVYPKGIQELLLYVKKKYNNPLIYITENGIDEFNDPTLSIEEVLIDTYRIDYYYRHLFYLKSAIKDGANVKGYFVWSLLDNFEWANGYTVRFGMNFVDYKNGLKRYQKLSAKWFKNFLKKY

SEQ ID NO: 176252 - protein, 117 aa, Glycine max
  Coding DNA Sequence Number=SeqID_59474
MRRIALERRERSTGQPQGLQVKEVPLCHIDVRFVNTGWMCEGRVSVIHEETPQDQPNWVRPCPPKFELGNWRIFKQPRISVANSISNNKSSKSSDTEDPDVDFMQLINQAEDGEDED

SEQ ID NO: 176253 - protein, 367 aa, Glycine max
  Coding DNA Sequence Number=SeqID_59475
MGSSSCSCWGWCSRFASLPPPFSPFFCQDLCPYNDPHGAPRSFLWLDHQDPLRTRLVLGFVQPRSGRRVCNARTSVPLEEASAYLVGAACSTIHSTRVSKLSIDLEGSPSHNANVATFRNVGQPRHRIASSLVDLLDSINKKMLSSHSCFMAMCMRDVVIIQGIVGLTGMRFTLGVLVDCMSKMFFPLGVSYTGLQLIVGIIGLTGMRFTLGALVDRVSGMFVPLGASHTGLQLIVVGLQFPEFLLMKDIVKSSVLHVDVHARCCIHAGMFVPLGASRTGLQLVVVGLQFPKFLLMATFHLCDAGLELAKSITVCHCREKGIGNWIGSRLRSDHVLTISAGGHSGSFIVAPWWTLNVLTEIWSKLTS

SEQ ID NO: 176254 - protein, 267 aa, Glycine max
  Coding DNA Sequence Number=SeqID_59476
MAPKKLLSKRARKDAAGEGSSAAPQVDMKFDGHRFQSEEHQHHFEAIKGLSFLKERRVQLREEEFVEFQEEIDKRQWTQLAVPMAKYDPEIFMEFYVNTWPMEEGETIGQLLCVLGQDFARSVTGRQLVYAILTQVSVHVVQLISDAIYQFAGITPPRHPVDLEKSNRALGFPALITGLCQFYGQEEDQQQPAADAPLPSLRQPPSLESISAHMRRMELQMHAYMQHVTDQQAANHRGQVQLNESFYQYTLHQQSQDPGPFPWPPPE

SEQ ID NO: 176255 - protein, 174 aa, Glycine max
  Coding DNA Sequence Number=SeqID_59477
  Gene Ontology: Mol. function=RNA-directed DNA polymerase activity; Biological process=RNA-dependent DNA replication
  Homolog annotation: Hit_ID=Q2HS45; Match level="QueryCoverage=63%, HitCoverage=21%, E-value=8e-24, Identity=52%"; Hit description=RNA -directed DNA polymerase
MAEEAINSALVQEDGKHQIPIYFVIRVLHDVEKRYQMTKKGSMELSVEFDYKDVFSWEMDRREFGTALITSPISTCQKLAKKFSSNLVLKSGTIIGINWLSWEKLMMKKEFGGLEFQHLYVFNLSMLGNQGYKFSANLDAIATKVFQAKYFHNDGFMEAPLGHKPSYIWHNIHT

SEQ ID NO: 176256 - protein, 377 aa, Glycine max
  Coding DNA Sequence Number=SeqID_59478
MELTKDMATSDHAILHDRLHISSKKSLLELTSQDALLAQNKILAKQLKPSWSHSTSIHDHCIPFSQLNLPLCKLEDAPYVAYEWFKMRHLWRSITWQTKTVKTIIKEAIIKVVTFLKIKGQGCKSLSRNKFNKDQGVPSYRPPNQGLNLYERTTKLEDTLTQFMQVSISNHKSTESAIKKLEMQVGQLSKQPAEKSNGKFVANTEQNPKEQCKEVLTRSKRMKGLVSDELVEGIVEDVSDDDEGVDKVLASKTKSQMARKANKGAPSGPTKDVPFTCKLQTTTSMTIIVKLDHTSSRQANHGTHVLARVSMFYASNNEFECMPISISEIAVATYPSAGGRGETQGIRVRELFTCGEGISTPCARHKGQQPLIERAKS

SEQ ID NO: 176257 - protein, 774 aa, Glycine max
  Coding DNA Sequence Number=SeqID_59479
  Gene Ontology: Mol. function=transferase activity, transferring glycosyl groups; Cellular component=integral to membrane; Biological process=response to oxidative stress
  Homolog annotation: Hit_ID=Q9LXU2; Match level="QueryCoverage=99%, HitCoverage=100%, E-value=0.0, Identity=77%"; Hit description =Anthranilate phosphoribosyltransferase-like protein
  Pfam annotation: Domain name=C2; Domain location=203-285; Score=72.1; E_value=1.8e-18; Accession=PF00168.20; Description=C2 domain
  Pfam annotation: Domain name=C2; Domain location=365-456; Score=85.0; E_value=2.3e-22; Accession=PF00168.20; Description=C2 domain
  Pfam annotation: Domain name=C2; Domain location=42-122; Score=94.0; E_value=4.7e-25; Accession=PF00168.20; Description=C2 domain
  Pfam annotation: Domain name=PRT_C; Domain location=619-774; Score =401.8; E_value=9.8e-118; Accession=PF08372.1; Description=Plant phosphoribosyltransferase C-terminal
  Pfam module annotation: Pfam domain module=C2::C2::C2::PRT_C; Domain location=203-285::365-456::42-122::619-774
MHKPAEALDFALMETSPNIGAGAVMRDKLSCTYDLVEQMQYLYVRVVKAKDLPGKDVTGGVDPYVEVKLGNYKGLTKHFEKKSNPQWNQVFAFSKERIQASVLEVVIKDKDVVVDDFVGRVMFDINEIPKRVPPDSPLAPQWYRLEDRRGDKAKGELMLAVWMGTQADEAFPDAWHSDAATVGPEAVANIRSKVYLSPKLWYVRVNVIEAQDLVPSDKTRYPEVFVKANLGIQFLRTRVSQSKTINPMWNEDLMFVAAEPFEEPLVLTAEDRVGPNKDEILGRCLIPLHNVQRRLDHKPVNTKWFNLEKHVVVEGEQKKETKFSSRIHLRVCLEGGYHVLDESTHYSSDLRPTAKQLGKASIGILEVGIISAQGLMPMKTRDGRGTTDAYCVAKYGQKWIRTRTIVDSLAPRWNEQYIWEVFDPCTVITVGVFDNGHLHGGDKSGGSKDSRIGKVRIRLSTLEADRVYTYSYPLLVLYNSGVKKMGEVQLAVRFTSLSLINMLCMYSQPLLPKMHYIHPLSVIQQDSLRHQAIQIVSMRLSRAEPPLRREVVEYMLDVDSHMWSMRRSKANFFRITKVLGGLIAFGRWFDQICNWKNPLTSILIHILFIILVLYPELILPTIFLYLFMVGIWNFRWRPRHPPHMDTRLSHADAAHPDELDEEFDTFPTSRSSDMVRMRYDRLRSIAGKVQTVVGDLATQGERFHNLLSWRDTRATTLFVTFCFIAAIVLYVTPFQVVFLLIGFYVLRHPRFRQKHPSVPFNYFKRLPARVDSIL

SEQ ID NO: 176258 - protein, 2331 aa, Glycine max
  Coding DNA Sequence Number=SeqID_59480
  Gene Ontology: Mol. function=oxidoreductase activity; Biological process=electron transport
  Homolog annotation: Hit_ID=Q1RYZ2; Match level="QueryCoverage=63%, HitCoverage=99%, E-value=0.0, Identity=79%"; Hit description=NAD -binding site; Serine/threonine dehydratase, pyridoxal-phosphate- binding site; ...
  Homolog annotation: Hit description=AMP-dependent synthetase and ligase
  Pfam annotation: Domain name=AMP-binding; Domain location=531-988; Score=235.5; E_value=1.1e-67; Accession=PF00501.18; Description=AMP -binding enzyme
  Pfam annotation: Domain name=Amino_oxidase; Domain location=31-427; Score=-38.2; E_value=0.00062; Accession=PF01593.14; Description =Flavin containing amine oxidoreductase
  Pfam annotation: Domain name=Catalase; Domain location=1737-2065; Score=-273.9; E_value=0.078; Accession=PF00199.9; Description =Catalase
  Pfam annotation: Domain name=DAO; Domain location=23-418; Score= -27.4; E_value=0.00035; Accession=PF01266.14; Description=FAD dependent oxidoreductase
  Pfam annotation: Domain name=Hexapep; Domain location=1382-1399; Score=3.0; E_value=62; Accession=PF00132.14; Description=Bacterial transferase hexapeptide (three rep
  Pfam annotation: Domain name=Hexapep; Domain location=1411-1428; Score=12.4; E_value=1.6; Accession=PF00132.14; Description=Bacterial transferase hexapeptide (three rep
  Pfam annotation: Domain name=Hexapep; Domain location=1671-1688; Score=9.0; E_value=12; Accession=PF00132.14; Description=Bacterial transferase hexapeptide (three rep
  Pfam annotation: Domain name=Hexapep; Domain location=2295-2312; Score=10.0; E_value=8.6; Accession=PF00132.14; Description=Bacterial transferase hexapeptide (three rep
  Pfam annotation: Domain name=PP-binding; Domain location=1130-1196; Score=31.0; E_value=4.3e-06; Accession=PF00550.15; Description =Phosphopantetheine attachment site
  Pfam module annotation: Pfam domain module=AMP-binding::Amino _oxidase::Catalase::DAO::Hexapep::Hexapep::Hexapep::Hexapep::PP -binding; Domain location=531-988::31-427::1737-2065::23-418::1382 -1399::1411-1428::1671-1688::2295-2312::1130-1196
MDPERSVEDQFSKLHPSMPVNTRIGIVGAGPSGLSAAYALARLGYNNITVLEKHHTVGGMCESVEIEGKVYDLGGQVLAASSAPVIFHLAKETGSPLEEMDSHKLAVIDSSSGKYRDVKVADDYVSVMTLTLEIQEKVKNSGRFGVHALSEVASDLAPDYLERHGLKSVPKSVAYGYTASGYGFIQDMPYAYIHEFTRTSMAGKIRRFKGGYTSLWQRIAESLPIKLHYNTEVLAIRRNSDSVTVNVKGSNEIETMEYDKIIISENETDVMDVSELEKDLFSKVETNDYYTTVLKIKGLEHMPVGFYYFGEYMEDPSTIGNPVAMQKFYADSNIFLFWSYGNSADIKGPTVTELAIKSIESMGGEVENFILQRRFKYFPHVSSQDMRNGFYEKLESELQGSRNTYYVGGLMAFELTERNSSYAMALICKNFASSSDLPVFPYTKILHTLSSHVFQIELHLLEECLLQSLFPLQTEIQKKEPKELGELPGVKFPNFPALNSYLKHWGTHPVTQNRTLYTWLNEGGTVVDKRTYGEQHLNASCIAHKLLTSQKPVIKPGDRVLLVYVPGLDFVDAFFGCLRAKVLPVPVLPPDPMQRGGQALMKIENITKSCGIVAILSTVSYHSAVRVGLVKSLISLTGKNGKSTAQWPKLPWLHTDTWVNNSRNSAVEDVDDQCESQPGDVCFLQFTSGSTGDAKGVMITHGGLIHNVKLMRIIYKSTSRTVLVSWLPQYHDMGLIGGLFTALVSGGSAVLFSPLTFIKKPLLWLETISKYQATHSAGPNFAFELVVRRLESEKDKLQNLDLSSMIFLMVAAEPVRMKTLNRFLDLTTPFGLSQKVMAPGYGLAENCVFVSCAFGEGYPILVDWQGRVCCGYIHPGDADVDIAIVDPESGEELEEDGKEGEIWISSPSAGIGYWGKEELSQKTFRNELQNHPGRNYTKTGDLGRIIDGKLFITGRIKDLIIVAGRNIYSADVEKTVESSSEFLRPGCCAVISVPEEILSAKGISLPDGSDQVGLVVVAEVRDGKTVSKDVIEHIQTRVVEEHGVSVASVKLIKPRTISKTTSGKIKRFECLKQFSDETLSLVPQPILTKKSLVRSFTTGTCREGRTPRAHLVRSSTPLPIPRISNKEIVEHLKRLISEQSGIPVNNISVTDNMSTYGIDSIGVVKATQKLTDFLGVPVAAIDVFTASCIQELANFSESLLLKSQPQLMSNSSHAPEAEIDSIEVVVDVSKSRQWGICLLQLLALVYISIMLVTPAYLSITAFQSFIPNVSESVYGMPWSSYLISLTLAPLSWILCMVSTCICISFFGNSFLRPNYALTPEISIYSMDFVKWWALYKTQEISSKVLATHLRGTVFLKYWFETLGARIGSLVLLDTVDITDPSLVSIGDEVAIAEGVLVQSHEVKNGILSFLPIRIGKNSSIGPYSIIQKGSVIKEGSEVHPLEKVEGGQHVLKPAKLNNVKENAVLLVTTNKTQSNAMYHFLGIYLTGLVSSLAAAIAYILYIRLFHLPASFQHFSFLCICGAFHWIPFTIVAYATMFSNVPSNPIAFTFSFTSAYLLHGLILSSLTCALTRLLKLNQNQTHFKTWLRHQLTIFCHHRFAKLLSGTEAFCIYLRLLGAKIGKHCSIRAINPVSNPELMSIGDGVHLGDFSKIITGFHYSNGYACGKIEVQDNSVVGSQSLILPGSVVEKNVILGALSVAPMNSILHEGSVYIGSQTRVATRNSSYDLDERIEEMDMEYKKVVANMAANLAVTTINVKARYFHRIGVSGKGHLKIYDKLDDGIPLHKIFHPGKSYPIMVRHSNSLSADDDARIDARGAALRILSDAPDSNHHVPLIDLTLKTGNAFYARTLADFATWLVCGLPAREELVKRTPHVREAVWNSLRHANSYAELHYYSNICRLMRFTDGQEMYVKFKLRPFDTSISEDTGKVVPTGILPPETGAIPRDEKDTRPLLFLAKDFQRRVNSPGGVRYVFQVQLRAVPEDEAARDMALDCTKPWDENEFPYIDVGEININENLSREESDRLEFNPYLKSHELDVIPATSNTQSASIDHGRSLIYEICQHVRNRQPLPESWRNLVEQSNVKVDLSCCPVAALLPKKETKKVMTTLTLTRTWYQTFSALFTQPLLQTVLPYTVVGLAVFAPLNFLVNMKNVEKIPVQWMFPLFWVVSGVMAALACVVAKWILVGRKKDGETVPIWSKRVAMDSTWQAIRTLVGDYFMDMASGSFLFVMWMKLMGADIDMEGGGAYVDSTGALLNPEMVKIERGGCVGREALLFGHIYEGDEGGMVKFGGIKIGEDGFVGSRAVVMPGVHVENEANLSALSLAMKGEIVRSR

SEQ ID NO: 176259 - protein, 67 aa, Glycine max
  Coding DNA Sequence Number=SeqID_59481
  Subcellular localization annotation: CTP_CleavageSite=53; ConfidenceScore=5.17e-01
MATIFFRKLKQDFSVILLAHSNSFNFCQYRAELPSMTTPPPLLNSNSINHCNSAATTKEQPSSNTHF

SEQ ID NO: 176260 - protein, 88 aa, Glycine max
  Coding DNA Sequence Number=SeqID_59482
MWYIVRDFNDVKCEDERKGGLEHSRQEEIQAFEELMEEAKAMNSSIVGMRFTCYRDDVLTLKGTQTILPLREPNLLHKDGQEEDTFMT

SEQ ID NO: 176261 - protein, 951 aa, Glycine max
  Coding DNA Sequence Number=SeqID_59483
  Gene Ontology: Mol. function=nucleic acid binding; Cellular component= spliceosome; Biological process=nuclear mRNA splicing, via spliceosome
  Homolog annotation: Hit_ID=Q7XIR8; Match level="QueryCoverage=89%, HitCoverage=67%, E-value=0.0, Identity=80%"; Hit description =Putative DEAH-box RNA helicase
  Pfam annotation: Domain name=DEAD; Domain location=170-333; Score= -7.2; E_value=2.3e-05; Accession=PF00270.19; Description=DEADDEAH box helicase
  Pfam annotation: Domain name=DUF1605; Domain location=689-791; Score =103.5; E_value=6.4e-28; Accession=PF07717.6; Description=Domain of unknown function (DUF1605)
  Pfam annotation: Domain name=HA2; Domain location=565-655; Score =101.8; E_value=2e-27; Accession=PF04408.13; Description=Helicase associated domain (HA2)
  Pfam annotation: Domain name=Helicase_C; Domain location=410-504; Score=60.4; E_value=5.9e-15; Accession=PF00271.21; Description =Helicase conserved C-terminal domain
  Pfam module annotation: Pfam domain module=DEAD::DUF1605::HA2::Helicas e_C; Domain location=170-333::689-791::565-655::410-504
MSLSQSKKLSQLTADNAQWEDRQLLRSGAVRGTEVQTEFDDEEEHKVILLVHDTKPPFLDGRVVFTKQAEPIMPLKDPTSDMAIISRKGSTLVREIHEKQSMNKSRQRFWELAGSKLGDILGVEKTAEQIDADTAEVGEDGEIDFKEEAKFSQHMKKGEAVSDFAKSKTIAEQRQYLPIFSVVRENQVVVVVGETGSGKTTQLTQYLHEDGYTIGGIVGCTQPRRVAAMSVAKRVSEEMDTELGDKIGYAIRFEDVTGPNTIIKYMTDGVLLRETLKDSDLDKYRVIVMDEAHERSLSTDVLFGILKKVVAQRRDFKLIVTSATLNAQKFSNFFGSVPIFHIPGRTFPVNILWSKSPVEDYVEGAVKQAMTIHITSPAGDILIFMTGQDEIEAACYALAERMEQMVSSSKKAVPKLLILPIYSQLPADLQAKIFQKAEDGARKCIVATNIAETSLTVDGIFYVIDSGYGKMKVYNPRMGMDALQVFPVSRAAADQRAGRAGRTGPGTCYRLYTESAYLNEMLPSPVPEIQRTNLGNVVLLLKSLKVENLLDFDFMDPPPQDNILNSMYQLWVLGALNNVGGLTDLGWKMVEFPLDPPLAKMLLMGEQLGCLEEVLTIVSMLSVPSVFFRPKDRAEESDAARERFFVPESDHLTLYNVYQQWKQHDYRGDWCNDHFLHVKGLRKAREVRSQLLDILKTLKIPLTSCWPDTDIVRKAICSAYFHNSARLKGVGEYVNCRNGMPCHLHPSSALYGMGCTPEYVVYHELILTTKEYMQCATAVEPQWLAELGPMFFSVKDSDTSLLEHKKRQKQEKTAMEEEMENLKKVQAEVEKERKQKEKEKMAKHQQQISMPGLRKGSSTFLRPKKFGLLRKKRLQIPWMAAGLPEYTVFTLWKTIFERLIYYFGNSTALLEHCHIHCKFVGFITAQSRNCPQEITGYVFPSHCKLFNMFNS

SEQ ID NO: 176262 - protein, 184 aa, Glycine max
  Coding DNA Sequence Number=SeqID_59484
NNKLAGKRAETDYAPFIIQEQQAEWINTHRQILHTLSFRNNKLGGKRAETDSAPFIIQEQQSEWINAHRRILHPLSFRSSESSDFANWVINAHRRILRPLSFRNNKLGEQQAEWINAQRKILCPLSFRSSESSGTTSWVVNAQRQIMRPLSFRFRKSSDKRARTNYAPLSFGDSSTGREVHWPN

SEQ ID NO: 176263 - protein, 91 aa, Glycine max
  Coding DNA Sequence Number=SeqID_59485
  Gene Ontology: Mol. function=oxidoreductase activity, acting on NADH or NADPH, quinone or similar compound as acceptor; Cellular component=photosystem II; Biological process=electron transport
  Homolog annotation: Hit_ID=Q9MUL0; Match level="QueryCoverage=93%, HitCoverage=40%, E-value=2e-22, Identity=43%"; Hit description =NAD(P)H-quinone oxidoreductase chain H, chloroplast (EC 1.6.5.-) (NAD(P)H dehydrogenase, chain H)
  Pfam annotation: Domain name=Complex1_49kDa; Domain location=20-89; Score=-125.3; E_value=0.00036; Accession=PF00346.9; Description =Respiratory-chain NADH dehydrogenase,
MLELSRIASHLLWLGPFMADIGAQTPFFYIFRERELIYDLFEAATGPMLRASGIQWDLRKVDNYECYEEFDWEVQWQKEGDSLARYFSSNW

SEQ ID NO: 176264 - protein, 80 aa, Glycine max
  Coding DNA Sequence Number=SeqID_59486
MTKLGLCLSSGPQPLDDKRVRITVRMTKLGLCLSSGPPPLDDKRVRITIRVRITVRYLRVSWVQNDQTWSLLVIGPAASG

SEQ ID NO: 176265 - protein, 73 aa, Glycine max
  Coding DNA Sequence Number=SeqID_59487
MRAGISDLYGFLEPQSIQRSRQSQFETKSYIKSWIQSSKRDVYLGAYLNGALKGLDDAPQHKSKVPARWIVVK

SEQ ID NO: 176266 - protein, 85 aa, Glycine max
  Coding DNA Sequence Number=SeqID_59488
FKNSPGLSGLPQTGRVILGQIHDRYNNQTGLVMSLGPNPTSQWWMVVGIVANGSTTTKHVMEVCRDGKDEESCVEAMSSRQLIPA

SEQ ID NO: 176267 - protein, 173 aa, Glycine max
  Coding DNA Sequence Number=SeqID_59489
MEDSLLILTRGFILNIEGQPWKLLRKDLTTLAQTWSVFSYSNLDPTSHTSDLNTDRARLVYGLITRMDMNIGGLIYGQMTMMAQSNSSHLGFPALITTLCRSRGVGFDALTSYENLRPTIDLAYIIRNCWNANDQTVKFLEARKSKLRAADAPSSFAPIAGILASSTSPHSQL

SEQ ID NO: 176268 - protein, 302 aa, Glycine max
  Coding DNA Sequence Number=SeqID_59490
  Gene Ontology: Mol. function=carboxypeptidase activity
  Homolog annotation: Hit_ID=Q1SIS3; Match level="QueryCoverage=66%, HitCoverage=44%, E-value=1e-49, Identity=46%"; Hit description =Peptidase M14, carboxypeptidase A
LSVKQFCKTLICQIEETDHPLMDNLNLLLQPYRLSLNSKYSKAVLYHFEAFINQSFYQDFENSVFQKNGCTKFLDPRQDRQAQFSSFVALRNLSWNEVLRKGTKYYSEEFSKFCDQKMSCIITTLNWTRPWPEQLLQAFFVAAKCIWLLHLLAFSFNPPLGILRVEENRNFDPHYMEDLVTDRQRSQGPSRVKIMVVPGFYVQDRILSEGTLHDDEGGAKGPRVTMKGVAVTSRDDEGAGGDLNSLAASKVGAKGNGDDSATVWRRWHSGVGEEEVGKEWAYRLRMEYVRVQGWVLDDIQKF

SEQ ID NO: 176269 - protein, 322 aa, Glycine max
  Coding DNA Sequence Number=SeqID_59491
  Gene Ontology: Mol. function=nucleic acid binding
  Homolog annotation: Hit_ID=Q7XIR8; Match level="QueryCoverage=95%, HitCoverage=25%, E-value=3e-36, Identity=34%"; Hit description =Putative DEAH-box RNA helicase
MEKDGAGAGAGVVDIDKITATLEPEKPTSGGLYVPGKDRMVYVPQERKSRLGLDALASAKRSQHDAGFKVPKERTISIAASAEDEDKSELSVSEESGHDGIVNRRRHTNRRYRDTTNETSHSESSVTEDHYGDTNRTPSSEHKGSDVPASPSGYDREDHRSERRHHRDDSRSGNGRVRHWDYYESKGSYSERDSHSRYDREYGRKRNRYEGSRRMPGRSDWDDGQWEWGDTPRRDSVSSSRRHQPSPSPMFVGASPDARLVSPWLGGHTPHSSFTSPSPWDHVSPSPVPIRASGSSAKSSVSRHNGRSHQLSFSSETSNRYE

SEQ ID NO: 176270 - protein, 158 aa, Glycine max
  Coding DNA Sequence Number=SeqID_59492
  Homolog annotation: Hit_ID=Q9XHQ5; Match level="QueryCoverage=28%, HitCoverage=11%, E-value=3e-12, Identity=76%"; Hit description=G-Box binding protein 2
  Pfam annotation: Domain name=bZIP_1; Domain location=42-91; Score =17.0; E_value=0.0021; Accession=PF00170.11; Description=bZIP transcription factor
MLQCEGFSSKIRYDFQITNGENVRNWVANMILKFHDDSTVNGFEIVVFLRQAECDELAQRAEALKEENASLRSEVNRIRSDYEQLVSENSALKSRDHKMVCQSSRVWACGVVQKLHWYAMSWQEMQLIALDHVVCVEEKRDWCYLAFKRNEFHIGLGF

SEQ ID NO: 176271 - protein, 124 aa, Glycine max
  Coding DNA Sequence Number=SeqID_59493
MVIDQSLFFELTQLFSVGVPFKGTLDDEWKFDFSVSDACRMVCTNQADMTGRILAGSLAFECHIMQYLIVRTSYFLDHPTLHRSFSIGANVVSSFGYRKERDGTWVKKDAPAQAAEDRSPSPPP

SEQ ID NO: 176272 - protein, 118 aa, Glycine max
  Coding DNA Sequence Number=SeqID_59494
MKMISLAITSLRSNVNRIGIVVEKNPLEHVLKIVSHPLRRLLILVVRRGGENLRVVAKDSRIELKDHELNNKKGYWVVIMSDTENPSMEKMGTKSMKELNKKSSNRYFSWEKMQKKIK

SEQ ID NO: 176273 - protein, 65 aa, Glycine max
  Coding DNA Sequence Number=SeqID_59495
  Gene Ontology: Mol. function=phosphatidylinositol phosphate kinase activity; Biological process=phosphatidylinositol metabolic process
  Homolog annotation: Hit_ID=Q9LLS0; Match level="QueryCoverage=77%, HitCoverage=7%, E-value=8e-16, Identity=75%"; Hit description =Putative phosphatidylinositol 4-phosphate 5-kinase
MPARAERMARRSDFDQYTPCCSGETYDVVIYCGIIDILQDYDISKKLEHAYNHDNEGREIFVHGG

SEQ ID NO: 176274 - protein, 490 aa, Glycine max
  Coding DNA Sequence Number=SeqID_59496
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q9LK11; Match level="QueryCoverage=92%, HitCoverage=90%, E-value=1e-167, Identity=61%"; Hit description=Beta- 1,3-glucanase-like protein
  Pfam annotation: Domain name=Glyco_hydro_17; Domain location=26-352; Score=274.8; E_value=1.6e-79; Accession=PF00332.9; Description =Glycosyl hydrolases family 17
  Pfam annotation: Domain name=X8; Domain location=373-456; Score =142.2; E_value=1.4e-39; Accession=PF07983.3; Description=X8 domain
  Pfam module annotation: Pfam domain module=Glyco_hydro_17::X8; Domain location=26-352::373-456
MAPNFLHQVAFLLVLSTAVSSGYAWVGVNWGTMATHQLQPEKVVKMLKENGFRKLKLFDADEFIMTALMGTDIEVMVAIPNNMLDKISNSPKAADSWVNDNVTSYFTGVKIKLSAAIAMYVAVGNEPFLKAYNGSFAKKTLPALKNIQTSLNKAGLGSKIKITVPFNADIYYSPDSNPVPSTGDFRPEVRDLTVEIIQFLYANNAPFTVNIYPFLSLYGNQDFPFDFAFFDGNNKPLRDGKALYTNVFDANLDTLLWALDKAGYPDMKVMIGEIGWPTDGDKNANAKNAKRFNLGLLKHALSGKGTPKRNGTVDLFLFSLIDEDTKSVAPGNFERHWGIFEFDGKPKYELDLIGQHKEKGLVPVEDIKYMEKRWCILNPDVTKLDDLAGSIDYACTFSDCTSLGYGSTCNNLSVQGNASYAFNMYYQVNNQQNWDCDFSGLAVITHKDPSQNGCQFPVMISSSSSLLLHGGLSEILKKALRVYIFVMFLL

SEQ ID NO: 176275 - protein, 294 aa, Glycine max
  Coding DNA Sequence Number=SeqID_59497
  Gene Ontology: Mol. function=RNA-directed DNA polymerase activity; Biological process=RNA-dependent DNA replication
MDSFLEIRKVTIVIKKKDHALRHPYWKHAKTKIMSEIEEVQEQMKTDMEAMKEQMKKMIEAMMDMRKIMEVNVAASTATERNPTHSPIFNQESNLVLGVEGQGGATGTEAYNSNARDEAREAPLDHTDVLQKDGGLCEGREVVNAFFLGKPDWGGYYLYNSNMAPDRIQLQNLSKRNNKSFKEYAQRWQYLAAQLYGFCVYGEMIEVSLKKGKFDYVASTNFGSKRPRMNEVKKIEGEAHVVATKDLQGKWAPNYKGPFVVKKAFSGGALILTNMDSEELSSPVNFDVVKQYYA

SEQ ID NO: 176276 - protein, 93 aa, Glycine max
  Coding DNA Sequence Number=SeqID_59498
MTSSYKDIKEVLLGGNLMAPKKLTFKRFRKIAAREGSSTTPPIEIEFDGHRFHSEEHQRRFEVIKDWSFLKERRIQLAEGEYVEFQVEIARRH

SEQ ID NO: 176277 - protein, 222 aa, Glycine max
  Coding DNA Sequence Number=SeqID_59499
MGVQIAPRPTWALRNIPPEGGTSLSFEFAWKNCFREENLSRGASVTFSVRNFAKISTVLRRSSFVLHRSSIFNGLPSLGADVWGANTFPVRKYNSRTFHLKVRRSRLFRFFRRFPQINVGGDSARIPFVEHASHESRVALPPKGRLRHNRIMVFVTDYNARLRGRSRLASSSPKLRENFNPKQGTRLVMQGKRKRGLELKKQRENVEEEGEEEKQSRGATEL

SEQ ID NO: 176278 - protein, 52 aa, Glycine max; identical to SEQ ID NO: 124036
  Coding DNA Sequence Number=SeqID_59500

SEQ ID NO: 176279 - protein, 144 aa, Glycine max
  Coding DNA Sequence Number=SeqID_59501
MGSSQKPSFKKRFYQVKIKSLEVTSLREVGQLMGQLQRQAFRKPMDFQLVPTVKEFEEIRGCPLGGRKPYLFSGLYPSTTRVAKVVKISAQELNRVKQNRNGVVGVPRKFVLFPNMEGLVDLAAIDAFLAFHHGKESPVVAILA

SEQ ID NO: 176280 - protein, 192 aa, Glycine max
  Coding DNA Sequence Number=SeqID_59502
  Homolog annotation: Hit_ID=Q69Q42; Match level="QueryCoverage=45%, HitCoverage=23%, E-value=3e-12, Identity=47%"; Hit description =Putative BRI1-KD interacting protein 118
  Subcellular localization annotation: CTP_CleavageSite=34; ConfidenceScore=5.26e-01
MPSFYQEPAPAKAELKKIPTTRAKSPKLGRKKSTANSESDGNNSSSSRLARLSLDEKVSESNPTKGPTPPVHQKKPQRRSLPARLASEGNSVSNSRTALTSSKAAIKDEKSSLSSAAKKDNNLTNATGEAKTMTIAANEEKSTLSSETSAVMPLNLIPSDKLSEEESHVNGDIAVKEYSQLSLEQEPIAAER

SEQ ID NO: 176281 - protein, 74 aa, Glycine max
  Coding DNA Sequence Number=SeqID_59503
MLHNGVRARFLSQYGVVRGQTKEEASGHVTLRTVNDLESSQALQVISEMVVDVSKRLPIEDYDQWRVLTNEKVE

SEQ ID NO: 176282 - protein, 65 aa, Glycine max
  Coding DNA Sequence Number=SeqID_59504
  Subcellular localization annotation: CTP_CleavageSite=23; ConfidenceScore=5.02e-01
MVTIRHGSGTRPSPQSSLYLPLSISHKFTRRYSSSVLTLPLLYFDLLSDIDSAIDEDTKVSLSLS

SEQ ID NO: 176283 - protein, 700 aa, Glycine max
  Coding DNA Sequence Number=SeqID_59505
  Gene Ontology: Mol. function=protein binding; Cellular component =nucleus; Biological process=negative regulation of ethylene mediated signaling pathway
  Homolog annotation: Hit_ID=Q1S5E5; Match level="QueryCoverage=90%, HitCoverage=98%, E-value=0.0, Identity=82%"; Hit description=Leucine Rich Repeat, putative
  Pfam annotation: Domain name=F-box; Domain location=62-110; Score =35.8; E_value=1.5e-07; Accession=PF00646.23; Description=F-box domain
  Pfam annotation: Domain name=LRR_1; Domain location=214-238; Score =4.7; E_value=37; Accession=PF00560.23; Description=Leucine Rich Repeat
  Pfam annotation: Domain name=LRR_1; Domain location=240-263; Score =8.5; E_value=7.3; Accession=PF00560.23; Description=Leucine Rich Repeat
  Pfam annotation: Domain name=LRR_1; Domain location=266-290; Score =2.7; E_value=89; Accession=PF00560.23; Description=Leucine Rich Repeat
  Pfam annotation: Domain name=LRR_1; Domain location=346-373; Score =3.2; E_value=72; Accession=PF00560.23; Description=Leucine Rich Repeat
  Pfam annotation: Domain name=LRR_1; Domain location=398-419; Score =11.8; E_value=1.8; Accession=PF00560.23; Description=Leucine Rich Repeat
  Pfam annotation: Domain name=LRR_1; Domain location=425-447; Score =1.3; E_value=1.7e+02; Accession=PF00560.23; Description=Leucine Rich Repeat
  Pfam annotation: Domain name=LRR_1; Domain location=452-475; Score =11.7; E_value=1.9; Accession=PF00560.23; Description=Leucine Rich Repeat
  Pfam annotation: Domain name=LRR_1; Domain location=478-499; Score =0.5; E_value=2.3e+02; Accession=PF00560.23; Description=Leucine Rich Repeat
  Pfam annotation: Domain name=LRR_1; Domain location=505-528; Score =6.1; E_value=21; Accession=PF00560.23; Description=Leucine Rich Repeat
  Pfam annotation: Domain name=LRR_1; Domain location=532-559; Score =8.1; E_value=8.6; Accession=PF00560.23; Description=Leucine Rich Repeat
  Pfam annotation: Domain name=LRR_1; Domain location=584-607; Score =12.2; E_value=1.5; Accession=PF00560.23; Description=Leucine Rich Repeat
  Pfam annotation: Domain name=LRR_1; Domain location=610-633; Score =0.2; E_value=2.6e+02; Accession=PF00560.23; Description=Leucine Rich Repeat
  Pfam module annotation: Pfam domain module=F-box::LRR_1::LRR_1::LRR _1::LRR_1::LRR_1::LRR_1::LRR_1::LRR_1::LRR_1::LRR_1::LRR_1::LRR_1; Domain location=62-110::214-238::240-263::266-290::346-373::398 -419::425-447::452-475:...
  Pfam module annotation: Domain location=:478-499::505-528::532 -559::584-607::610-633
MFGFSGVDDFCPMGSIYANPKEASFFLSLGPQVDVYFPPRKRSRVNAPFVFDGEWFEQKQKTSIEALPDECLFEIFRRLPAGEDRSACACVSKRWLMLLSSICKSEISVNKNTTVENPEKEGDDVEFGGKGYLSRSLEGKKATDVRLAAIAVGTSSRGGLGKLSIRGSNIVCGVTSHGLKAVARGCPSLKALSLWNVATVGDEGLIEIANGCHQLEKLDLCKCPAITDKALVAIAKNCQNLTELSLESCPNIGNEGLLAIGKLCSNLRFISIKDCSGVSDQGIAGLFSSTSLFLTKVKLQALTVSDLSLAVIGHYGKSVTDLVLNCLPNVSERGFWVMGNGNGLQKLKSLTVASCRGVTDIGLEAVGKGCPNLKIAHLHKCAFLSDNGLISFAKAASSLESLRLEECHRITQLGFFGVLFNCGAKLKAISLVSCYGIKDLNLVLPTVSPCESLRSLSISNCPGFGNASLSVLGKLCPQLQHVELSGLEGVTDAGLLPLLESSEAGLVKVNLSGCTNVTNKVVSSLANLHGWTLENLNLDGCKNISDASLMAIAENCALLCDLDVSKCAITDAGIEALAHAKQINLQVLSLSGCTLVSDRSLPALRELGHTLLGLNIQHCNAINSSTVDTLVELLWRSSSSSDSVPFYRSVQSFSPHFCRFLQWEACSFWHPFCPLLNGCISENIATGFWSVGIFVTGVGT

SEQ ID NO: 176284 - protein, 67 aa, Glycine max
  Coding DNA Sequence Number=SeqID_59506
  Gene Ontology: Mol. function=protein dimerization activity; Cellular component=endoplasmic reticulum; Biological process=proteolysis
  Homolog annotation: Hit_ID=Q6H8S2; Match level="QueryCoverage=96%, HitCoverage=15%, E-value=5e-25, Identity=87%"; Hit description =Putative auxin-amidohydrolase precursor
EVASRSGPLLAGSGFFEAIISGKGGHAAIPQQSIDPILATSNVIISLQHLVSREADPLDSQKVRAAL

SEQ ID NO: 176285 - protein, 32 aa, Glycine max
  Coding DNA Sequence Number=SeqID_59507
SMSYKVVVECATVMNEMVSDDEGRMMDAGGTD

SEQ ID NO: 176286 - protein, 88 aa, Glycine max
  Coding DNA Sequence Number=SeqID_59508
MEQFTEMVAWPGTQPSLHREDEEPSAQGEDIPSPQPAADPSTPLLEMLQDPTTPVLAMDTSPLATPVLHLTDEEDVQTQDTQDQSQEF

SEQ ID NO: 176287 - protein, 90 aa, Glycine max
  Coding DNA Sequence Number=SeqID_59509
  Gene Ontology: Mol. function=transferase activity, transferring nitrogenous groups; Biological process=ethylene biosynthetic process
  Homolog annotation: Hit_ID=Q71T07; Match level="QueryCoverage=54%, HitCoverage=10%, E-value=2e-19, Identity=87%"; Hit description=1 -aminocyclopropane-1-carboxylate synthase
MHIRTADCLMMSEDAVIHIVGLMSHSVLAANLVGTLCSVCDMNMLSRKASHDSHGQDSSYFLGWQEYEKNPYHPIQNPTGIIQMGLAENQ

SEQ ID NO: 176288 - protein, 444 aa, Glycine max
  Coding DNA Sequence Number=SeqID_59510
  Gene Ontology: Mol. function=RNA-directed DNA polymerase activity; Cellular component=chromatin; Biological process=RNA-dependent DNA replication
  Homolog annotation: Hit_ID=Q8S8M1; Match level="QueryCoverage=92%, HitCoverage=48%, E-value=3e-76, Identity=33%"; Hit description =Putative retroelement integrase
  Pfam annotation: Domain name=zf-CCHC; Domain location=118-135; Score =23.2; E_value=0.00015; Accession=PF00098.13; Description=Zinc knuckle
  Pfam module annotation: Pfam domain module=RVT_1::zf-CCHC; Domain location=268-441::118-135
MRRVMRRRYVPISYSRIVLLKHHKLSQGNISVEAYCKEMEMALIRANIDEDNKAKNTHLLSGLNHDIRDVMELQEYVELEDLVHKGEGSSTSPIVTSPHGKSPLKPNTSALRTGTRDIKCFKCLGRGHITSECPTKRTMLVKKYGKIMSESSTIDGGSCTNVANSILVSELNLETKPHPRYNDVVPMKASHFLLGRPCEYDIKAIHYGFTNKISSRKNEQKIVLKPLSPREECKDVFPKEVLNGLPPLRGIGHHIDLILEGWVQGNMSLSVIPMILVPKKDGTWRTCTECRAINNITVNYRHLIPRLNDLLDELHGACIFSKVDLKSEYHQIRMRGGDEWKIVFTTKYGLYEWLVMPFGLTSAPSTFMRLMNRVLREFLGKFVVAWENLAVDGRGSSSLKETLKGLKSRLKEWNQSYFENVHKNIAIEKALNELDKKGEIVDLF

SEQ ID NO: 176289 - protein, 200 aa, Glycine max
  Coding DNA Sequence Number=SeqID_59511
  Gene Ontology: Mol. function=RNA-directed DNA polymerase activity; Cellular component=integral to membrane; Biological process=RNA -dependent DNA replication
  Homolog annotation: Hit_ID=Q1RTD3; Match level="QueryCoverage=93%, HitCoverage=31%, E-value=4e-37, Identity=46%"; Hit description=IMP dehydrogenase/GMP reductase
MVRGIEVDGTWVENPLEKLKRPFGIVEIQRVRTPDGFNLKFIKESWGVLKDDIFNFLKDFHESSTFARGTNASSIALIPKVEEPQGWEEGDYRLILLVGWMCKVVAKILAKRLQKVLYGVIDERQSVFVEGRNILHSILIANEVVDEAWRKKKSEFLLYMLGRLGFHEKWIKWIHGCLKSSSMSILVNGNPSKEFMLQRG

SEQ ID NO: 176290 - protein, 190 aa, Glycine max
  Coding DNA Sequence Number=SeqID_59512
  Gene Ontology: Mol. function=chromatin binding; Cellular component =chromatin; Biological process=chromatin assembly or disassembly
  Homolog annotation: Hit_ID=Q1SAV4; Match level="QueryCoverage=83%, HitCoverage=48%, E-value=6e-36, Identity=42%"; Hit description =Integrase, catalytic region
MDAEDKGRSLVEGERKVHALFEQGKAPYLYKVPSKTPTTYLLEVHPPTVLEPIEWARTGTDRNVRGGERSGTPDELGIPAEVGDDKPLLRYAPLSERGQRISGTAWGDGGDRRWSFASPVSTLHRPIGQHRIAHRGDGRPRNASWPPEPSATYFGVWNGGCGAPVGQSEQLRSLWYQKYSQRPSAGACRK

SEQ ID NO: 176291 - protein, 1132 aa, Glycine max
  Coding DNA Sequence Number=SeqID_59513
  Gene Ontology: Mol. function=nucleic acid binding; Cellular component= nuclear pore; Biological process=DNA integration
  Homolog annotation: Hit_ID=Q1ST43; Match level="QueryCoverage=98%, HitCoverage=96%, E-value=1e-166, Identity=37%"; Hit description =Integrase, catalytic region; Peptidase aspartic, catalytic
  Pfam annotation: Domain name=zf-CCHC; Domain location=246-263; Score =13.4; E_value=0.0061; Accession=PF00098.13; Description=Zinc knuckle
  Pfam annotation: Domain name=zf-CCHC; Domain location=284-301; Score =6.6; E_value=0.081; Accession=PF00098.13; Description=Zinc knuckle
  Pfam module annotation: Pfam domain module=RVT_2::Retrotrans_gag::zf -CCHC::zf-CCHC; Domain location=773-993::77-192::246-263::284-301
MNETTLNNIESYLYLHPSESPAIALVSPVLDATNYHSWSRSMITALSAKNKVEFVDGSAPEPLKTDRMYGAWRRCNNMVVSWIVHSVATSIRQSILWMDKAEEIWRDLKSRYSQGDLLRISDLQQEASTMKQGALSVTEYFTRLRVIWDEIENFRPNPTCFCNIRCSCSALAIIAQRKLEDRAMQFLHGLNEQYGNIRSHVLLMDPLPAISKIFSYVVQQERQLLGNVSSNLNLEPRDISINTAKVVCDFCGRTGHLENVCYKKHGMPLNYDGKSRNNNVRYGKTCTHYGKIGHTIDVCYKKHGYPPGYKTFNGRSTTNNVVAVESKATDDQTQHHESQDIVRFSPEQYKALLALIQQPSAGNTAPNQTQTSTSWILDSGATDHVTCSLSNLHSFNRINPIMVKILNGQHVCATHSGVVHLSTFITLLDVLYIPTFAFNLISISKLVSSTNCTLIFSSTSSTLQDTSNRVKIGTVEVRHGLYQLTPDQIIPNTICSTIVHPKCNIIPIDLWHFRMGHPSSERLQCMQSYYPILQNDKSFTCNTCHYAKHRKLPFPSSNSYALHGFDLLHIDIWGPSSTSSQLTRALLFQASLPPSVWCYALPHAAYLINCIPTPFLHNVLPYEKLHGHSCDISNLRVFGCLCYVNTLKAHRQKLDPRAHPCIFIVSSDHFDPPAETMTTIPTIQNFLTHAEPSSPHLRQSTRPKHAPTYLKDYHRDLTSLTASTSTIVRYPLSSVLSYSRLSPSHRHFVMSISSNTKPSSYAEASCHDCWIKAMQAELHALQVNNTCTLTNLPPHKTTIGCRWIYKIKYHVDGSIERYKARLVAKGYTQMEGLDYLDTFSPVAKLTTVRLLLALAALHQWHLRQLDVNNAFLHGELTEEVYMQVPPGLSVENPNLVCRLQRSLYGLKQASRQWFTRLSSFLISHGMLGSRPHSTPMDYSTKLQATSGTPLSADTSSSYRRLVGRLIYLTNTRPDITYDVQQLSQYMSNPTTSHHQAAFRISRYLKGTPGSGLFFATTGTHQLQAFSDSNWAGSSEAEYRTLASTTCELQWLTYLLQDFRVSFIQPATLYCDNQSAIQIATNPVFHERTKHIEIDCHIVRNKVNSGLIKLLPVSSSKQLADIFTKALSPAVFQ

SEQ ID NO: 176292 - protein, 1046 aa, Glycine max
  Coding DNA Sequence Number=SeqID_59514
  Gene Ontology: Mol. function=RNA-directed DNA polymerase activity; Cellular component=chromatin; Biological process=chromatin assembly or disassembly
  Pfam annotation: Domain name=rve; Domain location=910-1046; Score =64.3; E_value=4e-16; Accession=PF00665.16; Description=Integrase core domain
  Pfam annotation: Domain name=zf-H2C2; Domain location=851-892; Score =24.8; E_value=0.00018; Accession=PF09337.1; Description=His(2) -Cys(2) zinc finger
  Pfam module annotation: Pfam domain module=RVT_1::Retrotrans _gag::rve::zf-H2C2; Domain location=378-566::105-201::910-1046::851 -892
MADHGTRKTTTDRLEEAIVRLSNSHTSINDRYNDLASKVDSILEHLRLRDSSPPPAAVPMASPSHQRNAVKLDIPKFDGHDPLGWIFKITQLFQYQKTPEDERVTIASLYLDGAALSWYQWMFSNGLITSWEGFLQALESRFTPTFYEDPKGALFKLTQHGTVNEYLTQFERLANRVLRREVMAFQPISLLQAQALAKLQEEKLRDKPAPMPRGPVFSKPSFHQNATVSTRPKSNFVQRTPAEMAFRREKGLCYNCDEKWHIGHRCKGKVMLFIAEDQAPSPDSMEHEVAEDPGTAVLDNPEPSVDSDCSHISLHALAGLPSSETFRIYGTIRNAMLTILVDSGSTHNFLQPRIAQFLHLRPQSTQPLRVMGHTFTVSFHLLPISGADAVLGIDWLKELGPVTTDYTEFVMRFHHSGHDISLKADVASGPEPTSATQLCADYRALNSVTVRDRFPIPTIDELLDELGCASWISRTHNGHFEYLVMPFGLCNAPSMFQSAMNTLLRPFLRQFVTVFFDDILIYSSSLSSHLHHLETIFQALQQGEFVLKRSKCLFAQRSLEYLGHVVSDKGVTPEPSKIQAVIRWPTPKTTKELRAFLDLTGFYRKFVKGYASIVAPLTKLLCKDAFQWTHESQTAFDLLKTAMTTTPVLALPKFAEPFMLETNASSTAIGVVLMQNGHPLAYFSKHLGPRLLHASTYIRELHAIVTVVRKWRQYLLGRPFTILTDHKSIRELMSQIIQTPEQHYYLSKLLGYDYSIQYKSGASNVVADALSRAPVTNGEFLLLSAPQLDFLRDIKKSLETNLEFQQLTKSFHDDPASHPEYTLRDGLILFRGRIWLNDGNPSIPSLLIEYHTTPLGGHLGIAKTTHRLESNFFWKGLKGDVKRFIKECITCQQNKNLHQRPSGLLQPLPAPSNVWEDLSMDFITHLPSSHGFTVILVVVDRYSKGIHLGALPTGFTAFKVATLFMEIVCKLHGFPKSIVSDRDPVFVSSFWKELFRLSGTRLRLSTAYHPQSDGQTEVLNRVLEQYLRCFVHDRPASWFPYLALAE

SEQ ID NO: 176293 - protein, 120 aa, Glycine max
  Coding DNA Sequence Number=SeqID_59515
MQGKAGGNSRGNEEDEKGEVAEEEEQGRRCRRRTLFEPSLVKEQHFSLVFEHCKRDKGNVSIEAPREVSSISHSTCGTIRVLEVPNEHAVGFERLSKPFIGMSRWGGGSCCVFGGEGCFP

SEQ ID NO: 176294 - protein, 56 aa, Glycine max
  Coding DNA Sequence Number=SeqID_59516
MTQLSRDDPKSMRHLRMTLTLMPSALLGSSMWKIVFVEVDGEGRDGRMGCGGGGHL

SEQ ID NO: 176295 - protein, 48 aa, Glycine max
  Coding DNA Sequence Number=SeqID_59517
MDVRDIKDPEHPYSLEELKVITKEAVEVDDQHNYARHSKLTDAAFKDG

SEQ ID NO: 176296 - protein, 199 aa, Glycine max
  Coding DNA Sequence Number=SeqID_59518
MRRMPDRVYGIKLDNIFIGRKKIQVNSPRHGHGVVEGKNMRESNGGGVKQPLQVQRDEYDIAGMVATRKDCVEDWFDEIIPWMIGLGVYIVHIRLLPHGRQVQMKINLEFETDEHTIVKECNCVIVKEVNCVIQIPNPRSNKEAISNVNKAGFSLEDIFEVPESSENANLGLYCRLYQFEKDVGNGKGKGIVRCTPALF

SEQ ID NO: 176297 - protein, 162 aa, Glycine max
  Coding DNA Sequence Number=SeqID_59519
  Homolog annotation: Hit_ID=Q1WK55; Match level="QueryCoverage=57%, HitCoverage=24%, E-value=1e-07, Identity=39%"; Hit description=CYC5
MRNRGVLAEESKQCGEETNQDLIQLGSWNPFETGDQESAGAKRTTTHSVAEHPSSLDVITIEAKEQSYHAAKEHDDDDDDSLVVLSKWSPSLIFNNYGFSQDNFSPWESCGRPKTITSLMRRQKCASLLCICLLSFQKFNGVRHLGDPHIPFEVKIKIDFII

SEQ ID NO: 176298 - protein, 213 aa, Glycine max
  Coding DNA Sequence Number=SeqID_59520
MGNTMGRSKKTKVMKVDGETFKLKTPARANDVVKDYPGHVLLDSEAVKHFGLRAKPLEPYQELKPKKIYFLVELPKIQPEEEKTALPRRVRSSGIRGMNASDRLELLMLSKRSVSDLPLARQGPKMGSDGPMRVKMRLPKAHLDKLMEESTDGSEVAEKIMSLYVGTNAGEGGGVAAVAEEGGAKTVYNHKPRGKGTKTIRFIGRIQHQIPRI

SEQ ID NO: 176299 - protein, 122 aa, Glycine max
  Coding DNA Sequence Number=SeqID_59521
  Gene Ontology: Mol. function=nucleic acid binding; Biological process= regulation of transcription
  Homolog annotation: Hit_ID=Q1T5G4; Match level="QueryCoverage=55%, HitCoverage=9%, E-value=1e-17, Identity=63%"; Hit description=Zinc finger, CCCH-type
  Subcellular localization annotation: CTP_CleavageSite=21; ConfidenceScore=5.10e-01
MKCPEQWPHSTTTKSNYKHMVTTKRKSKLQRFFFQFANNDIEGFKGLSEKDFSSINEVGLWYGQQNGSKQFVLEHKTYLMVAATYGSINVMKIILLYPEADVDFGVWGQQKHCPVFAYKVFD

SEQ ID NO: 176300 - protein, 50 aa, Glycine max
  Coding DNA Sequence Number=SeqID_59522
MGVGWLVQVWNVIQICRLKVLYDTFGTLNSLKDWVEYPKNSVYPNVAEGS

SEQ ID NO: 176301 - protein, 117 aa, Glycine max
  Coding DNA Sequence Number=SeqID_59523
  Homolog annotation: Hit_ID=Q9ASI0; Match level="QueryCoverage=40%, HitCoverage=13%, E-value=4e-07, Identity=60%"; Hit description =Putative arm repeat-containing protein
CDLLGRTKPPHCITSVLFMVGGIAIVTEGDDGVILVGEVFQARSPQGGGNGGGRTAGVGASAAERPRFEGPSGEGHPAPHQDLAAVPPPAPASRGATRVHAPSRLARVPRTCASRSA

SEQ ID NO: 176302 - protein, 288 aa, Glycine max
  Coding DNA Sequence Number=SeqID_59524
  Gene Ontology: Mol. function=transporter activity; Cellular component= integral to membrane; Biological process=transport
  Homolog annotation: Hit_ID=P49173; Match level="QueryCoverage=99%, HitCoverage=96%, E-value=5e-98, Identity=63%"; Hit description =Probable aquaporin NIP-type
  Pfam annotation: Domain name=MIP; Domain location=36-276; Score =202.6; E_value=9.5e-58; Accession=PF00230.10; Description=Major intrinsic protein
MAAKSEGIQEEMPSMEEGVSSPSPSRTCNVSHNCCSNHVVALAQKVFAEVIGTYFVVFAGCGSVAVNKIYGSVTFPGVCVTWGLIVMVMIYSLRHISGAHFNPAVTITLAIFRRFSYKQVPLYIFAQLLGSILASGTLALMLDVTPKAYFGTVPVGSNGQSLVAEVIITFLLMFVISAVSTDDKAVGDFAGVAVGMTIMLNVFIAGEWEKERVNGAGGGLREKGMGRKIQCGGPVSGASMNPARSIGPALIKHVYQGLWIYVVGPIVGSIAGALAYNFLRSPYKPPSE

SEQ ID NO: 176303 - protein, 75 aa, Glycine max
  Coding DNA Sequence Number=SeqID_59525
  Subcellular localization annotation: CTP_CleavageSite=30; ConfidenceScore=5.10e-01
MFNSNLGNPSSLCTIRSLSMNPYSSWFKVEVAAGSQKNNNNKAFDAVAFEAEAQPWWKLPTLPGTKKRKVEEMGN

SEQ ID NO: 176304 - protein, 127 aa, Glycine max
  Coding DNA Sequence Number=SeqID_59526
MNLGGGGVGGGRDGGGGGGRDGGGGGGSGDESSQLSGGVGEEISGRNSGGGEAGGGGGGDRSCSSQGFPQGHDPHLISVCVGCETSDWSNLLENVLASTGDEIVMQKRSSTIVSFCVVQLFVVDTIV

SEQ ID NO: 176305 - protein, 52 aa, Glycine max
  Coding DNA Sequence Number=SeqID_59527
  Homolog annotation: Hit_ID=O64438; Match level="QueryCoverage=57%, HitCoverage=13%, E-value=7e-09, Identity=87%"; Hit description=ARG10
VGGLRCYESPQNKITAVPTEEEEIWGAFFKVIVELKKLELNIHYVTRIARCN

SEQ ID NO: 176306 - protein, 55 aa, Glycine max
  Coding DNA Sequence Number=SeqID_59528
MSPAPLEPHNHSQTHLMLSGWLPLQGGLVGACALSATLARLACIREFGLSAQLLA

SEQ ID NO: 176307 - protein, 82 aa, Glycine max
  Coding DNA Sequence Number=SeqID_59529
MAFLGETSSQTVVNSTLDVIFPNGSIVHNDSGVSFQASTPVPIRVPIECDVQMLKTRMHNTLKLTNKQFLDEIYYRKPFTYA

SEQ ID NO: 176308 - protein, 149 aa, Glycine max
  Coding DNA Sequence Number=SeqID_59530
  Gene Ontology: Mol. function=unspecific monooxygenase activity
  Homolog annotation: Hit_ID=O04892; Match level="QueryCoverage=56%, HitCoverage=21%, E-value=5e-16, Identity=51%"; Hit description =Cytochrome P450 like_TBP
LCARTPKGIGLPTLETAQPEVGSSGWKSTARRVVSGAPPAALENPEDRVPPTPGRTHNRIRSPRAGHGGPSPEPVGCRWTARAASAARAGRRVPVGGRIGNGPFGASSPGVEQSTQNCALNVKVKKFNQARVNGGSNYDSLKVAKCLVI

SEQ ID NO: 176309 - protein, 248 aa, Glycine max
  Coding DNA Sequence Number=SeqID_59531
  Gene Ontology: Cellular component=membrane
  Homolog annotation: Hit_ID=Q6J5N4; Match level="QueryCoverage=49%, HitCoverage=98%, E-value=1e-48, Identity=68%"; Hit description=CrcB -like protein
  Pfam annotation: Domain name=CRCB; Domain location=120-236; Score =154.5; E_value=2.7e-43; Accession=PF02537.6; Description=CrcB-like protein
  Subcellular localization annotation: CTP_CleavageSite=78; ConfidenceScore=5.87e-01
MFIFAQNSRAFFTAWPTATLPNTVVMPSSRCVRAAYASAKASSTPISVSKIRVRIGISSLMMSATVNIVTSAAPAYYRASEVMACHLTQPPSGYRRLMTPDNLLIPARETAELQTMLKSLFAVMIGGAIGCTLRWLISLRFNTLFPNLPPGTLIVNLVGGFIIGAAMAWFVRNPHIDPVWKLLIVTGLCGGLTTFSTFSAEIVVLLQSGKYLWAMSSVMVHVIGSLLMTFAGFAVVNLLGYTTRLNHP

SEQ ID NO: 176310 - protein, 131 aa, Glycine max
  Coding DNA Sequence Number=SeqID_59532
  Homolog annotation: Hit_ID=Q9AVH2; Match level="QueryCoverage=35%, HitCoverage=16%, E-value=3e-20, Identity=97%"; Hit description =Putative senescence-associated protein
VPGDSEGRDESKRQGLNLSGSPAARPLCHLQYPVVYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 176311 - protein, 165 aa, Glycine max
  Coding DNA Sequence Number=SeqID_59533
  Homolog annotation: Hit_ID=Q84VI1; Match level="QueryCoverage=95%, HitCoverage=27%, E-value=6e-79, Identity=81%"; Hit description =Envelope-like protein
MSRHQRGAKKSGKKVPGNVPDAPLDNISFHSIGNTMDLIKAAGLLKTVTKLGDCYEGLVREFIVNIPSDITNRKSDEYQKVFVRGKCVRFSPAVINKYLGRPTEGVVDIDVSEHQIAKEITAKRVQHWPKKGKLSAGKLSVKYAILHRIGAANWVPTNHTSTVAT

SEQ ID NO: 176312 - protein, 133 aa, Glycine max
  Coding DNA Sequence Number=SeqID_59534
  Gene Ontology: Mol. function=nucleic acid binding; Biological process= DNA integration
ENIVVGGNCSAVIQKILPPKHKDPESVTIPCSIGEVTVVKALIDLGANINLMPLSMCRRLGELEIMPTRMTLQLVDHSITRPYEVIEDVLVRVKHFIFPTDFVKLELGFEDQKIDFDLFVEDNPAPKQNVCLQ

SEQ ID NO: 176313 - protein, 112 aa, Glycine max
  Coding DNA Sequence Number=SeqID_59535
MIPLKLLQEHNKGKGNFTKEKKHRVVMMLELNMRYPSHEKKHRLLTMLECDEHDCEGDETYLGMVAKEKKQRLVTMLECDEDDARVPRTRCSDADRDLEGRRRLEEEESAKA

SEQ ID NO: 176314 - protein, 142 aa, Glycine max
  Coding DNA Sequence Number=SeqID_59536
  Gene Ontology: Mol. function=DNA binding; Biological process=DNA integration
  Homolog annotation: Hit_ID=Q1SJY5; Match level="QueryCoverage=65%, HitCoverage=9%, E-value=3e-24, Identity=55%"; Hit description =Integrase, catalytic region
MGERSMFLDLKPLEREEVAFGGIGNGKITSIGKIGIPSLASIDNVLYVEDQIIGDQTKGVKTKSSLKDLASYALVSKIEPKTIDEALTNNDYIISMEEELHQFTRNDVWTLFPKPENKRIIGIRWIFRNKLDEHGKVVRNKA

SEQ ID NO: 176315 - protein, 66 aa, Glycine max
  Coding DNA Sequence Number=SeqID_59537
MSKVVALTSRRVMSLSSPQPWMNVCPMPGGATSIGCAGHYVYSSASDPLAALDGIMGDFPWRSLVK

SEQ ID NO: 176316 - protein, 248 aa, Glycine max
  Coding DNA Sequence Number=SeqID_59538
MEEADKEEQDAEEQEYDAIMMVSVESLMMQEARPCRCRDRMMVVLSPIWWDFLLLCRAYPLMLVRSMFDLPLVDGYEGLVVVRFVELGPLTMVVVVAVNERTKEMPWTGDVFALGFDKPLKLCRGLLRVDLWFDETMRLTKTHQGRTLGFVSPLEDRLGNCPTWVLGVVLLHSCHLPWVARTRDLMACSCICVTHGVEHTRDLVSCSCIHWRALAYMSLIVGGMYMRRNGVLLLTCHSLWVAYTRDLV

SEQ ID NO: 176317 - protein, 167 aa, Glycine max
  Coding DNA Sequence Number=SeqID_59539
  Gene Ontology: Mol. function=DNA binding; Cellular component =mitochondrion; Biological process=DNA integration
  Homolog annotation: Hit_ID=Q1T192; Match level="QueryCoverage=99%, HitCoverage=31%, E-value=1e-21, Identity=30%"; Hit description =Polynucleotidyl transferase, Ribonuclease H fold
MAREEEELNWMTPYRNFLIQGVLPSDENGTRCLKRKASYYAILDGELFKRGLTKPLLKCLNNQQIDYIKARPPQEITASDVEIFTWKHLICRYDLLCVIVIDNNTQFKAKTYEEFLARLGIKHLVTSVDHPQTNDQVKAANIVILRALGTRLDKSKDLWKEELPNIL

SEQ ID NO: 176318 - protein, 249 aa, Glycine max
  Coding DNA Sequence Number=SeqID_59540
MAPSSLSVFLSIKAKYDEFALTTCKAKEWTGVKVDSVKGDLEPLEKVVAHAFVTSVYVYLVVPMLLLLLSFSLGGFVGASLMSTSMLKASSRIVVQLAIMMRILKLAKYRLKAQVEKGEGPSNSCGVYPDLSSFTGSGVIQISIACIKRSAPTQVHITLGCDMFNSVPEFGHFFHLDAAFGSFAQLVHATGGVLYRLFVNLSGHRARSMECNATSGGHAMRPAGYVLCTEAFDEGFEAVYGSWWEFIVL

SEQ ID NO: 176319 - protein, 234 aa, Glycine max
  Coding DNA Sequence Number=SeqID_59541
  Gene Ontology: Mol. function=RNA-directed DNA polymerase activity; Cellular component=chromatin; Biological process=RNA-dependent DNA replication
  Subcellular localization annotation: CTP_CleavageSite=22; ConfidenceScore=5.07e-01
ALKLSLKARSRVTFSGPSRTVLASLPFTLLQNLFNGVICLDYHSVTLEVWPKALSRALLSVMDGELIKYMGSWCFPSSCMRVKLRALSATKRYRSRGTPGLGLLKTGGVVMVFLKARKAYSQVSSHRKGSIFLNNFLDIGRVAHLQYDSAFLLEEHDFAFPESTFFRVETQLIFAEFPENFFQVCHMIGYALRLDDYVVHIYLDVLSDLLFKDSVHQSLPAFESGCTRSRRPGA

SEQ ID NO: 176320 - protein, 68 aa, Glycine max
  Coding DNA Sequence Number=SeqID_59542
  Subcellular localization annotation: CTP_CleavageSite=21; ConfidenceScore=5.05e-01
MVHNFQFRSGFASRRFSSGVSSDVVSNERDRVAFFELSPFVGKLVLEEGGVTEEEDGDLWMRDKGKKI

SEQ ID NO: 176321 - protein, 92 aa, Glycine max
  Coding DNA Sequence Number=SeqID_59543
  Gene Ontology: Cellular component=chloroplast
  Homolog annotation: Hit_ID=Q58IU5; Match level="QueryCoverage=72%, HitCoverage=20%, E-value=5e-14, Identity=62%"; Hit description=Non -intrinsic ABC protein
MTSAFSRVLRCVVAIETLSRTTLVRRFCSIRGVSVVRPRGFLHGLEFVEGLEAEFNHPLGIPFLLRDDIRVRSSMFNNDGFHDHGGFDNRGG

SEQ ID NO: 176322 - protein, 75 aa, Glycine max
  Coding DNA Sequence Number=SeqID_59544
  Homolog annotation: Hit_ID=Q9SFU0; Match level="QueryCoverage=61%, HitCoverage=4%, E-value=1e-07, Identity=61%"; Hit description =Protein transport protein Sec24-like At3g07100
MPSFRDLEQKWAPKVEALFGASMENEGERKATIPTITTHQVLNKVCKKEESFFGLFTLPHKVARGGGEEEEGGGG

SEQ ID NO: 176323 - protein, 60 aa, Glycine max
  Coding DNA Sequence Number=SeqID_59545
  Gene Ontology: Mol. function=RNA polymerase II transcription factor activity; Cellular component=transcription factor TFIIE complex; Biological process=transcription initiation from RNA polymerase II promoter
MVDHYNKLVKLAARAFYDDLTSKGENQPKSGRSDNRGIAVVILDALTRITYSKGMINEWK

SEQ ID NO: 176324 - protein, 236 aa, Glycine max
  Coding DNA Sequence Number=SeqID_59546
  Homolog annotation: Hit_ID=Q9LXV3; Match level="QueryCoverage=24%, HitCoverage=15%, E-value=2e-13, Identity=72%"; Hit description=2 -oxoglutarate/malate translocator-like protein
MILKDKVVTELGIRSPAVKFFNAYAKQLHNLPNVIDTVHDNELHEVVLSVYMHGDPIPGSLPSLSSSPKLGLQRGASCADDSLGVGEGGGNFLATGEGGVREQRRRQDEAQVGECPRRACGGHCRVKDENEMCEVTIGVKGESEMCSRHGERRVGDGKDDTLTVMVFLTLVVVAIIITMLEEPSRQLAPYNGQQAFYDGGHVNTDIEGKFSRMDGAQVSTVLESKLSKTMLTSAPI

SEQ ID NO: 176325 - protein, 62 aa, Glycine max
  Coding DNA Sequence Number=SeqID_59547
MDKWLQLPLNPYKLKCDKEPLNSSLCFFLEEEGTIHIWKVTSNVDPTTEFCTFRTLRAAVLG

SEQ ID NO: 176326 - protein, 237 aa, Glycine max
  Coding DNA Sequence Number=SeqID_59548
  Gene Ontology: Mol. function=nucleotide binding; Cellular component =chloroplast
  Homolog annotation: Hit_ID=Q2PMM5; Match level="QueryCoverage=95%, HitCoverage=9%, E-value=1e-120, Identity=94%"; Hit description =Protein ycf2
MSRENWIWLDNVWLVNKDRFFSKVRNVSSNIQYDSTRSSFIQVTGSSQLKGSSDQSKDYFDSIRNEDSKYHTLINQREIQQLKERSILCWDPSFLQTERTEIESERFPKILSGYSSMCRLFMEREKQMNNHLLPQEIEEFLGNPARATRSFFSDRWSELHLSSNPTERSTRDQKLLKKEQKKHLVLSRRSENKEIVNLFKIIMYLQNTVSIHPISSYPGCDMVPKGETGQFQIRFHS

SEQ ID NO: 176327 - protein, 246 aa, Glycine max
  Coding DNA Sequence Number=SeqID_59549
  Gene Ontology: Mol. function=binding; Cellular component=outer membrane-bounded periplasmic space; Biological process=cell adhesion
  Homolog annotation: Hit_ID=Q6D4J8; Match level="QueryCoverage=57%, HitCoverage=47%, E-value=1e-65, Identity=88%"; Hit description =Periplasmic chelated iron-binding protein
  Pfam annotation: Domain name=SBP_bac_9; Domain location=1-154; Score =49.3; E_value=2e-13; Accession=PF01297.8; Description=Periplasmic solute binding protein family
MSPSNALVYIENIRKALVEHDPANAATYNRNAKAYAEKIGALDAPLRERLARIPAAQRWLVTSEGAFSYLAQDYQLKEVYLWPINADEQGSPQQVRRVIDAVRAHHIPVVFSESTISDKPAKQVAKETGAKYGGVLYVDSLSTRDVERGRRHRDLQQRTHRHSQRQLYPERWFDLRAGRRQRQRQVDVVQKHYGPGQAHRRPGIAERQTGGGGAEKESDRLRAADRRRRLELPGAGGRRGDDGPLR

SEQ ID NO: 176328 - protein, 108 aa, Glycine max
  Coding DNA Sequence Number=SeqID_59550
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=99%, HitCoverage=18%, E-value=7e-41, Identity=100%"; Hit description=DNA -directed RNA polymerase beta chain
  Pfam annotation: Domain name=RNA_pol_Rpb2_1; Domain location=14-108; Score=-33.2; E_value=9.6e-05; Accession=PF04563.6; Description=RNA polymerase beta subunit
MLGDGNEGMSTLPGLNQIQFEGFCRFIDRGLPEGLFKFPKIEDTDQEIEFQLFVETYQLLEPLINEKDAVYESLTYSAELYETENIYSSFIISYGFEFKRNSRECLLS

SEQ ID NO: 176329 - protein, 46 aa, Glycine max
  Coding DNA Sequence Number=SeqID_59551
  Gene Ontology: Mol. function=RNA polymerase II transcription factor activity; Cellular component=transcription factor TFIIE complex; Biological process=transcription initiation from RNA polymerase II promoter
RQWVREEDLAKDLKLHTKQLRRTLRFFEEEKIITREYRREHSSVVQ

SEQ ID NO: 176330 - protein, 56 aa, Glycine max
  Coding DNA Sequence Number=SeqID_59552
MSVKHLNVVNQEVAQTTLVQAGRLDKPHKPATLALVEVTTLGTRQLLSILGGSINS

SEQ ID NO: 176331 - protein, 270 aa, Glycine max
  Coding DNA Sequence Number=SeqID_59553
  Gene Ontology: Mol. function=RNA polymerase II transcription factor activity; Cellular component=transcription factor TFIIE complex; Biological process=transcription initiation from RNA polymerase II promoter
  Homolog annotation: Hit_ID=Q6S7C3; Match level="QueryCoverage=71%, HitCoverage=73%, E-value=1e-40, Identity=47%"; Hit description=TFIIE- alpha 2
AQLKPLMDQLSRVKDLPVPEFGSLLAWEARASAMGRAANGDMSGDSKMSQLGYNGAPMPYSGDTKVVVDFNGTEDIKDVKSETGSASLKVLPPWMIKSGMVLTKEQRGEAKEEIKMDGTSTSSSAQYLDDKKSTDEYIKAYYAALLKQQHELEAASKQELPNTLTANDPSSSASNRQVGMKSKLEEDDDGTEWEEAPVAVIKVTLPVATLAWCNGNDGYGGKTVVVVATDDDCSRVDNNCIGNENYKVDLNVEADDTPADDDEEVDWEEG

SEQ ID NO: 176332 - protein, 187 aa, Glycine max
  Coding DNA Sequence Number=SeqID_59554
  Homolog annotation: Hit_ID=Q1SDG1; Match level="QueryCoverage=96%, HitCoverage=13%, E-value=8e-08, Identity=22%"; Hit description =Integrase, catalytic region; Zinc finger, CCHC-type
MYRLKIQTQRNKYNKICRLRKTREIWDSLSINYEGINDVQLTKVVTLTRHYESFTMKDETSVDEMFGRLQVLLNGLQVLLNGLQALRHTFTKALINLKILDNFSEMLNKKRKLQHSSKRKSETSSITSSNDEEEMSYDVLLQNSQMISLLCKKYKEKVKAFICENIELKKSNEVLKKKIQTLEENLS

SEQ ID NO: 176333 - protein, 124 aa, Glycine max
  Coding DNA Sequence Number=SeqID_59555
MDFRSLPCVLLGYNTSHKGIYIYRHVIFNETVFPYATQPPPVHSTTPPIHLATTLHLLEQVTVVPTITTPPTPPLSPSPSTVPNTQTPITPSYQQPTTNSRAKHTQPSQSHFRPAENTTNPMVT

SEQ ID NO: 176334 - protein, 259 aa, Glycine max
  Coding DNA Sequence Number=SeqID_59556
  Gene Ontology: Mol. function=nucleic acid binding; Cellular component= mitochondrion; Biological process=DNA integration
  Homolog annotation: Hit_ID=Q2HUL7; Match level="QueryCoverage=53%, HitCoverage=16%, E-value=8e-20, Identity=30%"; Hit description =Integrase, catalytic region; Zinc finger, CCHC-type
MEFSGRMHELANPIYNVGNIWASDGDILDRTNYLLKKGWIMTWGSLTCKMRTWNRSCTILSPSNLDSQKVVQVTKDVEKTTSRRVNKEGSIKFACSKAVGDKEVLEFIEPCTFSQVAIEECVVDVKLSHTPTIGKGNRNVAWLVDTCGAESEIVKGEGESGGVGGVVIVGTTVTCSRRCRVVARWRLGGIGKDGFIENNVTVGWVLKTCSQKVKGRDDWDKRMQHEMLGDENGDFSLVRKSHVDEPNVDANHGVWYAQQ

SEQ ID NO: 176335 - protein, 450 aa, Glycine max
  Coding DNA Sequence Number=SeqID_59557
MVMDGNDSEGSIQQPLVDREVIPIGGSSLEETLHGVSDCESSSSKRLTVSHCVGGVTMILPPSASGEARRSGGGDVRVPPRVQHGHSVGSLSSLPVIACFEWHLNVAPFQLHANSLAMEKAFKVLAPSSTFDQELFEFDSNMFPYFKDHFFKVLATDVMADGLQLMFNRDGEPCSSSTSSQTLPGSTSRQTLPGLVGCVSHFVSSSMDDPLATFDVKQVGPTGRTMAPSVVIPPTGEGGLPSIPFSVLAKHDDNAGVLGCKKSRDIALATAIVVVASPPPPASSVEEISASSAAEVSALATLTGSIVAPSSIIVVPLLSVGAATMSAPKMPPPPSLAPPVPSLTVLVGASPSTSSHPENERWHQEPLTKDLISEFGYLLHLDVSFGSFLQLIHATRVADTKPIGVRNASKCSSGLVVPSYRSMLSGFQPRGVIPLECTQTLCEQSTHCPG

SEQ ID NO: 176336 - protein, 110 aa, Glycine max
  Coding DNA Sequence Number=SeqID_59558
MALRKLPAKRSQKGTTEKGSSVAPQANTDFERHRFRSAEHQQCFETIKGWHWAPLVSPMAKFDPEIVMEFYANARPTRRGCPQPIPGPPPDLRGGPTVRVRPEEEAGLRL

SEQ ID NO: 176337 - protein, 269 aa, Glycine max
  Coding DNA Sequence Number=SeqID_59559
  Gene Ontology: Mol. function=nucleic acid binding; Cellular component= chromatin; Biological process=chromatin assembly or disassembly
  Subcellular localization annotation: CTP_CleavageSite=44; ConfidenceScore=5.06e-01
MANSSSSLLTLANNNTSNLSLQHPPITIKLDRDNYSRWRSTIISALETFELESFILSLAPPSETRITTTFDGFTLSERALSIMVRASSSHMEWTAIDKTFQAQTRAHRMALKAQLQTLNKGSLSMIEYIKHKLSIADSLAENLHPISDEDLVGYLLSGLDSSYGHFSIAFMMKDAYASVDDLAGLLLQEEARLEQDHARHATPVTLPSQVPPLLPTPTAYTATHCSTRPAPNNTQSNNSGSFQNHSYDNRHRRPTCQICNKPGHEAIDC

SEQ ID NO: 176338 - protein, 122 aa, Glycine max
  Coding DNA Sequence Number=SeqID_59560
  Subcellular localization annotation: CTP_CleavageSite=21; ConfidenceScore=5.10e-01
MEYPLLPARSSGPLLIRPSLRSTTPPGRHRARHHNSLGTANSRQQTHCHHLQSPPQLVYRGWNAICNMGLAKKFEVAVAWPEDWPDSQTGEGLVGTSGEADKAQEDEDMADLFDFLGGSEAI

SEQ ID NO: 176339 - protein, 33 aa, Glycine max
  Coding DNA Sequence Number=SeqID_59561
SYSEHVTTVFNAVGTQRCGGQGSKGLGTVGSRE

SEQ ID NO: 176340 - protein, 59 aa, Glycine max
  Coding DNA Sequence Number=SeqID_59562
  Subcellular localization annotation: CTP_CleavageSite=13; ConfidenceScore=5.05e-01
MSSRVSTGRCLSSSNHRSQWRTYVCLRAGGMNSDSIRSTDATTTEAPTNVTKTKCGRHL

SEQ ID NO: 176341 - protein, 255 aa, Glycine max
  Coding DNA Sequence Number=SeqID_59563
  Gene Ontology: Mol. function=DNA binding; Cellular component=beta -galactosidase complex; Biological process=DNA integration
MATSSETKPKSFKEASQSDKWIKAMNAEIEALEANHTWILTNLPPNKSSIGSAVNNWHLKQLDVNNVFLHGDLNEEVYMTLPPDMLGSKPVSAPIDYAVRLHQQFGIPLDDIIASSYRRLIGRLIYLTYTRLDITYAVQHLSQFVAHPSSAHQQVAYRILRYLKAALGSGIFFSASSILQLKAFSDSDWVGCIDTRRSITGYSVYLGNSFISWKSKRQAMVSRSSSEVEHWALASATCELQWLTHLLNDFGIVYT

SEQ ID NO: 176342 - protein, 86 aa, Glycine max
  Coding DNA Sequence Number=SeqID_59564
MMKIEKESEEMFNLVHVIDQNNTGGVLKDDQAEANNIEARGAGFGVACKEKKKALMGSILNLESKDKEMMEIKGTGKIDRVGEGDQ

SEQ ID NO: 176343 - protein, 66 aa, Glycine max
  Coding DNA Sequence Number=SeqID_59565
MSRTKKEEEDEVYKEPQEIIIHPMKSMTSPKWERYSDYVHELTEEFKALLGLYNTGLLLLLKKHKG

SEQ ID NO: 176344 - protein, 53 aa, Glycine max
  Coding DNA Sequence Number=SeqID_59566
  Subcellular localization annotation: CTP_CleavageSite=19; ConfidenceScore=5.30e-01
MCGLHSSTSLMSLLHPSTSLASVKTRPTTTSSPVHVQWTEFEKSAKGGELREG

SEQ ID NO: 176345 - protein, 36 aa, Glycine max
  Coding DNA Sequence Number=SeqID_59567
MANSLNVFEALSSGKIVSLNQPYLPLFDHDEFVEGQ

SEQ ID NO: 176346 - protein, 112 aa, Glycine max
  Coding DNA Sequence Number=SeqID_59568
MATPPRSPLHSDAHLESTSRRTQEKIPIFHCNWKDAPESLKNLIWDDILGKFDIPEASNAKKKEIRKKVQEIQKFNDYPHLLSHEGYDLLEKNLMEEKRKKKQQEAMNTENP

SEQ ID NO: 176347 - protein, 408 aa, Glycine max
  Coding DNA Sequence Number=SeqID_59569
  Gene Ontology: Cellular component=membrane; Biological process =vesicle docking during exocytosis
  Homolog annotation: Hit_ID=Q94KJ7; Match level="QueryCoverage=79%, HitCoverage=90%, E-value=3e-76, Identity=46%"; Hit description =Vacuolar protein sorting-associated protein 33 homolog
  Pfam annotation: Domain name=Sec1; Domain location=17-405; Score= -233.5; E_value=0.012; Accession=PF00995.13; Description=Sec1 family
MAQIPNLDNAPVNLTSIREHSQKELLNILKNVTLNYKQEHGVELRHLSGDPIQTDCSKVVYIVHAQPKLMRFICSNIHNDVSKGLQREYHVYFVPRRTVVCEKVLEEEKLHNMVTIGEYPLYSVPMDEDVLSFELDLSYKECQVDGDTSSLWHIAKAIHKLEFSFGVIPNVRAKGKASVRVADILNRMQAEEPVNSSDFLHINNGSVELDASIMGLQQEGKKTKVPLNSRRELLHSYGFEHIAMLNNLEKAGLFKKQESKSNWLTIKRALQLVVEDTDTAKRPVEEILKLLPGPHLEMKRGGFSNSPSFDTLSGIQSSIAKLQALALKKRSTKGWSIKYGSHMIHNSKSDVGGVIMGQHNERPAIWMAYSSRNRQDPGVGCAHEDGVNGEEISLGHLVGQRELPLCGG

SEQ ID NO: 176348 - protein, 578 aa, Glycine max
  Coding DNA Sequence Number=SeqID_59570
  Gene Ontology: Mol. function=ubiquitin-protein ligase activity; Cellular component=ubiquitin ligase complex; Biological process =protein ubiquitination
  Homolog annotation: Hit_ID=Q8VZ40; Match level="QueryCoverage=91%, HitCoverage=83%, E-value=0.0, Identity=69%"; Hit description=E3 ubiquitin ligase PUB14
  Pfam annotation: Domain name=Arm; Domain location=322-362; Score =53.7; E_value=6.1e-13; Accession=PF00514.13; Description =Armadillobeta-catenin-like repeat
  Pfam annotation: Domain name=Arm; Domain location=363-403; Score =29.2; E_value=1.4e-05; Accession=PF00514.13; Description =Armadillobeta-catenin-like repeat
  Pfam annotation: Domain name=Arm; Domain location=404-444; Score =31.7; E_value=2.6e-06; Accession=PF00514.13; Description =Armadillobeta-catenin-like repeat
  Pfam annotation: Domain name=Arm; Domain location=445-485; Score =10.1; E_value=0.67; Accession=PF00514.13; Description=Armadillobeta -catenin-like repeat
  Pfam annotation: Domain name=Arm; Domain location=486-526; Score =21.2; E_value=0.0038; Accession=PF00514.13; Description =Armadillobeta-catenin-like repeat
  Pfam annotation: Domain name=DUF634; Domain location=313-483; Score= -152.3; E_value=0.026; Accession=PF04826.4; Description=Protein of unknown function (DUF634)
  Pfam annotation: Domain name=U-box; Domain location=194-267; Score =91.5; E_value=2.6e-24; Accession=PF04564.6; Description=U-box domain
  Pfam module annotation: Pfam domain module=Arm::Arm::Arm::Arm::Arm::DU F634::U-box; Domain location=322-362::363-403::404-444::445-485::486 -526::313-483::194-267
MLNHPKQKLLTSSTLNHQGQKQIMSKYTLPNFQDLSLYATALRRNDTADKFQKVTEKIEAVLSEIPYNKLDISDEVREQIELVHAQFKRAKAQTEFADIQLDLDMAVAQKEKDPGPAVLKRLSEKLHLRTINDLRKESSELHELFITSGGELGDSFEMITSLLSKLRECVLTENPEVDSSECEKLSVKHRSPMIPDDFRCPISLELMKDPVIVSTGQTYERSCIQKWLDAGHKTCPKTQQTLVHTALTPNYVLKSLIALWCESNGIELPKKQGNCRTKKCGGSSLSDCDRTAISALLDKLTSNDIEQQRAAAGELRLLAKRNADNRVCIAEAGAIPPLVDLLSSSDPRTQEHAVTALLNLSINESNKGTIVNAGAIPDIVDVLKNGSMEARENAAATLFSLSVLDENKVQIGAAGAIPALIKLLCEGTPRGKKDAATAIFNLSIYQGNKARAVKAGIVAPLIQFLTDAGGGMVDEALAIMAILASHHEGRVAIGQAEPIHILVEVIRTGSPRNRENAAAVLWSLCTGDPLQLKLAKEHGAEAALQELSENGTDRAKRKAGSILELLQRMEGVDNLQSS

SEQ ID NO: 176349 - protein, 276 aa, Glycine max
  Coding DNA Sequence Number=SeqID_59571
  Gene Ontology: Mol. function=transcription factor binding; Cellular component=intracellular; Biological process=regulation of transcription, DNA-dependent
  Homolog annotation: Hit_ID=Q40210; Match level="QueryCoverage=52%, HitCoverage=73%, E-value=1e-74, Identity=96%"; Hit description=RAB5B
  Pfam annotation: Domain name=Arf; Domain location=99-265; Score= -97.0; E_value=0.028; Accession=PF00025.11; Description=ADP -ribosylation factor family
  Pfam annotation: Domain name=Miro; Domain location=119-220; Score =27.4; E_value=1.2e-05; Accession=PF08477.3; Description=Miro-like protein
  Pfam annotation: Domain name=Ras; Domain location=118-267; Score =217.3; E_value=3.4e-62; Accession=PF00071.12; Description=Ras family
  Pfam module annotation: Pfam domain module=Arf::Miro::Ras; Domain location=99-265::119-220::118-267
  Subcellular localization annotation: CTP_CleavageSite=6; ConfidenceScore=5.41e-01
MSVRPRDSTPQTEGCHRNAPAPPCVPRCRHFPLPSPSSSSCPRHHCHSLMVAVDTSSLRSLNANASTLLSFGSGGGRKLGWSQTPLWASPGAAVKLCLGDLLVMGSNPETASLHMQGCIVLRFVRGQFDPTSKVTVGASFLSQTIALQDSTTVKFEIWDTAGQERYAALAPLYYRGAAVAVIVYDITSPESFSKAQYWVKELQKHGSPDIVMALVGNKADLLEKREVAVQDGTDYAEKNGMFFIETSAKTADNINELFEDIVDYATSKLPNDVLAA

SEQ ID NO: 176350 - protein, 76 aa, Glycine max
  Coding DNA Sequence Number=SeqID_59572
  Homolog annotation: Hit_ID=Q2HUH8; Match level="QueryCoverage=79%, HitCoverage=16%, E-value=2e-10, Identity=55%"; Hit description =Histidine triad (HIT) protein; Homeodomain-like
EDEGTDFGLEHAWRLLKDQPKWLEQFTESCFKRTKISAYGAYSSSSNPETPVEADTPSPIIRRMGKKTVKRKSKGK

SEQ ID NO: 176351 - protein, 158 aa, Glycine max
  Coding DNA Sequence Number=SeqID_59573
MDSVITVLYFNGRVYEDNDGVIFEGSKNAIQIKRKYIALQICDDEDVETMVESFKQQQEMSVLELYIEKDVAGGSMFQSTNSLTSCGNYLSNDETQPPTNMSNLHLDEDDDHNDDDYLVSNSYVEESLDEDDSVDDISDTDNEVPDMIPLVRIVHPTE

SEQ ID NO: 176352 - protein, 126 aa, Glycine max
  Coding DNA Sequence Number=SeqID_59574
  Gene Ontology: Mol. function=nucleotidyltransferase activity
  Homolog annotation: Hit_ID=Q6R3K9; Match level="QueryCoverage=56%, HitCoverage=15%, E-value=8e-16, Identity=45%"; Hit description=Metal- nicotianamine transporter YSL2
DLMNPMGTNTLNKEELKEIENLIRKDIEEAPIVLEDLILTTRLVPNLNVLTTLLEFLFIRAWTKVFAKAKIVSTSFTRQENTITQTWVGIEENNPGSTKEPRIGWMTTFLFMTSFVGLLALVPIRK

SEQ ID NO: 176353 - protein, 381 aa, Glycine max
  Coding DNA Sequence Number=SeqID_59575
  Gene Ontology: Mol. function=transferase activity, transferring glycosyl groups; Cellular component=integral to membrane; Biological process=metabolic process
  Homolog annotation: Hit_ID=Q8S9A8; Match level="QueryCoverage=99%, HitCoverage=97%, E-value=0.0, Identity=82%"; Hit description =Glucosyltransferase-1
  Pfam annotation: Domain name=UDPGT; Domain location=2-381; Score= -101.7; E_value=1.7e-05; Accession=PF00201.9; Description=UDP -glucoronosyl and UDP-glucosyl transferase
MALTFELCRATTHHLRRILNSISQTSNLKAIVLDFINYSAARVTNTLQIPTYFYYTSGASTLAVFLYQTIFHENYTKSLKDLNMHVEIPGLPKIHTDDMPETVQDRAKEVYQVFIDIATCMRDSDGVIVNTCEAMEERVVEAFSEGLMEGTTPKVFCIGPVIASASCRKDDNECLSWLDSQPSHSVLFLSFGSMGRFSRTQLGEIAIGLEKSEQRFLWVVRSEFENGDSVEPPSLDELLPEGFLERTKEKGMVVRDWAPQAAILSHDSVGGFVTHCGWNSVLEAVCEAVPMVAWPLYAEQKMNKVILVEEMKVGLAVKQNKDGLVSSTELRDRVMELMDSDRGKEIRQRIFKMKISATEAMTKGGSSIMALNRLVEMWREH

SEQ ID NO: 176354 - protein, 53 aa, Glycine max
  Coding DNA Sequence Number=SeqID_59576
MEGVAALTAAIYLEVASQVKAVGEVGRIAGRKGEEFLALFMASVESASCVIFI

SEQ ID NO: 176355 - protein, 73 aa, Glycine max
  Coding DNA Sequence Number=SeqID_59577
GEIGIAVVGWNVAKQQRHPYLCMSGHVAAWVKSCPGMHSSCVIASLSGCVRTIGHPPISGGGPETDKRKLLAP

SEQ ID NO: 176356 - protein, 49 aa, Glycine max
  Coding DNA Sequence Number=SeqID_59578
MPGSHIINKTSKGVGLHPQKETTPEYLAFHRFKQKTLTESLCTNPKVAI

SEQ ID NO: 176357 - protein, 66 aa, Glycine max
  Coding DNA Sequence Number=SeqID_59579
  Subcellular localization annotation: CTP_CleavageSite=58; ConfidenceScore=5.56e-01
MGDFAKIFHRSSSFFVRSSSFFGLQPAKINSQNQASSAKITENHFKVQRLKRSSLLLSVNMDRSKA

SEQ ID NO: 176358 - protein, 367 aa, Glycine max
  Coding DNA Sequence Number=SeqID_59580
  Gene Ontology: Mol. function=transporter activity; Cellular component= outer membrane-bounded periplasmic space; Biological process=transport
  Homolog annotation: Hit_ID=Q6D583; Match level="QueryCoverage=73%, HitCoverage=87%, E-value=1e-118, Identity=76%"; Hit description=ABC transporter, substrate binding protein
MVDFVNLVSGKWAIPILYRLIMIDGPVFPEVPPRVEYQVTALADRRLVADARRVDGGALDLFIAFAPALQHLRVFAADDDAVDGGVDGVHQTVAFFGGDRDVGHVGADADHFGLAGQRRLVGAGGVGAEERIGAPGLNAQVGGGVVGHVDRLHGRQPGGAVLLIPSQQYVFLIGAGSDDDPQPGDVLRPVDRGDVAGGFDVKAQRVHPISGEVEFGLAQFGDGDVEDRRVVFAGADAQRPIFPRGRHQIQLQPKAVGHQAGDVRIAADQRFIVLGEQRQRRRVLESHRHRQLAGHREVKVCRNQCDSGRVFLRAYRLSVSLQIDTARRGRLHGGAQQQRAQRRNPQWHSTLYPLLIMGLLLAAARGK

SEQ ID NO: 176359 - protein, 793 aa, Glycine max
  Coding DNA Sequence Number=SeqID_59581
  Gene Ontology: Mol. function=protein-N(PI)-phosphohistidine-sugar phosphotransferase activity; Cellular component=integral to membrane; Biological process=phosphoenolpyruvate-dependent sugar phosphotransferase system
  Homolog annotation: Hit_ID=P69786; Match level="QueryCoverage=59%, HitCoverage=99%, E-value=0.0, Identity=90%"; Hit description=PTS system glucose-specific EIICB component (EIICB-Glc) (EII-Glc) [Includes: Glucose ...
  Homolog annotation: Hit description=permease IIC component (PTS system glucose-specific EIIC component); Glucose-specific phosphotransferase enzyme IIB component (EC 2.7.1.69) (PTS system glucose-specific EIIB component)]
  Pfam annotation: Domain name=PTS_EIIB; Domain location=402-436; Score= 69.4; E_value=1.1e-17; Accession=PF00367.11; Description =phosphotransferase system, EIIB
  Pfam annotation: Domain name=PTS_EIIC; Domain location=13-320; Score =365.0; E_value=1.2e-106; Accession=PF02378.9; Description =Phosphotransferase system, EIIC
  Pfam module annotation: Pfam domain module=PTS_EIIB::PTS_EIIC; Domain location=402-436::13-320
  Subcellular localization annotation: CTP_CleavageSite=48; ConfidenceScore=5.17e-01
MFKNAFANLQKVGKSLMLPVSVLPIAGILLGVGSANFSWLPAVVSHVMAEAGGSVFANMPLIFAIGVALGFTNNDGVSALAAVVAYGIMVKTMAVVAPLVLHLPAEEIAAKHLADTGVLGGIISGAIAAYMFNRFFRIQLPEYLGFFAGKRFVPIISGLAAIVLGVVLSFIWPPIGTAIQTFSQWAAYQNPVVAFGIYGVVERALVPFGLHHIWNVPFQMQIGEFTNAAGQVFHGDIPRYMAGDPTAGKLSGGFLFKMYGLPAAAIAIWHSAKPENRAKVGGIMISAALTSFLTGITEPIEFSFMFVAPILYVIHAILAGLAFPICILLGMRDGTSFSHGLIDFIVLSGNSSKIWLFPIVGIVYGLVYYTIFRVLIAKLDLKTPGREDTAAEQTAQGGSEMSAALVQAFGGKENITNLDACITRLRVSVADVSKVDQAGLNKLGAAGVIVAGSGVQAIFGTKSDNLKTDMDEYIRAKALFEFGERREELDLFAAVGFTHEILQRIALRQPGGDIAQQRNAQAVVDEFLQYGAGHAASELEKGGVEAVDGEGNHPGIVFKGGRDKQADVMLEHRQRFVRDMVLNPFAVQLGGFARHPDAHQQIDHDAVTAAHLLRQQLAFLAARDIGGSGFAGALQQIGDQLNVIFDQRIGLRFAGAAKTQGVLGLVRHVGLGVAVGVIWRAGNHSVGRPVSIKMASPGNAGRVALRYFMRDAATTPSLTERTNIAIGAALAGRKRGAFTPLLFAGPAPAVGGGDGQPDRHAVPGAVGQAGHRHQPQSGGDVPRPVFTAGGDRH

SEQ ID NO: 176360 - protein, 208 aa, Glycine max
  Coding DNA Sequence Number=SeqID_59582
  Gene Ontology: Mol. function=3-oxoacyl-[acyl-carrier-protein] synthase activity; Cellular component=mitochondrion; Biological process=fatty acid biosynthetic process
  Homolog annotation: Hit_ID=Q669L5; Match level="QueryCoverage=56%, HitCoverage=28%, E-value=7e-55, Identity=86%"; Hit description=3 -oxoacyl-[acyl-carrier-protein] synthase II precursor
  Subcellular localization annotation: CTP_CleavageSite=53; ConfidenceScore=5.04e-01
MPGQQLDFTIDNPGGSKAAIAELQAAIARRQRIVALSVNPVHAPSCCRVISLRSQNSRRRGDTQPCWCPDDRRKKARLKNRAFISYPQRELHSAEDQRAIGAAEAEGVTQAELHIADLARFVRHEVQIATFIRVIQVDGWRYRLIAQRQHGEDRLDRACRTQQVASHRFGRAHQHALCIGAEDGFHRLRFRLVARRRRGAVRVDVADL

SEQ ID NO: 176361 - protein, 200 aa, Glycine max
  Coding DNA Sequence Number=SeqID_59583
  Gene Ontology: Cellular component=integral to membrane
  Homolog annotation: Hit_ID=Q9LV46; Match level="QueryCoverage=73%, HitCoverage=98%, E-value=5e-18, Identity=51%"; Hit description =Arabidopsis thaliana genomic DNA, chromosome 3, P1 clone: MOB24
MMMKMWNWYQNSLSVHPVKTQAISSAILWGVGDLSAQYITHSAAPKKLLQLSQFALLDSDAKFTINWNRLAVTSMFGFGFVGSVGHFCLLQHEIASNFLEGGVWPVVQLLYVNFYLLDCAFLSWLEQQKDAPWKKLFASFHSTNEKGGHRCGEGSSLKEIDVLSEDEAQSLNRVRHINCISILLEHKVEDTPLEDALPIK

SEQ ID NO: 176362 - protein, 143 aa, Glycine max
  Coding DNA Sequence Number=SeqID_59584
  Gene Ontology: Mol. function=sugar porter activity; Cellular component=integral to membrane; Biological process=carbohydrate transport
  Homolog annotation: Hit_ID=Q101R7; Match level="QueryCoverage=59%, HitCoverage=28%, E-value=5e-16, Identity=53%"; Hit description =Putative sorbitol transporter
MAVSLSGLGLGLQNSGRVKFKAFVDDSVQHCHCLCQCFFIGLGPITWVYSSEIFPLRLRAQGSSLVISGKGLVSGVVSMTFLTISKKITFGGVFFVMMMTTTFFYVFMPETKGKTLEEMETLFEDSDCLVEVVLDSDLPSSAV

SEQ ID NO: 176363 - protein, 568 aa, Glycine max
  Coding DNA Sequence Number=SeqID_59585
  Gene Ontology: Mol. function=protein serine/threonine kinase activity; Cellular component=mitochondrion; Biological process =protein amino acid phosphorylation
  Homolog annotation: Hit_ID=O65793; Match level="QueryCoverage=90%, HitCoverage=78%, E-value=1e-178, Identity=46%"; Hit description=Leaf protein
  Pfam annotation: Domain name=PPR; Domain location=100-134; Score =22.6; E_value=0.0014; Accession=PF01535.11; Description=PPR repeat
  Pfam annotation: Domain name=PPR; Domain location=136-170; Score =42.5; E_value=1.5e-09; Accession=PF01535.11; Description=PPR repeat
  Pfam annotation: Domain name=PPR; Domain location=171-205; Score =45.0; E_value=2.6e-10; Accession=PF01535.11; Description=PPR repeat
  Pfam annotation: Domain name=PPR; Domain location=206-240; Score =46.2; E_value=1.1e-10; Accession=PF01535.11; Description=PPR repeat
  Pfam annotation: Domain name=PPR; Domain location=281-315; Score =42.4; E_value=1.5e-09; Accession=PF01535.11; Description=PPR repeat
  Pfam annotation: Domain name=PPR; Domain location=30-64; Score=21.4; E_value=0.0032; Accession=PF01535.11; Description=PPR repeat
  Pfam annotation: Domain name=PPR; Domain location=316-350; Score =29.7; E_value=1e-05; Accession=PF01535.11; Description=PPR repeat
  Pfam annotation: Domain name=PPR; Domain location=351-385; Score =40.7; E_value=4.9e-09; Accession=PF01535.11; Description=PPR repeat
  Pfam annotation: Domain name=PPR; Domain location=386-420; Score =30.0; E_value=8.4e-06; Accession=PF01535.11; Description=PPR repeat
  Pfam annotation: Domain name=PPR; Domain location=65-99; Score=46.2; E_value=1.1e-10; Accession=PF01535.11; Description=PPR repeat
  Pfam annotation: Domain name=TPR_4; Domain location=170-195; Score =9.9; E_value=2.5; Accession=PF07721.5; Description=Tetratricopeptide repeat
  Pfam annotation: Domain name=TPR_4; Domain location=315-340; Score =8.7; E_value=3.5; Accession=PF07721.5; Description=Tetratricopeptide repeat
  Pfam module annotation: Pfam domain module=PPR::PPR::PPR::PPR::PPR::PP R::PPR::PPR::PPR::PPR::TPR_4::TPR_4; Domain location=100-134::136 -170::171-205::206-240::281-315::30-64::316-350::351-385::386-420::65- 99::170-195::315-340
MNALIGKGKPHEAQAVFHNLTEEGHKPTLITYTTLVAALTRQKRFKSIPALLSKVADNGMKPDSILLNAMINAFSDSGKVDEAMKIFQKMKEYGCKPTTSTYNTLIKGFGIVGRPYESMKLLEMMGQDENVKPNDRTYNILIQAWCTKKKLEEAWNVLHKMVASGIQPDVVTYNTMARAYAQNGETEKAERLILKMQYNKVKPNERTCGIIISGYCKEGNMTEALRFLYRMKELGVHPNPVVFNSLIKGYLDATDTNGVDEMKIVQALTLMEEFGIKPDVVTFSTIMNAWSSAGLMDNCEEIFNDMVKAGIEPDIHAYSILAKGYVRAGQPRKAESLLTSMSKYGVQTNVVIFTTIISGWCAAGKMDRAFSLCEKMHEMGTSPNLKTYETLIWGYGEAKQPWKAEEILSTMEERGVVPEMSTMQLVADAWRAIGLFKEANRILNGSEEESELDQEFDSDKMPVQSLESIYKKQKLSASPSNLLQIRDVVVAHPERTTNGNIRSRMVVKLSDNMRNVTTSMFFVRTRSSYGVQPLIHTMPMSSGGKNCRYHSWTSEIRTYAYNFDKMLV

SEQ ID NO: 176364 - protein, 60 aa, Glycine max
  Coding DNA Sequence Number=SeqID_59586
MGGDIAGWSARPRILKAAKEIGSQRKTETLASTTGNHMLVRYIESAYKEENCELGFWVTR

SEQ ID NO: 176365 - protein, 60 aa, Glycine max
  Coding DNA Sequence Number=SeqID_59587
MALNVYPAYYIDIIISNLLPPKSFPLAIRDAVIIFQLMETKYQMLLGAIFLPKVFRFAPT

SEQ ID NO: 176366 - protein, 66 aa, Glycine max
  Coding DNA Sequence Number=SeqID_59588
MLLFIITYGLPVSNLVSALDHQLKMSFTMLAYELCLSSESNRANKVTSQPKREGEVSSHHKNSSSE

SEQ ID NO: 176367 - protein, 234 aa, Glycine max
  Coding DNA Sequence Number=SeqID_59589
  Homolog annotation: Hit_ID=Q1T493; Match level="QueryCoverage=94%, HitCoverage=40%, E-value=1e-19, Identity=26%"; Hit description =Nucleic acid-binding, OB-fold, subgroup
  Pfam annotation: Domain name=Rep_fac-A_C; Domain location=90-223; Score=-64.0; E_value=0.033; Accession=PF08646.1; Description =Replication factor-A C terminal domain
SYLASINNSFKASKLIINQPVMEIQEFNEQYFLLAELGIEARSGFKSHGEGSTQLSGSIQLSSKESFFGKTEAKTIVEINTISEEIVCVTVGTITRIVLDNHSWCYTACIQCHKKSDAEMAPFTCACGKYNKEVVLRYRLEVMINQGNESTKFLLWDRECSELIGQSTDAVNKLKIEDGDVDLNASPQALDKLLGHELAFKIKVQPKFRNFAVLKCSADSSLINAVMDMLADAE

SEQ ID NO: 176368 - protein, 104 aa, Glycine max
  Coding DNA Sequence Number=SeqID_59590
  Homolog annotation: Hit_ID=UPI0000612705; Match level="QueryCoverage =86%, HitCoverage=93%, E-value=2e-08, Identity=33%"; Hit description =UPI0000612705 related cluster
  Subcellular localization annotation: CTP_CleavageSite=72; ConfidenceScore=5.66e-01
MARACSPLMARMCSPLKVRACSPLMARTCSPMMARTCSPLKVRACSPLMARTCSPLKVKACSPMQARILVPKGSLEAHARCPSLPQCKALRFMHGAPHYPSVRL

SEQ ID NO: 176369 - protein, 250 aa, Glycine max
  Coding DNA Sequence Number=SeqID_59591
  Homolog annotation: Hit_ID=P75991; Match level="QueryCoverage=23%, HitCoverage=74%, E-value=4e-10, Identity=59%"; Hit description =Hypothetical protein ycgZ
MRQNVAEFPDSASEIARYFSRATAPTQQETLGQIVVEILRAGKNLNRKAICTKLLRRLEGQPLVRKGTVPQGVGMQRSQIERLTEIVLGEAVVRLLDNNERINVATVSARLRSMAAEEFNPDRLEAIRIAIRELQMQSAARENREKPMAALGGMSQPRAVWQDARHNTAISGWPIFLATTGLGGERYAAEAAALDAVIRDIVIHGQKVTSKTIILYLIAELEMTTDIVKLDVLRNVLEIVVGRTPDDEGF

SEQ ID NO: 176370 - protein, 227 aa, Glycine max
  Coding DNA Sequence Number=SeqID_59592
  Gene Ontology: Mol. function=nucleoside-triphosphatase activity; Cellular component=signal recognition particle, endoplasmic reticulum targeting; Biological process=SRP-dependent cotranslational protein targeting to membrane
  Homolog annotation: Hit_ID=Q98E72; Match level="QueryCoverage=54%, HitCoverage=23%, E-value=2e-34, Identity=65%"; Hit description =Signal recognition particle protein
  Pfam annotation: Domain name=SRP_SPB; Domain location=31-131; Score =148.0; E_value=2.4e-41; Accession=PF02978.9; Description=Signal peptide binding domain
MGDIVSLVEKAAENIDAEKARAMAEKMAKGKFDLNDLADQLAQMKKMGGMGGIMGLMPGMAGMKDKMASAGMNDKMFDRQIAIISSMTKAERANPDILKHSRKKRIAAGSGTDAAEINKLLKMHRGMADMMKAMGGKGKGGIMKQMMGGLAGKMGLGGMMGGGMPDLSNIDPKQLEALQKQAEAAGLGKPGGMPGLGGLPGGLPGLGGTKLPGLGGMPGLPGFPKKK

SEQ ID NO: 176371 - protein, 62 aa, Glycine max
  Coding DNA Sequence Number=SeqID_59593
  Subcellular localization annotation: CTP_CleavageSite=31; ConfidenceScore=5.12e-01
MGDQTKSISETATLRITPPLRLARILRRAKRAEAALSNRCALSPNGELSATTTFRNSRFSLI

SEQ ID NO: 176372 - protein, 56 aa, Glycine max
  Coding DNA Sequence Number=SeqID_59594
MPFKGLKSARKRAVFSGKRDELAKRACCTKRVHQYSLYPRAMPSIPEPSAFGCGIR

SEQ ID NO: 176373 - protein, 121 aa, Glycine max
  Coding DNA Sequence Number=SeqID_59595
MVKEECKEVSVSSKRLAKKESHFVIKINIKETSPLRQPPHLLLCKKTLVSTVTSIGLNVIPQVKELLDEGLVCRSLNPRALLVPKIGAEGRSPEYQEPLDLRSNPFQGGGDDAILLPKDIG

SEQ ID NO: 176374 - protein, 114 aa, Glycine max
  Coding DNA Sequence Number=SeqID_59596
  Subcellular localization annotation: CTP_CleavageSite=63; ConfidenceScore=5.21e-01
LSSFIGSGVYPDLSSLTGSGVYPDLSSFIGSGVYPDLSSFTGSGVYPDLSSFTGSGVIQTFVVCIKRSAPSQIHIIWPSSFSTWAFSLYLASFMILIIPSFLENICPQMSRIIT

SEQ ID NO: 176375 - protein, 67 aa, Glycine max
  Coding DNA Sequence Number=SeqID_59597
MDEPYLGADPSNVDVLVHFVGVKGEPCEIRNVDPDNFIGACRPWIFFINGVLCFLKMNDSGMEKEER

SEQ ID NO: 176376 - protein, 190 aa, Glycine max
  Coding DNA Sequence Number=SeqID_59598
  Gene Ontology: Mol. function=helicase activity; Cellular component =membrane; Biological process=viral genome replication
  Homolog annotation: Hit_ID=Q1SN45; Match level="QueryCoverage=98%, HitCoverage=11%, E-value=2e-55, Identity=56%"; Hit description=AAA ATPase
  Pfam annotation: Domain name=DUF889; Domain location=1-104; Score= -31.8; E_value=2.4e-09; Accession=PF05970.5; Description=Eukaryotic protein of unknown function (DUF889)
EYLSSDSVDKSETNEDSYFQSITTKFLNSLNTSGLPTHSIKLKIGSPIMLLRNLDQNQGLCNGIRLVVTKMTKHVIAAEIISGKNIDLAVYIPRMSMSPSQSPWPFKLLKRQFPIMLSYAMAINKSQGLLLSMVGLYLPKPVFTHGQLYVALLRVNSTKGLKILIHDDEQKSMNSTTNVVFKEVFRNIKR

SEQ ID NO: 176377 - protein, 103 aa, Glycine max
  Coding DNA Sequence Number=SeqID_59599
GSSRCGVSTENYGGLWWLMVVVGDGESAWDVRNGFGRNKEEEMVFFLSYTKAKAKNAQVRNALGNGSFAHTPDIFSKIPTTAHVASSRSFIKMLPQEASWWLL

SEQ ID NO: 176378 - protein, 106 aa, Glycine max
  Coding DNA Sequence Number=SeqID_59600
  Subcellular localization annotation: CTP_CleavageSite=40; ConfidenceScore=5.12e-01
MGRDPIKQAQLCKKCSDPWPCSFLYRKKNGRRPGRRRSVLLPHRRGYDSFRSGNNIAYSTLLESQNNRPNERNFKLFFRPVQSGACVLTRQQGLTGSAKASFLIND

SEQ ID NO: 176379 - protein, 62 aa, Glycine max
  Coding DNA Sequence Number=SeqID_59601
MSLLASNCKNYRDLGSSPVVKFNPIQVDIVRSGWLIKESNNEDSTQDPDEGICNVSSQESRC

SEQ ID NO: 176380 - protein, 116 aa, Glycine max
  Coding DNA Sequence Number=SeqID_59602
TQPTSSYYRFVMLVPEVVIPSESLSSSADVAISHFDFDSSSKDTNATSPSLVSPRSILPKAWIPLGVDMVDLVSEDEGENQEEDMSYEEDQSMDKEDLAPEIIEEDSSQDSSKESY

SEQ ID NO: 176381 - protein, 89 aa, Glycine max
  Coding DNA Sequence Number=SeqID_59603
MWCYEWKKSETLRVGRLSLNSVLVLFECCFAWMLWKLGRIDGDPVLRETRIWATWEYVSSVGGGQQGMVGLCAHCGCGKLVVHHRPTAT

SEQ ID NO: 176382 - protein, 69 aa, Glycine max
  Coding DNA Sequence Number=SeqID_59604
MGTACGYGGGMVDALNANFYGNGTQTLVLVFDLAFAPNVRPSSLYDPKKYSTFDGYAEDAWSAFLMSSI

SEQ ID NO: 176383 - protein, 107 aa, Glycine max
  Coding DNA Sequence Number=SeqID_59605
MVAQVMLGNGYEPRMGLGKDNGDKTILLSARGNRGNFGKKEREVKARDWDEKSSFLSAGQGHEGQVVAICEDDSPSGSDLVRPCPPGFRLGNWRVEERPDIYETSIM

SEQ ID NO: 176384 - protein, 110 aa, Glycine max
  Coding DNA Sequence Number=SeqID_59606
MNMPRALENLALPLLFVILLPEIALLFLLPTLSSLKPTEPPTLFLEVWLEENPTYTVATRVLKQSWVLKAQSFLREYCRLRYEESLKFRAILLDLTTIVTVWVRDCLEHQ

SEQ ID NO: 176385 - protein, 171 aa, Glycine max
  Coding DNA Sequence Number=SeqID_59607
MWDATVFGVFNDNFPLYIKHEDVSEIAHGGQCLNISILQLWVLHMTETKSYTKNWMQNSKRDVYLGAYLNGPDNYLKGIINRSVLFFNTFALALVGNINILIVQYTSMLVFSSALKGLDDTPQSKSKAVVRWIVVKCNRQKGSIECGYYVMHWMSTIILDSFKNNWETVIV

SEQ ID NO: 176386 - protein, 102 aa, Glycine max
  Coding DNA Sequence Number=SeqID_59608
MLVQMMDPEKEAGLGRTRVAGAGGKGEVEGVDVEGAKVRGVEVDGASDPLALDLRVPQKVTEGSSRDSKVRESDVTPRALHKAIIRAGISSLEESCCAIREI

SEQ ID NO: 176387 - protein, 56 aa, Glycine max; identical to SEQ ID NO: 156316
  Coding DNA Sequence Number=SeqID_59609
  Subcellular localization annotation: CTP_CleavageSite=35; ConfidenceScore=5.13e-01

SEQ ID NO: 176388 - protein, 60 aa, Glycine max
  Coding DNA Sequence Number=SeqID_59610
  Subcellular localization annotation: CTP_CleavageSite=51; ConfidenceScore=5.03e-01
LFLLLSQVLLTQPGVDDDSTFSRVSIRSGDSSCFSWAIESTENGITAVRVSAASLSKSGT

SEQ ID NO: 176389 - protein, 136 aa, Glycine max
  Coding DNA Sequence Number=SeqID_59611
  Pfam annotation: Domain name=DUF1936; Domain location=88-123; Score =15.3; E_value=0.047; Accession=PF09151.1; Description=Domain of unknown function (DUF1936)
MDLSFDTVVIGFNAVDLRALDSHQFPFELVFEFEFMLEFEFEFAAVPIRVRVHHCHDLVTLDLSCTVPLWVCVYSDPGAHLSMKFPSKELLEKCGWNDVVEVKEAKGEGDVFDLLNPNCDNVVSLLDRVASFMDHS

SEQ ID NO: 176390 - protein, 96 aa, Glycine max
  Coding DNA Sequence Number=SeqID_59612
MGFLEVPSWHLTLMLPCLPFTLAFLFAKEASLYLASPLHVELVGLRSSSSMKVIYFLKMNGSGMEKEERWLERRRHFKEKMSQEEAHHHRKSWIRP

SEQ ID NO: 176391 - protein, 109 aa, Glycine max
  Coding DNA Sequence Number=SeqID_59613
  Subcellular localization annotation: CTP_CleavageSite=61; ConfidenceScore=5.73e-01
MGKPRRGRRSPSGFFSGSSSRSSSPPTLVPPLAHAPFFGPVLPRTPNPLPHHSPLPPEAPAAAALPRRGTKGTANFLNRSAEDAMLEVFECGVIGRHVEIESYHACNID

SEQ ID NO: 176392 - protein, 105 aa, Glycine max
  Coding DNA Sequence Number=SeqID_59614
  Subcellular localization annotation: CTP_CleavageSite=31; ConfidenceScore=5.17e-01
MSFLEFEFGSIESELSTKVSFSVSVSCSLERAVARGCRSLSSSSLRARIEGLERRTSSCSLFTLCEAFGLPHLLQRHDEAAEATTNVRMRERAACTLPDKERKRK

SEQ ID NO: 176393 - protein, 74 aa, Glycine max
  Coding DNA Sequence Number=SeqID_59615
  Homolog annotation: Hit_ID=UPI0000196CDA; Match level="QueryCoverage =50%, HitCoverage=4%, E-value=2e-09, Identity=68%"; Hit description =ATP binding / kinase/ protein kinase/ protein serine/threonine kinase
MARNVVPKKDVVETIQRFNIQVNNLTQFQFKVLPFLQVLLRSQHQGHRIDIWSAGVTLLYMVSGKTPFTGDPKQ

SEQ ID NO: 176394 - protein, 270 aa, Glycine max
  Coding DNA Sequence Number=SeqID_59616
  Homolog annotation: Hit_ID=Q9FX29; Match level="QueryCoverage=41%, HitCoverage=32%, E-value=2e-40, Identity=52%"; Hit description =Steroid 22-alpha-hydroxylase, putative
MMLTKTHERGCCLTYDYVTNDDTDLLGEKDLDSISRLRGLLVSRPADSSFSHKNALHRCVEHAKLWLAKSEQPIGPNADVTYAALREKLNNIMSSEYFTTTPEMKAPVEVDVAAAGGNYVSFHVPVHGFVVPVEVEQPVFQSQEKVISVYGCTECCWEESLLDDAIADFIINLLFAGNETTTKTMLFAVYFLTQCPRAMKQLLDEHDCFVVPFLSAVHLDENVYSGALNINPWRWMEPENEEKRNWRTSPFYAPFGGGARFYPGAELACL

SEQ ID NO: 176395 - protein, 188 aa, Glycine max
  Coding DNA Sequence Number=SeqID_59617
  Gene Ontology: Mol. function=translation initiation factor activity; Cellular component=eukaryotic translation initiation factor 3 complex; Biological process=translational initiation
  Homolog annotation: Hit_ID=Q1SQK2; Match level="QueryCoverage=99%, HitCoverage=33%, E-value=3e-56, Identity=50%"; Hit description =Translation initiation factor eIF-3b
MVDVMVMKEIKDTALHLGVDLSTLDLDAIRLPPGEKCGIVSLRSSKKWSLDGLWMPVDPETEKTLGYYFIEYNTPQEAELAKEKTHGMFDDFDRFMKVPNEWAPPETKPYAPGVRFWSRTLYLIDISDALWCWYLLQENLQHWLTDAKARDQFVIHAGSDTKFWTESFVQWSPLGTYLATVHTQGAAV

SEQ ID NO: 176396 - protein, 77 aa, Glycine max
  Coding DNA Sequence Number=SeqID_59618
MSFVSDYEVLEVEETPTTCISSILHLSILFVVKEASQIWRAKSFIGSSFTSFQCAFALMTLMHALLGSFNSGNWSDS

SEQ ID NO: 176397 - protein, 292 aa, Glycine max
  Coding DNA Sequence Number=SeqID_59619
  Gene Ontology: Mol. function=protein binding
  Homolog annotation: Hit_ID=P16659; Match level="QueryCoverage=44%, HitCoverage=22%, E-value=6e-65, Identity=91%"; Hit description =Prolyl-tRNA synthetase
  Pfam annotation: Domain name=UPF0066; Domain location=2-78; Score =51.2; E_value=3.4e-12; Accession=PF01980.7; Description =Uncharacterised protein family UPF0066
  Pfam annotation: Domain name=tRNA-synt_2b; Domain location=199-292; Score=15.6; E_value=1.1e-06; Accession=PF00587.15; Description=tRNA synthetase class II core domain (G, H, P, S and T)
  Pfam module annotation: Pfam domain module=UPF0066::tRNA-synt_2b; Domain location=2-78::199-292
  Subcellular localization annotation: CTP_CleavageSite=45; ConfidenceScore=5.02e-01
MAGGWRPTVRPPRLGGNARMGVFATRSTFRPNPIGMSLVELKGIRCEQQQVILQLGSLDLVDGTPVVDIKPYLPFAEALPEARAGFAQSAPDASMPVRFSAQAQQQLQQQQRHYPQLARFITEVLAQDPRPAYRKGESPGREYAAWLLDFNVRWRIDAAGTEETPSDAEVISHQLMLRAGMIRKLASGLYTWLPTGIRVLRKVENIVREEMNNAGAIEISMPVVQPADLWEESGRWEQYGPELLRIKDRHERPFVLGPTHEEVVTDLIRNELSSYKQLPLNVYQIQTKFRDE

SEQ ID NO: 176398 - protein, 81 aa, Glycine max
  Coding DNA Sequence Number=SeqID_59620
  Gene Ontology: Mol. function=sequence-specific DNA binding; Cellular component=nucleus; Biological process=regulation of transcription, DNA-dependent
  Homolog annotation: Hit_ID=Q9LV52; Match level="QueryCoverage=80%, HitCoverage=20%, E-value=4e-27, Identity=81%"; Hit description =Similarity to heat shock transcription factor
  Pfam annotation: Domain name=HSF_DNA-bind; Domain location=13-81; Score=-49.6; E_value=8.5e-06; Accession=PF00447.8; Description=HSF -type DNA-binding
MEHNIIVNNNVIAPFVIKTYNMVNDPTTDKLITWGPANNSFIVLDPLDFSHSLLPTFFKHNNFSSFVRQLNTYVLFQYANF

SEQ ID NO: 176399 - protein, 570 aa, Glycine max
  Coding DNA Sequence Number=SeqID_59621
  Gene Ontology: Mol. function=glutamate synthase (NADPH) activity; Cellular component=membrane; Biological process=nitrogen compound metabolic process
  Homolog annotation: Hit_ID=Q1GXP0; Match level="QueryCoverage=99%, HitCoverage=30%, E-value=0.0, Identity=69%"; Hit description =Glutamate synthase
  Pfam annotation: Domain name=Glu_synthase; Domain location=85-435; Score=404.3; E_value=1.7e-118; Accession=PF01645.7; Description =Conserved region in glutamate synthase
MHAERKRRPAALRDILALPCDLTHVDSEAEFGRKLGRYSLVNNGFAIRGLRCEAVNGSLNQFELRLIDAIAGLKPESERLAALSRALKTRFNDEIESSSITEGVLHITAYGQAADYLAKIFTALPSLPLEEIQPAHEITRTFASGAMSHGALVAPAHEAVAHGTNMVGGMSNCGEGGEHYSRHGTIRASRIKQLASGRFGVWAAYLADPMLEELEIKIGQGAKPGEGGQLPAPKVTVEIAAARGGTPGVELVSPPPHHDTYSIEDLAQLIHDCKAARVRVIVKLVSSEGIGTIAVGVAKAGADVINVAGNTGGTGAASVTSLKYTGRVAEIGIAEVHQALCANGLRDKVQLRCSGAQQTGSDVIKSALLGGDSFEFGTTALMMLKCVMAKNCNVKCPAGLTTNAEAFDGDPRQLAQYFINVAQEVREFLARLGLRSLREARGRSDLLHLMDHPLEVGKLDLRAMLTVVPEQKIAQPVYLEKDFELDDGWVEELKAQLVDAARREITLGNGVTLNNRNKSVGGQLAIDIERMLNHELSAQQLAALPAVLQDDRGRKYLAPRTVQIDTRGSA

SEQ ID NO: 176400 - protein, 89 aa, Glycine max
  Coding DNA Sequence Number=SeqID_59622
MIMRGQDIYSSQDEATTSPSSSESEEAKNEESSEEIYPQEEGQPLVVKEKCKEVKCLLQEKFESRPFQNILEVGLLKEEATGWQAPPRC

SEQ ID NO: 176401 - protein, 90 aa, Glycine max
  Coding DNA Sequence Number=SeqID_59623
GWCLVLDMQRVDFVADLGVAFVVDWVFLVGRVTGASGKFGHTGSAAINEVLPPSSSRHSSRDPITRIRRSNIIKFPFVRQVASDILSRGG

SEQ ID NO: 176402 - protein, 284 aa, Glycine max
  Coding DNA Sequence Number=SeqID_59624
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=1e-17, Identity=30%"; Hit description= UPI00006A17C9 related cluster
MAVALWDKHGRGLHALAISGLHALAFRGLHVLTFRGLHILTFRGLHVLAFKVLHALTFRGLQALTFRVLHVLTIRGLDALAIRGLHVLTFRGLRALTFRGLHVLAFRGLHVLFFRGLHVLTLRGMHALAFRGLNVLTFRGLHRTTCPHLQSATCPHLQRANTLTFRGVHILAIRGLHALAIRGLRALTLEDNMFLPSEGYTPSASEDYMSSPSKGYMPPPSEGYTPSPSKDYTSSPSEGCTPSPSEDYTSSPSEGYAPSPSKDYMSSPSEDCTSSSSEDYMSSP

SEQ ID NO: 176403 - protein, 455 aa, Glycine max
  Coding DNA Sequence Number=SeqID_59625
  Gene Ontology: Mol. function=chitin binding; Cellular component =extracellular region; Biological process=chitin metabolic process
  Homolog annotation: Hit_ID=UPI00006A17C9; Match level="QueryCoverage =95%, HitCoverage=100%, E-value=3e-45, Identity=32%"; Hit description= UPI00006A17C9 related cluster
  Subcellular localization annotation: CTP_CleavageSite=61; ConfidenceScore=5.74e-01
GYTSSTSEDYTSSPQRATCPHNQTTTPPHLQRSTRPPLQRTTRPRLQRSTRPPLQRTTRPRLQRATCPHLQRVTRPHLQRTTRLCHQRTAHPGHQRTTCPRHQRPTRLRLQRTTHHPLQRTTRPHPRGLHTLSFRGLHVLTFRGLHLLTSEGYMPSPSEDYTSSASEDYMSSPLEYYTSSPSEEDCTPWPSEDYTSTPSEEYNSSPREDYMSSPSGTTSPHLRGLPDLVFRGLHVLTFGGLHVLAFRGLHTFAFRRLHVLTIRGLHVLTFKVLHAMTIRGLHALTFRGLHVLAIRGLHVFPIRGLHTLAIRGLHVLAILGLHTLTFRGLQIIAISGLHVLSIRGLHAFTFRGQHVLAFRGLHVLPFRELHVLAFRELHVLTFRGLHVLTFRGLNVLTLRELHSLIFLELDAIIFRELHTLAFRGLHVLNFRGLHGLTFRGLHIPTFRGLHVPTFR

SEQ ID NO: 176404 - protein, 70 aa, Glycine max
  Coding DNA Sequence Number=SeqID_59626
MAQGLTKDRLGLNLDGNSEMTKERMENKVANFVGLNKVVLGIKWMNGMLWPRDNSGQRWIFWNCGLKEQG

SEQ ID NO: 176405 - protein, 300 aa, Glycine max
  Coding DNA Sequence Number=SeqID_59627
  Gene Ontology: Mol. function=transporter activity; Cellular component= outer membrane; Biological process=transport
  Homolog annotation: Hit_ID=Q2YBD6; Match level="QueryCoverage=99%, HitCoverage=43%, E-value=5e-24, Identity=28%"; Hit description=TonB -dependent receptor precursor
VGAEHHAVAAVDRQAVAQAGQVLFQLLVAQRVAEAVVRQAVELLLAGRRIGVQRADAELLLDLQAEGGGGGLDVVDLVLGAARVAFELVFARGRVDQARARQVQLLRGGVAIQADRAVVVAEGDAAAAALAAFAAVLAVAVAVQRLHVGVHAHLLVVQGHGGVVLAQAVAAEGGGGAGRDRLLGELLARDDVDHAAGGAAAVLHRAAAAHDFDALDLVQRHHAQAGGGQVVGVLLDAVDHDQRVAGAGDAEAAQVDDGVVAGAGGVDQVDAGLRRQQVLHGAGAAGGDVLGGDDGDRHRQ

SEQ ID NO: 176406 - protein, 100 aa, Glycine max
  Coding DNA Sequence Number=SeqID_59628
MELDEFKAELERHNFHKRFTNLADNSIDLALLKEFYANLYSPEGPSPKQVRIRGHLIRIDADNLNTFLETPVVLAEGESLPAYSRYCRMPTDFREIEAAL

SEQ ID NO: 176407 - protein, 219 aa, Glycine max
  Coding DNA Sequence Number=SeqID_59629
  Gene Ontology: Mol. function=N-isopropylammelide isopropylaminohydrola se activity; Biological process=cytosine metabolic process
  Homolog annotation: Hit_ID=Q39BH7; Match level="QueryCoverage=90%, HitCoverage=49%, E-value=3e-70, Identity=67%"; Hit description=N -isopropylammelide isopropylaminohydrolase
MARHYRGLRGVDLEPAAVDHHAALQRHRSHGRRAVVGAHRHERSRQAFGNTVARQADHLRGMGGDHVQRQHQVGIGVEAGTVAQQHRPLQQVAIAIRPPAVTDVVVACEHAHTGIMQGAQRRERMIPRRVAHDRHTRSGQCFAHLQRARQRHLAQRIGMADRNAPLQAGGPGTRSDAQQLRQTGFAGLVQMDVQLHTVALGQSEQQRQLAFGITIERGG

SEQ ID NO: 176408 - protein, 234 aa, Glycine max
  Coding DNA Sequence Number=SeqID_59630
  Homolog annotation: Hit_ID=Q2XKJ5; Match level="QueryCoverage=26%, HitCoverage=21%, E-value=3e-15, Identity=61%"; Hit description =Transcriptional regulator, LysR family
MGDVDDLALLDALEQQRAGADLQAAVGIAQHRVDAPGIGHLHPGQARHALGQRVTERNAQCFPAVAVATIDQLGIDHALQCGGRQRPLHRQRRKAGGHARGDQRTLVLQMRLQGSGQGIETGGDFVGHGKAPWGTETSGTLRADVAGRAAGLTMFRCVMREIHPRMAWIYCVVDHRQLTLAIDDAVLAADRAARQQADADAIGHGALDATERRTGEGDAPAQAQRFHGVDHLVA

SEQ ID NO: 176409 - protein, 74 aa, Glycine max
  Coding DNA Sequence Number=SeqID_59631
MGEMLATQLTWVSSAHPSEQECYGTPRIVQRCFLLSSGMSRNFTNCATMLPFEFRHVTKLHKLPDDGCQVPQNG

SEQ ID NO: 176410 - protein, 350 aa, Glycine max
  Coding DNA Sequence Number=SeqID_59632
  Gene Ontology: Mol. function=serine-type endopeptidase activity
  Homolog annotation: Hit_ID=Q1RW49; Match level="QueryCoverage=66%, HitCoverage=47%, E-value=1e-35, Identity=35%"; Hit description=IMP dehydrogenase/GMP reductase
  Pfam annotation: Domain name=Tetraspannin; Domain location=9-279; Score=-61.6; E_value=0.1; Accession=PF00335.10; Description =Tetraspanin family
MPCFTPHHSLLLLLLSIFFFSLSVTAARTSSFHSLRIQDGIEGGGEGEHYHEVLPWKTRRSMAEEEATSNASLILAQKRTTRKDPLDNFNRYTGGWNISNRHYIASVVFTAVPFFVVAAVWFVVFGLSLSLICLCYCCCPREPYGYSRLAYALSLIFLILFTLAAIVGCVLLYTAQGKFHGSTTSTLKYVVSQADFTAENLRNVSHYLDAAQKIGVDAVFLPGDVQKNIDEVQTKINSSAAELSSKTKENSETIKDVIDAMRLALVIVAAVMLFLAFLGFLFSIFGLQGLVYLFILLNVQSVNIVPSMAAVWLLSGGFLLLAHLYFVVYFSFFTNIIFEGSRKFEAVRNN

SEQ ID NO: 176411 - protein, 175 aa, Glycine max
  Coding DNA Sequence Number=SeqID_59633
  Gene Ontology: Mol. function=chromatin binding; Cellular component =chromatin; Biological process=chromatin assembly or disassembly
  Homolog annotation: Hit_ID=Q1SAV4; Match level="QueryCoverage=81%, HitCoverage=53%, E-value=4e-17, Identity=32%"; Hit description =Integrase, catalytic region
MANTSTTPYEITFGRRPFNFPDYLAGSSKSKMKLYADQHRRDVQFTPGDWVLVATKIGPVAYRLDFPEGVRIHPVFHCSNLKPFRGEPESISPTPLPPTFHENQPLIAPLAILGSRRATSDPHSPRQVLEQLHQDYHLEDKVILQGPGDDTSTENEEEGAEEEEDQSPTQEEKKG

SEQ ID NO: 176412 - protein, 248 aa, Glycine max
  Coding DNA Sequence Number=SeqID_59634
MKTNKEAMKEQMITMMEAMMSMRKMMEVNTATFVAVSIAIEVDLTHPSGLNQVQSKHSFPPYGLPPNYTQPNVAHVPNENVDNSTPIPIESQQPQSDHTLVSQPMWEIHEAPRDQNLVDFEPHLGYATEGQAVGGVPLPNTLGGPQFCPQPQPLHFIVGRVPPAMVERGKFDHIEERLAAIADMVQFCLVPNVVIPSKFKVLNFGKYKGTTYPKNHLKMYCRKMGAYVKDEKLLMHFFQESLSGATVT

SEQ ID NO: 176413 - protein, 124 aa, Glycine max
  Coding DNA Sequence Number=SeqID_59635
  Homolog annotation: Hit_ID=Q2HSJ5; Match level="QueryCoverage=98%, HitCoverage=34%, E-value=1e-08, Identity=27%"; Hit description=Zinc finger, CCHC-type; Zinc finger, SWIM-type
MYFKTAQLFAIRDRQTQTVINSGSQYSEVVSDAMNNGQQESNTHIAKHLSCSHVIAACKSVNLDPMNYVSMLFTLQYTLHIYENSFGLLPHESVWQEYERDQWDPDPRRKRTAKDRSISTRIPT

SEQ ID NO: 176414 - protein, 95 aa, Glycine max
  Coding DNA Sequence Number=SeqID_59636
  Gene Ontology: Mol. function=receptor activity; Cellular component =cellulose and pectin-containing cell wall; Biological process =protein amino acid phosphorylation
  Homolog annotation: Hit_ID=Q9ATK2; Match level="QueryCoverage=73%, HitCoverage=22%, E-value=1e-12, Identity=50%"; Hit description=S -receptor kinase
MATLWDTSNFVLQQLHPNGTKSMLWQSFDYPGDDLLPRMKLGVNFKTVRNWSIVSWMGSLNPSLGTFRMELGTQKKRIGHQATKTIVLDKWRAKK

SEQ ID NO: 176415 - protein, 224 aa, Glycine max
  Coding DNA Sequence Number=SeqID_59637
  Gene Ontology: Mol. function=DNA binding; Cellular component=nucleus; Biological process=regulation of transcription
  Homolog annotation: Hit_ID=UPI00000529F6; Match level="QueryCoverage =97%, HitCoverage=14%, E-value=2e-43, Identity=43%"; Hit description =transcription factor
  Pfam annotation: Domain name=JmjN; Domain location=148-207; Score =70.5; E_value=5.5e-18; Accession=PF02375.7; Description=jmjN domain
MGTELMRICVKEDNDDFPSVPPGFESYTSFSLKKVENNEKQDDKNMTSCSASTSASESPSTQAENDVQVGDTAKVPRSLRRRPWINYGQYENISDEDPDCERHDQNFSSRPCLPRGVIRGCPDCSNCQKVVARWRPEDARKPNIEDAPVFYPTEEVSFNSYDTFEFTSVHEFQDTLKYISSIRSKAEPYGICRIVPPSSWKPPCPLKEKSIWEGSKFSTSCSED

SEQ ID NO: 176416 - protein, 384 aa, Glycine max
  Coding DNA Sequence Number=SeqID_59638
  Gene Ontology: Mol. function=DNA binding; Cellular component=nucleus; Biological process=regulation of transcription
  Homolog annotation: Hit_ID=UPI00000529F6; Match level="QueryCoverage =91%, HitCoverage=30%, E-value=1e-142, Identity=67%"; Hit description= transcription factor
  Pfam annotation: Domain name=JmjC; Domain location=169-285; Score =237.3; E_value=3.2e-68; Accession=PF02373.13; Description=JmjC domain
MSKIQTNMKRKRRRCTRMGVDNSTRTGPNAGFCEVERFGFEPGPEFTLETFQRYAEDFQLKYFRKNENVSHLGANTTILNGTSEPSVENIEGEYWRMVESPTEEIEVLYGADLETGIFGSGFPSKSSQVGSASHEQYIKSGWNLNNFARLPGSLLSYESSDISGVLVPWLYVGMCFSSFCWHVEDHHLYSLNYLHWGAPKMWYGVPGKDACKLEEAMRKHLPELFEEQPDLLHKLVTQLSPSILKSKGVPVYRCIQNPGDFVLTFPRAYHSGFNCGFNCAEAVNVAPVDWLPHGHIAIELYQEQGRKTSISHDKLLLGAAREAVQAQWELDLLKKNTLDNLRWKDVCGKDGLLAKALKLLENLMIHNTNPMIKPIDFYSKMNLK

SEQ ID NO: 176417 - protein, 77 aa, Glycine max
  Coding DNA Sequence Number=SeqID_59639
MTWANEPVDMQRLTSSAAPFVTQRQQVRWHAEIPKRLSVQTICVNPDSGSQVAGRGIVWLSAPFVNQGQTSPLTPRD

SEQ ID NO: 176418 - protein, 118 aa, Glycine max
  Coding DNA Sequence Number=SeqID_59640
MLQNLTDYAKMLVFLSECCETLWITQRCLFSGVLKEANKGTKDKTLISFERNITWPMNIPTSGTCHLEKKNRQGRQQNFSASKAIKRDNHNVSTCCRTRLSLPSREESRALSGLNVSK

SEQ ID NO: 176419 - protein, 653 aa, Glycine max
  Coding DNA Sequence Number=SeqID_59641
  Gene Ontology: Mol. function=DNA binding; Cellular component=nucleus; Biological process=regulation of transcription
  Homolog annotation: Hit_ID=UPI00000529F6; Match level="QueryCoverage =98%, HitCoverage=52%, E-value=1e-125, Identity=42%"; Hit description= transcription factor
  Pfam annotation: Domain name=FYRC; Domain location=479-573; Score =96.4; E_value=8.3e-26; Accession=PF05965.4; Description=FY rich C -terminus
  Pfam annotation: Domain name=zf-C5HC2; Domain location=30-83; Score =71.9; E_value=2.1e-18; Accession=PF02928.6; Description=C5HC2 zinc finger
  Pfam module annotation: Pfam domain module=FYRC::zf-C5HC2; Domain location=479-573::30-83
MERARREFLCSPSQALKMESTFDATNERECNICFFDLHLSAAGCRCSPDRYACLDHAKQFCSCSWDSKFFLFRYDISELNILVEALEGKLSAIYRWAKSDLGLALSSFVSASKETIHKELKSYSSNLSHSSRATVHKEMALHPLNKYIDNSQLIDVPTENQANSKDQSYFQQRKSVESISSLRSMKELLTFKSSQPTSEAANHKICVNKEESVICRSNMRTPGWQLSQDDTSYALSVPLAQHGGEKSSLNRHNNSIILLSDDEDDEKMSGSNRRKELSSMLTCPRDKTSPCNDIENTKLTISVSDSAVIGEKDAITLPRENMSSDSTRLLHVKQECHEHTGTVLASTPVDLSCHMGLTSTESIRNIPAPSKVEASDYCLESLEVCPLNPQLSGIKVKTEDNHENLGGCATSNVADNARAVNGNISCAPNNYRQKGPRIAKVVRRINCNVEPLEFGVVLSGKSWCSSQAIFPKEIVDAGRGWPLFMVSLENCASEVFIHMSAARCWELIREKVNQEIAKQHKLGRKGLPPLQPPGSLDGFEMFGFSSPAIVQAIEALDRTRLCNEYWDSRPYSRPQGQISQSSQTNVNGGNGQGVLLNKHMPVEVVAVLRSLFKKSNAEELNLLYSILSNNRPEADRNLVAQLLNEEIHKSQPP

SEQ ID NO: 176420 - protein, 111 aa, Glycine max
  Coding DNA Sequence Number=SeqID_59642
  Subcellular localization annotation: CTP_CleavageSite=52; ConfidenceScore=5.13e-01
MISVNPDPISQVAGGVASEPVDTQRLMSSSAPFVIQRRRGYLMVIHTFRQPGASEPADAQRLASSSAPFVVQRRRVLLLSSRDGDSDDMRGYLMVIRTFCQPRRTSSMVSG

SEQ ID NO: 176421 - protein, 260 aa, Glycine max
  Coding DNA Sequence Number=SeqID_59643
  Gene Ontology: Mol. function=protein kinase activity; Biological process=protein amino acid phosphorylation
  Homolog annotation: Hit_ID=Q9XF49; Match level="QueryCoverage=81%, HitCoverage=51%, E-value=3e-57, Identity=53%"; Hit description =Membrane related protein CP5
MAEDQGAEFVSYDTIKGEWKIKVKHFSIYKLIPSFMDIITDLAMFITPLWIAVIVGVVVGWAWKPKWAFHPKDALLKFRSPRPPNPQNDTAFTYSATSSSAREKDASGSPVVTEDDLLHLWKLVEEKDGGRAWIQMMDRSTPTMTYQAWRRDPESGPPQYRSRTVFEDASPELVRDFFWDDEFRLKWDDMLIHASTIQECVLTGTMMVHWVRKSHVDLVQFCLQFPFFCSDREYIIGRRIWDAGRIYYCVTKVRMKLIAN

SEQ ID NO: 176422 - protein, 632 aa, Glycine max
  Coding DNA Sequence Number=SeqID_59644
  Gene Ontology: Mol. function=transferase activity, transferring glycosyl groups; Cellular component=chloroplast; Biological process =glucan biosynthetic process
  Homolog annotation: Hit_ID=Q9ZSQ5; Match level="QueryCoverage=99%, HitCoverage=100%, E-value=0.0, Identity=74%"; Hit description =Granule-bound glycogen (Starch) synthase
  Pfam annotation: Domain name=Glyco_transf_5; Domain location=80-368; Score=422.4; E_value=6.4e-124; Accession=PF08323.2; Description =Starch synthase catalytic domain
  Pfam annotation: Domain name=Glycos_transf_1; Domain location=408 -589; Score=42.3; E_value=1.7e-09; Accession=PF00534.10; Description =Glycosyl transferases group 1
  Pfam module annotation: Pfam domain module=Glyco_transf_5::Glycos _transf_1; Domain location=80-368::408-589
  Subcellular localization annotation: CTP_CleavageSite=13; ConfidenceScore=5.44e-01
MATVSYAVSGSACQSHRGASRTEAKVNYSAQVSLNCQGLRSLNKLHVRTTRAAKTKTLLSAKSNKSGREGVLGRIECGMNLIFVGTEVAPWSKTGGLGDVLGGLPPALAGNGHRVMTVSPRYDQYKDAWDTSVTVEVKIGDRIETVRFFHCYKRGVDRVFVDHPCFLEKVWGKTGSKLYGPSAGVDYEDNQLRFSLLCQYLITENYNTFILIDSGNDIINMLSNFQAALEAPRVLNLNSSKYFSGPYGEDVIFIANDWHTALLPCYLKSMYQTKGIYKNAKVAYCIHNIAYQGRHSFADFSLLNLPNKFKSSFDFTDGHVKPVKGRKLNWMKAAILESDRVLTVSPYYAQELVTGEERGVELDNVIRSRGITGIVNGMDNREWSPKTDKFIDLHYDATTVTEAKSLLKEALQAEVGLPVDRNIPLIGFIGRLEEQKGSDILVEAIPKFIDQNVQIMILGTGKKIMEKQIEQLEKIYPDKARGVAKFNGPLAHKIIAGADFIVIPSRFEPCGLVQLHAMPYGTVPIVSSTGGLVDTVQEGYTGFHMGAFNVECEAVDPVDVEKLATTVKRALGTYGTPAMTQMIQNCMSQDFSWKGPAKHWEKVLLSLEVAGSEPGIDGDEIAPLAKENVATP

SEQ ID NO: 176423 - protein, 369 aa, Glycine max
  Coding DNA Sequence Number=SeqID_59645
  Gene Ontology: Mol. function=ubiquitin thiolesterase activity; Cellular component=lysosome; Biological process=ubiquitin-dependent protein catabolic process
  Homolog annotation: Hit_ID=Q8LMT7; Match level="QueryCoverage=81%, HitCoverage=33%, E-value=4e-85, Identity=50%"; Hit description =Putative ubiquitin carboxyl terminal hydrolase
  Pfam annotation: Domain name=UCH; Domain location=6-304; Score=111.0; E_value=3.5e-30; Accession=PF00443.19; Description=Ubiquitin carboxyl- terminal hydrolase
MKAGDRKLFGTPLVTYLVEDPQFGANIEASVHKMLEPLRKAYSSSKSHDGKENGFISAGSDEQSNISNTQSESQSLTTGNKEQEGTSCGESSFQLVLTNECCLSCEPIEKASFIKPNQVVRVFLDWTDKEHELYDASYLRDLPEVHKTGFTVKKTRQEAISLFSCLEAFLTEEPLGPDDMWYCPRCKEHRQATKKLDLWKLPEILVFHLKRFSYSRYLKNKLDTFVNFPIHNLDLTKYVKSKDGPSYVYDLYAISNHYGGLGGGHYTAYCKLIDENKWFHFDDSHVSSVTEAEIKSSAAYVLFYQRNRIKGQMEGETSQQLAQSGAFVLDSYFTSQCKTARATLVFVKGIVPSCYYVVRIPVPSIMWKR

SEQ ID NO: 176424 - protein, 100 aa, Glycine max
  Coding DNA Sequence Number=SeqID_59646
  Homolog annotation: Hit_ID=Q9FHX5-2; Match level="QueryCoverage=43%, HitCoverage=12%, E-value=8e-08, Identity=52%"; Hit description =Isoform 2 of Q9FHX5
MGATKVKLYDADVKLMVGLGNEYFSRMKDPKQAQAWIKSNLQAYPSSNLHYDNMLFAQIDAVYSALDSLAFQGASGRSRTKQNPKEDTGAWQWGEEQRQN

SEQ ID NO: 176425 - protein, 567 aa, Glycine max
  Coding DNA Sequence Number=SeqID_59647
  Gene Ontology: Mol. function=ubiquitin thiolesterase activity; Cellular component=lysosome; Biological process=ubiquitin-dependent protein catabolic process
  Homolog annotation: Hit_ID=Q33AW7; Match level="QueryCoverage=86%, HitCoverage=53%, E-value=1e-152, Identity=55%"; Hit description =Ubiquitin carboxyl-terminal hydrolase family protein, expressed
  Pfam annotation: Domain name=DUF1055; Domain location=139-264; Score =172.9; E_value=8.1e-49; Accession=PF06337.3; Description=Domain of Unknown Function (DUF1055)
  Pfam annotation: Domain name=UCH; Domain location=329-565; Score =129.5; E_value=9.2e-36; Accession=PF00443.19; Description=Ubiquitin carboxyl-terminal hydrolase
  Pfam module annotation: Pfam domain module=DUF1055::UCH; Domain location=139-264::329-565
MAAILSPKSSLMIKASGDWPEIVTDAGCRRLARKEVCRSQNRATARRYSDASNPVAPMTPAKWHDLGRELRCSSCDGQGWFSRWQSYVGPCVGMLSVDKQSSDGHNANMTHPKIADRPGPIDNSDIISKGNSCDNNNLDIHRMLEEGTDYVLVPEKVWERLLEWYKGGPALPRKLISQGHEHKQYNVEVYPLSLKATIGELHELVCKIKGVEQNKACIWDYFNLNKQSLLTVSDPKTLEDANLIMDQDILLEVSLDRDGSSHSGMDSMGNELALVPLEPSRSSMSIAGGPTMSNGHSTGSSFSLYQGSSVSSSLTNMDDRYDVYKGERGGLAGLQNLGNTCFMNSSIQCLVHTPPLSEYFLQDYSDEINMDNPLGMCGELALAFGDLLRKLWSSGRTAIAPRAFKSKLARFAPQFSGYNQHDSQELLAFLLDGLHEDLNRVKQKPYIEMKDSDGRPDEEVASECWKNHMARNDSLIVDVCQGQYKSTLVCPVCGKISITFDPFMYLSLPLPSTVTRTMTITVFYCDGSGLPMPYTVTVLKHGSCRDLCQALGIACCLKSDEMLLLAE

SEQ ID NO: 176426 - protein, 153 aa, Glycine max
  Coding DNA Sequence Number=SeqID_59648
  Gene Ontology: Mol. function=N-acetylmuramoyl-L-alanine amidase activity; Cellular component=outer membrane; Biological process =peptidoglycan catabolic process
  Homolog annotation: Hit_ID=Q7N3C7; Match level="QueryCoverage=96%, HitCoverage=54%, E-value=2e-50, Identity=65%"; Hit description =Complete genome; segment 10/17
  Pfam annotation: Domain name=PG_binding_1; Domain location=84-145; Score=40.7; E_value=4.8e-09; Accession=PF01471.9; Description =Putative peptidoglycan binding domain
MLGQKTWYPYREQQISALTALAKEIIRRYGITPDNVLGHSDIAPLRKQDPGRLFPWKALAAQGVGAWPEPQRVQKYLAGRAMNAPADVLSVQTLLKRYGYDQIPLSGFLDEDTRKTISAFQMHFRPENTDGTPDAETEAIAQALNEQYRATSV

SEQ ID NO: 176427 - protein, 192 aa, Glycine max
  Coding DNA Sequence Number=SeqID_59649
  Gene Ontology: Mol. function=zinc ion binding
  Homolog annotation: Hit_ID=Q9MAQ7; Match level="QueryCoverage=73%, HitCoverage=13%, E-value=6e-39, Identity=57%"; Hit description =Location of EST 206I21T7, gb|N37185
MCQELQIGVACFVACLINDIMSKGRRMTYEELCNAVLPHWHNLRKHNGERYAYSSHSQAVLDCLRNRHEWARLVDRGPKTNSNRKRRKLDAEESDDNGYGKGRTAKDVEGKNFELQKEEFPKGKRKARKRRRLALQGRAVKDVRRRQKADSLTDEDLGPFSNSSEESMFSEDEIQAGRIRPAGSSSDEAGSA

SEQ ID NO: 176428 - protein, 1082 aa, Glycine max
  Coding DNA Sequence Number=SeqID_59650
  Gene Ontology: Mol. function=zinc ion binding
  Homolog annotation: Hit_ID=Q9MAQ7; Match level="QueryCoverage=90%, HitCoverage=82%, E-value=1e-83, Identity=30%"; Hit description =Location of EST 206I21T7, gb|N37185
  Pfam annotation: Domain name=PHD; Domain location=122-167; Score =35.0; E_value=2.7e-07; Accession=PF00628.19; Description=PHD-finger
  Subcellular localization annotation: CTP_CleavageSite=56; ConfidenceScore=5.21e-01
MDESSVDSNDGPVTFGSDSTGSDSYESDPSRNVIYNNTQPRISPSFPASPSPSVFPAATESGDSSPPSVTFPTPNQLQNPHRLKSLLISVPSVTARMKGGRSHRPRSSDPPDEWVDGSWTVDCICGVTFDDGEEMVKCDECGVWVHTRCSRYVKGDDTFSCDKCKARHNKNNTTTNNSNNNSNSTTNPMETEVAQFLVELPTKTISMDNKKALPSRPRLWTDKPIEERVHVQGPPGGDPSIFAGQSASSIFTPQLWKACGYVPKKFNFKYNEFPFWNNNNDKEGVPAKDGNNNDNGVGVSKEANNTAAAPPVAPSVETRSGHAKDADTGKFGSQDVPPRVHGDVKKERTLLRPPVVHNSKRSKGDLGNSSSKERIGKKRLRTSDREVDSRKRTLHSSKSAFTPTGDGKQLDFYEDRGSKMFKADARSIKNKNLKDMVVQEHVSDDPVAVDTIMEESNNNLTTTEDSSEPLYPDMTKHGVSVGDVVAEEKASRKTPTLVEMSSKTDDAVTSALKQNYVGNASVKEKRCSVSVHSMFNMAALRLVMVCQDGDCLVADNADDALVVRSAASPRTEGHCVSAPELVDNQVSQDLGRNMRPSSAKCKVKMGRDDNVDNFRKPSNFHSSPISDHKNNEKPSDHTSDIVKVNDAPVPSLPSCESKVGGVDISSELIPADHTNKPIELSGDFCQRKLEPVGSEGSLETQKGFSETKDGLDAAKDPSKSEALGCSPKVGKSSPTSSTMNSKSLGHDCRSEDTEIPNSFTKHGVMADSNIHTKNENCPSVAARDENSKKSVKERPKSSLNSNSKGLHSSRSVQNSVSKQVNSDARDSVHVLSSKPLIHQTASILGSSESNHQKVLQVQSKISSSAPQKVEKLNQTNIHTSSKLNQSHVPSVNPSLISNSSMLSDEELALLLHQELNSSPRVPRVPRARHAGSLPQLTSASATSMLMKRTSGGGKDHYFASRRKHKDASRDGSGSSRELEYEAKRIEKEKGPSSSDQRKQDMSYAEDAPAREEGLASMAAANSITNNTVSSTSGIANSDASTPPEDQNLSSMRNSPRNVSDDDTATAGRPVHRTLPGSSLSGK

SEQ ID NO: 176429 - protein, 72 aa, Glycine max
  Coding DNA Sequence Number=SeqID_59651
  Homolog annotation: Hit_ID=Q5VRQ2; Match level="QueryCoverage=53%, HitCoverage=7%, E-value=5e-13, Identity=79%"; Hit description =Putative hydroxymuconic semialdehyde hydrolase
  Subcellular localization annotation: CTP_CleavageSite=46; ConfidenceScore=5.56e-01
MAFKDTNNQLNKSVSVLNAFVHLFLFVFFFRSLGSGRSCLKGSFATLTMRHGIPYTTLYVEPQGKLDLIWTL

SEQ ID NO: 176430 - protein, 51 aa, Glycine max
  Coding DNA Sequence Number=SeqID_59652
MDQMENEEPMLHLEVECAWGRWISDMVRGVDNFLGYLCYTLMIVDNLEEHI

SEQ ID NO: 176431 - protein, 163 aa, Glycine max
  Coding DNA Sequence Number=SeqID_59653
MTCGVDSRVLFWELENAPGDTYENNGTVYYRMLGNTPCAEHGVSSERHLVEFRKLLKIFSEMSGVPFTTWSYDEFQSIPQVRKIILELIDRETDLPHCCVPLRNVSRSVFSARPVTLLKSREAILPDSRPMAAGYTSVSVPPTAVMRVSCQSITVTCLTSIRL

SEQ ID NO: 176432 - protein, 244 aa, Glycine max
  Coding DNA Sequence Number=SeqID_59654
  Homolog annotation: Hit_ID=UPI00004DBC99; Match level="QueryCoverage =84%, HitCoverage=48%, E-value=4e-26, Identity=36%"; Hit description =UPI00004DBC99 related cluster
  Pfam annotation: Domain name=DUF1173; Domain location=1-231; Score= -79.7; E_value=1.5e-06; Accession=PF06666.2; Description=Protein of unknown function (DUF1173)
MAARVRIGQVPLQQSLMLMAMKDSPQAAQNRHIAKDAGRASRRLILISQLAAWIDAADARLQHTLPLGLFAGFPALQLPDDVRARLARSFSRELGDWRRGVRVIVICETEPPETVFIRREGRNLPRSSCRIIDSALMTVSPRYIPLDSRYEEMVEERLWQEKRAFIKPLRYDGEEDVFPDFVLMDVAGMEALPMEVFGMNTPDYLQRKQVKSALYDREYGAGQWWQWDASEDPEGMDMPGFPPR

SEQ ID NO: 176433 - protein, 141 aa, Glycine max
  Coding DNA Sequence Number=SeqID_59655
  Homolog annotation: Hit_ID=Q1M706; Match level="QueryCoverage=30%, HitCoverage=13%, E-value=7e-09, Identity=72%"; Hit description =Putative HTH-type transcriptional regulator
PSCSAARITFERVLSATDAPGVKVLDTAERETPASRATSSAFTQFFPLSFIRCPPCRFICTNYTGKAYRRAITFSGVVTRKEIMLIAGHGSCGSVVKDLTSSGIAQWSEDSSWAIIFFSDSDSSSNGRRCPLVTGSASVKE

SEQ ID NO: 176434 - protein, 719 aa, Glycine max
  Coding DNA Sequence Number=SeqID_59656
  Gene Ontology: Mol. function=protein binding
  Homolog annotation: Hit_ID=Q8FVV6; Match level="QueryCoverage=35%, HitCoverage=94%, E-value=9e-55, Identity=43%"; Hit description =Inositol monophosphatase family protein
  Pfam annotation: Domain name=DUF1228; Domain location=580-646; Score=- 23.0; E_value=0.034; Accession=PF06779.4; Description=Protein of unknown function (DUF1228)
  Pfam annotation: Domain name=Inositol_P; Domain location=263-513; Score=155.0; E_value=2e-43; Accession=PF00459.15; Description =Inositol monophosphatase family
  Pfam annotation: Domain name=MFS_1; Domain location=362-702; Score= -37.6; E_value=0.017; Accession=PF07690.6; Description=Major Facilitator Superfamily
  Pfam annotation: Domain name=Peripla_BP_1; Domain location=6-257; Score=-12.3; E_value=6.8e-06; Accession=PF00532.11; Description =Periplasmic binding proteins and sugar b
  Pfam module annotation: Pfam domain module=DUF1228::Inositol_P::MFS _1::Peripla_BP_1; Domain location=580-646::263-513::362-702::6-257
MNTGSSNFIGIVTAGFDNPFRSKLLSPLVHQLALHGFMPLLMNADDPEQLAPSLRQLLSYHVAGVIITSGAPPLSLAEEYLARKIPVTLINRHAELPGCDRVASDNAQGMALMADYCRQQGWRNIGFVGEHITNFSTQQRYEALMDSAPDLVVTSRFIAGGGYAAGRAAAQELSRCQVLLCATDMLALGAIDGLRALNSGDFVPAVIGFDDIPQASWDPYHLTTVQQDTDGLAQQAVDLLITRIAQFDLPAREVMATHEVDSLLARYRFACSLAESGGKMAYELYRQRDSLLTEHKGNDLQDVVSRADCEVESYVKSRIAEAFPGDGFLGEESGTVDAQQRVLWVVDPIDGTSCFLNGLHTWCLSLAIVADGEPVIGVVYDPNHHELFHALLGQGAWLNDRRITPHAALTVAGGVMGVGTSHRVSSADFLPFLDELLQHGGMFVRNGSGALMSAWAAAGRLIGYYEPHMNPWDGLPGIVLMREAGGSTNDYLADDGITRGNPVLLAIRDDTQQSATPPPFGDNMMSGLLSYFRASPEKHAGAFNEQRFRFVRWQTFLAMTLAYVTFYVCRLSFTVAKSALVDLGISPSELGMIGSALFFSYAIGKLVNGFIADHANVVRFMSLGLLLSAGMNLMMGMTTNAILLAIFWGINGWAQSMGVGPCAVSLARWYGTKERGTFYSIWSTAHNIGEAMTYMVIAAVIAGYGWHMGYLSTAALGAA

SEQ ID NO: 176435 - protein, 613 aa, Glycine max
  Coding DNA Sequence Number=SeqID_59657
  Gene Ontology: Cellular component=integral to membrane
  Homolog annotation: Hit_ID=P0AAP1; Match level="QueryCoverage=56%, HitCoverage=92%, E-value=6e-41, Identity=30%"; Hit description =Hypothetical protein yaiC
  Pfam annotation: Domain name=GGDEF; Domain location=307-466; Score =160.4; E_value=4.7e-45; Accession=PF00990.12; Description=GGDEF domain
  Pfam annotation: Domain name=MASE2; Domain location=133-301; Score =53.5; E_value=7.2e-13; Accession=PF05230.2; Description=MASE2 domain
  Pfam module annotation: Pfam domain module=GGDEF::MASE2; Domain location=307-466::133-301
AAVTADEPENTARVHFLLNTVSDRDGPDKSKGAVATEQIFAGRHHVNAGFLHSSIRSGCPADFSPVRAVLAFDSYHSCLFYATPLHHIHEFGEHFTAGVQPRHALSPLSSQIPPSSEFTTMPYYSPENSHLAQRSARFVRRMFMMRQLGTTLCFFPILSVLMEMDRGLTFTILLSVNAFIWPWLAYRRALRANDATTTEKQNLILDAAFGGIWVALMALSPFPSFIIMAVLASDRYAAGGSAQLIASVRAFVCASGVVWLMNGLELNMTFSMRTVWLSIPLSTCYLLALSVTSYNLTLRLRQRNRELERIALMDPGLEIPNRRMFERCLEKAFLSSRRGDSSGYLMLLDIDNFKAVNDNWGHEAGDFLLAEISAVLRQHAGMQDTPARFGGDELGVILHHASNECAVAMARSLQDKILQIRLPASDDFRCTVSIGIASATEAETINQWFHNADEALYEVKRSGRNGGKSPFNPISAICCAADLTAPCCTSALPPVISGRTAAVFLDGSSATTTMEKYSNKTSVLEPFVFNVSDQPAPATDGLTYCAAASINAIGKKIKCRFDRPFAITGVAEFLAQGCMRHSSGLMCHQYILSAIQQQHGGQPLWYGASVKTL

SEQ ID NO: 176436 - protein, 173 aa, Glycine max
  Coding DNA Sequence Number=SeqID_59658
  Homolog annotation: Hit_ID=Q1RGE9; Match level="QueryCoverage=43%, HitCoverage=97%, E-value=6e-20, Identity=56%"; Hit description =Putative antitoxin of gyrase inhibiting toxin-antitoxin system
  Pfam annotation: Domain name=CcdA; Domain location=102-173; Score =112.0; E_value=1.8e-30; Accession=PF07362.3; Description=Post -segregation antitoxin CcdA
VSISDLSGHDAPGDDALDQRIAEAKSNLAEEGRFYRSVITAIVVCALLLVLNHFTNPASTDQPLATEAATADAAAGQRRTLHSSGAALAPGKGRNEPAAAATRQNVNLSIDKELLNKARDAGMNLSRTLSMAIDEELRRYAASRWQEENAEGINTLNRIGEETGCFSDNYRNF

SEQ ID NO: 176437 - protein, 203 aa, Glycine max
  Coding DNA Sequence Number=SeqID_59659
  Gene Ontology: Mol. function=hydrolase activity; Cellular component =integral to membrane; Biological process=aromatic compound metabolic process
  Homolog annotation: Hit_ID=Q5VRQ2; Match level="QueryCoverage=79%, HitCoverage=27%, E-value=1e-17, Identity=37%"; Hit description =Putative hydroxymuconic semialdehyde hydrolase
MGVMGKARSVAAMGGRILNEAVSFVAFCVLDLVDFLLCFVFKAVDLWVEAELRPCYCSSAKEAITSSGKILVSEQGGESKIVSLLSSTKLQLEDISDTLYSRPSLVSEVSRLTINELKRFKLEDPVLQSKRGTNSRCSTFTVNTTIVEMLQGKIARHLTHPIPRWSDCDCKLCTSWISSSSSPHNDNTNAKATLFLKSQCPTT

SEQ ID NO: 176438 - protein, 122 aa, Glycine max
  Coding DNA Sequence Number=SeqID_59660
GELDSGDNGDNSGSIDDNGGGGGIVATIMRCNGHDDDVVVVVNRAKSSCSGSDDGGGMVEAIMVVVAQRGVIVVTMTVTVVVVVEWWQRRIDDVIMTRCGDGSDDGSGCSGMVAVKATMMGW

SEQ ID NO: 176439 - protein, 180 aa, Glycine max
  Coding DNA Sequence Number=SeqID_59661
  Pfam annotation: Domain name=DUF630; Domain location=80-139; Score =122.7; E_value=1.1e-33; Accession=PF04783.3; Description=Protein of unknown function (DUF630)
MPTPTSTTTFAGVETPNGDSSNTNPHPKHTRQESRDLSPFLSCSYPITLKLLLLHYATVKHVLLRRGYPHLILLYRDTDMGCGGSKVEDFPAVVLCRERKAFLKAASEQRYALTAAHVAYFHSLSEIGDALHKFTEQDLTTTTGSSSLVLTLPSETKSINNNKLSSSSPSIASNEKNYEK

SEQ ID NO: 176440 - protein, 280 aa, Glycine max
  Coding DNA Sequence Number=SeqID_59662
  Gene Ontology: Mol. function=binding
  Homolog annotation: Hit_ID=Q10SR2; Match level="QueryCoverage=61%, HitCoverage=38%, E-value=2e-39, Identity=54%"; Hit description =Expressed protein
MPEPESQNGHEQDPEPQPETEPVPTEQTQPQLEPKSKSTPEPEPNPQPESEPVPTEQTQAQLEPKSGSEADPAVNDADLRETTIHSNETYANPSPTPQLRKDEGSRTFTMRELLNGLKNDSEPEREDGNSPYSPEQQQQQADQNNAAMDLINSVVGVDEEGRSRQRILTFAARRYATAIERNPEDYDALYNWALVLQESADNVSPDSTSPSKDALLEEACKKYDEATRLCPTLHDMGGSRGSSSLSRMKKHFLNILEEMRIEIESFRLSVGNSRKNENCW

SEQ ID NO: 176441 - protein, 180 aa, Glycine max
  Coding DNA Sequence Number=SeqID_59663
MKHWSGMATKLGISGCPVKILPQKPPDLCSSMERDGHCLRWISGLPCGLTQPPRFDCDTPAIIKTSGSRSSQGKDDEGRVTDKAGENKFLNLMGQTQTTKDSEYQDKSCHITTQELPSCAAVQFTREPGDLITTIAVVMMLCFMAKNTEENRALGKHGSAHIFVFDTGEVKVNFGMQWSG

SEQ ID NO: 176442 - protein, 711 aa, Glycine max
  Coding DNA Sequence Number=SeqID_59664
  Gene Ontology: Mol. function=nucleotidyltransferase activity; Cellular component=integral to membrane; Biological process=aromatic amino acid family biosynthetic process
  Homolog annotation: Hit_ID=Q6R3L0; Match level="QueryCoverage=88%, HitCoverage=93%, E-value=0.0, Identity=72%"; Hit description=Metal -nicotianamine transporter YSL1
  Pfam annotation: Domain name=OPT; Domain location=83-696; Score =487.3; E_value=1.8e-143; Accession=PF03169.6; Description=OPT oligopeptide transporter protein
MYNQQVKESKGPFRRDESRRKRNRQKNKTGLIAATTDREIMISPSSGLNMEEEKKEEIVERDEDLEEQVPAAAEVEPQPWTEQITVRGLFVSMIIGITFSIIVMKLNLTTGMVPNCNVSAALLAFVFIRTWTKLLHKAGFVAKPFSRQENTIIQTCAVACYSIAVGGGFASYLLGLNRTTYELSGVENEGNNPGAIKEPGFGWMTGFLFVVCFVGLFVLIPLRKIMIVDLKLTYPSGLATAVLINGFHTQGDKMAKKQVRGFTKYFCTSFLWGLFKWFFSGIEDCGFEQFPTFGLQAWKQTFYFDFSMTFVGAGMICSHLVNCSLLLGAVLSFGVMYPLIDRLKGDWFPDNLEETNMKGLYGYKVFVSIALILGDGIYNFTKILISTVLNVNERMRSKNNKNVAADRHENPTEDLKQTDEFLRETIPLRIGVIGYVVFTMISIIIIPRMFPQLKWYYVVVAYIFAPSLAFCNAFGAGLTDINMAYNYGKVALFTLAAVTGKENGVVAGLVGCGLIKSVISVSCILMQDFKTAHYTRTSPRAMFICQVIGIAMGCVTAPLSFFLYYKAFDVGNPHGEFKAPYALIYRNMAIIGVQGFSALPQHCLQLCFGFFAFAIGVNMIRDFAPQKIGKWMPLPMVMAVPFLVGAYFAIDMFIGTVVVFAWQKLDSKKAELMVPAAASGLICGEGLWTLPAAILALARIKPPICMKFVPT

SEQ ID NO: 176443 - protein, 686 aa, Glycine max
  Coding DNA Sequence Number=SeqID_59665
  Homolog annotation: Hit_ID=Q1SFC5; Match level="QueryCoverage=66%, HitCoverage=55%, E-value=4e-31, Identity=25%"; Hit description =Asp/Glu racemase
  Pfam annotation: Domain name=DUF1723; Domain location=153-202; Score =45.3; E_value=2.1e-10; Accession=PF08330.1; Description=Protein of unknown function (DUF1723)
MASPHPEYATSHGTNIQANLAAKEILPVEGKNYIPIPRLGEKSLKIWSSQVLLPYTANNHSYAFLGPFLPYLKLEQLDQFLPRLDEEWPLVHLPIIRTDFTNKDHARIFRATPPVDRNNFFKWMDRVENVYGNHWKKLGIYEFMQLCRLDLTSLDIPLLMASFILWNRSTHAFDLPCGPASPTLLDIAAITGLRPIGERYAMGLIKDEINVETVGVNFRYSTYRRYIKEHQGEAALKVTKNVFNLAQALHLGKDICLSKFLLASLYKAMDEAVDIFKAPYLLRNFSGPLWLMQLWLNAIFEKKLNLKGEATMQKVEGARLTYLTRKKEYTVEAFKEYISTFLSFEEFTDDLAPFLRPSLIGPKWLKLRFPCENRGEQSELINIWSAFLTGDIIFTGTMERDIRFYAYQPQLFARQFGLSQLLPVPVMKQRLKPDHILNKKFIPDLINTAISKPQPSFTPVSFENNFYGIQPFFDWWKSYYSKKPIIINQIFEKLTNSITFPELDLKAAEPLTLPKRNEDWESAEEEEDQLITPKASRIRKGTSLSETSNRSSKKSFVKNKEVKTSKKGTLTPITQEKITGPAKEASKGKALATEDRRPSKQIQSTMPKLMASGIVSARVEVTQELNFQSDDLDLGKSLVSTKFAFPLPDWEKTSINPGIDEEYICRTPSPLIPVGDEQHPIRKIVR

SEQ ID NO: 176444 - protein, 84 aa, Glycine max
  Coding DNA Sequence Number=SeqID_59666
MEYQLDLLLNLYAPIAALEVGYVDEGGEQHNDQVVEVINVEQHKDNWFEQEICSEVKWCRALDSSSSIFGATVCSFEGLVSSKI

SEQ ID NO: 176445 - protein, 70 aa, Glycine max
  Coding DNA Sequence Number=SeqID_59667
MTKRKAKAKSKETNFDLVEIKAMQESLSQYIMIINFDEGFECEDMYSYAFSKELATMTSISNCGMMLLGE

SEQ ID NO: 176446 - protein, 495 aa, Glycine max
  Coding DNA Sequence Number=SeqID_59668
  Gene Ontology: Mol. function=electron carrier activity; Biological process=electron transport
  Homolog annotation: Hit_ID=Q6EPG5; Match level="QueryCoverage=98%, HitCoverage=96%, E-value=1e-111, Identity=44%"; Hit description =Aluminum-activated malate transporter-like
  Pfam annotation: Domain name=UPF0005; Domain location=50-456; Score =486.6; E_value=2.9e-143; Accession=PF01027.11; Description =Uncharacterised protein family UPF0005
MARGNEVVKEVEWRIKVEEDETLQKTVVGCIWAVTAGVALKLCKFVKKAWELGVNDPRKFIHCLKVGIALSAVSLFYYWKPLYDGVGGNAMWAVMTVVVVFEYTAGATICKTVNRMFGTSLAGFLGIGVHWVASRAGEQWEPVIVGVSLFLLASAATFSRFIPTLKARFDYGILIFILTFSLVSVSGYRVDELLVMAQYRICTIIIGSILCIIISVIIRPIWAGFELFVLVTGNLDKLANSLQCCVAQYFGGSEASEDSDEMSDKKLLGYKCVLSSKATEETMANFARWEPAHGRFNFRHPWRQYVKIGASMRSCASCLDALIGCINSDNQASDDMKKNMSSISMKLGANCASVIRELATTIRKMAKSSKLDILVTDMNSAAQELRSLLNSYPNLVNAPSHNAKISTQTETASPDDQAAKIEIPLMEIIQVVTVASLLIEIVARVEGIVENVEELSVLANFQAEMCVKSKQHTSDSKVSPDQQNDDEPVRTLQMV

SEQ ID NO: 176447 - protein, 675 aa, Glycine max
  Coding DNA Sequence Number=SeqID_59669
  Gene Ontology: Mol. function=transcription regulator activity; Cellular component=nucleus; Biological process=regulation of transcription
  Homolog annotation: Hit_ID=Q6EPG4; Match level="QueryCoverage=62%, HitCoverage=56%, E-value=1e-59, Identity=37%"; Hit description =Transcription factor-like
  Pfam annotation: Domain name=HLH; Domain location=476-528; Score =11.4; E_value=0.009; Accession=PF00010.16; Description=Helix-loop -helix DNA-binding domain
KVEFLEQTQSVLTEMDDDMGMFDMPGNAVLPLDCENNDLNGFLDSISSASPNNSFPSQYNTYEESVATLQGDSSYLGDQLKGTMEALVVLSDRDSADVLLKPNSSTNNLIAENPYFGVCGNELSSFDLLEQQLVSCVSAQEDADVCFTNENAFATSELLGQDLALTSLCSMDRGSFQGKLQNSLDNQYSTQSSVVTDVDFSSSLNALHGLSENLERVDMSEEILKFSSMEDLCQWFGPSPKDSICKAVIALDNTFSESTEFNPTSFDLVGSSSLNDISVTCLTGQNSNSEGKETSVVMHSTENALLDNLKLDFSYDQADEWWGNMLTPVVSGVTDTGFSECISELNTDIPTGTRKRLFSELGIDELLRGEANYNPFNSSELEHELLLPNKRQTVESSSVNRNSIPFTNLHWPGVARADLTQTFCDLDSANNLPTKKDKFPKLQTGMWNDDSHSINIGKAVPVHPQKPEEPAKPPKKRARAGESTRPRPKDRQQIQDCIKELRRLIPNDGKCSIDSLLDRTIRYMLFLQSVVKYSDKLQEPNEPKANKVVLKDSGAADGKNCGITWAYEVAHQPMLCPIIVEDMSLPGQMLIEMLCEEQGFFLEIIDIIRHFGLNILKAKMERRRNKLWARFIVEANNRHVTRIDVFLSLIRFLQQTNTSGIDSSNKNCDVIDANI

SEQ ID NO: 176448 - protein, 79 aa, Glycine max
  Coding DNA Sequence Number=SeqID_59670
  Homolog annotation: Hit_ID=Q9SVA6; Match level="QueryCoverage=55%, HitCoverage=10%, E-value=1e-07, Identity=65%"; Hit description=GTP -binding-like protein
MSWQEELERNQKASGSKSDGCARQVASYEFTTLTCIPGVITYRGAKIQIFCLWVDKPGMPKADLVVLFLIIVERRLNDM

SEQ ID NO: 176449 - protein, 49 aa, Glycine max
  Coding DNA Sequence Number=SeqID_59671
MRTREALAEIDTKQIQSEWSKKERGMDCDGGAAEDGGDGEQRTKDARLQ

SEQ ID NO: 176450 - protein, 506 aa, Glycine max
  Coding DNA Sequence Number=SeqID_59672
  Subcellular localization annotation: CTP_CleavageSite=17; ConfidenceScore=5.04e-01
MGSGSSCSHSTKGSGISHSHSTKRSGNPHSHSNLKILFIETERELIGIDFKQLLLHPEWTTIQDPIVVPIYFKINLLNFFNGKSIVGMKHITVDSNVYLIGGESLGSGAIPNKSYVSNHPDSYLGSSNRVLHLSFEKNAFSLKRTSRIKRFLYGKCSPMVENIEGKIFVLEGKPYLHDHHLNGPFEVYDPNEEYPQILNNPPPYTRYPQGKIDGHFVLGHKFIVFEKKTCETIDGYFYDTRTHSGWEKLDPYVISFFTQIGLPINGICVPYFPQLEDYKLELILARKGIEEAYALLINASSGGLLYYQSLREVFQNRFPLTETGQRVHLNNGRNFFFMLPNNQICAIWVAFDHHKTLRLFTTIFALRACFNFNAERLLLCPSHPIERRFLEVFDIHNWDCVVKNNGTYSNHICSSPEANPNANQQTPRYKSAPSTTTASVLLHVDPVQDMLLAQSQVTLLFYYLICYMVGKEEGPSPEGGSTVDCVHRQLGQVGEGECGFTHILEI

SEQ ID NO: 176451 - protein, 99 aa, Glycine max
  Coding DNA Sequence Number=SeqID_59673
MWVKPHSPSPTCPSCRCTQSTVDPPSGDGPSSSITIHLTGLMKEIITLDCEVFAGKHTLPTMVLMLVLKIFYAHWCDGPVVCKGDAEGYRVILNWGSFY

SEQ ID NO: 176452 - protein, 169 aa, Glycine max
  Coding DNA Sequence Number=SeqID_59674
  Gene Ontology: Mol. function=nucleic acid binding
  Homolog annotation: Hit_ID=Q1SLA4; Match level="QueryCoverage=74%, HitCoverage=23%, E-value=7e-34, Identity=51%"; Hit description=Zinc finger, CCHC-type; Lipocalin
MREKLKSTWKLEDGFNLMDITHGYILVNFYMDKDRDKDISGGLWMIFDPYLIVRPWTLDFLAMNMKVDKTLVWVHFPSLGMVFYEENVLLALESTIGRPIIDLNTLNMARGRFAQVCIEIDLDVPVKLHCFGDGGTTEGGWCGCDLARHGFHRVNQGINPYEPYVTIIA

SEQ ID NO: 176453 - protein, 174 aa, Glycine max
  Coding DNA Sequence Number=SeqID_59675
  Homolog annotation: Hit_ID=Q8H0V6; Match level="QueryCoverage=32%, HitCoverage=7%, E-value=7e-16, Identity=75%"; Hit description=ABC transporter protein, putative
MLPAHSGDPTHSHRPRYYSREPALCHNPHSHSYDHVLVGGVVAYCHCSRAHGRRGMWSLTSSTTAIGFDKEASQSSLSSFSTSLFNFSYGNRRIKETRGLMHLFPDDTPLTLVDLDVVEAVIQGLVLFQGGILMQVSHDEHLISGSMEELWVVFEGRVTPFHDTFQEYKILQSS

SEQ ID NO: 176454 - protein, 59 aa, Glycine max
  Coding DNA Sequence Number=SeqID_59676
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q6YXZ6; Match level="QueryCoverage=96%, HitCoverage=15%, E-value=4e-11, Identity=51%"; Hit description =Putative beta-1,3-glucanase
MTLPDLQTIQSALVKTGLGNQQSAQVPSDGDFRQDIHDLMVQTVKFLSQNNLYPFISLY

SEQ ID NO: 176455 - protein, 66 aa, Glycine max
  Coding DNA Sequence Number=SeqID_59677
MADSEIGKQIYTPQQYHKEIRMKRPQYRPPNRQPSRKKNPTRRTLLQRLFEQNQYVYKRSITDKKL

SEQ ID NO: 176456 - protein, 156 aa, Glycine max
  Coding DNA Sequence Number=SeqID_59678
  Homolog annotation: Hit_ID=Q1SM62; Match level="QueryCoverage=28%, HitCoverage=14%, E-value=1e-11, Identity=70%"; Hit description =Glycoside hydrolase, family 17
MPTIVGEAGWPADRDRNANLQYAQRSNQSFMSRYIAGKGTPMRPVLNRHGKKIRIRGYPSESVPTLTGNTRVDRVWVRVRVFPDNQKSGTVLNRHGKKTRTRGYPSESVPTLTGNTRVDRVWVRVRVFPDNQKSGTGTSMGLLDRSRPRTRTRPAT

SEQ ID NO: 176457 - protein, 275 aa, Glycine max
  Coding DNA Sequence Number=SeqID_59679
  Gene Ontology: Mol. function=nucleoside-triphosphatase activity; Cellular component=membrane; Biological process=defense response
  Homolog annotation: Hit_ID=Q1SI25; Match level="QueryCoverage=99%, HitCoverage=29%, E-value=1e-118, Identity=77%"; Hit description=NB -ARC domain, putative
MDEDESIELFSWHAFKQASPREDFIELSRNVVAYSAGLPLALEVLGSYLFDMEVTEWKNVLEKLKKIPNDEVQEKLKISYDGLTDDTEKGIFLDIACFFIGMDRNDVIHILNGCGLCAENGIRVLVERSLVTVDYKNKLGMHDLLRDMGREIIRSKTPMELEERSRLWFHEDALDVLSKETGTKAIEGLALKLPRTNTKCLSTKAFKEMKKLRLLQLAGVQLVGDFKYLSKDLRWLCWHGFPLACIPTNLYQGSLVSIELENSNVNLLWKEAQNI

SEQ ID NO: 176458 - protein, 770 aa, Glycine max
  Coding DNA Sequence Number=SeqID_59680
  Gene Ontology: Mol. function=RNA-directed DNA polymerase activity; Biological process=RNA-dependent DNA replication
  Homolog annotation: Hit_ID=Q1SFJ7; Match level="QueryCoverage=35%, HitCoverage=39%, E-value=2e-48, Identity=34%"; Hit description=RNA -directed DNA polymerase
GIMGMDISTTYLGDDMVLVFGLNIERAKQLMNEFGHTRAGEVPAIKKILGVMGDVVEIDEEVEERRRMDRVRVLLKTPWKLFIQYTVNVHIGTEVYEVQIMEERAPYVDLWQGARRSGMLSLEDIDSDRSLMESPASARSQGRTFEIATADNEERPNTTAPHQTGSRSHDDDDTQQVEVMSCGHMEKARKKVQWRPWGGLQIWTATLKRKVGQWGGKGKWQTNVVSCRGGHLHPGRCIPEPGGATSKRRKARKLKKPKLLMPQDQQENGQSGNTEKQYVEEHTTLGENMRHEAATIWDLAKKLGGVKWAAIRRLIKKENVDLICIQEIKKEIIEKSTCQALWGDPAMSWELQPAVNSAGESYACGQWIKEAVQVHIVTVYSPCDIQKKRILWDAIKQMKSANHGDLWCISGDFNNIRDPVERVGVCQRTIEESSIKEFNDWIDELEVVEAPWTGSQNGSEAYNNLWTGIFLITAQCCFGPRVLANPPAKRMGRICVERKNKEIEGKKERARWVKERDCNSRYFHLLVNANRRGNSLHGLWIDGEWVEESARVKEAACLFLLHKFQEEDHNRSHLDGIEFKAIDHHHNDMLIRRFLEEEIRDAVWGCRSEKSSGPDGINFKFIKRFWHLLKPDVLQFLDEFYVTGIFPKGCNASFIVLIPKIVAKLLANILKKVMPFIIDEGQSAFIEGRHLLQSPNEVVDEARRSQKPCLVFKVDYEKAYDLVSWDFLENVRAIKAILRIFELASGLKINFAKSCFGAFGVQELWKSEVA

SEQ ID NO: 176459 - protein, 130 aa, Glycine max
  Coding DNA Sequence Number=SeqID_59681
  Gene Ontology: Mol. function=RNA-directed DNA polymerase activity; Cellular component=chromatin; Biological process=RNA-dependent DNA replication
MVEIKGDPGLSRTLVSPHTLLKMTQVEEISMIWVLEVEENSEAVPIQNGMIVREYAQVFSEPQGLPPSREVDHIIPIKVGVDPVKVRPHRHPYLQKHEIEKQVVDMIKLGIIRPSNSPYSSLVILVKKER

SEQ ID NO: 176460 - protein, 86 aa, Glycine max
  Coding DNA Sequence Number=SeqID_59682
  Gene Ontology: Mol. function=RNA-directed DNA polymerase activity; Biological process=RNA-dependent DNA replication
MQYLREVLETLVKKLFFDNLKVEYLGHLISQQGVAMDTKKVEAILKWSIPKSVMALRGFLGLAGKGIGVVLSQNRKAITFSSKPLS

SEQ ID NO: 176461 - protein, 519 aa, Glycine max
  Coding DNA Sequence Number=SeqID_59683
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q9M088; Match level="QueryCoverage=90%, HitCoverage=89%, E-value=0.0, Identity=66%"; Hit description =Putative glucan endo-1,3-beta-glucosidase 5 precursor (EC 3.2.1.39) ((1->3)-beta-glucan ...
  Homolog annotation: Hit description=endohydrolase 5) ((1->3)-beta -glucanase 5)
  Pfam annotation: Domain name=Glyco_hydro_17; Domain location=26-383; Score=228.8; E_value=1.2e-65; Accession=PF00332.9; Description =Glycosyl hydrolases family 17
  Pfam annotation: Domain name=X8; Domain location=402-486; Score =122.9; E_value=8.7e-34; Accession=PF07983.3; Description=X8 domain
  Pfam module annotation: Pfam domain module=Glyco_hydro_17::X8; Domain location=26-383::402-486
MVCGKLRGCLVLVFFAALLVGLVNGIGVNWGTQLTHPLPASTIVKMLKDNGIQKVKLFDADPDILNALKKSGIQVMVGIPNDMLYTLANNMQAAEKWVSKNVSAHVSSGGVDISREFGGFVKDCGICFNAFEKKWYRTILEEIIVTGSGILHIIIKMGNEPFLSTYNGTFEAITLPALQNIQSALVKAGLGNQVKVTVPLNADVYQSTQVPSDGDFRQNIHDLMVQIVKFLSQNNAPFTVNIYPFISLYSDSNFPVDYAFFNGFQSPINDNGRIYDNVFDANHDTLVWALQKNGFGNMPIIVGEVGWPTDGDRNANLQYAQRFNQGFMSRYIAGKGTPMRPGPMDAYLFSLIDEDFKSIQPGNFERHWGLFYYDGQPKYMLNIGSRANGLVAATGVAYLPKKWCILKTSANLNSDQVAPSVSYACQNADCTSLGYQTSCGGLDARGNLSYAFNSYFQVNDQIDSACKFPGLSVVTDKDPSTGDCKFKIMIQTDSAGLHGNGRIWSLRIVLFVLLFFTLM

SEQ ID NO: 176462 - protein, 125 aa, Glycine max
  Coding DNA Sequence Number=SeqID_59684
  Gene Ontology: Mol. function=endonuclease activity; Cellular component=cytosol; Biological process=DNA repair
  Homolog annotation: Hit_ID=UPI0000610A8E; Match level="QueryCoverage =88%, HitCoverage=44%, E-value=3e-20, Identity=43%"; Hit description =UPI0000610A8E related cluster
  Pfam annotation: Domain name=Endonuclease_5; Domain location=1-124; Score=-42.2; E_value=0.00035; Accession=PF04493.5; Description =Endonuclease V
MFGVTENLRGSFGLACHIGVEANLPTIGIGKNLYKLQLHHVDGLTHSRVRELLGAEENCSEDFINLVGCSGHIWGVAMRSTQGSIKPIFISIGHKISLQTAIMIVQMTCKYRVPEPIRQVKLSAI

SEQ ID NO: 176463 - protein, 108 aa, Glycine max
  Coding DNA Sequence Number=SeqID_59685
MVVPKSEKMQRQVETNKEQAYNHGYLKENHEGQTGASFLIEIARQIWKIPFRLKGSSRCGVSKENNGGPWWPLVAVGGGEEAWDIGNGFGRKKEKEMAFFQGFTKSKF

SEQ ID NO: 176464 - protein, 228 aa, Glycine max
  Coding DNA Sequence Number=SeqID_59686
  Homolog annotation: Hit_ID=Q10HC5; Match level="QueryCoverage=42%, HitCoverage=14%, E-value=1e-40, Identity=86%"; Hit description=CBS domain containing protein, expressed
  Pfam annotation: Domain name=DUF21; Domain location=3-160; Score= -16.8; E_value=4.2e-05; Accession=PF01595.10; Description=Domain of unknown function DUF21
  Pfam annotation: Domain name=Pyrophosphatase; Domain location=143 -228; Score=0.5; E_value=1.4e-08; Accession=PF00719.9; Description =Inorganic pyrophosphatase
  Pfam module annotation: Pfam domain module=DUF21::Pyrophosphatase; Domain location=3-160::143-228
MCKVRELAEKEPENGVFRLLRSDVTRFLTTILIGTTVVNIGATALVTEAATAMFGEAGISAAIGAMTVAILLLTEITPKSIAVHNATKVSRFVCDCHSFLLICERKYGLDDNTIHFIGHALALHSDDRYLVEPALNTVKRMKVVEITKGSKVKYELDKRTGLIKVDRVLYSSVVYPHNYDFIPRTLCEDNDPIDILVLMQNISTLPAIENLHLIASPRFDASLKTRHA

SEQ ID NO: 176465 - protein, 113 aa, Glycine max
  Coding DNA Sequence Number=SeqID_59687
  Gene Ontology: Cellular component=exocyst; Biological process =exocytosis
  Homolog annotation: Hit_ID=Q5Z4V4; Match level="QueryCoverage=89%, HitCoverage=17%, E-value=2e-10, Identity=30%"; Hit description =Putative Exo70 exocyst complex subunit
MVLYTLRGWGKLLSILVVPRDILSPSSVSVTSQDLENRLNAFNLAFDERYKKQSNWVISDEILRENVCKHLVEENDAKVDKYMKYMAQSLENKIGSLFQPKQRKVTDLTLAAL

SEQ ID NO: 176466 - protein, 68 aa, Glycine max
  Coding DNA Sequence Number=SeqID_59688
FYGVAVTSSKGIRPLTNRAFIKKCCVSRQAQGETPQQPGDGRQRATDAPPSPLEFTSAHPQKVIAGHT

SEQ ID NO: 176467 - protein, 272 aa, Glycine max
  Coding DNA Sequence Number=SeqID_59689
  Gene Ontology: Mol. function=aminocarboxymuconate-semialdehyde decarboxylase activity; Cellular component=cytosol; Biological process=metabolic process
  Homolog annotation: Hit_ID=Q1LCQ5; Match level="QueryCoverage=59%, HitCoverage=48%, E-value=4e-68, Identity=77%"; Hit description =Amidohydrolase 2
MHPGAGAPLGHDDRRPHEALDAAVAGRHARRNAAGHPVADPVGRVRAHSAQPEAVFRPRRRQLRLPAGARGQRLAPPRHRASGLSAAALVVHRPLLRRLRRVRSALAAAVDRRDGRGPRAAGLRLSVPAGRTGGRPAGVEFRPVARGAAQDPGGQHADVLRAGSLSRPPTMTVTHGNARGFTMKRIHLLAAAAAVALAPGAATWADVKIGLLTTLTGPGSVLGQDQLDGFMLAVEHGGGKLGGVPVQVIKEDDQFKPEIGVQAARKLVQSDE

SEQ ID NO: 176468 - protein, 144 aa, Glycine max
  Coding DNA Sequence Number=SeqID_59690
  Gene Ontology: Cellular component=chloroplast
MYEFSRREEPWWSPPDRPDPTSEEKVGSTLGSHLNRPIYPPEDKFGFKPQIQTGEVRHANVPWMIHISGSGADEHIKLSMWLRALTVQAQRRNYQRARSTTELIARLRLPCYDFTPVTSPAFGIPLLAVKVTTSGMASSHSVTG

SEQ ID NO: 176469 - protein, 208 aa, Glycine max
  Coding DNA Sequence Number=SeqID_59691
  Gene Ontology: Mol. function=transcription factor activity; Biological process=regulation of transcription, DNA-dependent
  Homolog annotation: Hit_ID=UPI00005F6FD0; Match level="QueryCoverage =34%, HitCoverage=62%, E-value=9e-23, Identity=55%"; Hit description =COG3558: Uncharacterized protein conserved in bacteria
EPVAGVVAPLVGIAHRDAEGARLIAIADEFGAVAPARVQAVGQRHLVGVAAVPAVFGQADLLHRAGVGEGRKRRAGSGGGCHGGYLTAGARKGVAANRDGKGKRGATRHRDRAIDEHQQLRGGLVGVRQCGGAGQRPHVLQQAGLVLARHRQDRAGLVTDLSGRVQESAATKIVGAELFPQGVEHRQQPGARGLRPLAGRDEPLHPPL

SEQ ID NO: 176470 - protein, 259 aa, Glycine max
  Coding DNA Sequence Number=SeqID_59692
  Gene Ontology: Mol. function=transcription factor activity; Biological process=regulation of transcription, DNA-dependent
  Homolog annotation: Hit_ID=Q2L354; Match level="QueryCoverage=56%, HitCoverage=90%, E-value=3e-70, Identity=87%"; Hit description =Putative cation uptake regulatory protein
MLLPQAARAAVSGRTQDYSTVGGGGQTPGQPEGVAAQIAAVRRQVSGDITILGRFSGFQGPDRGAPVGAGGTGARAGRRRPCPMPSMMMVMMPAIGGLLLLALRAQRADFGLVGGQRVAGLGNAFGQLPAHGGIGYLGHRAATGTDHQQVVGSAADVVAGAPGVDGVQSVDQAFVHQEVEGAVHRRGRGARMHFTHGVEQLVGFQAAAMAQQQFQHLAADGGQAPAALFAQRLGDAELGAYGVTAGGTGPERAWRASSE

SEQ ID NO: 176471 - protein, 49 aa, Glycine max
  Coding DNA Sequence Number=SeqID_59693
MKLNEERRRNTQEKDLLLRQEELDNLLFRISQISPLGVHSWLFGRCNKQ

SEQ ID NO: 176472 - protein, 788 aa, Glycine max
  Coding DNA Sequence Number=SeqID_59694
  Homolog annotation: Hit_ID=P45475; Match level="QueryCoverage=30%, HitCoverage=97%, E-value=2e-87, Identity=69%"; Hit description =Hypothetical protein yhbV
  Pfam annotation: Domain name=SCP2; Domain location=565-671; Score =51.8; E_value=2.3e-12; Accession=PF02036.7; Description=SCP-2 sterol transfer family
  Subcellular localization annotation: CTP_CleavageSite=29; ConfidenceScore=5.14e-01
MAQEYSRNVPLTAAIQRHSGQAAPVTVAVAAARHHQRRFTRFVSAEAINLCQRALILRRQAHNIDPAMHTGEIVAKVVTVAAHGLNAVQDKHLLALLRQHAASGGIINTAAPAADGHSRALQPQTDRAGQRHGTAATAESASRVTSPPACTSASCPPAAAAGASAQLTVFNIAAQLFDFGRRLQQRQRAQHHLFAAGRQRAAHLHPLNERSGAAFAAHRFAEVDNLCAAFCGALVKLLQRGGWPVPQHRADGVFHTVSLLPVAVIGAEGGLAAFRKFTERAHPRLLHRELLRIGHAAIDRLTPHFSHLRHIGRAALASLNFHRGDIGAQQLWQQRQGIEAARDSAGYPPRSALYTASDSPRSHRRRNGTRAVRRLAGQPRREIAAAFGHDAQAAKGEYFERHRRFARQLLHLVHRQHARQHHAAQRKVAVTFNLRIAAGGVLQRGDIGQNQRIGTVLCGDVNGALPAVKAVGMGEGVDRHVQFTPVLMQEARGFCQFLIGRRTPRQRRAPPPISAQAVKAGLPGRNGEFSHRHGAISLIPVEAKADGWPEFLALPVSLTPFAVKKTVLQQLLNWQFRHALAEGELDFLQGRYLGIEIADVNLRWITTLQDGRLTVSRDAEADVWFRGEANDLLLIAARKADPDMLFFQRRLVIEGDTELGLEVKNLMDAIELDAMPTPLRTGLLQLAAFVEAGMTQDAKAAEARAGISCIDSLLKRSFATAAEAELVQQLREDGLLTLGVVATDDEGQVLGYAAFSPVTLQGEDRNWVALAPLAVDASVRSQGIAKQL

SEQ ID NO: 176473 - protein, 96 aa, Glycine max
  Coding DNA Sequence Number=SeqID_59695
MEEFEEILGCPLGGRKPYLFSGFYPSMARIAKVVKISVQELDQVKQNRNGVVGILRKHLEGKAEALANQDLAVIDDFLAYHHSKESSVVVVLADAL

SEQ ID NO: 176474 - protein, 243 aa, Glycine max
  Coding DNA Sequence Number=SeqID_59696
  Homolog annotation: Hit_ID=Q47522; Match level="QueryCoverage=20%, HitCoverage=69%, E-value=5e-14, Identity=71%"; Hit description=LacZ protein
VPPVQLLTGWCVTAKAPPDISAGKCSGHAARRVPFAIQAAQLLGRAIGAGLFAITPAGERGMCCKAIKLVGEIRPFTVQIFGDSLKVLRDISQTGDFYGISGRGGTNLRIPPASVKPQTHIHSLSGIDSQNGGLLAADNDLICYTRIFIGRQYILGYLQRNICTIDFKQPKIGIKKIGGARYQLLFPLVRVNFELGVIMVIAVSFGKPVVPAALMNRPTRGERRFAYWALAECILAYYVGTDE

SEQ ID NO: 176475 - protein, 121 aa, Glycine max
  Coding DNA Sequence Number=SeqID_59697
MCVVLIGLGISKEGQLSDPNFVWELLFTVVLILANQKVLFDTNFCTRREIVQRFGQGCGKYPREGQKGHFKQFYGPWLGQAIFWITWAPKLFRAEGTSSPGRAAALLSEPVSSGLSNNSLG

SEQ ID NO: 176476 - protein, 327 aa, Glycine max
  Coding DNA Sequence Number=SeqID_59698
  Homolog annotation: Hit_ID=Q47522; Match level="QueryCoverage=19%, HitCoverage=83%, E-value=1e-21, Identity=75%"; Hit description=LacZ protein
WNSYVPINVSFSPKVGPRASRYQQGHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSIALKLSHKQIRPISEIALSASNQMLACGYKRSSFSTAVSAKRVSSNIDDSITLRSMSSNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 176477 - protein, 380 aa, Glycine max
  Coding DNA Sequence Number=SeqID_59699
  Homolog annotation: Hit_ID=Q5PCG7; Match level="QueryCoverage=93%, HitCoverage=93%, E-value=1e-158, Identity=73%"; Hit description =Outer membrane protein
MKMRAFTLSAVAALLVAAPLASQAEITLLKQDPQAGDPLSRLDFKVGGSIRPQYLHQNGVNDKSYKRNGYDGGSRFRFSANYYLFDDVSWVGYYELGVNFPAWWGWDNHYADGAHNTTRRQLYTGFKSASLGELYFGQQNSVYYDVVGAKTDIWDYDMLAQAPGNGINGDYDGSYRSRKMLKYKNTFGDADVYAAYLFEDDDYLPGNGLRYKRKGGGSLGVNYHITKDLAWGTAWNYTRADIRNPGNGDSKRYDQNIYGTALSWTPDNWTLSAGAGWYENFSPTKRNTVNNYFADDAWGVEYFAGYKFPIGQYAVKSIQPYFMGNRLEFVNGRNYKRIDNGVGVSAQLDYGFRVDYEYVITSSTDKSLGNVNLVRLRYDF

SEQ ID NO: 176478 - protein, 271 aa, Glycine max
  Coding DNA Sequence Number=SeqID_59700
  Gene Ontology: Mol. function=dihydrodipicolinate reductase activity; Cellular component=cytoplasm; Biological process=lysine biosynthetic process via diaminopimelate
  Homolog annotation: Hit_ID=UPI00005F7074; Match level="QueryCoverage =99%, HitCoverage=98%, E-value=8e-87, Identity=62%"; Hit description =COG0289: Dihydrodipicolinate reductase
  Pfam annotation: Domain name=DapB_C; Domain location=130-267; Score =277.9; E_value=2e-80; Accession=PF05173.4; Description =Dihydrodipicolinate reductase, C-terminus
  Pfam annotation: Domain name=DapB_N; Domain location=4-127; Score =235.9; E_value=8.8e-68; Accession=PF01113.11; Description =Dihydrodipicolinate reductase, N-terminus
  Pfam annotation: Domain name=GFO_IDH_MocA; Domain location=4-127; Score=-12.8; E_value=0.018; Accession=PF01408.12; Description =Oxidoreductase family, NAD-binding Rossmann fold
  Pfam annotation: Domain name=Semialdhyde_dh; Domain location=5-115; Score=-23.7; E_value=0.053; Accession=PF01118.15; Description =Semialdehyde dehydrogenase, NAD binding domain
  Pfam module annotation: Pfam domain module=DapB_C::DapB_N::GFO_IDH _MocA::Semialdhyde_dh; Domain location=130-267::4-127::4-127::5-115
MSEIRIAIVGAPGRMGRNLIQAAQQAEGVVLGAALARGGSSLLGADAGELAGIGKTGVRVTDDLRQVVNDFDVLIDFTRPEGTLEYLAFCRQHQKAMVIGTTGFDEAGKAAIREAAEEIGIVFAANFSVGVNLVLNLLQQAAKVMGDYADIEIVEAHHRHKVDAPSGTALAMGEAIADAMHWKLDEHAVYAREGHTGERKAQTIGFATVRAGDIVGEHTAMFADIGERVEITHKASSRMTFANGAVKAAAWLKDKKSGLYDMRDVLDLTML

SEQ ID NO: 176479 - protein, 83 aa, Glycine max
  Coding DNA Sequence Number=SeqID_59701
MSGFTCNSPQISASPHQLDLAPYASEPYNAQWNAPGLLRDKHTLRSSRILGEMEVDEPWLGLWLPLNYQVVFIIGSAVDRLCG

SEQ ID NO: 176480 - protein, 285 aa, Glycine max
  Coding DNA Sequence Number=SeqID_59702
  Gene Ontology: Mol. function=electron carrier activity; Biological process=electron transport
  Homolog annotation: Hit_ID=UPI00005F72E0; Match level="QueryCoverage =64%, HitCoverage=29%, E-value=2e-67, Identity=68%"; Hit description =COG3519: Uncharacterized protein conserved in bacteria
MPPGCDPDGARCARAHILSGGSAADRWGQTGQSCKSPRHGARPLRAAARWPALPGQTPATVSDQCAALRTSAAAHVPADSAGRPAHPAGAAAETDRSATRLPAHARRPVAHLAALLAVEGEFGKAIQRHQPTADAFQHAAEQPRAGTGERLFVDLQRDADAARKHHRARFRHPAIDRAKLAVANTVNLARHRRFGEISVQAQQLAQRGGALAVAAVHQAQVVHLQVADQTPRGEPFGQRRTRRRRAFTQLQLTDRDRIRHDEIALLLLQQHQRQVAAGAEHVCRQ

SEQ ID NO: 176481 - protein, 81 aa, Glycine max
  Coding DNA Sequence Number=SeqID_59703
  Gene Ontology: Mol. function=sequence-specific DNA binding; Biological process=regulation of transcription, DNA-dependent
  Homolog annotation: Hit_ID=Q83M35; Match level="QueryCoverage=97%, HitCoverage=60%, E-value=9e-25, Identity=68%"; Hit description =Hypothetical protein ybaQ
MTLQVKPEFNRGGENPCQPVGHLSAEFTVVIHQRADGVAMHIQHLRQIIHFEVERFEKFILQDVPHAGGFAHCLFHKVLSL

SEQ ID NO: 176482 - protein, 58 aa, Glycine max
  Coding DNA Sequence Number=SeqID_59704
MSEVATNIYSRKTLEKSKRGLRILKRRIRELFTPGEGSTTGLPLLLHILRCDEEFKPT

SEQ ID NO: 176483 - protein, 139 aa, Glycine max
  Coding DNA Sequence Number=SeqID_59705
MTDLVSAEDDVNLRVSTGLSAAIDKGRRRRHSKKVVYTDNHSGISARQRDSKVSMTDLVSAEDDVNLRVSTGLSAAIDEGRKRRHSKKVVYTDNHSGISARQRDSKVSMIDLVSAEDDVNLHVSTGLSAAIDEGHRRRR

SEQ ID NO: 176484 - protein, 98 aa, Glycine max
  Coding DNA Sequence Number=SeqID_59706
MLPVSYYEKMVVYMPSSFADLVFAGERIEVGLRRGKFDCLALTSKKPGANRENEKGEGTCVLTAIPTWPNFLPAQQFHYSANVSPFHYPPPNHPRGHH

SEQ ID NO: 176485 - protein, 77 aa, Glycine max
  Coding DNA Sequence Number=SeqID_59707
  Homolog annotation: Hit_ID=Q1SZM6; Match level="QueryCoverage=88%, HitCoverage=23%, E-value=2e-07, Identity=40%"; Hit description =Ribonuclease H
VVIYHPHATIIAAIRSLIHTNWNLTLNQTLRQGNTVANYLAKEGAKSIAQFSSLHACPAGLYHSVATDVVGTMYPRQ

SEQ ID NO: 176486 - protein, 94 aa, Glycine max
  Coding DNA Sequence Number=SeqID_59708
MTGHASQWGDQSGSRCFTRMPQPCGISTGLKKHSNRMTPKAYTPKSPSGPLDEDITKGKDHEALEGPMTRGRLKQAQHVIETKLVICIAAIDDD

SEQ ID NO: 176487 - protein, 51 aa, Glycine max
  Coding DNA Sequence Number=SeqID_59709
MEFSNPRVAPCFGYRNFFQPSSSLGQPPLWLLIHSLKRVRIGGFRLPPDLG

SEQ ID NO: 176488 - protein, 70 aa, Glycine max
  Coding DNA Sequence Number=SeqID_59710
MVKIRHNKATPCHIKSPKLKTLEITKTSHNKSTSHPSEQGVINLAFRDLDYVETSSNPRSELTLCKDLIV

SEQ ID NO: 176489 - protein, 494 aa, Glycine max
  Coding DNA Sequence Number=SeqID_59711
  Gene Ontology: Mol. function=translation initiation factor activity; Cellular component=eukaryotic translation initiation factor 2B complex; Biological process=cellular metabolic process
  Homolog annotation: Hit_ID=Q9FFV8; Match level="QueryCoverage=97%, HitCoverage=74%, E-value=1e-170, Identity=64%"; Hit description =Similarity to guanine nucleotide exchange factor
  Pfam annotation: Domain name=IF-2B; Domain location=185-478; Score =310.6; E_value=2.8e-90; Accession=PF01008.8; Description=Initiation factor 2 subunit family
MASKNRAEKREESGKEVHPDLPSISKPLKEKNTKGERRALQEAQRAAKAASKVVLHPADGNTTVAETRRAAPSKRMWQSSQKKDGPLVMSPVATDKKSGDRPLEKERKKDAPPPRMQFDDKNRVEKAKRRAVVDQNEARNRVELFRHLPQYERWTQLPKLESKFFQLDSVHPAVFKVGMRYLAGDISGSNARCIEMLRAFQEAIIDYSTPPGKVLVRDLTAKISSYVSFFSECRPLSISMGNAIRFVKSCVAKLPLSHTESEAKAALCSDINQFINEKIILADKVIVGHAASKVRDGDVLLTYGSSCVVEMILLYAHDLGKQFRVVVVDSRPKFESRALLRRLVARGLSCTYTHINAVSYVMHEVTRVFLGASSILCNGTAYAKVGTACVAMVAHTFRVPVLICCEAYKFHERVQLDSICSNELGDPDAVAVVPGRMDVNYLDNWTNQDNLQLLNLFYDATPSDYVSAIVTDHGMIPPTSVAVIVREYGREHLI

SEQ ID NO: 176490 - protein, 668 aa, Glycine max
  Coding DNA Sequence Number=SeqID_59712
  Gene Ontology: Mol. function=RNA-directed DNA polymerase activity; Biological process=RNA-dependent DNA replication
LPRITFTIRDFKGINPINQDDPMVISTIIVNFMVSKALIILGSSTDILYWKIFQRLELSSDTVHPHSGPLLEFEGEKCYTGSLRVAPYHPTREHDSPYPITGGGTQVMSVNEGSPIRALTIYEASLDGIFDVDPHVDTADRGPKLIEELINHLKCRVSIPTLYATSFPSVPRPNQYHKRRGRWDKSEANSKWRMCTDYIDLNRACPKDAYPLPNIDWLVNEASKFQVYVNDMVVKSQSIAQHVADLEDVFGEIYKYYMRLNSEKCTFGVNGGKFLGFMITHREIKANLDKCTTLLKMYNPTSVQEIQKLNSKLASLSRFLLKLTKKVKPFYKLLRKTEPFLWDEACKQAFLVFKKTITTPSILSKPRPGAPLLLYLTVADKVVSSTLVQEEGLEPTSWETPAQRLRPYIQSHQVIVKTNYPIKQRQARTARGGYWWLWVVEEEFLGLFHVEERIYNLQILFNELVSLTKNPFLALSVTFCVEHNSSQVGIFAKRDISHLAQFLSGDRMVNKCKTMVLPEQVGLSLVSPDKTQDKRILGRRSTSSSNPRSALVSQARQTQSPPLVNLASPKARQTQGPSLVSLTGSSNPRSTLGDSHFSKGSSNPRTILGESHRLVKPKVRPCLTGSSNPMSALDESQRLIKPKSRQTQGPSLMSSLLLRLVKLKAHPW

SEQ ID NO: 176491 - protein, 123 aa, Glycine max
  Coding DNA Sequence Number=SeqID_59713
  Gene Ontology: Mol. function=RNA-directed DNA polymerase activity; Biological process=RNA-dependent DNA replication
  Subcellular localization annotation: CTP_CleavageSite=85; ConfidenceScore=5.08e-01
MGLSHVRMDMAKVGSKISQVRLRVVFVKRTRGGACKTKDSDAQQSLVEHNSDSKSQASVPFTFSEFSPFESMNFPIIHRSSPEKSCSHPVNIITKSFWQFKASHYAVQGICHDSPLPLHPTTL

SEQ ID NO: 176492 - protein, 84 aa, Glycine max
  Coding DNA Sequence Number=SeqID_59714
  Subcellular localization annotation: CTP_CleavageSite=15; ConfidenceScore=5.35e-01
MAHSHNSIGSIFNCRVFAIKQPHVSPVRPMISAVSVLDSSTNMDFSQIDLSRLQVPRTPPQKIPYRICPNPSAIIWRSRKSRRR

SEQ ID NO: 176493 - protein, 118 aa, Glycine max
  Coding DNA Sequence Number=SeqID_59715
  Gene Ontology: Mol. function=oxidoreductase activity; Biological process=electron transport
  Homolog annotation: Hit_ID=Q7EYS3; Match level="QueryCoverage=77%, HitCoverage=14%, E-value=9e-17, Identity=48%"; Hit description =Glycine/D-amino acid oxidases-like
VQEPQQVVSTIPSLFGSSDLADKAEGSYDVLVCGGTLGIFIATALCARGLRVAIVERNVLKGRDQEWNISTKELLELVEVGVLEEDDIERATAVKFNPVIPELLQFSFQSIYSKNHLN

SEQ ID NO: 176494 - protein, 427 aa, Glycine max
  Coding DNA Sequence Number=SeqID_59716
  Gene Ontology: Mol. function=pepsin A activity; Cellular component =anchored to membrane; Biological process=proteolysis
  Homolog annotation: Hit_ID=Q9LS40; Match level="QueryCoverage=87%, HitCoverage=70%, E-value=5e-46, Identity=31%"; Hit description=CND41, chloroplast nucleoid DNA binding protein-like
  Pfam annotation: Domain name=Asp; Domain location=64-425; Score= -150.4; E_value=0.0001; Accession=PF00026.14; Description=Eukaryotic aspartyl protease
MNILLTFWCALLITSIPLSHSATILSIPLYNRAMLKYDTFKPHARFHYYPNTKVISDIYSADDAYAMFLWVGTPVQIVFVMIDTGSPITWFQCDPCSNCYPMQRPPFNTRASTSFKELGCYSDTCLIPMMRGIFGNCTGWTCRYNMQYEYDYANMSQSRSFGMMVTETLNFEHSNIQVKDFIMGCGDSYEGPFRTQFSGVFGLGRGPLSVQSQLHAKAFSFCVVSLGSEKPSSLEFYDTQPPKTNQNGNTNGSIMVPLSENNRYPYYYFVQFVGISINGFMLDIQSRVWGYGLNYDGGIVIDMGTVLTYLPGEAYSVFRSEILKTNGNLTKKSGFEELEFCYKEDPTNVYPTIEFFFQNGDIAGLNFVSFKLDNNQLLLQVEEGTVCLSFAEGKDSALTVIGSNNLQGTLLTYDLVNEILVFTYNKC

SEQ ID NO: 176495 - protein, 295 aa, Glycine max
  Coding DNA Sequence Number=SeqID_59717
MHEFSIVDGFVEISECMAEMTKYVANEPSVGLFFIQQHAQNAVPNIIKVKKNVVEKSHETTLHTEDLEDSVTMVQSMKECGFPIADKMIREIKKSLITMETKQPKRGLIHPASSSHSERASFLGNAAFYAQEGNEKRSNYFSNVLKSAKEKAGSFKWRQLDTRGSIDSTDEKPPMYPNLPLLVTSASITSSFRAAETDELPVSSQVEDESQHKQTDVSDISINLLSVSERFDDFKANKEAKLAEWLDGTGNLDDNCGTGDEKSMTAINHGKLDDENIPKEMYGISGRELFNVAAP

SEQ ID NO: 176496 - protein, 151 aa, Glycine max
  Coding DNA Sequence Number=SeqID_59718
  Gene Ontology: Mol. function=glycerol-3-phosphate dehydrogenase activity; Cellular component=glycerol-3-phosphate dehydrogenase complex; Biological process=glycerol-3-phosphate metabolic process
  Homolog annotation: Hit_ID=Q9SS48; Match level="QueryCoverage=79%, HitCoverage=19%, E-value=6e-34, Identity=64%"; Hit description =Putative glycerol-3-phosphate dehydrogenase
MTRLRKLGTVATAIATAYGGALILHEPLVSASDHGGGSRLEALRKKVHDSDAVVPARKAQLSALEAAGKSNPLDVLVIGGGATGSGATLDAVTRGLRVGLVEREDFAAGTSSRSTKLLHGGICITVAAIVAVAIHTLTWRRVADRFLKPWL

SEQ ID NO: 176497 - protein, 80 aa, Glycine max
  Coding DNA Sequence Number=SeqID_59719
MELYPQHVANQQAANHRGHVQLNESFYQYTLHQSRQDPNPYSWLTLEPSFQAGARPTWVPGDEDGAQEDDDMADVMDFFL

SEQ ID NO: 176498 - protein, 528 aa, Glycine max
  Coding DNA Sequence Number=SeqID_59720
  Gene Ontology: Mol. function=ATP-dependent helicase activity; Cellular component=nucleus; Biological process=rRNA processing
  Homolog annotation: Hit_ID=Q84T03; Match level="QueryCoverage=89%, HitCoverage=76%, E-value=1e-172, Identity=63%"; Hit description =Putative RNA helicase
  Pfam annotation: Domain name=DEAD; Domain location=102-273; Score =234.0; E_value=3.3e-67; Accession=PF00270.19; Description=DEADDEAH box helicase
  Pfam annotation: Domain name=Helicase_C; Domain location=343-441; Score=63.5; E_value=6.7e-16; Accession=PF00271.21; Description =Helicase conserved C-terminal domain
  Pfam annotation: Domain name=ResIII; Domain location=98-268; Score= -26.1; E_value=0.0071; Accession=PF04851.6; Description=Type III restriction enzyme, res subunit
  Pfam module annotation: Pfam domain module=DEAD::Helicase_C::ResIII; Domain location=102-273::343-441::98-268
MAEAEHNDPTSPEREDQTKSNKKKLRKRKRPQKTEQKQEEEKNDANIDSAQTQTEDEGENQEDTNVNNNVSSGIMSTESFSSLGLSEPTSKAIADMSFHRMTQIQAKAIPTLLTGNDVLGAARTGAGKTLAFLVPAVELLYNVQFTPRNGTGVVVICPTRELAIQTHAVAKELLKYHSLTLGLVIGGSGRKGEAERIMKGVNLLVATPGRLLDHLQNTNGFVYKNLKCLMIDEADRILEANFEEEMKQIINILPKKRQTALFSATQTKKVKDLARLSFQTTPIYIDVDDGRKKVTNEGLQQGYVVVHCAKRFVVLYSFLRRYQSKKVMVFFSSCNSVKFHADLLKCTGLDCLNIHGKQKQHARTTTFFNFCKAEKGILLCTDVAARGLDIPDVNPMEDAGAPNLVGYPRTLQERNDWIVQFDPPDEPKEYIHRVGRTARGEGGKGNALLFLIPEELQFLHYLKAAKVPVKEYAFDHKKLANVQSQLEKLVAGIYHLNVMAKDAYRSYILAYNSHSMKDIFNVHRLDLQ

SEQ ID NO: 176499 - protein, 59 aa, Glycine max
  Coding DNA Sequence Number=SeqID_59721
MVAAVEVVMVHLRLAAGGPTPTTVLASACNELRGRNQQPIELANVGSSGLRIIKNGGLN

SEQ ID NO: 176500 - protein, 234 aa, Glycine max
  Coding DNA Sequence Number=SeqID_59722
  Gene Ontology: Mol. function=long-chain-alcohol O-fatty -acyltransferase activity
  Homolog annotation: Hit_ID=Q84XY9; Match level="QueryCoverage=86%, HitCoverage=58%, E-value=5e-29, Identity=38%"; Hit description=Wax synthase isoform 1
MYGEIERFIKVWISAILGLCYCYYIAARIPKGFLRLLSLLPILYLFIILPLNISSPNLVGYTSFFLVQLGIFKLLLFSFNKGPLALSPPNIVHFISIASLPITPKQHPPTNKNNTTNTQKPKWLLPLKLLIFAMIARFYEYNEYFHPHFILVLYCLHLYLSLELVFALIATPVQTLFGLEIEPHFNEPYLSSSLQDFWCHRWNLMVRHDKKTHTGGYPPESILTLMDNTRVNRI

SEQ ID NO: 176501 - protein, 399 aa, Glycine max
  Coding DNA Sequence Number=SeqID_59723
  Gene Ontology: Mol. function=nucleotide binding; Cellular component =protein complex; Biological process=barrier septum formation
  Homolog annotation: Hit_ID=O65875; Match level="QueryCoverage=98%, HitCoverage=96%, E-value=1e-134, Identity=67%"; Hit description=FtsZ protein
  Pfam annotation: Domain name=Tubulin; Domain location=60-235; Score =267.4; E_value=2.9e-77; Accession=PF00091.15; Description =TubulinFtsZ family, GTPase domain
  Pfam annotation: Domain name=Tubulin_C; Domain location=237-359; Score=103.8; E_value=4.9e-28; Accession=PF03953.7; Description =TubulinFtsZ family, C-terminal domain
  Pfam module annotation: Pfam domain module=Tubulin::Tubulin_C; Domain location=60-235::237-359
  Subcellular localization annotation: CTP_CleavageSite=53; ConfidenceScore=5.75e-01
MAMLPLTNPTPIRYNALPSSSFVQRNCVSLNPRSRRCAFEPQRRRFASVTCCSFSTVDSAKIKVVGVGGGGNNAVNRMIGCGLHGVEFYAINTDAQALLHSAAENPIKIGELLTRGLGTGGNPLLGEQAAEESKEAIANALQGSDLVFVTAGMGGGTGSGAAPVVARIAKEAGYLTALEAIEKLQKNVDTLIVIPNDRLLDMADEQTPLQDAFRLADDVLRQGVQGISDIITIPGLVNVDFADVKAVMKDSGTAMLGVGVSSSKNRAEEAAEQATLAPLIGSSIQSATGVVYNITGGRDITLQEVNRVSQVVTSLADPSANIIFGAVVDDRYNGEIHVTIIATGFSQSFQKTLLTDPRAAKLLDRELGGQESKAVSPPLKSSNYPSTVASRASPRKFFF

SEQ ID NO: 176502 - protein, 169 aa, Glycine max
  Coding DNA Sequence Number=SeqID_59724
  Gene Ontology: Mol. function=protein transporter activity; Cellular component=mitochondrial inner membrane; Biological process=protein transport
  Homolog annotation: Hit_ID=Q10QJ0; Match level="QueryCoverage=71%, HitCoverage=61%, E-value=8e-37, Identity=61%"; Hit description =Mitochondrial import inner membrane translocase subunit Tim17/Tim22/Tim23 family protein, putative, expressed
  Pfam annotation: Domain name=Tim17; Domain location=28-146; Score =74.1; E_value=4.6e-19; Accession=PF02466.9; Description =Tim17Tim22Tim23 family
  Subcellular localization annotation: CTP_CleavageSite=38; ConfidenceScore=5.69e-01
MASDATVNSVSDVNNAPNPTKSVGPSYTPSPTASLLLPAATSTACGALTGSLFGYGAGLIKKKGFKGSFIEAGSNAKTFAILSGVDSVVVCILGRLRGKDDAINAGVAGCCAGLATSFPGTPQSLLQCCIAYGALSFIIEGLTKQRSALACPMSKKTSVRNQGIIPTSH

SEQ ID NO: 176503 - protein, 223 aa, Glycine max
  Coding DNA Sequence Number=SeqID_59725
  Gene Ontology: Mol. function=RNA polymerase II transcription factor activity; Cellular component=nucleus; Biological process=regulation of transcription factor activity
  Homolog annotation: Hit_ID=Q8LRG9; Match level="QueryCoverage=99%, HitCoverage=41%, E-value=2e-83, Identity=65%"; Hit description =Putative TAF6
  Pfam annotation: Domain name=CBFD_NFYB_HMF; Domain location=2-65; Score=13.1; E_value=0.0095; Accession=PF00808.13; Description =Histone-like transcription factor (CBFNF-Y) and archaeal histone
  Pfam annotation: Domain name=Histone; Domain location=5-68; Score =6.7; E_value=0.028; Accession=PF00125.14; Description=Core histone H2AH2BH3H4
  Pfam annotation: Domain name=TAF; Domain location=2-68; Score=139.6; E_value=8.3e-39; Accession=PF02969.8; Description=TATA box binding protein associated factor (TAF)
  Pfam module annotation: Pfam domain module=CBFD_NFYB_HMF::Histone::TAF ; Domain location=2-65::5-68::2-68
MSFVPKETIEVIAQSIGITNLSSDVALSLAPDLEYRIREIMQESVKCMRHSKRTFLTTEDVDTALALRNLEPIYGFTSNDPPRFKRAAGHKDLFYIDDKDVDIKDIVEAPLPKAPLDTSITSHWLAIEGVQPAIPENAPVEAPSEIRKSEFKEDGLPVDVKLPVKHLITRELQLYYEKITDLTLKKPGSIPFRRALVSLSADSGLHPLVPYFTFFVADEVARN

SEQ ID NO: 176504 - protein, 285 aa, Glycine max
  Coding DNA Sequence Number=SeqID_59726
  Gene Ontology: Mol. function=RNA-directed DNA polymerase activity; Biological process=RNA-dependent DNA replication
  Pfam annotation: Domain name=RnaseH; Domain location=137-271; Score= -22.8; E_value=0.0076; Accession=PF00075.14; Description=RNase H
MALGLSSMRSNFSLSSMAGGSLSTERIEANIDKCTSILEMQNPTNVQEVQKLNGRLASLSRFLPKLAKKAKLFYTLLKKTEPFLWGETYEQAFLAFKKTRTTSPILSRPRPRVPLLLYLSVADEAVSSTLVQEEGKHQLLIYFTSCILHDAKKRYQMGSGGGIILEGPDNVTLEQAFKLNFRALNNQAKYEALIAGLKLATKVEAKKLRCYTKLQLVQGQVANRYQTKEIVLLKYYQIAKTLIDNFKCLKMYYIPRENNTRKDLLSKLAITKKARHLKTIIQEML

SEQ ID NO: 176505 - protein, 314 aa, Glycine max
  Coding DNA Sequence Number=SeqID_59727
  Subcellular localization annotation: CTP_CleavageSite=64; ConfidenceScore=5.69e-01
MAPSSTVVALLLSVDVVTTSSPVAPPPSSSALIVPSSTSSQPRVSLDHIYTSNDVDFLLGMGVTACTVWRVERPKVVGATIAFVKAVRSNHQLSFKVGSVLAKLLHTRLDELFKRCKDLQEEKNNLAGRVEDVVAEKGKLAKKVADLEARAKESESMLKETELQATAEREAIKKLEDELLIFKREAMEHHEKGFNKVDLDLGLFDPFKDVKDGVLLDEYDIAAEKEADKEEQGIMGQGHIEDKCGIFNSVGSLVTHLVGLPSALRSFSPDACEESKHEFHLIEGLVTQSNDGLVVIYVVQLGPLNVVVVVVMSE

SEQ ID NO: 176506 - protein, 65 aa, Glycine max
  Coding DNA Sequence Number=SeqID_59728
MVVVGSDLRYWRHGDEGPYNLDQKFVMEMLAMLASCLVQTVLKVNNFRFAHIGEGGKIEGSMVLD

SEQ ID NO: 176507 - protein, 99 aa, Glycine max
  Coding DNA Sequence Number=SeqID_59729
MEKFNKTVFDQNPVAIFGVSKVLLPREIFGRNPIVSAKPLDNAPPPDDDALSQENSPGFDGQTSHLSSPPGFREDVRSHAGGSLNFVVLLCCIGLYFVV

SEQ ID NO: 176508 - protein, 431 aa, Glycine max
  Coding DNA Sequence Number=SeqID_59730
  Gene Ontology: Mol. function=lipid binding; Cellular component =integral to membrane; Biological process=defense response to bacterium
  Homolog annotation: Hit_ID=Q9LTR5; Match level="QueryCoverage=79%, HitCoverage=25%, E-value=3e-70, Identity=40%"; Hit description =Similarity to bactericidal permeability-increasing protein
  Pfam annotation: Domain name=LBP_BPI_CETP; Domain location=37-211; Score=78.3; E_value=2.4e-20; Accession=PF01273.15; Description=LBP BPI  CETP family, N-terminal domain
  Pfam annotation: Domain name=LBP_BPI_CETP_C; Domain location=243-430; Score=-44.8; E_value=0.0033; Accession=PF02886.7; Description=LBP BPI  CETP family, C-terminal domain
  Pfam module annotation: Pfam domain module=LBP_BPI_CETP::LBP_BPI_CETP_ C; Domain location=37-211::243-430
MAPSIVLSLLPLLLVSTCCYAQPLEEGFISGVISDKGLEYAKELLIEKGIASIVMLQLPEIENSAQVPLVGNAKVVLSDITIKDVEVNSSSVKTGESGIVLVISGAIANMSMRWRYTVSSWLIPFGISDSGNASVKVTGMQVGLTVNIRNQEGTLKLALLDYGCYVGDLSIKLDGGASWLYQLLVDVFEGDITSAVEEGISEKIKEGIMNLDHFLKSLPEQISLDKTAALNVSFVGNPVLSNSSIAIAINGLFTGKNEVLVPQRYYQKGMKISAACGGLQKMIKVSIHENVFKSASLVYYNAGKMQLIIDELPDQDILNTAEWRFIVPQLYKRYPNDDMQLNISISSPPVIQVTYQDIGATIFVDITIDVLEDGEVIPVACISVEISASCAVEIEGNNIAGWLRLQTFSAYLKWSKIGKLHVRLIQGPWGA

SEQ ID NO: 176509 - protein, 215 aa, Glycine max
  Coding DNA Sequence Number=SeqID_59731
  Gene Ontology: Mol. function=sequence-specific DNA binding; Cellular component=nucleus; Biological process=regulation of transcription, DNA-dependent
  Homolog annotation: Hit_ID=Q40988; Match level="QueryCoverage=58%, HitCoverage=17%, E-value=4e-37, Identity=65%"; Hit description =Homeobox protein
  Pfam annotation: Domain name=Kinesin; Domain location=18-213; Score= -172.5; E_value=0.0017; Accession=PF00225.13; Description=Kinesin motor domain
MAHIANGRDTGNCVSLLRVNSANSSQSNMLILQESCTNSTGSFVIYAPVDIVAMNVVLNGGDPDYVALLPSGFAILPDGTTSHNGSGGIGETGPSGSLLTVAFQILNLRTSELLEGVLQGRNGSVFCYGASGARKTYTMLGTVESPGVTVLAIKDLFSKIRMRSCDGNHAVHLSYLEVYNKTVGDCFHLEDLWFSEKINRFIKRNFNNVIKVTTY

SEQ ID NO: 176510 - protein, 39 aa, Glycine max
  Coding DNA Sequence Number=SeqID_59732
MSYGSLIVVGDISTTPFLAQRMKLYKNPDGMKLYKNLDG

SEQ ID NO: 176511 - protein, 181 aa, Glycine max
  Coding DNA Sequence Number=SeqID_59733
  Gene Ontology: Mol. function=microtubule motor activity; Cellular component=microtubule associated complex; Biological process =microtubule-based movement
  Homolog annotation: Hit_ID=Q229Q4; Match level="QueryCoverage=53%, HitCoverage=12%, E-value=1e-19, Identity=53%"; Hit description =Kinesin motor domain containing protein
  Pfam annotation: Domain name=Kinesin; Domain location=1-137; Score= -154.7; E_value=0.00013; Accession=PF00225.13; Description=Kinesin motor domain
MVIGIGQEDNMGIDKVKGIVAAGLTQYRAYSTDEVMALLQQGNQNRTTESTRANETSSRSHAILQVVVEYQVRDAAMNIIKKMGKLSAIDLAGSERALATDQRTVRSLEGANQYKLQRIEESKLSFSVTSTNCKETSFWDITTANSPSVTTLNGRKTRSHVISETTAHPSVLLQVSCFLFS

SEQ ID NO: 176512 - protein, 104 aa, Glycine max
  Coding DNA Sequence Number=SeqID_59734
GGGECKYHIPHYHPRQKRKNWSELGSGGGSKDVGRGWDLVLWSSMEHFRKLDGCLVLASPMREEIKKVFGGELPERRHEDGGGDHVRVSSGGEETSIWETIIIL

SEQ ID NO: 176513 - protein, 106 aa, Glycine max
  Coding DNA Sequence Number=SeqID_59735
MKSLITWLVKIAKVTTKAIIMIIIKVAITIKIKAKVGNFILRIISTKIKEINPKEHYKVVVARSRHKDNVAYGVKCEGDVVSDNEGVTDEDKGEKNKEKDLSVEKC

SEQ ID NO: 176514 - protein, 76 aa, Glycine max
  Coding DNA Sequence Number=SeqID_59736
MDDQSSMYGILSITPPKSNNLMHDDTKVVEMVVDDLVIVVVGYQKWMRRGRVCGILTGGGGGKAEAEAEQVQQQQH

SEQ ID NO: 176515 - protein, 184 aa, Glycine max
  Coding DNA Sequence Number=SeqID_59737
MKNILGLQAPVELTSQMAEEKPPSVVRLIVQAANVSYPSSLIQLISANQFHGDPYTHLATSIEICNTIKLVGVSNDAKHWLFSFKGNSLHTWDEIELKTPEEATKLIENMAASDHVIIQNRTHGWVTKWKVLWYPQQGKFGKGWYGFCRWLGLKEGDEVIFHKFHGVSMVFMLVKPIDMLSTME

SEQ ID NO: 176516 - protein, 275 aa, Glycine max
  Coding DNA Sequence Number=SeqID_59738
MVPNRIFPRLPICDEGKKKNVKLYFNMEMPSKQQHVQLVNYLRDWKTLFRGQKLIRKLNVDEAKTSWNQTVWIDTQHDVSSNFDKVPISNQRDFIHVLRPTWVYHSDDTNSLRKLSIIFNHNVFDLCKMSQAKFVARVKHLCEKKKPEMTQYEQTWKARLAVEVKQKIEVEARRKVIGKRKVKANATKDQPGKEVDAFIPALIVEAPINKVDSDMTKPQQSETAYEATSEDTIVVTVHTTTSESIPINYAPPEVVTMYEVQEMIGQAMNTVGEGR

SEQ ID NO: 176517 - protein, 240 aa, Glycine max
  Coding DNA Sequence Number=SeqID_59739
  Pfam annotation: Domain name=DUF1723; Domain location=56-111; Score =9.7; E_value=0.036; Accession=PF08330.1; Description=Protein of unknown function (DUF1723)
MIMMSQRRRPTASARRQRQEARIVEDPRTIVEELNEEQQQPHVEGVIDVEGFLGGPHDTSILRDFENHVALRIWNGEKTSSFHLLIGEATITLDDVALLLHLLIIGAFHSFEQLHVDDVVYMLVELLKVSIVEARAETIQCHGSYVRLSCVKEHSEVACRICHTLLQCWIYWHFSSVDFAIAIEDYDQQRPRACRWTSSKALPVSTYHRRLNRLTPDVPGDPLRVSPIRQYDIFVEPDVH

SEQ ID NO: 176518 - protein, 286 aa, Glycine max
  Coding DNA Sequence Number=SeqID_59740
  Homolog annotation: Hit_ID=Q9FN45; Match level="QueryCoverage=62%, HitCoverage=68%, E-value=9e-34, Identity=45%"; Hit description =Genomic DNA, chromosome 5, P1 clone:MYJ24
  Pfam annotation: Domain name=DUF617; Domain location=207-286; Score =29.9; E_value=2.6e-11; Accession=PF04759.4; Description=Protein of unknown function, DUF617
MIKRVTYLEGEQKCVNERRRRSLLREWKQERTWNEEEARKKKNQRRRSGNEGRRKTRKKKQQERSNIRSDLYFHVNKYKSNRIEYFFVGGQMGRCQFEMNKVTARSSQEMSSKRHHFHWTNKVGTEDGEVPTSESFSTLIKEEKKHEDKVSIVAAAAEATKAPASHVTRKKKLQAVAVSRIRSVLTVFNNNSNNNRSSNSSLGLGSRVVGTLFGYRRGHVHFAFQKDPTSQPAFLIELATPISVLVREMASGLVRIALECDKEKETEKKHVRLLEEPLWRTYCNGK

SEQ ID NO: 176519 - protein, 155 aa, Glycine max
  Coding DNA Sequence Number=SeqID_59741
  Gene Ontology: Mol. function=sequence-specific DNA binding; Cellular component=intracellular; Biological process=transcription
  Homolog annotation: Hit_ID=Q8W0W5; Match level="QueryCoverage=99%, HitCoverage=87%, E-value=5e-68, Identity=87%"; Hit description =Repressor protein
  Pfam annotation: Domain name=CBFD_NFYB_HMF; Domain location=1-59; Score=80.8; E_value=4.4e-21; Accession=PF00808.13; Description =Histone-like transcription factor (CBFNF-Y) and archaeal histone
MTKIIKEMLPPDVRVARDAQDLLIECCVEFINLVSSESNEVCNKEERRTIAPEHVLKALGVYNVCSTILFYLGQWFNFLVLGFGEYIEEVYAAYEQHKLETMQDSLKGAKWSNRAEMTEEEALAEQQRMFAEARARMNGGAIQSKEPEADQSLES

SEQ ID NO: 176520 - protein, 174 aa, Glycine max
  Coding DNA Sequence Number=SeqID_59742
  Gene Ontology: Mol. function=serine carboxypeptidase activity; Cellular component=vacuole; Biological process=proteolysis
  Homolog annotation: Hit_ID=Q41691; Match level="QueryCoverage=69%, HitCoverage=40%, E-value=2e-33, Identity=55%"; Hit description =Serine carboxypeptidase
MKHISTCKKEVFLLIGKFVSLGFAIGNGLTNPAIQYPEYPDFALDNKIITKAQHDDIIKSIPGCEEATKNCESKGGQSCETALNVCQGIFDSILSIAGDINYYDIRKKCVGQLCYDFNNVEKLLNLHKVKRALLEKGINVLDPTFWYPEPNRAWDRETRVKSVRFQFAIWETRV

SEQ ID NO: 176521 - protein, 260 aa, Glycine max
  Coding DNA Sequence Number=SeqID_59743
  Gene Ontology: Mol. function=protein binding; Cellular component =membrane; Biological process=protein transport
  Homolog annotation: Hit_ID=Q8GVS9; Match level="QueryCoverage=99%, HitCoverage=100%, E-value=4e-57, Identity=52%"; Hit description =Putative endosomal Vps protein complex subunit
  Pfam annotation: Domain name=Snf7; Domain location=20-222; Score =41.1; E_value=3.9e-09; Accession=PF03357.11; Description=Snf7
MEKVMNILKPKPNPQQLLRDWQRRLRQQCRNIERQIRGTPLSQNPNFNSLFYIYREKKKNVQKAIREAAKRNDMGSAKHSSKNNLGQGRPKAVLVKALTKELVRSRKTVNRLYENKAQMNSISMHLGESVAIARTVGHLSKSAEVMKLVNNLTKAPEMAVAMQEFSKEMTKAGVIEEIVNDAVDTALDSEDIEDEIEEVDKVLTTIAGETATLLPEAVRKERVKQPAQSVGAAEEEAIAEGVDDEEEMEEIRARLAKVRS

SEQ ID NO: 176522 - protein, 80 aa, Glycine max
  Coding DNA Sequence Number=SeqID_59744
MWYKAQRRQNQQNNITQMRKKLMKTLKDVTLLCEVQGNISVSVTYSMESGNWHYTRVGEAKNSVQNISISLFHFYQRLFQ

SEQ ID NO: 176523 - protein, 730 aa, Glycine max
  Coding DNA Sequence Number=SeqID_59745
  Homolog annotation: Hit_ID=Q9LJ43; Match level="QueryCoverage=99%, HitCoverage=98%, E-value=2e-38, Identity=25%"; Hit description =Arabidopsis thaliana genomic DNA, chromosome 3, P1 clone:MSD24
MYRSFLRCDDPKGVVECGTIRKYRTRSHKVKDKTRIQKTGENLETSLSLMNKRYKEENKVPKGCDGNLIDPSSYRDIMCDEKSEDIAEGIAKGALGLQDSLIMIRKLQEEASPHSASFRRKQTMKPERDRIEAKMIGRTQANPFGEQSNPKGFQRPQPSTGGCLSNCQEELKKVIKESLVRQNMFPKTSERFNSGSETFSTSTSQYSAVRTNSLFDPSFSAIAPKMERAPSLIFKLMGLEEAPSKSFPAVKQKQLDRELDMSKVRKNDSIAEKQKALRETLDTTHFKGILKESFVKEPKLHVHHFNDTNSKQFGDLSHIALMKPQCTLYQESVKSTYMSVPPKGSSSTNMGKEMEKGICKRVNKEEGPKFLKEVMKLDAKGINPVEESSGKVKLYCHIGHTSQTNETIDKKWKVQTISRKLLEKDISQPIIAATRPQYQRGIPSTKLRKLKSGSRIDMNEISYLKRTGRKNQMKNQSPIIEPEPAKLTVEQIRKGEKKKICTEISALEDELLMVCEADAHINKIGEKYKQRKSFSGDDIIMLLKSEHENNAITAYSINADKEGTELKHFLLTCPSFIGHAKKLFNLEVDCPNTLQKDETIYNMANLRLYLDCAYELTERKSLQESQVVRSFLLACGGSSRLHISVGRLAEEICNGIENLKFYKEHSGEEVFAGNDVFAMMEKDMKCNGEINGMWEKGWRRGFSADEAELVVNKIEILLMSGLIEEIIINL

SEQ ID NO: 176524 - protein, 67 aa, Glycine max
  Coding DNA Sequence Number=SeqID_59746
MSDEGSYVSGLKITIDENINMSLPSDENATLQQLTADKCCHKGMEIPGITRFTSNVAIYSCRLLLYF

SEQ ID NO: 176525 - protein, 143 aa, Glycine max
  Coding DNA Sequence Number=SeqID_59747
  Gene Ontology: Mol. function=drug transporter activity; Cellular component=membrane; Biological process=multidrug transport
  Homolog annotation: Hit_ID=Q6K7U1; Match level="QueryCoverage=54%, HitCoverage=11%, E-value=6e-16, Identity=51%"; Hit description =Putative pentatricopeptide (PPR) repeat-containing protein
MMKGNIALLPRRFVACIFLGLQLNILLHRKPSPRETGGVLSNQKLALAAVTRGDVMGALSLYDSAISEGVKLGQHHYTLLLFLCSSAAVGVVRPAKSGSGARTLNALVSSNEVPNEGTNGTHFELNGNAELNSDLNFTEKDGI

SEQ ID NO: 176526 - protein, 573 aa, Glycine max
  Coding DNA Sequence Number=SeqID_59748
  Gene Ontology: Mol. function=transporter activity; Cellular component= membrane; Biological process=oligopeptide transport
  Homolog annotation: Hit_ID=Q94DR9; Match level="QueryCoverage=91%, HitCoverage=91%, E-value=1e-130, Identity=48%"; Hit description =Putative peptide transporter
  Pfam annotation: Domain name=MFS_1; Domain location=24-503; Score =8.4; E_value=0.00013; Accession=PF07690.6; Description=Major Facilitator Superfamily
  Pfam annotation: Domain name=PTR2; Domain location=90-487; Score =247.9; E_value=2.1e-71; Accession=PF00854.12; Description=POT family
  Pfam module annotation: Pfam domain module=MFS_1::PTR2; Domain location=24-503::90-487
MEMSSMEQKKATELVERKKGGYRTIPFIIANETFEKVANVGLHVNMILYLLQEYHFDPATGAIIIFLWNALSNFFPIFGAFLSDSWLGRFRVIALGIVIDLVGLVVLWLTAIFRHARPQCDVEPCANPTTLQLLFLFSSLALMALGAGGIRPCTLAFTADQINNPENPHNERTMKSLFNWYYASVGISVTVSMTFIVYIQVKAGWVVGFGIPVALMTFSAIMFFLGSCLYKKVKPNKSLLTSLAQVIVAAWKNRHLPMSPKNSDIWYFHNGSNLVQPTGKARFLNKACMMKNREKDLDSGEMPIDPWSLCTVRQVEELKAIIKVLPIWSTGIILATSISQQSFSIVQAQTMNRVVFHMTIPPTNFAAFIILTLTIWVVVYDRILVPLFPKERVLTVKQRMGIGLLISCLATLVAALVERKRRNEAIKEGFIDNPKGVVNMSAMWLVPQYCLYGLAEGLNIIGQIEFYYSQFPKTMSSIAVSLCALGIGMGNVLGSLIVKVVKDGTKRGGEASWLASNINRGHYDYYYALLFILNLVNLLCFFIWSRIYGSTCDIKNWEEEVDTRVLEKELDTK

SEQ ID NO: 176527 - protein, 547 aa, Glycine max
  Coding DNA Sequence Number=SeqID_59749
  Gene Ontology: Biological process=regulation of transcription
  Homolog annotation: Hit_ID=Q1SWC6; Match level="QueryCoverage=98%, HitCoverage=99%, E-value=0.0, Identity=61%"; Hit description =Tesmin/TSO1-like, CXC
  Pfam annotation: Domain name=CXC; Domain location=161-202; Score =87.2; E_value=5.2e-23; Accession=PF03638.5; Description=TesminTSO1 -like CXC domain
  Pfam annotation: Domain name=CXC; Domain location=90-120; Score=7.9; E_value=0.0027; Accession=PF03638.5; Description=TesminTSO1-like CXC domain
  Pfam module annotation: Pfam domain module=CXC::CXC; Domain location =161-202::90-120
MGEGEAEGSDGAPKNIVSNDVVANALLPFDVPAKKLARQLDFTDFGGMPAPPQPPVILPLPPSASVRVGKPESPKSRPRPGFEIKEATPKKQKQCNCKHSKCLKLLLDAMGNYVELMFEIREAVEATLERNPNAFRPKIASSPHGTRDSREDAGEVLILGKHNKGCHCKKSGCLKKYCECFQANILCSENCKCMDCKNFEGSEERQALFHGDQNNNMVYIQQAANAAITGAIGSSGYSSPPISKKRKGQELLFGPTVKDPSVGRQGQQANNVRVPAPSSSLSPIPGARVGPATLGPSKLMYRSLLADIIQPQHLKELCSVLVLVSGQAAKMFTDHKNFMDKHAEDQTETSRASSTQEQLPSQKEANVEKAMADDDCSSANQTDNISPDNSCSDGADVPKGRPMSPGTLALMCDEQDTMFMTAASTVGSRAHACNTSLQPPYGQVMTEVYAEQERIVLTKFRDFLNRVITMGEINETKCSSLARSELESQKDPNINCTGNASTETQHQQGATNNGVAKTAGNSSNSTSLFPGGSLVSENGETYPKVEE

SEQ ID NO: 176528 - protein, 49 aa, Glycine max
  Coding DNA Sequence Number=SeqID_59750
MEDQVTTHSSCKAHYIYGVGPYLLISFFEFAQGIKMAMLVRVNLHEVPN

SEQ ID NO: 176529 - protein, 72 aa, Glycine max
  Coding DNA Sequence Number=SeqID_59751
MWSWESILHSDSSGGRRFDTEKKNGNGIIEGNVLPVELGCLESMMPFHSVVASARLVSSLSIESLGWGLVPQ

SEQ ID NO: 176530 - protein, 94 aa, Glycine max
  Coding DNA Sequence Number=SeqID_59752
MRHKERERVKVCSRLKGCGRFQQEELEIEGEPRESSTLVIVLHLFALKKPSDWSKEHKWLAMICSDSINHGRVRPESSHRTIEDHQPCCDNMFF

SEQ ID NO: 176531 - protein, 1215 aa, Glycine max
  Coding DNA Sequence Number=SeqID_59753
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q1RSD6; Match level="QueryCoverage=99%, HitCoverage=98%, E-value=0.0, Identity=72%"; Hit description=ATPase, E1-E2 type
  Pfam annotation: Domain name=Hydrolase; Domain location=446-906; Score=36.9; E_value=7.2e-08; Accession=PF00702.16; Description =haloacid dehalogenase-like hydrolase
MEGNGRRRRRHFSRIHAFSCGKASFKGEHSLIGGPGFSRIVYCNEAERGEGSLVSYGDNYVSTTKYTVATFLPKSLFEQFRRVANFYFLICAILSFFPVSPYSAVSNVVPLVVVVAATMGKEAVEDWKRKKQNWFLENSSEGYCGEGVVRGKVASSADIDMNNRKVKVHRGDGVFDYSKWKDLKVGDIVKVEKDEFFPADLILLSSSYDDAICYVETMNLDGETNLKVKQSLEETSKLQEDSSFQNFKAIIKCEDPNANLYSFVGSLELEDQLYPLSPLHLLLRDSKLRNTEFIYGVVIFTGHDTKVMQNSTEPPSKRSTVEKRMDKIIYFLFLVLFLISFIGSIFFGIATRKDLENGVMKRWYLRPDDTTIYFDPKKAPVAAMLHFLTALMLYSYLIPISLYVSIEVVKVLQSIFINQDLHMYYEEADRPAHARTSNLNEELGQVDTILSDKTGTLTCNSMEFIKCSIAGIAYGQGVTEVERALARREGVPLSQELTEDGNVPKSSIKGFNFMDERIMKGNWINEPHADVIQNFLRLLAVCHTAIPEVDEEIGKVSYEAESPDEAAFVVAARELGFEFYERTQTNISLHEFNPRSGQTTERSYKLLNILEFSSTRKRMSVIVRDEEGKLLLFSKGADSVMFERLARNGREFEEKTKQHIDEYADAGLRTLILAYRELDEEEYNLFNEEFMEAKNLVSADREQIVEEISEKIEKDLILLGATAVEDKLQNGVPECIDKLAQAGIKLWVLTGDKMETAINIGFACSLLRQGMKQIIISSDTPETKSLEKVEDKSAAAAAVKVSVIHQLTNGKELLAESDENSEALALIIDGKSLTYALEDDVKDLFLTLAAGCASVICCRSSPKQKALVTRLVKVKTGSTTLAIGDGANDVGMLQEADIGIGISGVEGMQAVMSSDIAIAQFRFLERLLLVHGHWCYRRISSMICYFFYKNIAFGFTLFFYEIYASFSGQAAYNDWYLSLYNVFFTSLPVIALGVFDQDVSARLCHKFPLLYQEGVQNVLFSWKRILGWAFNGVLSATIIFFFCINGMENQAFRKAGEVADLEVLGATMYTCVVWVVNSQMALSISYFTYIQHLFIWGGILFWYIFLLVYGTMDPSLSTTAYKVLIEACAPAPSYWLITLLVLVASLLPYFAYASIQMRFFPTFHQMIQWIRNDGQTTDPEYVNIVRQRSIRHTTVGFTARFEASHSSGASKSIQV

SEQ ID NO: 176532 - protein, 137 aa, Glycine max
  Coding DNA Sequence Number=SeqID_59754
MWRRERSLKMRFSTARLGNKRRNLMLNPGHLTKISVTRNEDIRDDKFISPAINAQDDVSRNCSSFETRDGKHAQACTDGVGNGFLDPKSSKGDKWHNGELGHFKSNEKLKGDFDDETLEANVRKAHYNRNSSSESGG

SEQ ID NO: 176533 - protein, 476 aa, Glycine max
  Coding DNA Sequence Number=SeqID_59755
  Gene Ontology: Mol. function=transferase activity; Cellular component= membrane; Biological process=cellular metabolic process
  Homolog annotation: Hit_ID=Q5BM98; Match level="QueryCoverage=86%, HitCoverage=93%, E-value=1e-169, Identity=68%"; Hit description =Secondary cell wall-related glycosyltransferase family 47
  Pfam annotation: Domain name=Exostosin; Domain location=104-411; Score=323.0; E_value=5.4e-94; Accession=PF03016.6; Description =Exostosin family
MAQQKRPPNSRGYYVKMKLLQKHGRPHHHHHHHQQEKNCFYRYYKWVLWLSLSLYFFTSYLISNNNNHHTKKPSHVSRALIQSNHTTTPQHALNSPESLKKLKVFVYDLPPKYNTDWLTNERCSKHLFASEVAIHRALLTSEVRTFDPYDADFFFVPVYVSCNFSTVNGFPAIGHARSLIASAVNLISSEYPFWNRSRGSDHVFVASHDFGSCFHTLEDVAMADGVPEIVRNSIVLQTFGVVFDHPCQKVEHVVIPPYVSPESVRDTMENFPVDGRRDIWAFFRGKMEVHPKNVSGRFYSKKVRTVIWRKFNGDRRFYLQRHRFAGYQSEIARSVFCLCPLGWAPWSPRLVESVALGCVPVVIADGIRLPFVSAVKWSEISVTVAEKDVGRLAEILERVAATNLSTIQRNLWDPATRRALLFNSQVQLEFLERWNLMTHVGAQSSSFKTFFEYINGDVVVVMMTWQEFIRWFCGLD

SEQ ID NO: 176534 - protein, 87 aa, Glycine max
  Coding DNA Sequence Number=SeqID_59756
MGSTAEVDESKLTSSKVEPDDLEEDTLQLPEQEEEDLNRIKEESRRRRETIMEKYKKQHQQVEAVVRNEGKVKKSGNNCKVFVGKDT

SEQ ID NO: 176535 - protein, 102 aa, Glycine max
  Coding DNA Sequence Number=SeqID_59757
MTLDQVRVLFLGYGSNHMIVLGGKHKNKSSENGYGLGCVGVLGRVSEWVTVFAVLVVHGGCVGSADGWARPMVVFGGCVGSADGWARPMVVVLGGGKGLSGG

SEQ ID NO: 176536 - protein, 132 aa, Glycine max
  Coding DNA Sequence Number=SeqID_59758
MDKTRMIEEEAKDKKHTVLAHKSTIPTSDDNEGENAEGSIAENLTLLEQQHGKKKSRSYTKKKKAYIAWEENSSSSSSGNSDEEEANLCLMANEKVDNNEARKSSISNNIPSRYALKPNNLCGILTMDAQGI

SEQ ID NO: 176537 - protein, 142 aa, Glycine max
  Coding DNA Sequence Number=SeqID_59759
  Gene Ontology: Mol. function=nucleic acid binding; Cellular component= intracellular; Biological process=regulation of transcription, DNA -dependent
  Homolog annotation: Hit_ID=Q58A50; Match level="QueryCoverage=77%, HitCoverage=17%, E-value=4e-22, Identity=48%"; Hit description =Embryonic flower 2
MENEQLKRQPGAQGSYPVRSEQGGSAQPLSCYANRAGEYCLCGKVSLESLYMAWDCFPNFRLGQRAEIMSTVDLLPCILKSDFPNDDTRISIQVPSNFENMSTSKQVQITISAEEFGAKEKSPYLSYAGSEVPSSSLSHMIG

SEQ ID NO: 176538 - protein, 114 aa, Glycine max
  Coding DNA Sequence Number=SeqID_59760
MSSSVNDSNSFLMLVVIVASDKSESDCKLLATDLYWKPFSSELLIVGFAITSTDDVVRGYDLGWFRTLDTTYWTKVLYEKAPPLSNSPFLRILTCLSSRNPHGFRCVGDQPNLN

SEQ ID NO: 176539 - protein, 152 aa, Glycine max
  Coding DNA Sequence Number=SeqID_59761
  Homolog annotation: Hit_ID=Q1RSZ9; Match level="QueryCoverage=62%, HitCoverage=7%, E-value=8e-19, Identity=54%"; Hit description =Polynucleotidyl transferase, Ribonuclease H fold
MIHVILWHHQNFQLDPLSTGWFCNWCLVSLNPTREWPPSSVKVIPCLSFIKHGRCLFSKNPTSRRWLRPHPPPWWLVTQMNLKRCLIIHQHATQIMVENGIQTMEILERIATTLVVMITQALAREALVAGVKVAVAAIAGVDSSSPRTTLGL

SEQ ID NO: 176540 - protein, 145 aa, Glycine max
  Coding DNA Sequence Number=SeqID_59762
MSVHVAQVIADAIYFFAGMPPTRHPLDPDKSNRALGFLALITGLCQSFGVPITPSKVIRPPITRAFIKKYCTPRQVQGDALEAADAPPPPHQANPAGSLGMERYLQHLVRQQAANHRGQVQIHEFYQFSLSQQGQGFAPFACLTP

SEQ ID NO: 176541 - protein, 43 aa, Glycine max
  Coding DNA Sequence Number=SeqID_59763
MWKLIKERMENKVVNFVGLNKVKWWLDRNIEMAITEATGLQMR

SEQ ID NO: 176542 - protein, 322 aa, Glycine max
  Coding DNA Sequence Number=SeqID_59764
  Gene Ontology: Mol. function=RNA-directed DNA polymerase activity; Cellular component=extracellular region; Biological process=RNA -dependent DNA replication
  Homolog annotation: Hit_ID=Q1SW56; Match level="QueryCoverage=90%, HitCoverage=32%, E-value=4e-18, Identity=25%"; Hit description =Polynucleotidyl transferase, Ribonuclease H fold
MASGSSSALNSNSKVAEGIWKAAASLRCRKLLWRACREGLPVRSLLLQKGIIKDDDTCPCCGTCKETTTHALLLCEGVKPFWLGSPLGLRVDSWHNVANITMLQWVDQCVDVLDKRGMGMLCAMVWGLWNKRNAWVLKKKKLDFAQVMAKALSVFVTDEWVPPLDSKIKANFAASVIEDVGTGLGVVFRNSKGEPMASDECYDSEIADTLCYKWAIEKAEELWFPEVIFETDCQQLYTQWNILTQGNNNTSDYTSYLNEILDECINMMQGTESSLTLVVHNANKVAQCLAAVAYDYGERIWVEDVPNEASECLQSDAAEIAN

SEQ ID NO: 176543 - protein, 283 aa, Glycine max
  Coding DNA Sequence Number=SeqID_59765
  Subcellular localization annotation: CTP_CleavageSite=67; ConfidenceScore=5.61e-01
MDTQRKDAKQSSPLGDTQRETLSLPPRLLFRFFFLRFSSLLPHSLSASSSCIFVLLLLTSPTFPFVVAVKGGCGKRFFFFFIEELATIVAMNRRLSWCIEEASAKSNAVVHRRGSFVIVHRRGKRHDHVVSTIVVGNRRGSCGFGYTQTIPASPVDSWVSYDDIHDRWMHYPDHMVPTGEVCTVSGQCVSDYIDWFFHISHPFMTPGQSSDPLPDGHALQPRVVPQVPETDIPQVSEPTAPSTSVRLAVEEPRHAVEVCYEIAKRLERHLSLGVVTPGSSTHE

SEQ ID NO: 176544 - protein, 286 aa, Glycine max
  Coding DNA Sequence Number=SeqID_59766
MALTSTVDDDEAPSTVDDGVALRGSLLNAPRQPPIHGNNGGKLLNEEEEEPLSATSFNGNDKWKRDAHIQGPWKTFWNKILPLKVKWTGVHSALYGDIGKQIYQLQGLIGAKAVGPWPTNFGAGAISILDMDSCKEGGENISLKYSVGFSMWYLGVLFFKLPLSGRGVGLSFDGFYKVLWCSWDIVVHEYCVAFFSVTSPCMKTFFKHLVDKDMTKSKGKDPLEGLGGLMTRARARKAKEALQQVLSLLFEYKPKFQGEKSKVGPIGNLDISLLGDQMVADLLAVG

SEQ ID NO: 176545 - protein, 137 aa, Glycine max
  Coding DNA Sequence Number=SeqID_59767
MTPLMKKIEGLQAPHGATSKPTTFSTQITCYKCDPFFAIAQAEKTFLPHLLLLTLPLKGCLVRVIAGLCHCRKRNDTVMETSAWVASHSSYVLVDSVGIEKVVSTIVLDALNFCFWPDPLKEGANGSCQSWVHVIYP

SEQ ID NO: 176546 - protein, 198 aa, Glycine max
  Coding DNA Sequence Number=SeqID_59768
  Gene Ontology: Mol. function=DNA binding; Cellular component =chromatin; Biological process=chromatin assembly or disassembly
  Homolog annotation: Hit_ID=Q1S735; Match level="QueryCoverage=99%, HitCoverage=43%, E-value=1e-29, Identity=41%"; Hit description =Probable transposase [imported]-Arabidopsis thaliana-related
  Pfam annotation: Domain name=DUF659; Domain location=1-67; Score= -47.0; E_value=0.0015; Accession=PF04937.6; Description=Protein of unknown function (DUF 659)
MVLYVGAKNVVHIVTDNAANYVAAGRLLEKEFPKIYWSPCAVHYMNLMLQDFGKFEEDALRAMVTSSDWIGSTYAKDSKAKKFVEQILDSSFWKSCADIVKLTEPLVRALLIADSEDKPAMGFLYQAMYKAREEMVRSFKRNKRKVEPYLEVLDRRWDSQLQKNLHVAGYWLNPTCRFNVEEFEKHRNTQSDILELID

SEQ ID NO: 176547 - protein, 353 aa, Glycine max
  Coding DNA Sequence Number=SeqID_59769
  Gene Ontology: Mol. function=protein serine/threonine kinase activity; Cellular component=intracellular; Biological process =protein amino acid phosphorylation
  Homolog annotation: Hit_ID=Q2QB51; Match level="QueryCoverage=90%, HitCoverage=24%, E-value=1e-138, Identity=77%"; Hit description=Fused
  Pfam annotation: Domain name=Pkinase; Domain location=6-256; Score =365.0; E_value=1.2e-106; Accession=PF00069.15; Description=Protein kinase domain
  Pfam annotation: Domain name=Pkinase_Tyr; Domain location=6-256; Score=116.1; E_value=9.8e-32; Accession=PF07714.7; Description =Protein tyrosine kinase
  Pfam module annotation: Pfam domain module=Pkinase::Pkinase_Tyr; Domain location=6-256::6-256
MGVENYHVIELVGEGSFGKVYKGRRKHTGQTVAMKFIMKHGKTEKDIHNLRQEIEILRKLKHGNIIQMLDSFESPQEFCVVTEFAQGELFEILEDDKCLPEEQVQAIAKQLVKALHYLHSNRIIHRDMKPQNILIGAGSVVKLCDFGFARAMSTNTVVLRSIKGTPLYMAPELVREQPYNHTVDLWSLGVILYELFVGQPPFYTNSVYALIRHIVKDPVKYPDRMSPNFKSFLKGLLNKAPESRLTWPALLEHPFVKESYDELEARELREINGSHMHSDAARVVEGKTIQTLTTGKNNHMAGMEAHIASPPQSAVQLNSPILDRANSSVLDESPVFSNQNVGESEKRMQGIPL

SEQ ID NO: 176548 - protein, 817 aa, Glycine max
  Coding DNA Sequence Number=SeqID_59770
  Gene Ontology: Mol. function=protein serine/threonine kinase activity; Biological process=protein amino acid phosphorylation
  Homolog annotation: Hit_ID=Q2QB51; Match level="QueryCoverage=98%, HitCoverage=59%, E-value=0.0, Identity=54%"; Hit description=Fused
  Pfam annotation: Domain name=Arm; Domain location=733-773; Score =21.6; E_value=0.0028; Accession=PF00514.13; Description =Armadillobeta-catenin-like repeat
  Pfam annotation: Domain name=HEAT; Domain location=738-775; Score =19.8; E_value=0.0097; Accession=PF02985.12; Description=HEAT repeat
  Pfam annotation: Domain name=HEAT; Domain location=781-814; Score =11.8; E_value=1.6; Accession=PF02985.12; Description=HEAT repeat
  Pfam module annotation: Pfam domain module=Arm::HEAT::HEAT; Domain location=733-773::738-775::781-814
MCSDQDVPESNQSLRILSNLVAAGAFSSSGLIDELIRELLVFTGSVIAMKSSEVTDLMAKSFSITKILLDNGGSCTSSSYLSHWVEFVEIYSQVVTSNNDASGRVLYESSACITVMLSRVAQVLRSSPKISGQEKLNETANRILEHAKTTGLVDNLCLCLATSGSSLITGSSNMLRAASEACRAVWCLINALDILFMKKSAILFPINALQSHSLHRMEVVHHEQDLLDKADSTKVVDAMTRAFLRSKAVLVAVYYCFHQQLESAMNCGLQLLSRCCLHNRIVPALLCGLPSSLPVTTVVSGGGDGTIVSEVFTVLSLCSSPANKDTQSVEPSNAKCKLTNPSALVRHSCLLVAVIAQCLKSSGRNSAIFMLTTSPKKQLARLSVFAHQISSDDKIKASIEPQSASAMLALASILSLESGALVESPISEIALPLIPRTSKLSDHLKFSSGNVNESDPCNISGKLSYWQGVRDGCVGLLDSRLKWGGPLAVQQLCASGTPLLLMGLLGNDVLNASHGNDHVNDRVGLSPIGVVWTISSLCHCLSGGALTYRQILIRNEHIKLFSNLICDVHINLVKCWIGPGGGRAGVRDLINAVIDLLAFPFVALQNAPGLPSATASVSSGFLLNIGSPGQRVCMEDKGIVKAIEEDIGKYIKILVEVGVPGIILRCLDHMDLNDLGRPVAFLAKMVCHRPLAIQLVSKGLLDPNKMRKLFDCSAPKEVTLDALMIISDLARMDKGFYEYIKGASVLEFLKDFLLHEDPNMRAKACSALGNMCRHSAYFYSSLARHQIVGILIERCSDPDKRTRKFACFAVLEDCCGI

SEQ ID NO: 176549 - protein, 142 aa, Glycine max
  Coding DNA Sequence Number=SeqID_59771
MLEQSVKVTYCWVMKQVGGAGPNSKWGSSMELRISDCGRGLLKALHESKPNNTEALDWEELQERVAVTVALMSHFQQRQNAMRSLQDDGLYVNGKQEHGSTQNKGFGGRQRKKSKSRKYKKTMQAAMRKRFTLNGEIVGIQV

SEQ ID NO: 176550 - protein, 152 aa, Glycine max
  Coding DNA Sequence Number=SeqID_59772
  Gene Ontology: Mol. function=endonuclease activity
  Homolog annotation: Hit_ID=Q109Y3; Match level="QueryCoverage=64%, HitCoverage=23%, E-value=5e-09, Identity=32%"; Hit description =NUMOD3 motif family protein, expressed
MRSFNGDFPPWRCNGRQRRRGERMRHPLGNKPWKKELHHQDEPWIRSLERITETRKKIGAEVRRQWEKRRGKKMKLLGKVVGQEKLQWNSYETLDEQLKQEWLMSVEQRKQVARTPSSKRAPRSPEKRRKITKAIAAKWADPSYVEESKKNK

SEQ ID NO: 176551 - protein, 111 aa, Glycine max
  Coding DNA Sequence Number=SeqID_59773
MAHYCAKRECEDHKNLLQCSFRESVPQNTSFENRCGGILIQYPGPLRRNNHVTLTHDLPSLWNADINKSKFTLTNKLLTKVDSEMMDYVGADNSLDSTEVFLYRSTTTIRH

SEQ ID NO: 176552 - protein, 170 aa, Glycine max
  Coding DNA Sequence Number=SeqID_59774
  Subcellular localization annotation: CTP_CleavageSite=30; ConfidenceScore=5.24e-01
MYPLLFSVTTTQVDVPSTCTTKDVPSNVLRQSSQAESGNQLPESKNSGTHYNVFSVTYYECLVTHKGPYTTLDLVYDGFVRQQHPRQATMTCHMLIIHFSTTLDPVYSDYEDSSFVPFYHIDEDYDYPYFVSKISNVGSYTTNKQALIGDNDEEMVNSDNSDDMDSRDSQ

SEQ ID NO: 176553 - protein, 206 aa, Glycine max
  Coding DNA Sequence Number=SeqID_59775
  Homolog annotation: Hit_ID=Q8TGM6; Match level="QueryCoverage=31%, HitCoverage=52%, E-value=8e-08, Identity=46%"; Hit description =Protein TAR1
  Subcellular localization annotation: CTP_CleavageSite=46; ConfidenceScore=5.26e-01
NGIYRPIGAAFPNNPTRRQRLVVRQGPGTTGLSPSLAPPSRETWARSATEDASPDYNSDAEGDRFSWWAFPGSLAVTKGILRVAPPDLRSRWERACTQRVVDGSRTDRLARDWSRAWLIHHFITAKSAMNPDFNQPRGGRALGLMASGATCVQRLDGSRDSAIHTKYRISLRSSSMQEPRYPLPRVIDEEAGRTGRRGHPLPPDGR

SEQ ID NO: 176554 - protein, 305 aa, Glycine max
  Coding DNA Sequence Number=SeqID_59776
  Gene Ontology: Cellular component=membrane
  Homolog annotation: Hit_ID=Q8ZQN3; Match level="QueryCoverage=88%, HitCoverage=36%, E-value=1e-80, Identity=57%"; Hit description =Putative transport protein
  Subcellular localization annotation: CTP_CleavageSite=43; ConfidenceScore=5.14e-01
MPGFFTPDCSQKSSSASRLLYLSFCSTFSPEDAVPWILLLLISLFSAPSFAVAIPGVTTGTTATKANTPPPEPDVEQKKAAYSALADVLENDASRQELISQLRKVAATPSQEPVPDIIPPQVEEQKTVLENVTDVSRHYGEALSSRFAQLYRNLIGSPHKPFNPQTFTVAATQFLMLAGAVFLFYWLVRLSAWPLYRKMGQWGRRKNQQRSSWLHLPLMIASAFIIDLLLLALTLFLGQMLADRLNAGNKTIAFQQSLFLNAFALIEFFKALLRLLFCPHVPELRPFSIRDESAKYWALRLSVLS

SEQ ID NO: 176555 - protein, 188 aa, Glycine max
  Coding DNA Sequence Number=SeqID_59777
  Gene Ontology: Mol. function=unfolded protein binding; Cellular component=cytoplasm; Biological process=protein folding
  Homolog annotation: Hit_ID=P0A6Y5; Match level="QueryCoverage=71%, HitCoverage=52%, E-value=6e-53, Identity=76%"; Hit description=33 kDa chaperonin
  Pfam annotation: Domain name=HSP33; Domain location=5-128; Score= -70.8; E_value=5.3e-06; Accession=PF01430.10; Description=Hsp33 protein
RGRPGSRYPGGLSGRLLHAFRAVANPPVLPAQEPNLDDFNHLATLTETVKSEELIELPATDVLWRLYHQEEATVYDPAPVSFKCTCSRERCGEVLKTLPPEEVDEILVEDGKIDMHCDYCGTHYVYDAVDIAAIHLETLGISGTTEVVYNPDYATLFQEETRPELEGYARGTLTQSGAIAVDTGIFTG

SEQ ID NO: 176556 - protein, 62 aa, Glycine max
  Coding DNA Sequence Number=SeqID_59778
MTSDDLQKDANAVGAGSEVGVLVGSEDAGGDERFLGGVELWLGREGLGTTKKKTREFFFHFF

SEQ ID NO: 176557 - protein, 56 aa, Glycine max
  Coding DNA Sequence Number=SeqID_59779
MVSEEPIIRDNVSDFSDDEQQHNFHEHGEPNNQINMVMDVIGGLEYRSAKYARGGS

SEQ ID NO: 176558 - protein, 107 aa, Glycine max
  Coding DNA Sequence Number=SeqID_59780
SSLSQTGMRFRDCNHIVEFVFVEFVSATYRLRSKKSRKGKSPEKGGNRFWKLCFRDCNHIVELVFVEFMSATYRLRSKKTTKGKGGKRFWKSIVVGFKTPREAIEVY

SEQ ID NO: 176559 - protein, 122 aa, Glycine max
  Coding DNA Sequence Number=SeqID_59781
MVGPYGEHGDNDTDGGGVRAHRWNCKRMAVHIRMIVNLLEMLKSTEVVWLPETKEHPTYNPSPLIKIQQRFGRGLKNWNIALSIIALFSTSRSLSPRSPLSAISHIGSQLSRASILSTHPTT

SEQ ID NO: 176560 - protein, 172 aa, Glycine max
  Coding DNA Sequence Number=SeqID_59782
MVCLVCWNDKSVCNKYRSILEAKKCEDYVDEGEIRKGLGLSHVGKSGTKAGFAISTVVHPSCGGRCVSGRATRDIKGKKNYMPSSKSLEIAFNHDKWWSKGLEGSYIEDARISRGSSYGNKIHPTIRNNDLYLDLGKRVQACGLPAKPTAHMVYKPYSFEHVQKAGFLACPT

SEQ ID NO: 176561 - protein, 131 aa, Glycine max
  Coding DNA Sequence Number=SeqID_59783
MVSYGVASPFIFLLLHSAAIRPQEEKESIDEEDPRPTSFTWSYINEEPPAAATAEDEDELTPPEPLDFDAGTHTAQEEEAIPEQIPEPSPAPAYAPDDATPVVEPKQTIQDSLVALALDLNEDQPQEEQDV

SEQ ID NO: 176562 - protein, 77 aa, Glycine max
  Coding DNA Sequence Number=SeqID_59784
YTMNSVITVLYFNGRIYEDNDDVIFEGSKKAIQIKRGISFNALKKKIGDKENILLCKFAMTKTLKRCWKVLNNHKKC

SEQ ID NO: 176563 - protein, 49 aa, Glycine max
  Coding DNA Sequence Number=SeqID_59785
MHEYVKKVIWTFQLPVTKDKTNIQRMRDNMMQMHKSATGGCTQHGNILK

SEQ ID NO: 176564 - protein, 257 aa, Glycine max
  Coding DNA Sequence Number=SeqID_59786
  Gene Ontology: Mol. function=helicase activity; Biological process =viral genome replication
  Homolog annotation: Hit_ID=Q1SRJ5; Match level="QueryCoverage=98%, HitCoverage=32%, E-value=1e-64, Identity=46%"; Hit description =Probable helicase [imported]-Arabidopsis thaliana-related
MFHPQTVLDSNGYPIYRRRNDDHTISKNGVIIDNIYIVPYNAKLLRKYQAHINVEWCNQNTSIKYLFKYINKGYDRVTAVVIHDDNGTLENAISQNDEIKEYVDCRYISPCEATWRIFCFPIHARKPAVERLHFHLPGQHNVFYEDDDDIDDILSKPCISESKFLAWMNSNKCFQRARSWNLRKKDNTIGRLIWVPPTTGELFYQRMMLTACKGATSFKDIRTVENVLYPTYREACFAMGFLQDDREFVEAIKEVKD

SEQ ID NO: 176565 - protein, 140 aa, Glycine max
  Coding DNA Sequence Number=SeqID_59787
MGQELQHSISSVSICSGTQSDIRVKSYCRLNWLRDSTFNFERLDILRDSIRHPSKKLLSFVLAQSFNIQFRASRYVTGLNQTSEGSTFNFERLDILRDSIRHPSKKLLSFELAKRFNIQFRASRYITGLNQTSEKKVIVV

SEQ ID NO: 176566 - protein, 153 aa, Glycine max
  Coding DNA Sequence Number=SeqID_59788
  Gene Ontology: Mol. function=RNA-directed DNA polymerase activity; Biological process=RNA-dependent DNA replication
  Pfam annotation: Domain name=AT_hook; Domain location=119-131; Score =14.9; E_value=0.061; Accession=PF02178.9; Description=AT hook motif
MKWRKASGVLCDAKLPIKLKGKFYRTAVRPAILYGTECWAVKSQHENKVGVAEMRMLRWMCGKTRQDKIRNEAIRERVGVAPIVEKMVENRLRWFGHVERRPVDSVVRRVDQMERRQTIRGRGRPKKTIREKWVYDPNIVGSWYLTHATKNAS

SEQ ID NO: 176567 - protein, 154 aa, Glycine max
  Coding DNA Sequence Number=SeqID_59789
MEAMMSMKKIMETNAVAVAAISIVAKVNSMPPSGLNQMNHPTSAMVGKDLGSTSGPYYVKIQNKHAFPPYSLPPNYTPPNVVYTLDEDVNNFAPILIESRQPHHAHVSQPMGETHEIPHHTLVDFEPCLEYATEGQVVGDIPLQNTLEGPQYQP

SEQ ID NO: 176568 - protein, 175 aa, Glycine max
  Coding DNA Sequence Number=SeqID_59790
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=3e-17, Identity=24%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHALAFRGLHVLTFRGLDVFHFRGPHILPFRGLHVLTIRGLHVVAFIGLHVHPLRGLQVLTFRGIHVLAFIRLQVLPLRGLYALTFRGLHVLALRRLHVLRFRGLHVLAFRGLHVLPFRGLHVLTFRGLPVLALRGLLVLPFRGLHALAFEGLHAFTFRGVHVLQFRGLRILAL

SEQ ID NO: 176569 - protein, 61 aa, Glycine max
  Coding DNA Sequence Number=SeqID_59791
MDMKSYEGEDGKTFSPLKARTCCPVMVTTCTPLKVWECSPMKARACSPPKGRTFTPLKVRT

SEQ ID NO: 176570 - protein, 62 aa, Glycine max
  Coding DNA Sequence Number=SeqID_59792
  Gene Ontology: Mol. function=protein binding; Biological process =phosphonate transport
  Homolog annotation: Hit_ID=P16692; Match level="QueryCoverage=69%, HitCoverage=17%, E-value=2e-09, Identity=61%"; Hit description =Protein phnP
MALNEVIGCPQVILTHISHQFDVWMMDNPLPDGIEAGFSPSPVGEGWGEGNRPHLTSIVIVF

SEQ ID NO: 176571 - protein, 75 aa, Glycine max
  Coding DNA Sequence Number=SeqID_59793
  Gene Ontology: Mol. function=ribonuclease H activity; Biological process=DNA integration
MELASSVVVIFIKRELICQYGLPRKIITENVSYKDWHEMLPFALHGYKTSVRTSTGATPYSLVYGMEAVLPFEVE

SEQ ID NO: 176572 - protein, 174 aa, Glycine max
  Coding DNA Sequence Number=SeqID_59794
  Gene Ontology: Mol. function=molybdate-transporting ATPase activity; Cellular component=outer membrane-bounded periplasmic space; Biological process=molybdate ion transport
  Homolog annotation: Hit_ID=Q8D002; Match level="QueryCoverage=96%, HitCoverage=63%, E-value=7e-58, Identity=64%"; Hit description =Molybdate-binding periplasmic protein of molybdate ABC transporter
  Subcellular localization annotation: CTP_CleavageSite=57; ConfidenceScore=5.19e-01
MQNTLYHWAAAAVITVSLSGQALAAEKITVFAAASLTNAMQQVATQYQQKSGVEVVSSFASSSTLARQIEQGAPADLFISADQQWMDDAVAKNSVIGSTRYTLLGNDLVLVAAKSAHAQPVTINAQTPWQNLLKGERLAVGDPDHVPAGIYAKEALQKLGAWDTLSSRLAPANN

SEQ ID NO: 176573 - protein, 270 aa, Glycine max
  Coding DNA Sequence Number=SeqID_59795
  Homolog annotation: Hit_ID=UPI00003CCF3D; Match level="QueryCoverage =67%, HitCoverage=73%, E-value=6e-08, Identity=27%"; Hit description =COG5266: ABC-type Co2+ transport system, periplasmic component
MKKFSLALIVLMTTLAAEAHVPFLKPNQFNVTHHRLTIESAFTEFPFQADFAMDSPNFTITSPSGEVAAIQPIAKTKAAVYLEPTLKEEGTYRISTGKRVGPVYKAVETPDKKLYFAADMKRVSGKPTTMNYYSYADTYIFKGQQNYVAKPFNKGLEIIPLASPNGLLLGGELSFQVLEHGQPVSNARIIVVTDNEHFIKHRIEDLYDVENVRASNLHANQQGVFSFKPQKAGLNFLFVTVHHQLNPQLWESLNASLTLEVNLPVTQGKP

SEQ ID NO: 176574 - protein, 172 aa, Glycine max
  Coding DNA Sequence Number=SeqID_59796
MDNEEGVQEQMKADMSALKDQMASITEAMLKIQKSIEDNATTVASNTTREAELVLQPAMNLGRDKSATGFNRRYSPQACPYGLPPDFTPRTAPDDLSQSPTFKGQLLPHADYPLQEDDERDAHLGPLLPLKEPTPHELPHPCPSMPRLNPHPLRNSFPFQRTRERSICLEKG

SEQ ID NO: 176575 - protein, 118 aa, Glycine max
  Coding DNA Sequence Number=SeqID_59797
DRECAELIGETADDVNRVKIELVNLCCFWQDGDLDLNASPQALDKLLGHVLAFKVRIQSKFKNAVVLRYSKDLDLINVVLEMLPDSEQSLSVTADHDPVAGLPLHPKSGCHMMKPMMS

SEQ ID NO: 176576 - protein, 428 aa, Glycine max
  Coding DNA Sequence Number=SeqID_59798
  Gene Ontology: Mol. function=transferase activity, transferring glycosyl groups; Biological process=lipid A biosynthetic process
  Homolog annotation: Hit_ID=Q4USP7; Match level="QueryCoverage=52%, HitCoverage=56%, E-value=1e-100, Identity=82%"; Hit description =Lipid-A-disaccharide synthase
MALRAWPSSTCEHHHVQARDAFGDLPGSLEEGFAEARDFAQAAARQHRQHLGRSRQAKRGARFLAVALQRNVVGHRMADEARVDAVLGIDGRLHREQAQHQVGAAADLLGTLLTPGPDRGADVMHGAHATLLQPALDAQVEVGGVDADEHVRLPVQRTLAERRAQLQQARQMAQYFGQAHHRQFAGIVPGLAAGAAHGVATDAGEFGMREARFQFANQARTEQIAGASPATRAIRNGRSLSTRCAGTLPQGPLGVLDEVQHGLHVIAVTRLFGQLHLGFGQRQARHVQGAVGTLDGGNALGIETAALQAFAVDAARAAQRIGADHGERRNVAIGQRPHAEEGMRADPAELVGTGEAADDHVVAHGHMAGQAGVVGEHAEVADMAVMRHVRVGQHPVVVADAGDAAACAGATVQRDELAEHVAVADHQL

SEQ ID NO: 176577 - protein, 111 aa, Glycine max
  Coding DNA Sequence Number=SeqID_59799
MRNHGSIGLLRGWCFGEEFGSECFGLFLFCFCLVQGEKVTDAQDFGWQSKGEDHFRRGWAFSLWVKVYGELGFWLKACRTAGHDICQSVGLASDSGIKGMSHIISMTHMQQ

SEQ ID NO: 176578 - protein, 181 aa, Glycine max
  Coding DNA Sequence Number=SeqID_59800
  Gene Ontology: Mol. function=protein dimerization activity
  Homolog annotation: Hit_ID=Q1RTL4; Match level="QueryCoverage=87%, HitCoverage=37%, E-value=2e-12, Identity=33%"; Hit description=Zinc finger, TTF-type
MSNKKYESGYEKLKKKQKVEKLIESQRGALDKFVIIHKNDAEASSIGENVIEQPLINHTDNEKNIIEQPPIDNTDNDVEQPPINNTDNTNSHNFNQELEDNILEIGVEGNVERNNTSSEVPTNIYDPGLWKNIDGKFRDLMIENGPIRHDNFQYPKDENNRYFYSSCYQRTLSNGEKHDRR

SEQ ID NO: 176579 - protein, 232 aa, Glycine max
  Coding DNA Sequence Number=SeqID_59801
  Gene Ontology: Biological process=conjugation with cellular fusion
  Homolog annotation: Hit_ID=Q6G1T3; Match level="QueryCoverage=91%, HitCoverage=71%, E-value=5e-13, Identity=24%"; Hit description=TrwI1 protein
  Pfam annotation: Domain name=TrbL; Domain location=45-232; Score =16.9; E_value=9.4e-05; Accession=PF04610.4; Description=TrbLVirB6 plasmid conjugal transfer protein
MAAPTTGVQLFSLGWIADWIDKSITTMLTDVVTPLVASVTEKIMPVVGLGLSIALIWYGWLIMNGTIQTPILQATRKLVSIAVIVGIAGAGGLYQRQIAGVMLDLPTDVAKIFTGTIKTPAQIMDDAANNGTEISTRLQERAPTGLKNIGKAFVFMLIALIITIISSIMSAIGMIVLITVKLGMGLVVVLGPLCILALLFEVTKDFFKYWLAQAAYYAIYAGLFMVVFMFIM

SEQ ID NO: 176580 - protein, 95 aa, Glycine max
  Coding DNA Sequence Number=SeqID_59802
QTQVDVPSTCTTKDLPSNVLRQRSQAVKPLILCEWGYKRILRRENGRHKRIQAGEVNEKMNSTSSKVRKTKKLQKAFGPKKKKKVKEIQGLQRID

SEQ ID NO: 176581 - protein, 121 aa, Glycine max
  Coding DNA Sequence Number=SeqID_59803
MGDQEETQEQMKADMSALKEQMASMMEAMLGMRQLMEKNVATAAAVSSAAEADPTLLATAHHPPSNIVGRGRDTLGHDGNPHLGYNRAAYPYGLPPNYSPPVLQDDACGVPKIMTGLIAMI

SEQ ID NO: 176582 - protein, 234 aa, Glycine max
  Coding DNA Sequence Number=SeqID_59804
  Gene Ontology: Mol. function=5-formyltetrahydrofolate cyclo-ligase activity; Cellular component=cytosol; Biological process=folic acid and derivative biosynthetic process
  Homolog annotation: Hit_ID=UPI00005F9234; Match level="QueryCoverage =74%, HitCoverage=87%, E-value=9e-70, Identity=69%"; Hit description =COG0212: 5-formyltetrahydrofolate cyclo-ligase
  Pfam annotation: Domain name=5-FTHF_cyc-lig; Domain location=43-224; Score=214.2; E_value=2.9e-61; Accession=PF01812.10; Description=5 -formyltetrahydrofolate cyclo-ligase family
MGSRVTACDGISEIPLLSGLCVLNATLSKPDTMPFQPQFAQQRQAIRQLIRQRRRELTPGQQRFAADKIAERLVAHTHIKAAHSIAVFLSFDGELDTGPLIEQLWTLGKRVYLPVLHPFSPGHLLFLRYAPETPLVRNRFNILEPRLDVRQVLPLGELDVVLTPLVAFDHTGQRLGMGGGFYDRTLQNWRSGGPYPIGLAHDCQQVEHLPTEHWDIPLPEILTPLCSWAWHEPK

SEQ ID NO: 176583 - protein, 251 aa, Glycine max
  Coding DNA Sequence Number=SeqID_59805
  Gene Ontology: Mol. function=DNA binding; Cellular component =intracellular; Biological process=regulation of transcription, DNA -dependent
  Homolog annotation: Hit_ID=UPI00005F9C6B; Match level="QueryCoverage =70%, HitCoverage=66%, E-value=1e-91, Identity=93%"; Hit description =COG1414: Transcriptional regulator
  Pfam annotation: Domain name=HTH_11; Domain location=83-137; Score =0.5; E_value=0.083; Accession=PF08279.2; Description=HTH domain
  Pfam annotation: Domain name=HTH_IclR; Domain location=80-168; Score =103.7; E_value=5.6e-28; Accession=PF09339.1; Description=IclR helix -turn-helix domain
  Pfam annotation: Domain name=IclR; Domain location=197-251; Score= -27.9; E_value=0.041; Accession=PF01614.9; Description=Bacterial transcriptional regulator
  Pfam module annotation: Pfam domain module=HTH_11::HTH_IclR::IclR; Domain location=83-137::80-168::197-251
MPGKLAKPLVSICVTDGSLQCGGNIADFWPAADNETAFRLHVMQALGAGWRFDTGEIFAMSLKAVDEKDDKKDKPLGSQSLFRGLQLIEILSNFPNGCPLAHLSELAGMNKSTVHRLLQGLHTSGYVTQAPSPGSYRLTTKFISIGQKALSSLNIIHVAAPHLEQLNLEVGETVNFSSREDDHVILIYKLEPTTGMMRTRAYIGQHMPLYCSAMGKIFMAYGNDDYPAHYWQSHQQEIQTLTRNTITELPK

SEQ ID NO: 176584 - protein, 116 aa, Glycine max
  Coding DNA Sequence Number=SeqID_59806
  Gene Ontology: Mol. function=nucleoside-triphosphatase activity; Cellular component=membrane; Biological process=transport
  Homolog annotation: Hit_ID=UPI00005F9C6A; Match level="QueryCoverage =94%, HitCoverage=21%, E-value=3e-43, Identity=78%"; Hit description =COG1129: ABC-type sugar transport system, ATPase component
  Pfam annotation: Domain name=ABC_tran; Domain location=34-116; Score=- 59.4; E_value=0.031; Accession=PF00005.17; Description=ABC transporter
MDNAAQPILTLSHIVKRFGGNVAVNDVSLQVMPGEVLALLGENGAGKSTLIKVLAGVYPRDGGDIRFQGASIASAAAIKSASRQPIAFIHQDLGLIEWMTVAENMALVMGFPRRFG

SEQ ID NO: 176585 - protein, 254 aa, Glycine max
  Coding DNA Sequence Number=SeqID_59807
MAPKKLSTKRSRRDAVAEGTSAIPEFDSHRFRSVVHQQRFEAIKGWDDEYTDFQEEIACRHWTSLATPMAKFDPEWIPFDADALNQFLGDPLVLEEGQKADGFDEEAIAQLLCTPGQDFARTVAGRRVRIMRTSMTTLTQMWMMLLLSNVLPSDHNSDLPLPKCPLVYAILTRMSVHVAQLIVDAIYLFAGMPPTRHPLDPDKSNRALGFPALITGFCQSFGVPVTPNAPPAPHQADPAGSLGMERYLQHLVRQ

SEQ ID NO: 176586 - protein, 117 aa, Glycine max
  Coding DNA Sequence Number=SeqID_59808
  Gene Ontology: Mol. function=RNA-directed DNA polymerase activity; Biological process=RNA-dependent DNA replication
MLECLVGKSHYCFLDGSSCYMKITIAPKDQEKTIFTCPFSTFAYRRMPFGLCNAPGIVLGHIISNKGIVATYPSAGGRRVTRGMRVPRKEYARSRHQRLFEENVGKTGKDAIYELLS

SEQ ID NO: 176587 - protein, 57 aa, Glycine max
  Coding DNA Sequence Number=SeqID_59809
MSMESLVGRLGVHDKTNHILGDQSESRCFVRMLQPCGIDTYLKEHSNRVYLPQGLHS

SEQ ID NO: 176588 - protein, 88 aa, Glycine max
  Coding DNA Sequence Number=SeqID_59810
VVPGDMSRGSGDLGDVRRAPGSQQIKGTKTTKQGGLCGGWPAVNFDLYVRYGLWLQKGNWEIVEASGNRLPVCVIDYTEEWVTGNRLP

SEQ ID NO: 176589 - protein, 149 aa, Glycine max
  Coding DNA Sequence Number=SeqID_59811
  Gene Ontology: Mol. function=RNA-directed DNA polymerase activity; Cellular component=mitochondrion; Biological process=RNA-dependent DNA replication
MANFKAAGVIPKDLNWQQRKKFFHDVRHYIWDDPHLFKVGFFWPALFKDAHHHVLKCDQCQRMGGISQRNEMPLQNIMEVEVFYCWGIDFIGPFPSSAGNKYILVAIDYVSKWVEAMATSRNDAKTMVKFIKENIFARFGVPRILIRDG

SEQ ID NO: 176590 - protein, 107 aa, Glycine max
  Coding DNA Sequence Number=SeqID_59812
MTEIKRKYCYAIRPFGPSRLGSNLARLSELGGNLLPLFPINRLKGAVLRVPDPPGDVFKLFWVNKNGFREDNPSRGASVTLPRCFRKQIREGFPPLFTVLQRVSFQI

SEQ ID NO: 176591 - protein, 46 aa, Glycine max
  Coding DNA Sequence Number=SeqID_59813
MELTSDADITRKGADDDSWSKDAGISGEAADDDISHCMLSGFESYG

SEQ ID NO: 176592 - protein, 68 aa, Glycine max
  Coding DNA Sequence Number=SeqID_59814
MPILGKDLWRQQGEQLLQRYLGFNLNEVELKHSLTRGICGLSFGFKYAVTIMLFGLSLVQQDGFKDKA

SEQ ID NO: 176593 - protein, 61 aa, Glycine max
  Coding DNA Sequence Number=SeqID_59815
MWPSAPFPEMSASSDGDFSSLTSYPELRRAGGPDDTRRYLTVIRTLLSSRAGRPDDMQRLT

SEQ ID NO: 176594 - protein, 111 aa, Glycine max
  Coding DNA Sequence Number=SeqID_59816
MEAMKEQMATMMEAMISMKKIMEANAVAVAATSAVAKVNLMPPSGLNQMNHPTLARVGKDLEITGGPHYAQIQNKHAFLPYGLPSNYTPPNVAYTPNENVNNSTPILIESQ

SEQ ID NO: 176595 - protein, 87 aa, Glycine max
  Coding DNA Sequence Number=SeqID_59817
  Subcellular localization annotation: CTP_CleavageSite=47; ConfidenceScore=5.13e-01
MASMDTSAMVNSKIFPCNLGMRGFGEFVPFLDTASRGNEMPQRTFLRRRHGPSVGLFTVGIKTEPICNAYAKDTMRECAQYDNIYRT

SEQ ID NO: 176596 - protein, 75 aa, Glycine max
  Coding DNA Sequence Number=SeqID_59818
MLSRIQFRTLSPLGFTIKYSWRENKESHEDSKNGGFNPFSVSMTFRNSIGTVGGKARGINRDAIIAVRRHVIPLR

SEQ ID NO: 176597 - protein, 89 aa, Glycine max
  Coding DNA Sequence Number=SeqID_59819
  Homolog annotation: Hit_ID=Q1SIT1; Match level="QueryCoverage=47%, HitCoverage=12%, E-value=3e-08, Identity=60%"; Hit description =Integrase, catalytic region
AGEERKFQLSELDEIHLEAYENSKFYKEMAKKFHDNLIAKKDFVLRSKVNPYKSFMVNGHRLKPFLINPSLVDVVVEETSLLHPTSLLP

SEQ ID NO: 176598 - protein, 89 aa, Glycine max
  Coding DNA Sequence Number=SeqID_59820
MEGRPVKANIHSTSSDMSKCQTQEEKERQSLNRNVVRDKTNIYYPYSLLFPGFQFPTQLTTSTSPPLVPLTHPLQIFPNFTFILYDIYL

SEQ ID NO: 176599 - protein, 98 aa, Glycine max
  Coding DNA Sequence Number=SeqID_59821
MTMPLTLRNKLKTLCTCGDGWSYAIFWRFHPRNSLLLTVEEAYYEEHLGEEIANMHPQDDSELQQQFSSGIKTIVVVPVKAWGVVQFGSRKKQMFLTI

SEQ ID NO: 176600 - protein, 105 aa, Glycine max
  Coding DNA Sequence Number=SeqID_59822
  Gene Ontology: Biological process=response to biotic stimulus
  Homolog annotation: Hit_ID=Q9SMF5; Match level="QueryCoverage=95%, HitCoverage=94%, E-value=1e-36, Identity=57%"; Hit description=Major latex protein homolog
  Pfam annotation: Domain name=Bet_v_I; Domain location=3-104; Score =42.6; E_value=1.3e-09; Accession=PF00407.9; Description=Pathogenesis- related protein Bet v I family
MAESDMLVKASADHFYDSLKGKKQHRVHDVAPDHIHKVEVHQGEWAEKSGNIKELTFAVEGDEHSLVKWTFLYEKVDHTASEPTKYKDLVVKLVKNVEALLVEAG

SEQ ID NO: 176601 - protein, 97 aa, Glycine max
  Coding DNA Sequence Number=SeqID_59823
MKKGFSKDEVDERKRKRNDGRLCNLVETQKQKKGMLETLGALANIGTIHKQCSHCQHLKCNVNSASFKGSPLKHEVDATGLVESMHWHGSIILVSQM

SEQ ID NO: 176602 - protein, 48 aa, Glycine max
  Coding DNA Sequence Number=SeqID_59824
MCQKHLQNLARPKQCSYGNFQLETQKFPTEKIFFVTNNPWLADAKKTI

SEQ ID NO: 176603 - protein, 35 aa, Glycine max
  Coding DNA Sequence Number=SeqID_59825
MEPKFCLYGLPTASLAKMGSAYGAHARARFVMPAE

SEQ ID NO: 176604 - protein, 66 aa, Glycine max
  Coding DNA Sequence Number=SeqID_59826
MDRHRPCHNGVKHYESFSMKEEEFVDNMFGRLQVILNSLEALGYTFTKAQINRFYTTFPRCGNQKQ

SEQ ID NO: 176605 - protein, 147 aa, Glycine max
  Coding DNA Sequence Number=SeqID_59827
  Homolog annotation: Hit_ID=Q2R3L0; Match level="QueryCoverage=87%, HitCoverage=27%, E-value=3e-20, Identity=37%"; Hit description =Expressed protein
AAAYYYHGLILDEGNTEKSQGMAVAALQAADEYFKESKKLCEAFNAAPPLSRNPPLWGTMKYLYEKIPKDTSSKVRINRDLYSYERTDKIMCFVVNAYYRIMETAPTLPDFALALKPDEYQLPQVDPSWRTENVKGGQSGATNHVNG

SEQ ID NO: 176606 - protein, 97 aa, Glycine max
  Coding DNA Sequence Number=SeqID_59828
MRDEPGKLGYGAQLRANLDPTKGVGRLRQQDGGHGSRNPLRSVLPTLETAQPEVGSSGWKSTARRVVSGAPPAALENPEDRVPPTPGRTHNRIRSPR

SEQ ID NO: 176607 - protein, 150 aa, Glycine max
  Coding DNA Sequence Number=SeqID_59829
  Gene Ontology: Mol. function=transporter activity; Cellular component= membrane; Biological process=transport
  Homolog annotation: Hit_ID=Q06H34; Match level="QueryCoverage=84%, HitCoverage=69%, E-value=1e-42, Identity=69%"; Hit description =Tonoplast intrinsic protein alpha TIP
  Pfam annotation: Domain name=MIP; Domain location=13-150; Score=71.6; E_value=2.5e-18; Accession=PF00230.10; Description=Major intrinsic protein
MATRRYEFGRMNEASHPDSIRAALVEFLSTCIFVFAGEGSALALRQIYKEPGSSAGELVVIALAHAFALFAAISASMHVSGGHVNPAVTFGALLGGRISVLRALYYWVAQLLGSIVAALLLRLVTNNMVYMLHQIPLFPLTPFLIREIIT

SEQ ID NO: 176608 - protein, 82 aa, Glycine max
  Coding DNA Sequence Number=SeqID_59830
  Gene Ontology: Mol. function=transporter activity; Cellular component= integral to membrane; Biological process=transport
  Homolog annotation: Hit_ID=Q1RUE1; Match level="QueryCoverage=63%, HitCoverage=21%, E-value=2e-18, Identity=70%"; Hit description=Major intrinsic protein
MNPARAFGPAMVGWRWHYHWIFWVGPLIGAALAALLYEYVMVPIEPPHHQPLAATKVATDIFSVKCKRFNAFENFNDSAKFQ

SEQ ID NO: 176609 - protein, 199 aa, Glycine max
  Coding DNA Sequence Number=SeqID_59831
  Gene Ontology: Mol. function=acetylglucosaminyltransferase activity; Cellular component=membrane; Biological process=electron transport
  Homolog annotation: Hit_ID=Q9FLD7; Match level="QueryCoverage=65%, HitCoverage=29%, E-value=1e-42, Identity=67%"; Hit description =Glycosylation enzyme-like protein
  Pfam annotation: Domain name=Branch; Domain location=82-199; Score =49.4; E_value=1.2e-11; Accession=PF02485.11; Description=Core-2I -Branching enzyme
MEPSKHHQRHQNKTKKKWFLPLILSLLISTFLILLSVIVSSNSPSQRWHHHHRAPVPKEVVPRFVESKLKISPTSTHLVPRIAYLISGSMGDGESLKRTLKALYHPLNHYAVHLDLEASSKERLDLANFVRNEPLFEKFGNVRTVVKANLVTYRGPTMVTNTLHAAAILLNEAQDWDWFINLSASDYPLVTQDGRYLSC

SEQ ID NO: 176610 - protein, 198 aa, Glycine max
  Coding DNA Sequence Number=SeqID_59832
  Gene Ontology: Mol. function=RNA-directed DNA polymerase activity; Biological process=RNA-dependent DNA replication
MTNAAARKEEEHAEIEIQQESIRQVTSIHHQLTNEEEKPEVSSTPEYPYLAIVGYVGGKDKGRLELSVEDQKISFDLFEAMKHSDMGDSCFEEEEVEQEIALLASTMILQSPLEKEHGYGRDCLACDEELDDSKDSCVNQVVFEELEKLRPAEKPKAELKTLSAHLKYVFLEEDETKPVIISNSLKKEEEDQLVQILK

SEQ ID NO: 176611 - protein, 159 aa, Glycine max
  Coding DNA Sequence Number=SeqID_59833
QTQEHRSLEQMDQWLTLNSGFTCDSPQISASPHQLDLAPYASGPYNAQWNAPGLLHDKHTLRSSRILGEMEVDEPWLGLWLPLNYQVDMGASGVCHRKCGRLALWLILGMAFVNNWAVGKEKVCYWLSNDIVGLVGNLAVLEWQSQHGLLLHPHPLHLP

SEQ ID NO: 176612 - protein, 82 aa, Glycine max
  Coding DNA Sequence Number=SeqID_59834
MANLHGFAQENISEALRKHLGLDFLHKNNFFHPKQLKCIARGMKDIWNNPDSPIYSKKGEEVAAQGSNPASKIFWKGPDSNI

SEQ ID NO: 176613 - protein, 152 aa, Glycine max
  Coding DNA Sequence Number=SeqID_59835
MWAFLTSRQIDWAHLLRYRMHKALRANAPLSYPHLVTLFLHHFKIPWKMNHLFKEKGLLLLVLWVRKHDLPQPIPDERTLSPPPQRVDSSSLLNDVLSELHSLRAFVGDRFDAMDTPLDAMDAHFDGMDTRITRLEDDMSFIRRCFDPPANP

SEQ ID NO: 176614 - protein, 54 aa, Glycine max
  Coding DNA Sequence Number=SeqID_59836
MVSNGRNDGSVTRQYINGVKWSLVASVVVGDGEIEIKDNTLRIKMVKKIKWRVT

SEQ ID NO: 176615 - protein, 264 aa, Glycine max
  Coding DNA Sequence Number=SeqID_59837
  Gene Ontology: Mol. function=hydrolase activity, hydrolyzing O -glycosyl compounds; Cellular component=membrane; Biological process =carbohydrate metabolic process
  Homolog annotation: Hit_ID=P14749; Match level="QueryCoverage=98%, HitCoverage=63%, E-value=1e-143, Identity=87%"; Hit description =Alpha-galactosidase precursor
  Pfam annotation: Domain name=Melibiase; Domain location=1-264; Score=- 82.7; E_value=3.8e-11; Accession=PF02065.9; Description=Melibiase
MEWNSWNHFGCDVNESVVRETADAMMSTGLAALGYQYVNIDDCWAELNRDTEGNMVPNAASFPSGIKALADYVHSKGLKLGIYSDAGNQTCSKRMPGSLGHEEQDAKTFASWGVDYLKYDNCENNGIKATDRYPPMSEALLKTGRPVFFSMCEWGWQDPATWAKTVGNSWRTTGDIEDNWNSMTNIADANDQWVSYAGPGGWNDPDMLEVGNGGMTTEEYRAHFSIWALAKAPLLVGCDIRSMDKTTFELISNPEVIAVNQGMN

SEQ ID NO: 176616 - protein, 88 aa, Glycine max
  Coding DNA Sequence Number=SeqID_59838
  Homolog annotation: Hit_ID=Q1RS97; Match level="QueryCoverage=75%, HitCoverage=17%, E-value=1e-07, Identity=47%"; Hit description =Glycoside hydrolase, clan GH-D
  Subcellular localization annotation: CTP_CleavageSite=52; ConfidenceScore=5.33e-01
MYINTIQIKSLISTKGKRSNYPMGGVWPRPLWTRFLLSVNTDNLLLPFTNKRAVEGFPCKSTRMHKASTIISMGNLRLQLENEYCIAI

SEQ ID NO: 176617 - protein, 193 aa, Glycine max
  Coding DNA Sequence Number=SeqID_59839
  Gene Ontology: Mol. function=transcription factor activity; Cellular component=nucleus; Biological process=regulation of transcription, DNA-dependent
  Homolog annotation: Hit_ID=Q8L701; Match level="QueryCoverage=60%, HitCoverage=38%, E-value=5e-22, Identity=51%"; Hit description =Putative Ap2 domain protein
  Pfam annotation: Domain name=AP2; Domain location=78-143; Score =126.3; E_value=8.8e-35; Accession=PF00847.10; Description=AP2 domain
MAAPPTKYTHHTKLLIPPGPEEDPPKHPYPKLLRITVTDTDATDSSSDEEQTNFSTRHRHRKLINEISIARASDTRRGQKFRGVRQRPLGKWSAEIRDPSQRGVRLWLGTYNTAEEAALVYDNAAIKLRGPHALTNFITPLLNEDTHNKFLFSPTSVLHVSENKVKVRGCSPVPDSVLFCDDDWSSEFLTASE

SEQ ID NO: 176618 - protein, 131 aa, Glycine max
  Coding DNA Sequence Number=SeqID_59840
MGLSLRLRLGHSFSNTAEGSSGRWEHQGSSESTSFTAFRSLFKLPSLPFAGIDDNNLPHQPSTEGEVAQRNGMNLMSDIVVVAGGAIVVHGVIFEEGLQEVTPLLCRQRRQNKFKLNVSIRLHVHHQVGSD

SEQ ID NO: 176619 - protein, 143 aa, Glycine max
  Coding DNA Sequence Number=SeqID_59841
MHKALRLNAPLPYSHLVTLFLQHFNIPLDSKLYVPIKRSFLIGAAVIASFGYRKEHDGSWDKKGAQPIDEEGHLHGGEDSFLFQKILDRFDGLQSFVGERFDTLELQVDMRFNEMDSRITKVEEDVSYIRTSFDLPPPLPPSS

SEQ ID NO: 176620 - protein, 61 aa, Glycine max
  Coding DNA Sequence Number=SeqID_59842
  Gene Ontology: Mol. function=nucleic acid binding
MVCLKARDSMWYLDSGCFGHMMDNKSKLANFVSKDGGCVTFGDNNKGKIMGEGNIGNQHKT

SEQ ID NO: 176621 - protein, 108 aa, Glycine max
  Coding DNA Sequence Number=SeqID_59843
MAKKNESYVKQANKNRKEVVLEPGDDVEHLKANAFQEEGNDKNLETAQIQGPMTKSRTKQSVDALQQMVADILNKAQVEKDEGPKAEALQSILIVAEGPCQICSIFYL

SEQ ID NO: 176622 - protein, 126 aa, Glycine max
  Coding DNA Sequence Number=SeqID_59844
  Gene Ontology: Cellular component=membrane; Biological process =protein complex assembly
  Homolog annotation: Hit_ID=Q8YGI7; Match level="QueryCoverage=73%, HitCoverage=31%, E-value=1e-33, Identity=60%"; Hit description =CYTOCHROME C OXIDASE ASSEMBLY PROTEIN COX15
MAADGWCCGAVGSVHTVAMVAQPVREPENGPVRAPHVRLYSSCSGCAAFAAGCYRYCNASDERSAASGPDASVLRVDRSGFRGCALARNKGRLRGVAGPTQVPERGGDLQFPRFILVVTVFAMPRG

SEQ ID NO: 176623 - protein, 97 aa, Glycine max
  Coding DNA Sequence Number=SeqID_59845
  Homolog annotation: Hit_ID=Q11J70; Match level="QueryCoverage=71%, HitCoverage=97%, E-value=1e-17, Identity=58%"; Hit description =Hypothetical protein precursor
MPPRFYPFTVTVHRLVKKREKENCAMPVRLKKLIGTFLLVALVIIYAVFATIIAVAHLAQSSAWVHLLYFFVTGILWVLPAMGIIWWMAQPPRKKQH

SEQ ID NO: 176624 - protein, 216 aa, Glycine max
  Coding DNA Sequence Number=SeqID_59846
  Gene Ontology: Mol. function=oxidoreductase activity; Cellular component=membrane; Biological process=protein complex assembly
  Homolog annotation: Hit_ID=Q8YGI7; Match level="QueryCoverage=100%, HitCoverage=59%, E-value=1e-109, Identity=88%"; Hit description =CYTOCHROME C OXIDASE ASSEMBLY PROTEIN COX15
MQPGHEPTQVNLHEHGEHDPTRKALDRPFRRSFAIGDKAPRNVEYRRYDDAGRRQMDRQAILADARQLAQAGGHHPPADGALQAAEREQTQHAIFEATAEASRHPEEGQRNGDQKPDKTRKQAMRPFPPENVLEFLQRHALVDLLILGNLAILVEFLHPFGVVERRDDAVNGLPFGYGKARTRHACGTADHDDGNQHDENCIKPVTHEATVAVLFG

SEQ ID NO: 176625 - protein, 55 aa, Glycine max
  Coding DNA Sequence Number=SeqID_59847
MVAQTVMVSGGFKKRGWSKGRFEESFASSSRPGQAYHVVDVTVQQCVVFGVVVTM

SEQ ID NO: 176626 - protein, 77 aa, Glycine max
  Coding DNA Sequence Number=SeqID_59848
MESVATYPPAEGRARLKANDDDINVVIQGKQLCEQESTVKGTLVVGTFENGNPTNVASPLHEKLDDHLLIIALQREM

SEQ ID NO: 176627 - protein, 91 aa, Glycine max
  Coding DNA Sequence Number=SeqID_59849
MRWCGRKKRSKLISPWRHPRTPLSNGELTKGALKCNVDASIFTDTTKFRMEATVRDVDGLFISAQTSTKVGILSIAEFEASALLEEIFVVV

SEQ ID NO: 176628 - protein, 55 aa, Glycine max
  Coding DNA Sequence Number=SeqID_59850
MAFPVVVRTEEWNTRIDTLKVQKATMLYIVFVGILQREVHEGQGGENGVSCCGED

SEQ ID NO: 176629 - protein, 207 aa, Glycine max
  Coding DNA Sequence Number=SeqID_59851
MKCKAKNKVGEFSLKIDISKVFDKVEWEYLFALLLKMGFDTKWISWIRLCIETVDFNVMINGDTIGHILPRRGLRQRDPLSPYLFVICMEVSPHSLTPSTLCCSVSFAHSASSNSPFLTTTIFAFSPLPHFLAFLAPSLTAKLLLLTLASALEVYLMVIISVALVVSVAKERFNMDATQVGSTLREGSGVRGRIDSTPTKTKLSWML

SEQ ID NO: 176630 - protein, 241 aa, Glycine max
  Coding DNA Sequence Number=SeqID_59852
MVNNPSRAQKKAKTLKRKQGECFQVALNRLDTWFTDESKKNDYKMIYDAKNVRIPKYLNLEWFSQQGFNFPNLLEAQGLSKLVQLKGTFYPELDKVFYTCALVDLESNLFFIVNGVEMVIHIEVWKEVVGLDMGGVHKFDETADGYNKMQTYRGMLLDPARNLRNLLTVYGLKSGIKMNWVLLIEDIMLKSHQLVDYKFPYVVLASRFIDYFNIDVSNEIVDFTKTSSEIYQKASQEAWNE

SEQ ID NO: 176631 - protein, 114 aa, Glycine max
  Coding DNA Sequence Number=SeqID_59853
MHVSESTMIGVGKRDFVVVGYVFFVDLGLGVGPHVRKSGYGWWLQISVCGDLWWCNGGATVVIWRSSVHVIHLYVGKLRCIDSTVPVEPLFESEVNKLKADQSKPFEQVILGTV

SEQ ID NO: 176632 - protein, 334 aa, Glycine max
  Coding DNA Sequence Number=SeqID_59854
MAEKFQAAIYGEIADAGNYNTWQSITDFVDLKGTRSCVEETNINLVSSDTSMSFLYAEKPHQSGIGSILIDSILQMMGFGMSSSTSPNWSQSLLNFIIISSISLSFVNFFLCIGSNFDSVLQKETNVVGGGSSNDSQIQKDWSPNNFSSSGGGVQVSTIDAFKPMNQEFSLDQQSLNSVVTSTNGSLSSGNFLVFSTSYGCLSTLIQILYEHQPQPQNSLFTNPSMSYGTCSNELSPTWSKVSSLLKPSMPKQQLSGLRFSNNTTYLWNSSTEALNDLRASVFASSQAQYQTPKFEEKPNCLRTPLKKLKREESLDAMKKNSPEPAAFKTLGDE

SEQ ID NO: 176633 - protein, 370 aa, Glycine max
  Coding DNA Sequence Number=SeqID_59855
  Pfam annotation: Domain name=DUF1218; Domain location=212-328; Score =137.1; E_value=4.9e-38; Accession=PF06749.3; Description=Protein of unknown function (DUF1218)
MVREVGVNRCYVQGSRTFKINDIVMHDWKLGEQFRDVRGYDVPGGFINCDGVDVASQNGARSEDPIGALVAGEGSFGDSDDEVEVFLSRMREAEPRAALKWLLENPRGRVEKEVVRDLDNVAEELSESNKVVAAQCHNERKEGDVGRWRVAVARRHDERKEGEGTMAATVKQMSLIVSLFGVVSFILGVVAENKKPAAGTPVPGLDGVSVTCKYPADPTVALGYLSTAFLVASTVTGYLSLFYPYKGKSIPQGVLFKHTTFTVFFNISLFTTGLAAAMLLWPTITEHIHLTRNVHRNINYECPTAKTGLLGGGAFLSLDSSLLWLIALMLADNAREDFFEEEGEDGDKGEFGTASSDAYYDADSGPKASS

SEQ ID NO: 176634 - protein, 120 aa, Glycine max
  Coding DNA Sequence Number=SeqID_59856
  Subcellular localization annotation: CTP_CleavageSite=34; ConfidenceScore=5.14e-01
MKLSSKIGRVSLNSMSKKQFKFDSNGREAPLPVLLAIRPHQRPLMRQVGPIGGIVPPSTTTLAVGEGGQPAGEAARLMPSAGYTLTTQDVPPTPPTIEAPADATTTATTSAFSPLPVVVV

SEQ ID NO: 176635 - protein, 154 aa, Glycine max
  Coding DNA Sequence Number=SeqID_59857
MTQNFKGLHHRPTVSMKLGRGYIQALQQSTLKSGQGRRADEHAPPSKMGNHNFRKPEQPSYKSPQATPGVDDGDPTLWVRCTWGDALTSPLPLPLIIPQEAEEGRITVPGLAPQQQQKVMPFHEDEKHPNQHDVRPSPSRKKRTHHRRHLGEYP

SEQ ID NO: 176636 - protein, 427 aa, Glycine max
  Coding DNA Sequence Number=SeqID_59858
MRVVRQRKSSLPGYLGRLHKGSTTIHNISLLHDQVKVGVEEVRDADAPILVPTEEGAVGPAKPVMWDATVFGVFNENFPLYIKHEDLYEIAHGGQCLNISVIQLWIVHMTETSMGAGNADVYGFLEPQPDNYLKGIINSALKGLDNTPQSKSKATAKWIVVKVDVVEWGPELHTSAWKGAFDRRGIRVPVAGLKWRVDTLSSVKGRLSHVEGVCPGEEFVEPLSMDEHCPMSDCFCHVVYDGCVFGVSGMCNARVLVLHTCHSWSRHVPELRFVREWGSIVVQNFRAPLQLPPITEDLPFFFVRFLEALPSSRMSSFLSDSAIGLGDSDSRGLIEQPIMDQKVISIGGSLSKDTHRGASDGESSSSERGMTFCCCWGASPGTVILPSSASWGMIRGSGSGDVRASPHVQRTQSVGSPSSTPGVAGYE

SEQ ID NO: 176637 - protein, 87 aa, Glycine max
  Coding DNA Sequence Number=SeqID_59859
MDVMDWCETSSKILESIQRLTSSEEDPEEDLEELPPEPAVDALDFLEGDEDPLLEVDSPEEVMSASEADSTEDSGPREMAISGGSSS

SEQ ID NO: 176638 - protein, 80 aa, Glycine max
  Coding DNA Sequence Number=SeqID_59860
MMHKLFIKEIATWRREGDTFGSDPLGMTLGEIEDLMEQDWTGKMESDPTSHHKHLAIFNGDDATRVYQNSDGVKPGVCSN

SEQ ID NO: 176639 - protein, 110 aa, Glycine max
  Coding DNA Sequence Number=SeqID_59861
MVILRLVSTERNKFDSIGMMFRWQEGSLAERCFTRTKLVSYLYFPFISNKRQVKRGNCHILISSGDHPLLGCNPRLTTLRYLAPIVRRSVKFCDMPEVKRKHCSTIREIP

SEQ ID NO: 176640 - protein, 356 aa, Glycine max
  Coding DNA Sequence Number=SeqID_59862
  Gene Ontology: Mol. function=GTPase activity; Cellular component =intracellular; Biological process=translation
  Homolog annotation: Hit_ID=Q11CZ0; Match level="QueryCoverage=69%, HitCoverage=40%, E-value=1e-108, Identity=81%"; Hit description=GTP -binding protein TypA
STLEDPTNQLAILAENLDRLVRLDRTGSDTAGDDAAEEVVGFEDRADHAERTFFDLGLRHVLDDEIEERRKTFISRAFRIDVHPAGTARAVEDREVELLVGCIQSREKVEDFVDDFLMAGIRTVDLVDGDDRAKADLQRLANHELRLRHRAFGSVNENDGAVHHRQHTLDFTAEVGVAGGVDDVDPVLDAGLLVFPGDGGVLGQDGDAAFLFLVVAVHHALGEDGALGQGAGLLQQLVDQGGLAMVDVGDDGDVAKIFDGHTKGGQSAPDLEKEVQHYTSNLTIREKVDFHAGHGAHSAGCPQRRPRPPGPSWLDAFPFCIKDLHVPHRHFSTPPQGPIKVELVADKGAADRGQLR

SEQ ID NO: 176641 - protein, 141 aa, Glycine max
  Coding DNA Sequence Number=SeqID_59863
  Gene Ontology: Mol. function=DNA binding; Biological process=DNA integration
  Homolog annotation: Hit_ID=Q1S3H4; Match level="QueryCoverage=82%, HitCoverage=24%, E-value=1e-30, Identity=47%"; Hit description =Integrase, catalytic region
MSPYRVVFGKACHLPVEIEHKAYWAVKTCNFSMDQAGEERKLQLSELDEIRLEAYENAKFYKVKTKKFHDSMIIKKDFMVGQKVLLYNSKLGLMSVEIKSDSINKSFKVNGHRLKSFLTNPSLVDVVVEETCLLRPTLPLP

SEQ ID NO: 176642 - protein, 672 aa, Glycine max
  Coding DNA Sequence Number=SeqID_59864
  Gene Ontology: Mol. function=zinc ion binding; Biological process =transcription
  Homolog annotation: Hit_ID=Q4SR86; Match level="QueryCoverage=57%, HitCoverage=17%, E-value=6e-16, Identity=26%"; Hit description =Chromosome 11 SCAF14528, whole genome shotgun sequence
MVEEWEVVLKATSSRQLISGLEIEDPSKVVLKATSSRQLISGLEIEDPSKGRNPMGRWADIHGALENVRHGMVIKAGMVSNTQTHQIAARKEKQMEALKAALGIVSSEANERNADGTDELGNDGGNGSNVEGNSKPEHAFLDRDFSKKQMVEDQKDENTKKKSVKDTRHHKKVETLKKKYEDDSSDSDSSLSDEKRGTRKRGKEYTSSSDESDSDSDAKRKVKAEKKRKIPKHHKKGRVEDSDDTNSYDSDDSDIAKKSYKKTDKSHRRHFSDDDSDDHEDVSKHKTWEGKQHSKMRKPHDSAVESDVDREEKKYGRREKQKTKRHSSDDEDSYRDGVKHASGQDRYVRRGSYTSSNDSSSDSDSDSDSSDHRYEKTKKGGPVVAKKGKGYGREENKFRDEARDSGAEKGKNTANIDALDSLKKSYGTDFAKGSNSRSREMTQGSSRKIDGDRDRGAVTLGMKDDSSEQRGRNYNKDVESHFVGRTARYGEDHETRRHIRDDDNHREHEHRRDNDNRGERKHGRDEDDHTGRKLAREEDVGEKKHVKDEDDSKEKHRRHEDGHGDYRIGRKHSRDEDDLGERKHARDEDDSKGKHRRYEDDRGERKNLRDEDDGAERKRGRDEDYRTGRKQTRDENEHIERKFIRDEDDREGRKFIRDEDVYGERKNLRDED

SEQ ID NO: 176643 - protein, 411 aa, Glycine max
  Coding DNA Sequence Number=SeqID_59865
  Gene Ontology: Mol. function=sugar binding; Cellular component =nucleus; Biological process=transcription
  Homolog annotation: Hit_ID=Q2N2B2; Match level="QueryCoverage=80%, HitCoverage=47%, E-value=7e-13, Identity=23%"; Hit description=RPGR ORF15 isoform
MVLGVHWVKTDMLVGGSYTSSNKSSSDSDSDSDSSDHRHEKTKKGGSVAAKKVKGYGMEENRFRDEARDSGADKGKYGANVDALGSLTKSYGRDITKGSNSRSREMTHGNRKIDGDREREPVTVVKHDEDDRKMESESKSARFEGPDDDSSEQRGRNYNKDVESHFVGRTARYGEDHETRRRRKDDDNHREHERIQGIMMTMEKESMEGMKMIVQEESMQGKRMSEKKSMERMRMILKKSTEGMTMALETIVWEESMQGMRMIPKKGSTEERKRGRDEDYRTGRKQARDEDEHRERKFRRNEDDREGRKFRRDNDVYGERKNLRDGDVHGERKNLRENDDRERKHSKDEDGRGERKHRRDDDDPEESSTAGMMMVVEIESTEGRRKSGETKVMRGKAGDLQESQILRFSFE

SEQ ID NO: 176644 - protein, 118 aa, Glycine max
  Coding DNA Sequence Number=SeqID_59866
REFAKRNLQWLSARKTPEEDELLSSLSAPLQVIKRTASSHPLSETNALSQNPLMCAKAIQICAKRTSTNKATYLSLKSDLQRGICRDASSKQKPFGELEMSLRFPDYRKLNPLLDLPY

SEQ ID NO: 176645 - protein, 276 aa, Glycine max
  Coding DNA Sequence Number=SeqID_59867
  Gene Ontology: Mol. function=methyltransferase activity; Biological process=metabolic process
  Homolog annotation: Hit_ID=UPI0000527D92; Match level="QueryCoverage =69%, HitCoverage=97%, E-value=3e-37, Identity=41%"; Hit description =Methyltransferase type 11
  Pfam annotation: Domain name=Methyltransf_11; Domain location=61-154; Score=64.6; E_value=3.2e-16; Accession=PF08241.2; Description =Methyltransferase domain
  Pfam annotation: Domain name=Methyltransf_12; Domain location=61-152; Score=51.2; E_value=3.5e-12; Accession=PF08242.2; Description =Methyltransferase domain
  Pfam module annotation: Pfam domain module=Methyltransf _11::Methyltransf_12; Domain location=61-154::61-152
GCTREGERTMPNDSVTDSRVRDGYSARAAEYTELFGDIAQMDTVDRERIAAWADRVEGRILDVGCGPGHWSAYLAERGCEIEGLDLVPEFIATARARFPHVPYRVGSVADGGIEPGPLGGVLAWYSLIHAGPDELPSLLAAVRRGLRSGGRLLVGYFDGPDGEPFPHAVTTAHYWSITGLTALLHDAGFAVIDTEARIQDGPDADRAALEGDQVAVAELTAAAAVHLTVDTHVAVDDDLFRVAARVEQAGELQELPEADHVATDGDVVDAAGTAHG

SEQ ID NO: 176646 - protein, 78 aa, Glycine max
  Coding DNA Sequence Number=SeqID_59868
MLCITSQHNTTNNTTQHHHSTRHPKSKRVQVGYYETAPDPRSPPFLLAITVISEREAARKKREKGTERKLRKAFTAEM

SEQ ID NO: 176647 - protein, 92 aa, Glycine max
  Coding DNA Sequence Number=SeqID_59869
MGCCGFASVALVAVDGGGGGPGEGSGGGVPGAADGEPWGAALAVDPAADDGGSVVVVVTEEEELVGDEGVVGHDHCNPLVIDLRHDNGRRVG

SEQ ID NO: 176648 - protein, 78 aa, Glycine max
  Coding DNA Sequence Number=SeqID_59870
MRTRSPLQARTYSPLKVIGTSTQGSTFMRKQEIDSSRGPVIQKDWTRDLGTYWVKTSNLPLGSLEVFAWCLSLPQCRA

SEQ ID NO: 176649 - protein, 232 aa, Glycine max
  Coding DNA Sequence Number=SeqID_59871
MDEIEKVQEQMKADPEALKEKMATMVEAMMSIKEIVVVSAAYQTRARTKIMGEVEKVQEHMKADMEAMKEQMATMMEAIISMKKIREVDTVAVATTSAVAKVNPMPPSGLNQMNHPTSNMAHVSQTMGETHEIPHHNLADFEHWIGHATEGQAVGSIPFENTLEGPQFRPQPQPLHFAVGRAPHAMAEKGKVDHLKERLRAIEGGEDYAFANLEELFLIPKHVHSQVQGAGL

SEQ ID NO: 176650 - protein, 79 aa, Glycine max
  Coding DNA Sequence Number=SeqID_59872
MWLQGVKIPMVLSGNRNEHAKHACALSPFIATVKILDFLMNALSEPCRAKRAKHHFAFVSFPLHKAKRVCALSPYCVLS

SEQ ID NO: 176651 - protein, 168 aa, Glycine max
  Coding DNA Sequence Number=SeqID_59873
AWDRYADNVLGRKILPERNVKLYITKFDEFRREIERMNWHKELTNFSKGSIDVAIVKEFYANLYDPEDKSPKQVRVRGHLIKFDADAFNTFLKTPVVIEEGESLPAYSRRAAFEDFEEELDYSGPDLECSIYSNLALTSHTSDITLDRAKLIYGLVMMMDMNLGSLIL

SEQ ID NO: 176652 - protein, 85 aa, Glycine max
  Coding DNA Sequence Number=SeqID_59874
  Gene Ontology: Mol. function=calpain activity; Cellular component =intracellular; Biological process=proteolysis
  Homolog annotation: Hit_ID=Q1SMV6; Match level="QueryCoverage=61%, HitCoverage=11%, E-value=1e-10, Identity=57%"; Hit description =Peptidase C2, calpain; Cyclin-like F-box; F-box protein interaction domain
  Pfam annotation: Domain name=F-box; Domain location=7-54; Score=30.1; E_value=7.6e-06; Accession=PF00646.23; Description=F-box domain
MRSEKKSCSPLLYDELIKEILSCLPVKTLIQFKCVYKGWNSLMSDPYFIKLHLNKSAAKDDLEHLQLMKNASLGSIPEIHMESCD

SEQ ID NO: 176653 - protein, 375 aa, Glycine max
  Coding DNA Sequence Number=SeqID_59875
  Gene Ontology: Mol. function=hydrolase activity
  Homolog annotation: Hit_ID=Q11IA1; Match level="QueryCoverage=70%, HitCoverage=85%, E-value=3e-49, Identity=38%"; Hit description=Twin -arginine translocation pathway signal precursor
  Pfam annotation: Domain name=Metallophos; Domain location=36-254; Score=49.8; E_value=8.9e-12; Accession=PF00149.18; Description =Calcineurin-like phosphoesterase
MGYAHALTAAQRQRLGDVAELYQLPDLRAAPLDGTLRFGLLADPQYADVEADVPANLYYRHALHKLPQAITALNQQPLDFVVTLGDLVDRHWASYATLLPLYDRLLHPHAVVLGNHDAQTIAQHLDDALPLPKSYYAFQLPGWRFIVYDGNDISLYCNQHNGDDRQRAAALLADLQARQQPQAQPWNGAVGATQLAWLETQLIEARACGQQVVVFGHYPLAPGYSHSLLNGAQLAELFCRYDVRACFAGHDHRGGYHRRADTVFITLQGMLDGPSRVPFAVVELTGETLRLSGWGGEISREEVYGAAPMASRPAREIYLAIDQRSDRLRRDFNIDDFNQAIIRSAQLAAVNRQQRAEPLLIIFAAKDGVFRKARP

SEQ ID NO: 176654 - protein, 61 aa, Glycine max
  Coding DNA Sequence Number=SeqID_59876
MEEKVKLKISGGLRSTYLKLLCSDTTCWKLAYEASMEAGSLSFNKQKIKEKRLEETSSTRE

SEQ ID NO: 176655 - protein, 70 aa, Glycine max
  Coding DNA Sequence Number=SeqID_59877
MVKLFLSPIVKLMFFDEMSGQMNDDSMSRTRIVPPMLESLMAEMVKMRRQAKESMRIANKALRGQDDLHL

SEQ ID NO: 176656 - protein, 251 aa, Glycine max
  Coding DNA Sequence Number=SeqID_59878
  Gene Ontology: Mol. function=DNA binding; Cellular component=nucleus; Biological process=regulation of transcription, DNA-dependent
  Homolog annotation: Hit_ID=Q8H256; Match level="QueryCoverage=78%, HitCoverage=84%, E-value=9e-66, Identity=64%"; Hit description=Myb -like transcription factor 6
  Pfam annotation: Domain name=Myb_DNA-binding; Domain location=13-60; Score=46.9; E_value=6.7e-11; Accession=PF00249.21; Description=Myb -like DNA-binding domain
  Pfam annotation: Domain name=Myb_DNA-binding; Domain location=66-111; Score=47.5; E_value=4.4e-11; Accession=PF00249.21; Description=Myb -like DNA-binding domain
  Pfam module annotation: Pfam domain module=Myb_DNA-binding::Myb_DNA -binding; Domain location=13-60::66-111
MRKPSCDIKDLNKGAWSKQEDQKLIDYIKKHGEVCWRTLPQAAGLHRCGKSCRLRWINYLRPDLKRGNFAEDEEDLIIKLHALLGNRWSLIAGRLPGRTDNEVKNYWNSHIRRKLISKGIDPNNHRLKHTIPSSLQNSLMSDDSSKAFSMKDTNKNETSKLPRVYNHVEVSDAASGEAESPCALPDLNLDLSITNPSASQSISGNNLANINCCYLATDQYSQILESENEKGDFWDSSAVHNYPLNGKYETE

SEQ ID NO: 176657 - protein, 59 aa, Glycine max
  Coding DNA Sequence Number=SeqID_59879
  Homolog annotation: Hit_ID=Q1STE3; Match level="QueryCoverage=61%, HitCoverage=9%, E-value=5e-10, Identity=83%"; Hit description=UDP -glucuronosyl/UDP-glucosyltransferase
MEYSPDSSTLMLRRRKDGFEKRMEGKVLIIRGWALQVLILEHEAIGAFVTHDGIQRWKQ

SEQ ID NO: 176658 - protein, 97 aa, Glycine max
  Coding DNA Sequence Number=SeqID_59880
DSSNDCGGSGGGDNGNNEGAVMVVVTISVLVVVTVLWSNNGDNNGDNACGSKVNGDSSSGRGCVNSNDSCNDNDHDSGGGGDYVVSVMAMVVVMLYC

SEQ ID NO: 176659 - protein, 654 aa, Glycine max
  Coding DNA Sequence Number=SeqID_59881
  Gene Ontology: Mol. function=ubiquitin-protein ligase activity; Cellular component=ubiquitin ligase complex; Biological process =protein ubiquitination
  Homolog annotation: Hit_ID=Q6Z2K3; Match level="QueryCoverage=94%, HitCoverage=95%, E-value=1e-166, Identity=54%"; Hit description =Putative Avr9/Cf-9 rapidly elicited protein 276
  Pfam annotation: Domain name=Arm; Domain location=404-444; Score =41.3; E_value=3.4e-09; Accession=PF00514.13; Description =Armadillobeta-catenin-like repeat
  Pfam annotation: Domain name=Arm; Domain location=447-485; Score =13.3; E_value=0.27; Accession=PF00514.13; Description=Armadillobeta -catenin-like repeat
  Pfam annotation: Domain name=Arm; Domain location=486-526; Score =43.8; E_value=5.7e-10; Accession=PF00514.13; Description =Armadillobeta-catenin-like repeat
  Pfam annotation: Domain name=Arm; Domain location=527-567; Score =14.7; E_value=0.18; Accession=PF00514.13; Description=Armadillobeta -catenin-like repeat
  Pfam annotation: Domain name=Arm; Domain location=568-608; Score =24.6; E_value=0.00035; Accession=PF00514.13; Description =Armadillobeta-catenin-like repeat
  Pfam annotation: Domain name=Arm; Domain location=610-650; Score=7.7; E_value=1.3; Accession=PF00514.13; Description=Armadillobeta-catenin -like repeat
  Pfam annotation: Domain name=U-box; Domain location=275-348; Score =84.5; E_value=3.4e-22; Accession=PF04564.6; Description=U-box domain
  Pfam module annotation: Pfam domain module=Arm::Arm::Arm::Arm::Arm::Ar m::U-box; Domain location=404-444::447-485::486-526::527-567::568 -608::610-650::275-348
MAGDDLAGDHTPELLCLVHEIAGMCSAGSSSGADAMFRKDCTDLVRRISLLTHLFEEIKELKNNNDVGGSASSSSSYSSSSSSASSKWSSDLVLALHSARRLLSVARNFRSYCSSDGAAKTIVFQFQCVTWKLEKLLSNLPYDDLDISEEVKEQVDLVRTQLRRATDKYGFMISKMPSHELSQPLAEEISQVLGKSVSRLHKQHSCPENLSELDSIPINYEEKRCSKNPAGTRLERTRSIPTEVEVSLNATDPESQEISETKILPEVKKPEAIVIPEDFLCPISLELMRDPVIVATGQTYERSYIQRWIDCGNTTCPKTQQKLQHLTLTPNYVLRSLISQWCIEHNIEQPTGLTNGKLKKSDGSFRDVTGDIAAIEALVRKLSCRSVEERRAAVTELRSLSKRSTDNRILIAEAGAIPVLVNLLTSEDVLTQDNAVTSILNLSIYENNKGLIMLAGAIPSIVQVLRAGTMEARENAAATLFSLSLADENKIIIGASGAIPALVELLQNGSPRGKKDAATALFNLCIYQGNKGRAIRAGIITALLKMLTDSSKSMVDEALTIMSVLASHQEAKVAIVKASTIPVLIDLLRTGLPRNKENAAAILLALCKRDADNLACISRLGVVIPLSELARNGTERAKRKATSLLEHIRKLQQL

SEQ ID NO: 176660 - protein, 135 aa, Glycine max
  Coding DNA Sequence Number=SeqID_59882
  Gene Ontology: Mol. function=transferase activity
  Homolog annotation: Hit_ID=Q1SP37; Match level="QueryCoverage=50%, HitCoverage=21%, E-value=1e-13, Identity=50%"; Hit description =Bacterial adhesion
MDPNIDLDEVLDQMIDEELQDNTDEEIIRLILESQQQLHGNTIRHSQRRRVVHRNREEDALNNHDEYFQMRVDALHRKGLSPLQKCTSAIRILAYGSPVNSVDEYVRIGKQPMECLERFVSGICTIFVNVLEKTK

SEQ ID NO: 176661 - protein, 308 aa, Glycine max
  Coding DNA Sequence Number=SeqID_59883
  Gene Ontology: Mol. function=catalytic activity; Cellular component =nucleus; Biological process=metabolic process
  Homolog annotation: Hit_ID=Q2HS18; Match level="QueryCoverage=71%, HitCoverage=49%, E-value=7e-27, Identity=29%"; Hit description =Tetratricopeptide-like helical
  Pfam annotation: Domain name=PPR; Domain location=114-148; Score =22.1; E_value=0.002; Accession=PF01535.11; Description=PPR repeat
  Pfam annotation: Domain name=PPR; Domain location=215-249; Score =40.0; E_value=8.1e-09; Accession=PF01535.11; Description=PPR repeat
  Pfam module annotation: Pfam domain module=PPR::PPR; Domain location =114-148::215-249
MVCLTYGIESGFRHTFAKARIPCSCRPICNCAPPPTFVYLHHAPLFNQPPIFSSLLHQFSNTFIHVKSIHAQIIKNWVSTENFLAAKLVTVYSDLGFLGHARKMFDQCSLPETAVCNAMMAGFLRNQQHTEVPKLFRMMGSCNIEIDTYTCMFSLKACASLLDDEIGMEIVRTAVRKGFRLHPYVGSSMVNFLVKCGYLDDAQKVFDGMPEKDAVCWNSIIGGYVKKGLFTEAIQMFPEMIGGGLRPSPVTMVSSLKACGESGLKKVGMCAHGCVLALGMGNDVFVLTSRMFSNIRLGKRKNPPCLYH

SEQ ID NO: 176662 - protein, 74 aa, Glycine max
  Coding DNA Sequence Number=SeqID_59884
MSFRPTLNIVGCTCRWWCNEGTQRCWRMGWAGLMRSLRKMKRWWVGWGGIGNYSKEWEGKVLEKRETAEKGQCK

SEQ ID NO: 176663 - protein, 64 aa, Glycine max
  Coding DNA Sequence Number=SeqID_59885
MDLEERSRIFRVITHGNVTENGRSFAAQLAQASKVASSRSNSLSGGIFLEGPRGPGCYLQPPFY

SEQ ID NO: 176664 - protein, 224 aa, Glycine max
  Coding DNA Sequence Number=SeqID_59886
MGNTFGAKKTTKVMKIDGETFKLKTPVKVREVLKDHPGLVLLDSEAVKHYGVRAKPLEAHKELQPKRLYFLVELPKETKPRRVRSGINMSAKDRLESLVLTRRSASDLSIMKQSNNMDNNENNGGGVRLKMRLPKAEVEKLIQGCKDEAEAAERIMKLYMANGSRENEGGTKENGEKMVVLEQQRVKESTKVNVQTTMIDEQTIEDTNSDAEEVGLESVDGDFD

SEQ ID NO: 176665 - protein, 381 aa, Glycine max
  Coding DNA Sequence Number=SeqID_59887
  Gene Ontology: Mol. function=ATP-dependent DNA helicase activity; Cellular component=cytoplasm; Biological process=DNA repair
  Homolog annotation: Hit_ID=Q1H217; Match level="QueryCoverage=75%, HitCoverage=40%, E-value=1e-112, Identity=70%"; Hit description =UvrD/REP helicase
YLRLIANEDDDPAFIRAATTPKKGIGNTTLERLGEYASAHKMSLFAAAFEGGFQHEIGAKQLDDLLTFCRYIQTLQGRAVKDPANEVLNDLLTAIQYETYLYDGEEGRAAETRWGNVQEFVAWLSKKGEASTEYGNESEGKNLLELTQLVSLITMLEGREDSEPDAVKLSTLHASKGLEYGHVFLIGCEEGILPHTNSIDSDQIEEERRLMYVGITRAQKSLNITWCKKRKRAGEMQACEPSRFIAELPKDDVKHFGNPFNGPDQVLSKDYGKSKMANIKAMLASQDGAYLAELLLNKGYVVHGVKRRASLFNTDRIDHLYQDPHIEHQNFILHYGDLTDSTNLIRIIQQVQPDEIYNLAAMSHVAVSFETPEYTANADGI

SEQ ID NO: 176666 - protein, 255 aa, Glycine max
  Coding DNA Sequence Number=SeqID_59888
  Gene Ontology: Mol. function=catalytic activity; Cellular component =cytoplasm; Biological process=cellular metabolic process
  Homolog annotation: Hit_ID=Q3SI05; Match level="QueryCoverage=98%, HitCoverage=76%, E-value=1e-102, Identity=69%"; Hit description=GDP -L-fucose synthetase
  Pfam annotation: Domain name=Epimerase; Domain location=1-182; Score =153.7; E_value=4.7e-43; Accession=PF01370.11; Description=NAD dependent epimerasedehydratase family
MANDTYPAEFIHENLAIQTNVIHQSYLNGVKRLLFLGSSCIYPKDSPQPIKEEYLLTGPLEPTNRPYALAKIAGIEMCWSYNRQYGTHFLAAMPTNLYGPGDNYHPENSHVIPALIRRFHEAKVNSQAEVVIWGTGTPKREFLYSEDMAEACTHILGLSDRNFASLIAADRNDGSPPILNIGYNADISIAELAETIKEVTAYEGKVVFDTSKPDGTMRKLMDSSRINHMGWAAKTELKNGLKAAYTDFINSKIAL

SEQ ID NO: 176667 - protein, 209 aa, Glycine max
  Coding DNA Sequence Number=SeqID_59889
  Gene Ontology: Mol. function=calpain activity; Cellular component =intracellular; Biological process=proteolysis
  Homolog annotation: Hit_ID=Q1SW04; Match level="QueryCoverage=84%, HitCoverage=29%, E-value=2e-18, Identity=34%"; Hit description =Cyclin-like F-box; F-box protein interaction domain
  Pfam annotation: Domain name=F-box; Domain location=7-54; Score=39.9; E_value=8.9e-09; Accession=PF00646.23; Description=F-box domain
MRSEKKPWSPLLCEELIEEILSRLPVKPLIQFKCVCKGWNSLMSDPYFIKLHLSKSAAKDDLEHLQLMKNVCLGSIPEIHMESCDVSSLFHSLQIETFMFNFANMPGYHLVGSCNGLHCGVSEILEEYRVCFWNKATRVISRESPTLSFSPGIGRRTMFGFGYDPSSDKYKVVAIALTMLSLDVFEKTEMKVYGAGDSSWRNLKGCGIL

SEQ ID NO: 176668 - protein, 133 aa, Glycine max
  Coding DNA Sequence Number=SeqID_59890
  Gene Ontology: Mol. function=nucleic acid binding
  Homolog annotation: Hit_ID=Q1T6D0; Match level="QueryCoverage=93%, HitCoverage=24%, E-value=6e-21, Identity=44%"; Hit description=Zinc finger, CCHC-type; Lipocalin
MNGIGSINEPPDDNDSNAPNVTKVFFRDKMMENINVVVTIPRVDLLQQNLAQIEYEDDNPLKHMVILDESLFNGLCTLWQDALVIKLLGTNIGFNIMREKLQGCGNSNWASNCLMLGMNTSWLRLTFKRIMLK

SEQ ID NO: 176669 - protein, 110 aa, Glycine max
  Coding DNA Sequence Number=SeqID_59891
MREIEERLRAIEGGGDHAFADMAELYLVPDVVIPSKFKVPDFDKYKGTTCPKNHLKVYYKKMEAYAKDEKLLMHFFQESLTGAAVTWYTNLESSRVHSWKDLMVSFIRQY

SEQ ID NO: 176670 - protein, 153 aa, Glycine max
  Coding DNA Sequence Number=SeqID_59892
MVGYAPSGFADLVFVGERIEVGLERGKFDHPALTNKRPGVNREDEKEEGIHVVTVIPTWPKFPPAQQCHYSANISPSHYPPSNHPQRPSPNQPQSRPAAHPMPNTALNTNQNTNQRGNFPAKQPVEFTSILVSYANLLSYLLDKSMVAITPDK

SEQ ID NO: 176671 - protein, 1368 aa, Glycine max
  Coding DNA Sequence Number=SeqID_59893
  Gene Ontology: Mol. function=phosphatidylinositol phosphate kinase activity; Cellular component=mitochondrion; Biological process =phosphatidylinositol metabolic process
  Homolog annotation: Hit_ID=Q652R9; Match level="QueryCoverage=92%, HitCoverage=81%, E-value=0.0, Identity=37%"; Hit description=Finger -containing phosphoinositide kinase-like
MSCEGQKKCSEKVHPSVSPQESPRQSPEPPSPCFSVESDRLGSPLKAELNQGTQFDRCFHDHDYGYYPCSVVNKSVNSSGTHPSSVSTHPSTFRSDKEGTDDSRKHLLSPSRTYCDNYSDIDSSSVSARHDTYNYNFVGSSPSDSPSRIGFTSSSAGLPVQKGQEKGPVPQTDGPFGQQSMAVLRKPGQGTEDAYTTAYFSDDLSIFRNQNENSQRPLDFENNGLIWFPPPPDDENDDAEGALFSSSCSLSNMFPGKEKLNDENKEPLKSVIQGHFRALVSQLLQGEGIKVGKENDSEDWLDIVATVAWQAANFVRPDTSKGGSMDPGDYVKVKCIASGSPSESTLVKGVVCTKNIKHKRMTSQYKKPRLLLLGGALEYQKVPNQLASFDTLLQQENDHLKMIISKIEALRPNVLLVEKSVASCAQEYLLAKEISLVLNVKRPLLERIARCTGALVTPSVDHLSKARLGNFFAAYHLSLETSFLADEGATLPKVIVKNSTDMPESATADTDISIIPISFSTTMCQSEADNAFRVEDFVGLDLKLENLGSVPEHLDDLSCHSVTGTMADYRAESVLSDSFYNNLTSNLTVESDYLHQGNESDGDTIFSTRDLLQSELQQTTVQEEREYGEVADLTKDKTNEDELSGEYFSATDGHQSILVYFSSHCVSKGTVCERTRLLRIKFYGSFDKPLGRYLRDDLFDQACCCQSCKEPAEAHVLCFTHQQGNLTINVRRLPSLKLPGERDGKIWMWHRCLRCPFEDGVPPATRRVVMSDAAWGLSFGKYGSMVAFFRYSPIDILSVHLPPSVLEFGHIQEEWIRKEAEELFIKVETLYVEISNVLEWLEMKIVSPGIGNESSDTCDIQNHILDLKDMLQRERTDYHCLLQSGSVTTQPGKMTLDILELNRLRRSLHIGSHVWDHRLYSLDSLIKRSFSSKVKQEDELCADVKELRVDSLHKERNFDCGLEQNNARLSKLHESHESHMLAEPDDALETCASGSFTCYLEGKKVHSDGELNRTLSECFPPNESNLSERIDSAWTGTDQPQANAVPAGSIQRSNQHDSPPFRRVSQPMRVHSFDSAVRVQERIRKVLPSSLHLSTLRSFHASGDYGNMVRDPVSNILRSYFQMLPWETQKLNLILSSTPSFISSVSGIAEGARLLLSQTYHGDRVIAVYDDDYSSIISYALSSKEYEDWVSGKSDMQESNWIARERSKEDLAASSFSAWGSLDLDYINYGSYGSEDVPSSVGSLLRDSKKSLHLQISFGDDSVGAGGKVNFSVTCYFAKQFESLRKKCCPNEVDFVRSMSRCRRWSAQGGKSNVYFAKSLDERFIIKQVTKTELESFEEFAPQYFKYLMDALNSGGPTCLAKILGIYQ

SEQ ID NO: 176672 - protein, 71 aa, Glycine max
  Coding DNA Sequence Number=SeqID_59894
MEVEEPWLGLFRCKIHFLVGVLVCAWLLDVRPANFVDDLGIAFVDDWVVGKEKGRYWLSDDIIGLVGSLAM

SEQ ID NO: 176673 - protein, 93 aa, Glycine max
  Coding DNA Sequence Number=SeqID_59895
  Gene Ontology: Mol. function=DNA binding; Biological process=DNA integration
  Homolog annotation: Hit_ID=Q2HRM7; Match level="QueryCoverage=56%, HitCoverage=12%, E-value=2e-12, Identity=48%"; Hit description =Polynucleotidyl transferase, Ribonuclease H fold
MAHFIPCKKVDDTHHVANMFFKEVLGTKLLLSTTCHPQTDGQTEDFNSRVNSLKEGGDDEDQTGNKDIEAIQGLGGPVKKAHAKKANETLIQM

SEQ ID NO: 176674 - protein, 57 aa, Glycine max
  Coding DNA Sequence Number=SeqID_59896
MNLLFGNLTLKNSTVKRVWLGVAMGWVTFLEVSQKACLRKGYLWRDLTGGGFRPTRS

SEQ ID NO: 176675 - protein, 101 aa, Glycine max
  Coding DNA Sequence Number=SeqID_59897
MKTIVAKPHPSVGKEDHPRKKVIPKNPRWSKKKGENITIQALGYGVDDYIEGSVHKKENHLVQGCTFSLFMHFSFHLDALRTLHVLSVGRGIIDPSTLSSL

SEQ ID NO: 176676 - protein, 175 aa, Glycine max
  Coding DNA Sequence Number=SeqID_59898
  Subcellular localization annotation: CTP_CleavageSite=57; ConfidenceScore=5.10e-01
MSSTHPKNPATTTTSTTLIVLSIILLCFPTTAKTDNPPCPYPCYPPPIGTVTPTTPSGGSTVPPAPPQPGLLYPPPSGNYPYYPTPPYGGGGGVGSNDGSGSGSGGFGSPPPPDPILPYFPFYYRKPPHKPEDNSASTTTMYKWTGMFCLNDIIIRIVSPLTTAICLYVSPALDG

SEQ ID NO: 176677 - protein, 478 aa, Glycine max
  Coding DNA Sequence Number=SeqID_59899
  Homolog annotation: Hit_ID=Q6ZGL2; Match level="QueryCoverage=81%, HitCoverage=81%, E-value=1e-109, Identity=52%"; Hit description =Putative pentatricopeptide (PPR) repeat-containing protein
  Pfam annotation: Domain name=PPR; Domain location=261-295; Score=6.7; E_value=1.2; Accession=PF01535.11; Description=PPR repeat
  Pfam annotation: Domain name=PPR; Domain location=333-367; Score =10.1; E_value=0.48; Accession=PF01535.11; Description=PPR repeat
  Pfam annotation: Domain name=PPR; Domain location=368-402; Score =13.9; E_value=0.17; Accession=PF01535.11; Description=PPR repeat
  Pfam annotation: Domain name=PPR; Domain location=403-437; Score =15.3; E_value=0.11; Accession=PF01535.11; Description=PPR repeat
  Pfam annotation: Domain name=PPR; Domain location=438-472; Score=8.7; E_value=0.69; Accession=PF01535.11; Description=PPR repeat
  Pfam module annotation: Pfam domain module=PPR::PPR::PPR::PPR::PPR; Domain location=261-295::333-367::368-402::403-437::438-472
  Subcellular localization annotation: CTP_CleavageSite=28; ConfidenceScore=5.13e-01
MDCTVSFPCVHFVPVGRTLCNYRRVTVVAHSKRRRPPKDNRYRPRPKQPPEFGVNLFLKKPSTASKPTDDDMDSNEENDEEEDGNIGVVWESDELEAISSLFQGRIPQKPGKLDRERPLPLPVPFKLRPLRLPTPKTQVKLTAPAVVSSRASMAKKVYKSPSFLVGLARQISRLGPDADVSKILGKWVQFLRKGSLSLTIRELGHMGFPERALQTFLWAQNQPHLFPDDWILASTVEVLARNHELRIPFNLGQYTGLASRAVLEAMIKGFIKGGNLRFAWKVLIVARRDKRMLDSSIYAKLILELGKNPDRHRHVLPLLDELGERDELNLSQQDCTAIMKVCVKMGKFEVVESLFSWFKQSGYQPSIVMFTSVIHSRYTEKKYREALAVVWEMEASNCLFDLPAYRVVIKLFVALNDLSRATRYFSKLKEAGFSPSFGLYKDMLQIYMASGRIAKCKELCREAEIAGFKLDKYLVSVR

SEQ ID NO: 176678 - protein, 112 aa, Glycine max
  Coding DNA Sequence Number=SeqID_59900
  Gene Ontology: Mol. function=zinc ion binding
MSALIAHIKSTEGHTTTYGRGERNIANATTRRSSSRGLHDIPLSFLGFQIVYQWISILQARGLGRWNMVVWERIAVMLASNQGYMQVLNKVIEDAQGKTNVHTVLEFDRCDT

SEQ ID NO: 176679 - protein, 95 aa, Glycine max
  Coding DNA Sequence Number=SeqID_59901
MEKSEKKNFNEKKAKRAYITWDDNDMDSSEDSENEVVNLSLMAKSYERDEEYIKEIKDLKNSLAKFSIGKSNLDVTLGKQRCVFDKTGIGYKPEK

SEQ ID NO: 176680 - protein, 203 aa, Glycine max
  Coding DNA Sequence Number=SeqID_59902
  Gene Ontology: Mol. function=microtubule motor activity; Cellular component=microtubule associated complex; Biological process =microtubule-based movement
  Homolog annotation: Hit_ID=Q8GZU1; Match level="QueryCoverage=99%, HitCoverage=18%, E-value=7e-68, Identity=59%"; Hit description =Kinesin related protein
  Pfam annotation: Domain name=Kinesin; Domain location=1-203; Score =29.2; E_value=6.2e-16; Accession=PF00225.13; Description=Kinesin motor domain
EDIFQSVGVPLVKNALAGYNTSILSYGQSGSGKTYTMWGHPSAMFEEPSPKSHKGIVPRIFQMLFSELEREQHVSDGKQFNYQCRCSFLEMKDGSKNALYIENLTEEYVTSYDDVTQILIKGLSSRKVGATSLNSKSSRSHIIFTFVIESWCKGISSNGFSSSKSSRISLIDLAGQDRNKVEDAGKQCLKEDKNVKKSLSQLG

SEQ ID NO: 176681 - protein, 293 aa, Glycine max
  Coding DNA Sequence Number=SeqID_59903
  Gene Ontology: Mol. function=carbohydrate binding
  Homolog annotation: Hit_ID=Q10NJ9; Match level="QueryCoverage=91%, HitCoverage=63%, E-value=7e-82, Identity=54%"; Hit description =Lipase, putative, expressed
  Pfam annotation: Domain name=DUF620; Domain location=34-283; Score =537.4; E_value=1.5e-158; Accession=PF04788.3; Description=Protein of unknown function (DUF620)
MGACMQRDSSAKYIVQQYVAATGGVAALNSLESMYAMGQVRICGSEVRRQGDGYEESVQSRGKTEVGGFVLWQKNPDLWCLELVVSGFKVSAGSNGKLAWNHSSSQPFHANKGPPRPLRRFFQGLDPRCTANLFLDAECVGENNINNEVCFMLRLQTDQHILQAQSMSNTEIVMHTMLGYFSQRTGLLVKFEDTKLVKMKAVKGKESVFWETSIESMIDDYRYIDGINIAHGGRTIATLYRYGAAHNHKHMIEETWTIEEVDFNIVGLSMDCFLPPSDGEREHEGAEQAVGMG

SEQ ID NO: 176682 - protein, 141 aa, Glycine max
  Coding DNA Sequence Number=SeqID_59904
  Subcellular localization annotation: CTP_CleavageSite=18; ConfidenceScore=5.60e-01
MQLLSLPTTRAALRSLIFASSPPSFSSTPTPNKASGTSPGQRHSFGALAVEIFLEEYKIDGYLNAQCNSKVNSRSTIAVLDIFNGISRTIFIIKEKEGMELLSLHSTSTRQSSRNDKENVRSYALYQKGNLSWKVSGHVTC

SEQ ID NO: 176683 - protein, 457 aa, Glycine max
  Coding DNA Sequence Number=SeqID_59905
  Gene Ontology: Mol. function=zinc ion binding
MCLSELLSYEDGDYEAENETDSEYTHPWNDYREDRDWTTLLDPKTFAENRTPPLPNCDDEYKATWDVDASFWMNDEATTTSDLKMRTVIPMRWKHHLIVKMKGFLRHTPNMKTQALIAYALDKWGYKLSLDQAYKAKCRALQKIQGASKEYKHLRQYNEEACKEAFVTTCRPLIGLDGCFLEGDFGGHLLTKTWSPIQELDFISDKQKGLVNVIKELGQHVEHHVCVRHLYNNFRKRHHGAQLKEMMWQAIRATTIPEFKRIIQKMKETNGSDWKELDELQASSWTKSTYGTPYVVSSGYGKVGHNKQTCKGKTQADRKINRGGNKEHKSRAEASALVARLASTIPKPAPSANFVTDGQTPTPIPIANSAPRGRTSAPTPTANSFACVNSAICVSAPTQAPNANSVASVPDALFGVGVELKEGGLEAKIKERNAALVVGNDSNCMEMKLWKMNALRP

SEQ ID NO: 176684 - protein, 543 aa, Glycine max
  Coding DNA Sequence Number=SeqID_59906
  Gene Ontology: Mol. function=calcium ion binding; Cellular component =mitochondrion; Biological process=metabolic process
  Homolog annotation: Hit_ID=Q1SQX3; Match level="QueryCoverage=98%, HitCoverage=76%, E-value=4e-67, Identity=28%"; Hit description=IMP dehydrogenase/GMP reductase
  Pfam annotation: Domain name=PPR; Domain location=112-145; Score =12.5; E_value=0.24; Accession=PF01535.11; Description=PPR repeat
  Pfam annotation: Domain name=PPR; Domain location=146-180; Score =33.5; E_value=7.2e-07; Accession=PF01535.11; Description=PPR repeat
  Pfam annotation: Domain name=PPR; Domain location=181-215; Score =45.2; E_value=2.2e-10; Accession=PF01535.11; Description=PPR repeat
  Pfam annotation: Domain name=PPR; Domain location=216-250; Score =33.9; E_value=5.6e-07; Accession=PF01535.11; Description=PPR repeat
  Pfam annotation: Domain name=PPR; Domain location=251-285; Score =42.5; E_value=1.4e-09; Accession=PF01535.11; Description=PPR repeat
  Pfam annotation: Domain name=PPR; Domain location=286-320; Score =33.6; E_value=7e-07; Accession=PF01535.11; Description=PPR repeat
  Pfam annotation: Domain name=PPR; Domain location=321-355; Score =46.1; E_value=1.2e-10; Accession=PF01535.11; Description=PPR repeat
  Pfam annotation: Domain name=PPR; Domain location=356-390; Score =39.9; E_value=8.5e-09; Accession=PF01535.11; Description=PPR repeat
  Pfam annotation: Domain name=PPR; Domain location=391-425; Score =45.1; E_value=2.4e-10; Accession=PF01535.11; Description=PPR repeat
  Pfam annotation: Domain name=PPR; Domain location=426-460; Score =36.3; E_value=1e-07; Accession=PF01535.11; Description=PPR repeat
  Pfam annotation: Domain name=PPR; Domain location=461-495; Score =52.0; E_value=2e-12; Accession=PF01535.11; Description=PPR repeat
  Pfam annotation: Domain name=PPR; Domain location=496-530; Score =26.8; E_value=7.9e-05; Accession=PF01535.11; Description=PPR repeat
  Pfam annotation: Domain name=PPR; Domain location=77-111; Score=12.6; E_value=0.24; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR; Domain location=112-145::146 -180::181-215::216-250::251-285::286-320::321-355::356-390::391 -425::426-460::461-495::496-530::77-111
  Subcellular localization annotation: CTP_CleavageSite=71; ConfidenceScore=5.10e-01
MVKVPPTKALLLFNTATYQGLQHTSHSISFILNHLLSSGMLPQAQSLILRLISGRIPSSLMLQLTQAHFTPCSTYTPLYDTVVNAYVHSHSTDQALTFLHHMIHEGHVPLSNTFNNLLCLLIRSNYFDKAWWIFNELKSKVVLDAYSFGIMIKGCCEAGYFVKGFRLLAMLEEFGLSPNVVIYTTLIDGCCKDGNVMLAKNLFCKMNRLGLVPNPHTYSVLMNGFFKQGLQREGFQMYENMKRSGIVPNAYAYNCLISEYCNDGMVDKAFKVFAEMREKGIACGVMTYNILIGGLCRGKKFGEAVKLVHKVNKVGLSPNIVTYNILINGFCDVRKMDSAVRLFNQLKSSGLSPTLVTYNTLIAGYSKVENLAGALDLVKEMEERCIAPSKVTYTILIDAFARLNHTEKACEMHSLMEKSGLVPDVYTYSVLLHGLCVHGNMKEASKLFKSLGEMHLQPNSVIYNTMIHGYCKEGSSYRALRLLNEMVQSGMVPNVASFCSTIGLLCRDEKWKEAELLLGQMINSGLKPSVSLYKMVHKVKGDV

SEQ ID NO: 176685 - protein, 125 aa, Glycine max
  Coding DNA Sequence Number=SeqID_59907
  Gene Ontology: Mol. function=protein binding; Cellular component =cytoskeleton
  Homolog annotation: Hit_ID=Q8GSM4; Match level="QueryCoverage=58%, HitCoverage=21%, E-value=3e-20, Identity=62%"; Hit description=Ovate protein
  Pfam annotation: Domain name=DUF623; Domain location=57-113; Score =72.5; E_value=1.4e-18; Accession=PF04844.4; Description=Protein of unknown function, DUF623
MQNVLRQGEFEETEIQRSVEEDEGSEKRRGTEVKKTTVTRRSVEGKVKESFAVVKKSKDPYEDLRKSMITEMEMSEAEDLEQLLQCFLALNSRSYHAVIVRAFMEIWQQMFVMKNLQTNVKTQEK

SEQ ID NO: 176686 - protein, 92 aa, Glycine max
  Coding DNA Sequence Number=SeqID_59908
MSIHLPWKGFSSSEKASIWKIQTHAHGKDDNNVGVGDISDNNDNDDKSDNYDNNNDSDDRSGGNSSENNDKSDIDIENNNSDTSAYWLLQPI

SEQ ID NO: 176687 - protein, 433 aa, Glycine max
  Coding DNA Sequence Number=SeqID_59909
  Homolog annotation: Hit_ID=Q1T3Y0; Match level="QueryCoverage=44%, HitCoverage=30%, E-value=8e-15, Identity=33%"; Hit description =Targeting for Xklp2
MAGEVEESFSMNFQGYNNNKALSHMSRSQARVKEEGCVWPLAANIKLTVDSIHSGSISFGRFENEPLSWERRSSFSHNRYLEEVEKCAKPGSVIEKKAYFEAHFKRKGMLGFIPSTGHEGSSDRATSENDGSERNAKQEDFESNDGHYVQFDEMSQKDFELDEGDHYIEMDQSSQEDFVTIEDGHYVQFSEIPGNSNYHEERGMDEYEREETITEYPMVSFSGLQMESAVNNSNDLEDDSKKNITLDEAHQSETSNILSDSGKIVIEVKRDDDVTINTDESSTNMIMPVDEPARGVEETISHDPANPSAKETKLKPQQNSEDNNVRVRKSTPSRSAKDPARIPGRESPRRSNMENNLSKLATPTTWSASKSTKEVSKSAEKLIRENKRLKCAFNFDSENASRVRKGAESQLSASKTAPKGIQEAERFVDMCKD

SEQ ID NO: 176688 - protein, 84 aa, Glycine max
  Coding DNA Sequence Number=SeqID_59910
  Gene Ontology: Mol. function=aminoacyl-tRNA ligase activity; Biological process=glycyl-tRNA aminoacylation
  Homolog annotation: Hit_ID=Q8L785; Match level="QueryCoverage=89%, HitCoverage=7%, E-value=2e-23, Identity=68%"; Hit description=Glycyl- tRNA synthetase 2, chloroplast/mitochondrial precursor
VVNLVEAPFPVLGKFKETFLDLLKDLLIMVMQKHQKYFAVCDANGQLLPYFVAVANGAIDETTVRKGNEAVLWYSYLNFLSCHI

SEQ ID NO: 176689 - protein, 84 aa, Glycine max
  Coding DNA Sequence Number=SeqID_59911
MEDCLEGPNSGNHETQLQTRKWRTHERKRNSWSFEKGGEWGIALRVRTQAIMKHSSKLKSGGYMNRLRNKIHGALKKGENGGLP

SEQ ID NO: 176690 - protein, 68 aa, Glycine max
  Coding DNA Sequence Number=SeqID_59912
MNSAEERQERHHSKHLITARETTKHDDWGWLTLGSLKSWSECCMAKEEGKLMERACGWKRTHPSCREA

SEQ ID NO: 176691 - protein, 211 aa, Glycine max
  Coding DNA Sequence Number=SeqID_59913
  Homolog annotation: Hit_ID=Q93ZR2; Match level="QueryCoverage=86%, HitCoverage=45%, E-value=7e-60, Identity=61%"; Hit description =Putative storage protein
  Pfam annotation: Domain name=DUF707; Domain location=61-211; Score =57.1; E_value=5.7e-14; Accession=PF05212.3; Description=Protein of unknown function (DUF707)
MVKATRRIITSTTVNNKGAEIEHLIPGLNLPYGLLHLSCIQEKYIDSSITSQDQFPSDATKIWVPTNPRGAERLPPGIVNAESDLFLGRLWGLPSEDLTFKPKYLVTFTVGYEQKKNIDAAVKKVCERVFKLDMPLEQFSKDFTILLFHYDGRTTEWDEFEWSKQAIHVSVHKQTKWWYAKRFLHPDIVVPYDYIFMWDEDLGVENFNAEE

SEQ ID NO: 176692 - protein, 88 aa, Glycine max
  Coding DNA Sequence Number=SeqID_59914
MPGLGSTAMWDFMGSCWNEDASAFAVAIKDINKNVRGRLSKEATLHSSMPMWTNKSSSLILGDAVSRMTYEANATSNMIFYGGDELIK

SEQ ID NO: 176693 - protein, 64 aa, Glycine max
  Coding DNA Sequence Number=SeqID_59915
MLMRHFRERFREDSSPFFVVLRSSTDKKQLNQRLVLKETRRSDFLIAIEEYVGARETPLSTTKR

SEQ ID NO: 176694 - protein, 216 aa, Glycine max
  Coding DNA Sequence Number=SeqID_59916
MVCTNQVDMTGRLLVGSLAFEYRIMHYLIVQILLPRSSNLAQVSKEDLIVIWFFLIGRQIEWAHLVRYRMHKALRSNAPLPYPHLITLFLRHFNVPLDSEPFVQVKRSFSIGAGVVSSFRYRKERDGSWVKKDAQPQTADDRSPSPPPQRDDSSSLMKNVLDKLDGLHTFVGERFDSLDSRIDAIDAWFAGMDTRITQLEEDVSFIRQCFDLPPPP

SEQ ID NO: 176695 - protein, 69 aa, Glycine max
  Coding DNA Sequence Number=SeqID_59917
MSRTHDAILYYHGKSNMPPQYKFVGCAFTGKDPKKFRIPSTCTIDELKNLIKQVAPKGIPPLGIHESQT

SEQ ID NO: 176696 - protein, 52 aa, Glycine max
  Coding DNA Sequence Number=SeqID_59918
LDAIDWSLCFDIAPFDFVFNQFLFSVMPVFGSGIVGFLEGVRMLNGSFLTGI

SEQ ID NO: 176697 - protein, 383 aa, Glycine max
  Coding DNA Sequence Number=SeqID_59919
  Gene Ontology: Mol. function=methyltransferase activity; Biological process=DNA methylation
  Homolog annotation: Hit_ID=Q5PDV9; Match level="QueryCoverage=62%, HitCoverage=50%, E-value=3e-96, Identity=72%"; Hit description=DNA -cytosine methyltransferase
  Pfam annotation: Domain name=DNA_methylase; Domain location=232-382; Score=-114.2; E_value=0.0003; Accession=PF00145.8; Description=C-5 cytosine-specific DNA methylase
NAVYPAKRFPDFPADRYPAVMHAIEAHSFSAAILPQSVEAKIVQDADRLEALGAIGLARVFAVSGALNTILFDANDPFADQRDLDDKKYALDHFQSKLLRLPETMQTEQGRALASHNAQFLVQFMAKLSAELRGDPLSLDEAVMPQNLSQENLLSLPSGEHAQALLRQLMTIYDVKTLVAQLVAVGDQHWSPAILKRVATVSRAASRLTNAECAHLASLLPAPPRHHPDYAFRFIDLFAGIGGIRHGFEAIGGQCVFTSEWNKHAVRTYKANWYCDPQEHSFNADIREITLSQRADISDEEAAKSIREAIPQHDVLLAGFPCQPFSLAGVSKKNAMGRAHGFACETQGTLFFDVVRIIAARRPPIFVLENVKNLKSHDQGRTF

SEQ ID NO: 176698 - protein, 70 aa, Glycine max
  Coding DNA Sequence Number=SeqID_59920
MGYFVMRGSVRLGFGVVGGGAQRFDGGGWVVANCTGGYEGQVVCAHVRGWWRVSVRRLDVTWYPIFIPSK

SEQ ID NO: 176699 - protein, 139 aa, Glycine max
  Coding DNA Sequence Number=SeqID_59921
MLLNSNVIHIHVRVVMLVRMIRTRLFAAARVKSCPGMHSRCVIASLSGRARIVGRPPISGGGPGTDKRKLKMRTRSPLKARACIPLQARMCSPLMARTYSPLKIDCPFEKGDNSCNLILSFANLSGNSLRVYVLFDLVT

SEQ ID NO: 176700 - protein, 72 aa, Glycine max
  Coding DNA Sequence Number=SeqID_59922
MKERESYDMVLRDSLSSSRSGESSLVCSETWPFSGECDEATMSFYDGDDGEPKRVKAMVCFEDRAGLNQDVA

SEQ ID NO: 176701 - protein, 250 aa, Glycine max
  Coding DNA Sequence Number=SeqID_59923
  Gene Ontology: Mol. function=helicase activity; Biological process =viral genome replication
  Homolog annotation: Hit_ID=Q9LTU4; Match level="QueryCoverage=99%, HitCoverage=17%, E-value=4e-74, Identity=51%"; Hit description =Helicase-like protein
MVESERLSYIRNNKKKLRVDKFCSLQQSLDDGSTKGLNKGKRVILPSTFVGSPRYMDQLYFDGMAICSHVGFPNLFITLTCNPNWPEIHRLLNPLNLKATDRPDIISKVFKLKYEQMLMDLTKNQMLGKVIAYMYTIEFQKRGLPHVHLFLFLHPDNKYPSSDEIDQIISAEIPSQQDDPELHSLVKNHMVHGPCGTSNPGSPCMKEGKCSRFYPKMFQPHTVLDADGFPVYRRRNNGHTIEKNGVIIDN

SEQ ID NO: 176702 - protein, 313 aa, Glycine max
  Coding DNA Sequence Number=SeqID_59924
MTNLWLSECCLAKPRYTDNILGRNILPKRNVHIYHTEFDEFKAELERRNLHKHLTKLQEGSIGVAIVKEFYANLYNPEDPSPKQARVRGHLIKIDANNLNDFLETPVVLEEGETLPTYSRFCRLRSNPQEIEARPCIPRKGFVLNAEGQPWKLLRKDLTILAQTWSVLSYSNLAPTSHTSDLNMGRARLVYGLVTYMDMNIGALISDQISSIAQSNSSRLGFPALITALCRARGVTSDSLTYESLSPTINLAYIKKNCWNLGDLTINFRGARKARARPTDVPSSSTPLAPSTSATPEPPGPSTQGSQDVESML

SEQ ID NO: 176703 - protein, 267 aa, Glycine max
  Coding DNA Sequence Number=SeqID_59925
  Gene Ontology: Mol. function=oxidoreductase activity
  Homolog annotation: Hit_ID=Q20Z18; Match level="QueryCoverage=99%, HitCoverage=84%, E-value=4e-53, Identity=46%"; Hit description =Alcohol dehydrogenase, zinc-binding
  Pfam annotation: Domain name=ADH_N; Domain location=1-74; Score= -18.9; E_value=0.037; Accession=PF08240.2; Description=Alcohol dehydrogenase GroES-like domain
  Pfam annotation: Domain name=ADH_zinc_N; Domain location=105-246; Score=44.4; E_value=4e-10; Accession=PF00107.16; Description=Zinc -binding dehydrogenase
  Pfam module annotation: Pfam domain module=ADH_N::ADH_zinc_N; Domain location=1-74::105-246
HVVVTVKAAAISQLAKARAAGAHYSADSHYPFIAGIDGTGTLSNGDPVYFLAFSAPWGSMAQQTRVPAAAVVALPPTLDPLLAAAIANPGMSSWAALTRRAQFQAGETVLINGATGTSGGLAVRIARHLGAGKIIATGRNRAVLEQLRTQGADIILTLDELPGALPALMQQGIDVVLDYLWGQSALDIMHAAVAGGEKTVRFVQIGSLSGQEIALHSKLLRSSGLTLMGSGLGSVSDSELIACIGEMLNAAAESDFSIAFQQRPLSE

SEQ ID NO: 176704 - protein, 121 aa, Glycine max
  Coding DNA Sequence Number=SeqID_59926
  Gene Ontology: Mol. function=transition metal ion binding; Cellular component=cytoplasm; Biological process=fucose metabolic process
MDQSWMNESRISPEYESDSKKPLYTGCKNSLTLLSTVLSLVNVKVRYGWSDKSFTSLLEVVHDLLPEENTLPKSCYQAKKILCPMGMEYQKIHACPNDYILYRHEFEEISKCLGVGHHGTK

SEQ ID NO: 176705 - protein, 101 aa, Glycine max
  Coding DNA Sequence Number=SeqID_59927
MEYFNNASFTYIHAFHWSYCSLHSFLENQIVNIVIKLKERALRHPYQMRARARVMGEVEEVQEQIKADIEAMKEKMTTMMEANMRMKEIMEVNAAALLRWT

SEQ ID NO: 176706 - protein, 100 aa, Glycine max
  Coding DNA Sequence Number=SeqID_59928
MGETHEMPHHNVADFKPCLGYATEGQALGDTPLQNTLEGPQYHPQPHFLHSTASKNPHAMAEMGKLDHLEERLRAIEGGEDYAFANLEELFLVPNIITLP

SEQ ID NO: 176707 - protein, 203 aa, Glycine max
  Coding DNA Sequence Number=SeqID_59929
  Gene Ontology: Mol. function=two-component response regulator activity; Cellular component=intracellular; Biological process=two -component signal transduction system (phosphorelay)
  Homolog annotation: Hit_ID=Q7W6U4; Match level="QueryCoverage=51%, HitCoverage=16%, E-value=2e-32, Identity=67%"; Hit description =Propionate catabolism operon regulatory protein
APVASVSISCPSCSATDGVGELELHRGGGRSRTSGSPGLQEFDSHERSAGAGAGVVDGLCEQLLAGATLARDQHIQGRGRIPACAGHCAQQGRAGAPETLEVVARGMVRAAMLDAQAVVRFVDGARVVQCERRTRGAAMLLNGGTVDQAYRYRRPRGGARYQLLFPLVRVNFELGVIMVIAVSCVKLLSAHNSTQHTSRKHKV

SEQ ID NO: 176708 - protein, 234 aa, Glycine max
  Coding DNA Sequence Number=SeqID_59930
MSINRDYFSLPFVIQRKSSLMARRDKYGHLLILSKTQCPSTKTTLVSLCYPETIKLNVHQPRLLLSPFTIQRQSSLMACKDKYGHLLLFGDLSVLRPRLLRSLFRHLETIKSDGIRRSSWSLNFIVPRLSKSPYHPKTSKSDVPFCHPEKASPMACGKRPWSSVVLKIIEVSPAISRQPSLMAYGDHHGFADWASARLGEQVAFGVSHQLAWARWAASSSPYFAINRHGRLKGR

SEQ ID NO: 176709 - protein, 78 aa, Glycine max
  Coding DNA Sequence Number=SeqID_59931
MEGYPNIDPFALKRLPRRPRKARRKNEVEGQSGTQQARGPILFDVQLAKSLIIIIGPIKGLHKHKCICKCPLNLQVEE

SEQ ID NO: 176710 - protein, 56 aa, Glycine max
  Coding DNA Sequence Number=SeqID_59932
IVATDNELVEIIIKKGEGYLRRQSECSKKDRRMDCDGGAAEDGGDGKQTTKDARLQ

SEQ ID NO: 176711 - protein, 170 aa, Glycine max
  Coding DNA Sequence Number=SeqID_59933
  Gene Ontology: Mol. function=hydrolase activity
  Homolog annotation: Hit_ID=Q1T1F7; Match level="QueryCoverage=89%, HitCoverage=31%, E-value=3e-19, Identity=35%"; Hit description=IMP dehydrogenase/GMP reductase
MVFLDALRDLTQSRGYAWGAAALVHMYDNLNDTSKSTVRQLVGYITLLQCWIYEQFSSVSFTVPAEDYDEKRQRACRWTSGKALPISTYRRRMDRLTPDAVCWSPYGDHRSFREFEVISLFFGHFKWGPLAVIHRPERVVQQFGYIQTIPPHPIASSLSIEEINDRRMQF

SEQ ID NO: 176712 - protein, 183 aa, Glycine max
  Coding DNA Sequence Number=SeqID_59934
  Homolog annotation: Hit_ID=O04892; Match level="QueryCoverage=38%, HitCoverage=13%, E-value=2e-23, Identity=76%"; Hit description =Cytochrome P450 like_TBP
MNRKLGYGAHLRANLDPTKGVGRLRQQDGGHGSRNPLRRRGGRCKTQGASPGGAVVGADLGGTGEARLIALCARTPKGNRPAHPGNGSAGGRVQRLEEHRTSRASGRWNNVGKGSRQNGSVTSGKGLALRAGHGGPSPEPVGCRWTARAASAARAGRRVPVGGRIGNGPFGASSPGVEQSTQN

SEQ ID NO: 176713 - protein, 308 aa, Glycine max
  Coding DNA Sequence Number=SeqID_59935
  Pfam annotation: Domain name=DUF218; Domain location=23-206; Score =54.3; E_value=4e-13; Accession=PF02698.7; Description=Uncharacterized ACR, COG1434
MKKLSCIIILLFLFLSNSWASEHKNVLLLLGSANPDVLTRRVDVAAQLYRIRKIDAVIVSGGCGAHGSKICEASSMALQLAGKGVPSSLIFKEENSKTTVQNYIFSRRLKNEAGQRIIQGGDTVYVVSDHWHAIAVAARLEKYDGVTAKFFIEGSIQPKKEDRLDYAAIFNGYEDNRLFTLKGTGSLQKPYGQKEIDQPINEWLKLPDSLNWSEFNTGYIQTNKLVLIGNEKMLLAEKNGKQFNRIKITSAERYFTNWPYSWAKGNVSAIGQKNDKIVLYRNMESVEFDPGSRIIGKAFALKLKWISN

SEQ ID NO: 176714 - protein, 132 aa, Glycine max
  Coding DNA Sequence Number=SeqID_59936
MRAFGTMAACLGKLLLSPEEIGSPRGAGSFSPKQFGGPREPEASLGEPRPKKLPEVTLLPLPLGIFRILDQNVERSHTLSKNWRRTIPYGLRSSSSMDSFASWKKNDSGMEKEEREETPLQGVDESRRSSPP

SEQ ID NO: 176715 - protein, 335 aa, Glycine max
  Coding DNA Sequence Number=SeqID_59937
  Homolog annotation: Hit_ID=Q1RUD8; Match level="QueryCoverage=62%, HitCoverage=46%, E-value=3e-20, Identity=33%"; Hit description=IMP dehydrogenase/GMP reductase
MDGSSSTSSLQQGVWENLGFGHVGSDHRRVRMDLMMPARRKEAIPFFWVLSFYGKNSQSALANQGEWTSLIDILTLLVFGTILFPNVDGLVDLAAINACIAYHHSKESPVIAVLVDAYDTFDLRCEKNSARIIGCTPVLYVWLVSHVFCHEVRSICPLQGHRMCTKKGKENWEELLAGFPNIPLMGTRGCINYNPIMAIRQLGYPMRGAPLKEIIVPFITRGFNEANAKILQRICKAWNTAERKDKELRAIGNASSVAITSAKKSKLEKMRMVKEKLKKVVTRVRKECDELRDVNMTTVKALEQETKRVRKEEWGRNKFRGALWGSSNKLKLRRA

SEQ ID NO: 176716 - protein, 77 aa, Glycine max
  Coding DNA Sequence Number=SeqID_59938
MWVQAIGLFAQATCAPEFGLPRPFNQRLLVLHVGGGAVNQQVPCYKVMTKDNDCTSKPYTGAMKGPMHKPQTNLGAD

SEQ ID NO: 176717 - protein, 126 aa, Glycine max
  Coding DNA Sequence Number=SeqID_59939
YILCGTSRGYIYLGLTKNKRGYISCGSVLVEGTSTRFKENKGGYIPCGYLLVKGFLQDPYAHLATYIEICNTVRLAGNSLKTWDEVVEKFLKKYFPESKTAEGKAAISSFHQFVDESLSEALERFH

SEQ ID NO: 176718 - protein, 168 aa, Glycine max
  Coding DNA Sequence Number=SeqID_59940
  Gene Ontology: Mol. function=helicase activity
  Homolog annotation: Hit_ID=Q1SN45; Match level="QueryCoverage=90%, HitCoverage=13%, E-value=2e-12, Identity=39%"; Hit description=AAA ATPase
  Subcellular localization annotation: CTP_CleavageSite=38; ConfidenceScore=5.51e-01
MSKPSISDSKFLAWMNSNKCFSDGRNLTYSQFVSKFVYNQKARSWNLRKKGNTIGRLIWVPPTTGVITKPKELWSQTWNWLAEDIAYHYKKTTLNTELLIDDEQLKNLTLLEIEKLLHANQKSLRDYPTMPDPKGGNPASCLENSLILSELNYNNDEARSEFEIFFYG

SEQ ID NO: 176719 - protein, 90 aa, Glycine max
  Coding DNA Sequence Number=SeqID_59941
MASNNRKTYASSSSQERFDRSRFHSQEAWEREFYANLYEPKDKFRNPPFGGRATRGLTGASSKKRKCAKSPPTFIRGKRRKNWEGVVYEL

SEQ ID NO: 176720 - protein, 280 aa, Glycine max
  Coding DNA Sequence Number=SeqID_59942
  Gene Ontology: Mol. function=catalytic activity; Biological process =carbohydrate metabolic process
  Homolog annotation: Hit_ID=P39657; Match level="QueryCoverage=92%, HitCoverage=95%, E-value=4e-52, Identity=47%"; Hit description =RuBisCO-associated protein
  Pfam annotation: Domain name=Glyco_hydro_18; Domain location=5-257; Score=-47.4; E_value=0.014; Accession=PF00704.18; Description =Glycosyl hydrolases family 18
MAGSKIVFREYTSDDSFTKLTDIPKDVSEIQVALTFARDYDGVGSTQGKFIPYWDTAIVNPDVIANFKSKYPSAKVLVSIGNNKRHFPFKIDEDRVTAWINAATESLTRIIKEYNLDGIDVYYEDIEVSNPAIFVHCIGELIKTLKLNKVITRASISPNIEINDNFYRSLHQNFEDHIDYVNLFLSVVENLTGNTNQEEVLEKLKPTLNQYPPIKRLLGYSSIPPPPIFFVVSKILLSHSFINGISLKVTSFSITYFPPQWILDLLQSPLAILGSCKCNL

SEQ ID NO: 176721 - protein, 310 aa, Glycine max
  Coding DNA Sequence Number=SeqID_59943
MENHAQEAHLVQEATWEVNCHVQEPTVSNSHLIFEEPLMAGDKPSRVTLKDYSSSSTPQYFTSIAQPKVQAANISYPHSLIQLIQGNLFHDEVVKKFLKKYFPESKTVEGKTPTHGFSKPIQLNIFIDTLQPHSRQLLDASAGEKIKLKTPNEAMELIENMAANDYVILRDKAYTPTKKSLLKLMSQDALLAQNKLLANQIETLMETLNKLPQWLHDSRGAHKLGMCMTQEEMFKEVNYMANPNRQGYHQGGKPGYHQGGNFSQNQGQENRQAGGHPDLVHAEIHCKLYGEHKEEPKGGMQGGSHKEQEE

SEQ ID NO: 176722 - protein, 102 aa, Glycine max
  Coding DNA Sequence Number=SeqID_59944
MTPEAFLEHVAWLGDRPSSVKEGGAAFGAGANIGPSGDDDAAEAEDDNDYIANGYKKQWHREPQLHSLVVCWLQKVVLQIDREWVNAFIEPKCLNPRKTMIS

SEQ ID NO: 176723 - protein, 645 aa, Glycine max
  Coding DNA Sequence Number=SeqID_59945
  Gene Ontology: Mol. function=DNA binding; Biological process=DNA integration
  Homolog annotation: Hit_ID=Q1S3H4; Match level="QueryCoverage=55%, HitCoverage=85%, E-value=1e-105, Identity=48%"; Hit description =Integrase, catalytic region
MSIYTKFLKDFLTKKGKNINNESIVEERNYSALIQQILPQKFKDLRSVTIPCSIGIVSVGKALIDLGASINLMPLSMCRRIRNLKIVPTKMTLELEDCSFMRSYGVVEDVLVKVQQFIFLVDFVIMDIEGDSNVFLILGRPFMLTAKCVVDMGKGNLEMSLEDQKEEKDLKVDDVKSVVISNNLSSTKEARLVERRLNQSMKEEVQKEILKLLEVGLIYPVSNSAWKIVLGHKIYSRGIEVDKAKIDVIEKLPPPPLSNMLNKDIVFKFEEECLLDFQTLKERLVFAPVIIFTDHAAIKYLLTNDDSRPRLIRWVLLLQEFYIKIKDKKGCKNLVVDHLSRLFVDIANFKAARIIPDDLNWHQWKKLEVYHGIVIIPPMENIIMGTGQVQRCYIPDSSGPRFLRMPMSTCCIVINVNGLGVFLREMRCPCRILFNWKCLSAGRMALKPSLSSLSKTSSPNFESQKYSSVMVSHTSAMHNCRRSWGTTMSDIRELKKILEKIVASLRKDWAVKLDDALWCYRTAFKTPIGLSPFQMVYGKALKFLNFDESLSGEKRKLQLLELEEVRLNAYESSKIYKQKMKAYHAKRFVKKNFYLGQQVLLFNSRLKLFPEKLKSKWSGLFTIKDVKPYGVFELMNPSSTDLERS

SEQ ID NO: 176724 - protein, 499 aa, Glycine max
  Coding DNA Sequence Number=SeqID_59946
  Gene Ontology: Mol. function=oxidoreductase activity; Cellular component=membrane; Biological process=electron transport
  Homolog annotation: Hit_ID=Q2LAL4; Match level="QueryCoverage=90%, HitCoverage=90%, E-value=0.0, Identity=73%"; Hit description =Cytochrome P450 monooxygenase CYP83E8
  Pfam annotation: Domain name=p450; Domain location=33-494; Score =377.7; E_value=1.8e-110; Accession=PF00067.12; Description =Cytochrome P450
MVSPLLILCFSLPLLLFFFFQSRRTFKKPPLPPSGPIGLPIIGNLHQLDSSALYLQLWQLSKKYGPLFSLQLGLRPAIVVSSPKLAKEVLKDHDLECCGRPKLLSHQKLSYKGLEIAFSTYGDIWREIKKICVVHVLSSRRVPMFSSIRQFEVKQMIKKISEHASSSKVTNLNEVVMSLTSTIICRIAFGRSYEDEGTERSRFHGMLNECQAMWGTFFFSDYIPFLGWIDKLRGLHARLERIFKESDKLYQEVIDEHMDPNRKIPEYEDIVDVLLRLKKQGSLSIDLTNDHIKAVLMNMLVAATDTTAATTVWAMTALLKNPRVMKKVQEEIRTLGGKKDFLDEDDIQKFPYFKAVIKETLRLYLPAPLLVQRETNEACIIDGYEIPAKTIIYVNAWAIHRDPKAWKDPEEFSPERFLDITIDLRGKDFELIPFGAGRRICPGMHMAIASLDLIVANLLNSFDWELPERMREEDIDTEMLPGITQHKKNPLYVLAKCRI

SEQ ID NO: 176725 - protein, 103 aa, Glycine max
  Coding DNA Sequence Number=SeqID_59947
MVKEWDLPSSNPSRRNIKGSNQNKIDFNIERSQRFEKHAFTGGEGNGGGGGTREKVEKCKGKRREEEKEKTAREWGEEQTPVGKEKERVPHLRKEEERTRGAH

SEQ ID NO: 176726 - protein, 70 aa, Glycine max
  Coding DNA Sequence Number=SeqID_59948
MELSNLCKFPIIGRPLGPGGRGGFLKALRCWMKNKKNTGRVRHRTSGKSIVTMRKKKVVNHIINQSMRMR

SEQ ID NO: 176727 - protein, 110 aa, Glycine max
  Coding DNA Sequence Number=SeqID_59949
  Pfam annotation: Domain name=zf-CCHC; Domain location=49-66; Score =22.3; E_value=0.0002; Accession=PF00098.13; Description=Zinc knuckle
MMRAENVDDEHYALVVVESERRRNHSRRHDRPRGRLKSQSHLQRDMSNIQCYYCNENGHVQARCKQMKEDLKKLRDMNKDGANSQANVVKSVEDEDAVFLAINDEVAKTK

SEQ ID NO: 176728 - protein, 187 aa, Glycine max
  Coding DNA Sequence Number=SeqID_59950
  Gene Ontology: Mol. function=oxidoreductase activity; Cellular component=membrane; Biological process=electron transport
  Homolog annotation: Hit_ID=Q2MJ14; Match level="QueryCoverage=90%, HitCoverage=34%, E-value=3e-50, Identity=55%"; Hit description =Cytochrome P450 monooxygenase CYP83E8
  Subcellular localization annotation: CTP_CleavageSite=22; ConfidenceScore=5.27e-01
MRKICVAHIFSSKRVSSFSSIRKFEVKQMIKTISGHASSSGVTNLSELLISLSSTIICRVAFGRRYEDEGSERSRFHGLLNELQVLMGTFFISDFIPFTGWIDKLKGLHARLERNFKELDKFYQEVIDEHMDPNRQHAEEQDMVDVLLQLKNDRSLSIDLTYDHIKGVLMTGKYEVDKGQIHVRSSN

SEQ ID NO: 176729 - protein, 142 aa, Glycine max
  Coding DNA Sequence Number=SeqID_59951
  Subcellular localization annotation: CTP_CleavageSite=21; ConfidenceScore=5.06e-01
MSEPWKIHNTRSTPNHRKTCRTMLNSCVRYYFSYGVIFVMFSRSFVGSTIQDLLVQQGLDQALEDERPASINEIKWTKIQWRVVSMIRLVLTPEIKTCVEGDNTEGLTGEVREYLYVKVANQSSLFEDGVVSTQNKDERRSP

SEQ ID NO: 176730 - protein, 327 aa, Glycine max
  Coding DNA Sequence Number=SeqID_59952
  Homolog annotation: Hit_ID=Q2LAL4; Match level="QueryCoverage=42%, HitCoverage=31%, E-value=7e-36, Identity=52%"; Hit description =Cytochrome P450 monooxygenase CYP83E8
  Subcellular localization annotation: CTP_CleavageSite=17; ConfidenceScore=5.00e-01
PSVSVSTFSSIRNFEVKQMLKKISGHASSGVSNVSELLISLSSTMICRIVFRRRYDDDDEGSDANYIPFTGWIDKLKELHARLEGSFKELDNFYQEIIDEHRDQNRQHAEEKDIVDVMLQLKNESSLAFDLTFDHIKGVLMVWWCLKSYSYSYPLEGVPNRRLERGLGAGVPVLRGGCRGPSPRRNSSRGAMAAGRQSYSPELRTDAAGLNGLQKSRPSGELVVAGHPLESNQGGSFHGEGGNVLIMAGLGTGLGKEDEGEAEEWLGFSRLATQRRRSSNFSVTTIWLEASREIASSMCSNGDLARGESAMGEGNESTKFVKNQRTS

SEQ ID NO: 176731 - protein, 102 aa, Glycine max
  Coding DNA Sequence Number=SeqID_59953
MERKKRERGENEREEENERPFISIGTASVTPKHRGKLDSWLCDTLALTMSRQHCQDLQTVFASADFDPEVLEAIKPAMRLSTNVDGYNMHFLVLECRETAGT

SEQ ID NO: 176732 - protein, 296 aa, Glycine max
  Coding DNA Sequence Number=SeqID_59954
  Subcellular localization annotation: CTP_CleavageSite=56; ConfidenceScore=5.57e-01
MDARRPPPYHPPTTIATTITTQSPSPNPTPPLLPTPQRTTTTSIPFKRLTPEELAVCWEKGLCFHCDEKFSRGHKCSSSLFLLVTEDEELTPQLAPPRSPSPDLLSEPSLAQLSLLALGVSSISSFSIPLSFIFQEAKESINKEDPRPTSSNGAYIKFEWTTIAGSKDNCCQNMEGELLMHVEGELEVVIIKKGEIVEAKLHDESRLIQRYFDDNKDDDKGDDKKLKGQSKNEFKMFKIESRTLQDSRGKLKNTSRFKRKVKFQNQESRFKDQVSKNQDQDSRLKIQESREDLIKI

SEQ ID NO: 176733 - protein, 1517 aa, Glycine max
  Coding DNA Sequence Number=SeqID_59955
  Gene Ontology: Mol. function=oxidoreductase activity; Biological process=electron transport
  Homolog annotation: Hit_ID=Q2LAL4; Match level="QueryCoverage=95%, HitCoverage=86%, E-value=1e-173, Identity=66%"; Hit description =Cytochrome P450 monooxygenase CYP83E8
  Pfam annotation: Domain name=p450; Domain location=35-493; Score =400.1; E_value=3.2e-117; Accession=PF00067.12; Description =Cytochrome P450
  Pfam module annotation: Pfam domain module=RVT_2::p450; Domain location=980-1132::35-493
MLSTILLPLVLCLTLLVLLLFFIRNLRTFKNPPLPPGPKGLPIIGNLHQFDSSILYLQLWQLSKKYGPIFSLQLGLRPAIVVSSPKLAKEVLKNHDLEFSGRPKLLGQQKLSYNGSEIAFSPYNEYWRQIRKICVVHIFSSKRVSSFSSIRNCEVKQMIKKISGHASSSGVTNLNELLMSLSSTIMCRVAFGRRYEDEGSEKSRFHVLLNELQAMMSTFFVSDYIPFTGWIDKLKGLHARLERNFKEFDKFYQEVIDEHMDPNRQQMEEHDMVDVLLQLKNDRSLSIDLTYDHIKGVLMDILVAGTDTTAATSVWAMTALIKNPRVMKKVQEEIRNVGGTKDFLDEDDVQKLSYFKAMIKETFRLYPPATLLVPRESNEECIIHGYRIPAKTILYVNAWVIHRDPESWKNPQEFIPERFLDSDVDFRGQDFQLIPFGTGRRSCPGLPMAVVILELVLANLLHSFDWELPQGMIKEDIDVQLSIKLDDKNFLLWNQRVGGIVAMHKLHHLLVNPIIPSKYNSDLDRQLDRMFVEYGKWFIQDQSLFTWLLSTRCESVLSTVLNCHHGHEIWDKSHTQYYATLKAKVRQLGSELKTAKKGNRSIAEYTLRIYALVDSLIAIGETISDQELLDVELATPVVFANVAHTTPNPQFQGGRGGRGRNNIARGCGRGRNLGNRLTCQLSGKYGHAVLNCWFKFDESFVPTTSVVAQPVAANTANSQASTLQSQTETTTANVAPQANLAQTSKEFDVSIPTDLESQAWFVDSGASHHLTTNSLNLQQSSAYVGSEQVHMGNGQGSLGGDGLYSFKSIPLSQQPAFQTTKVCPSLPNLPNPAPSVHTSVSASVQSSSEDVVDPILWHSHLGHVNFQTVKVVMKLCDIPITPSLSIPGSGQAADQSVFASSTTKFIPSTVSAPNSSAEIPSSAPASVSSNPVQSHMEQNLNNHPMLTRSKIDHSKPKTFLVTAKQKTVKHALSDSNWRSSMQAEYEALVKNNTWSLAKFPSHRKTIGHKWVFRIKENLNGTINKYKARLVAKALTNKWNIPQIDTKNAFINGFLQEGIYMQEPPGFEASGKTLLHFVFALKNLGKPDYFLGIKVKYQSNGSIVLTQTKYIRDLLQRDNMLDCNGISTLMVSSYKLSKFGSELLPNAHQYRDIVGALQYRILRYLSGTVTHGLLLQPAHMDAKISLRAYNDSDWGSDPAEMHSTSGSCIFSGSNLIAWSSKKQTLVARSVQKQSIKQPTLLCINLSAVMIAYNPILHSRTKHLDLEIHFVHEKVATKSLVVQHMPSNMQLADALTKPLPTSKFLDLRPKLKGMVARVAMAFSWRRPWFDWKIPKLNQFENDLEGAKLAQSSMAGWEWSNRGEKKYVVKEGLVWKMVFNRIQTVENLKKRNIVADGLFGEYGRSGMINNAVCDPVTVLDGIRYHAWCWCKAFAKDCPDIYFLSICFTSKFLIEEKVETDTLGAKDMDNINFSDFSPILIASNLIEGKIEGHISLRVAIAVLRFWIKNMKSTGRARHRTR

SEQ ID NO: 176734 - protein, 154 aa, Glycine max
  Coding DNA Sequence Number=SeqID_59956
  Gene Ontology: Mol. function=oxidoreductase activity; Cellular component=membrane; Biological process=electron transport
  Homolog annotation: Hit_ID=Q2LAL4; Match level="QueryCoverage=94%, HitCoverage=29%, E-value=5e-68, Identity=81%"; Hit description =Cytochrome P450 monooxygenase CYP83E8
MKMMFKFPLKAVIKETLRLHLPAPLLIPRETSQKCTIEGYEILAKTLIYVNAWAIYRDLKAWKDPKEFIPERFLNSNIDLRGQNFEFIPFGAGRKICPGLNLAFATMDLILANLFYSFDWELPPAMTREDIDTEVLPGITQHKKNPLCVVAKCR

SEQ ID NO: 176735 - protein, 296 aa, Glycine max
  Coding DNA Sequence Number=SeqID_59957
  Gene Ontology: Mol. function=oxidoreductase activity; Cellular component=membrane; Biological process=electron transport
  Homolog annotation: Hit_ID=Q2LAL4; Match level="QueryCoverage=88%, HitCoverage=52%, E-value=1e-101, Identity=67%"; Hit description =Cytochrome P450 monooxygenase CYP83E8
  Pfam annotation: Domain name=p450; Domain location=2-291; Score=-9.5; E_value=1.5e-10; Accession=PF00067.12; Description=Cytochrome P450
MEFVGWFLGISLGPVPGGCFFADLRPIANRLHARRERNFKVLNEFYQEVIDEHMNPNRKTPENEDIVDVLLQLKKQRSFFVDLSNDHIKAVLMDMLVGATDTATAMTVWAMTALLKNPRVMKKVQEEIRNLGGKKDFLGEEDDIQKFPYFKAVLKEVMRLHLPAPLLAPREINEACIIDGYEIPAKTIVYVNAWAIHRDPKAWKDPEEFLPERFLDNTIDFRGQDFELIPFGAGRRICPGVSMATATLDLILANLLNSFDWDLLAGMKKEDIDTEVLPGLAQHKKNPLCVLAKCQI

SEQ ID NO: 176736 - protein, 212 aa, Glycine max
  Coding DNA Sequence Number=SeqID_59958
  Gene Ontology: Mol. function=protein binding
  Homolog annotation: Hit_ID=Q1RXV5; Match level="QueryCoverage=91%, HitCoverage=41%, E-value=2e-37, Identity=40%"; Hit description =Cyclin-like F-box
MGSLRNSDLILIAQCFPFLEHLDLSFPKDTDNSTFPVSDVSVKALSLALPMLHSVDLSRNFFINDASILNLCKNYNFLEQVTIFECHFITQRGIASTIKERPCLRSFRVSNFRHQGETLVLQGCCNYSYVGVLCLLSTCQSLEHLDLQNAEFLCDQRVEELCEYLGNLVSVNVGGCRMLTDLALFALVRGCPLLNEIRMGELMLGRGGLMRI

SEQ ID NO: 176737 - protein, 238 aa, Glycine max
  Coding DNA Sequence Number=SeqID_59959
  Gene Ontology: Mol. function=RNA-directed DNA polymerase activity; Cellular component=chromatin; Biological process=chromatin assembly or disassembly
MAQSNQTRIKHSLDLLLEFGFLAIWVTIGLNRDWFGIWVEVDMVGNGSDWGRGDRAGGGGSVSGSKGRDGLRLNSEAYGEAGGLMPKGARSHWTPSTRSAPLKGNPKRVAAVTMDDSTVTNHNGNGGHQSRGKSEELCHAQLHKVVRTATIHEDRELVSHDGAVEISARLAEGNRGVLSDAPETISHRSDSKAPYLVSELIPQGGKVGGGLTGDEWWEHGNCGGGCGGGLGVIFLSCP

SEQ ID NO: 176738 - protein, 520 aa, Glycine max
  Coding DNA Sequence Number=SeqID_59960
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=97%, HitCoverage=32%, E-value=1e-146, Identity=50%"; Hit description =Chromo
MPTIDELLDELGAASCFSKLDLRQGFHQIRMAEEDIHKTAFRTHSGHYEYCVMPFGLCNAPATFQATMNEMLKPFLRKFVAVFFDDILVYSPSWADHLLHLEAVFTVLARDSFYLRESKCVFAKTQLQYLGHILSAKGVSLDPSKISAILDWPTPTTTTALRGFLGLTGFYRRFIRGYSLLAAPLNALLRKDSLIWTVDSQRAFDTLKQVMTSAPVLIPPDFTIPFCLEIDAFGIAIGAVLSQHAHPIVFFSKNLCPRLQRSSTYVRELHAITSAVRKWRHYLLDHPFTIITDHQSLKDLMNQVIQTPEQQQYLVKLLGYNYTIEYRAGSGNAAADALSRVVPAGQCLILSIPLLDCIADIHHSVQQSPTYHELLAKLQQQPETHPDYSIISGKIHFRGKLWLPSDNPFIPMLLEEFHSTPLGGHMGETKTLRCFRDSFYWDHIHRDVHRMVSQCRVCQQIKYEARKPAGLLQPLPICFGLWEDLSLDFISELPPSHGFTTILVVVDRTPRNPPRHTPTK

SEQ ID NO: 176739 - protein, 1133 aa, Glycine max
  Coding DNA Sequence Number=SeqID_59961
  Gene Ontology: Mol. function=RNA-directed DNA polymerase activity; Cellular component=chromatin; Biological process=chromatin assembly or disassembly
  Pfam annotation: Domain name=Chromo; Domain location=1025-1073; Score= 23.7; E_value=0.00065; Accession=PF00385.14; Description='chromo' (CHRromatin Organisation MOdifier
  Pfam annotation: Domain name=rve; Domain location=752-908; Score =83.3; E_value=7.4e-22; Accession=PF00665.16; Description=Integrase core domain
  Pfam annotation: Domain name=zf-H2C2; Domain location=693-734; Score =18.8; E_value=0.0011; Accession=PF09337.1; Description=His(2)-Cys(2) zinc finger
  Pfam module annotation: Pfam domain module=Chromo::RVT_1::rve::zf -H2C2; Domain location=1025-1073::269-438::752-908::693-734
YHRGHRCASRVLLMVVEEEDPSWSNIDPGDPTPTIDPPDSPNPLQAQISLNSLSGHLAPKALRLLASITDHRVTVLVDGGWEWTILGVLECEDVAICIQHHTFNLDLYILPISDANIILGVQWLKTLGPVLTNYNTLSMQFFHQDQLVELKGDHTSDNGPLTQHQFRRLYRHQPTASYFHITLSPDNPTVPNPQSLPPEIQHLLASYDLLFNQPQSLPPPRTTDHHIHLLPHSSPVNVRPYHYPHYQKHEIELQVDSMLQQGLIQPSNSPFSSSVLLVRKPDDTWRFYVDYRALNAVTVKDRFPIPTIDELLDELGGATYFSKLDLLQGYHQIRMNDEDVLKTAFKTHHGHYEFRVMPFGLCNAPSSFQATMNMIFRPYLCHFIIVFFDDILIYSASFEDHLLHLQTAFQIFLDNQFALKLSKCFFAQTQVEYLGHVVSASGVEPVASKVAAVHQWPTPRSTRAVRSFLGLAGFYRKFIRGYATIAALLVAATTFELPFTVETNASGVGMGAVLSQQRHPIAFFSKPFSPKLLRSSTYVRELCAITTAVKKWRQCLLGHHFIILSDHRSLKELLTQTIQMPEQHMYLARLMGYDYEIHYRSDNHNQAVDALSRLLETTSTLSLILSVPTLNFMEELRRQLDANSEYVALRQAIRDTPQDHPQFSLSRDLVLQSGRIWLPRELPLIKTLLTEYHSIPTGGHAGVTKTLARISENFQWPGLRDDVKHFVATCVDCQVTKYEARKTAGLLCPLPVPIRPWEDLSLDFITGLPPYHDNTTILVVVDRFSKGIHLGMLPTTHTSHMTATLFINIVVKIHGIPRSLVSDRDPLFISKFWQNLFHASGTLLRMSSSYHPQTDGKTEVLNRVIEQYLRAFVHRRPHLWGKLLLWVEWSHNISWNAGTGATPYEITFGRKPFNFAEYVAGTSKVDAVEEMLIDRDDTFRAIRSKLLKVQATMKSRADGKLAKRFYGPFKVLERIGPVAYKLQLPAGAQLHPVFHCSKLKPFHGSPEGVEGTPLPAETLNDQPLVFPLAILDHRCNSNGDAWEVLVQWNGLSPDDTTWEDWEQLCSNYHLGDKVVFEGPGDDTNEQVEAQTENPTGGISDNQEVRVASDMQEVQEAIKTKRGIIKPKYLTDYV

SEQ ID NO: 176740 - protein, 53 aa, Glycine max
  Coding DNA Sequence Number=SeqID_59962
  Gene Ontology: Mol. function=chromatin binding; Cellular component =chromatin; Biological process=chromatin assembly or disassembly
  Homolog annotation: Hit_ID=Q1SAV4; Match level="QueryCoverage=98%, HitCoverage=15%, E-value=2e-09, Identity=62%"; Hit description =Integrase, catalytic region
MESAASIGEVPVVYGGKAGGEAGTRVSGGIIAPFGQRKKRVPQGRLVMNERAK

SEQ ID NO: 176741 - protein, 236 aa, Glycine max
  Coding DNA Sequence Number=SeqID_59963
MCSCLPVKFAASRCGGLQARCSRGLPGVVHADFLFLFLYGDTLNLTEYEVVIIVVVVKKMTREICSSNDNQEDKWTRKLIRVSELIREFDNHDGNDEGDNNDKSGAHIGSDCCYNNNNNNSDNNNNQGSYNSGGGSSNNGYGGNDGSSNNDGGRSGGSEGVTKSWQKMLGHLNGRVLEQALKGCSRCPKEENVEGWEVTEIVDDDGHNAMYDDIWQMLQCHGSRDGEGSTCSNNRA

SEQ ID NO: 176742 - protein, 134 aa, Glycine max
  Coding DNA Sequence Number=SeqID_59964
  Gene Ontology: Mol. function=RNA-directed DNA polymerase activity; Cellular component=chromatin; Biological process=chromatin assembly or disassembly
  Homolog annotation: Hit_ID=Q1SAV4; Match level="QueryCoverage=42%, HitCoverage=14%, E-value=8e-11, Identity=55%"; Hit description =Integrase, catalytic region
MAMKNNAYRQLSMRPHYSKLAKRFYGPYRVTECVGPVAYRLQLPANSRIHPVFHVSLLKPHHGPPPPMDDPLPPTQDTSWENWDALRSVYNLRDEVEFLGEGVVSNGTQISKEAPTRDRPKRNTKKPAQYQDYI

SEQ ID NO: 176743 - protein, 388 aa, Glycine max
  Coding DNA Sequence Number=SeqID_59965
MGCILAKFDILEAPNAKKKVRSTMATRWRQFKSILTTKFVYADTEGQDKQDSSIKYGMYQQSWEEFAASRKTLNWQDSLQEQTTQITFVPHGHDDILNIVIGRPKHSGRVRAVGSAVPLHPSPQQQLSEIIGSLKEEWRNDLEPENKRSLEKMKQELKEAIKIELFQRDSTITSNKVVEPVQRLNNVVADDPLRQLIRILYDSYEKPIELLWDGTKFGIPNVDASFLLTYFDGFLEHQSIHNAKDRYVECQHYIETWVKESQREVYLGTYLNYTMKTLKTIVDGKTDQAAPQWIKVKWFSDDTLLDLETITTIRKKWATYFVKCKDILFRKDKCLLCDQALHFEGHCQAKDLDNRDDTPIGINKYEVRQLHSSWLLETIASIIWIQNQ

SEQ ID NO: 176744 - protein, 107 aa, Glycine max
  Coding DNA Sequence Number=SeqID_59966
MADSSSHLTEVLARLGDTMNSLNLKLGEILHCLSPTSPSSAFPNPSPPPHPPIPAVTHKMKLEVPRFDGTEPLGWIFKINQYFEYHNTLDKDRLTIASFYMEGRALA

SEQ ID NO: 176745 - protein, 275 aa, Glycine max
  Coding DNA Sequence Number=SeqID_59967
  Homolog annotation: Hit_ID=Q1SYP9; Match level="QueryCoverage=22%, HitCoverage=6%, E-value=7e-09, Identity=44%"; Hit description=Myb, DNA-binding
KGSKGYMQLSMKVMGARALWGDDLVEWKQVLTVNSSGGLLCLWEQGTFQVISWEGELGFLFIQVGRVSDGLWCVIGNFNSIRSQDKRLGRHASQHWNKEIHEFNNFIDNMGLFEIPWIRRKFTWEKLKHLKKDIKKWSVEKFGSQQALIESLVSNINNMNSKEELGGISLEEARKGMKTQSSSIPSSIGREGRKTSRGCKWGELGRFNSISKEENIMLVGVFTKEEVKAVVWNYDGNKSLEPDGLSFNFIKACWDVIKGDILSAVNEFHGYRQLV

SEQ ID NO: 176746 - protein, 288 aa, Glycine max
  Coding DNA Sequence Number=SeqID_59968
  Gene Ontology: Mol. function=transition metal ion binding; Cellular component=nucleus; Biological process=cytoskeleton organization and biogenesis
MSLIYQQEGSGVNCEQCYYGIVYINIMSLTMTTSSFALYMSYKRLKKAFNGNQENESVSQPFARNKVYDWVKDIITIFWKTQKKSSSEMNIWKKRLIFFNLPYWSDLHVRHCVDVMHVEKNICDSLIGTLLNIKDKTKDGLKCLQDLVDMGIQEGLHLISQGRRRYLPPTCQTVSTTDKRSFCQCLWSLKVPQGYSSNIKSLVSLNDLKLVGLKSCDCHVLMQQLLAVVMRGILPNNVRVAITHLCFVFNTIYSKVINPRQLDDLENEAVIVLCQLEMYFPPSFFDIM

SEQ ID NO: 176747 - protein, 71 aa, Glycine max
  Coding DNA Sequence Number=SeqID_59969
MDYEVSAGGLGDLTVGSGGGRVLDSNLGVGGLLERLHEHARLADDGTHAQRKTKETEGHVTIRVWSLVRTY

SEQ ID NO: 176748 - protein, 94 aa, Glycine max
  Coding DNA Sequence Number=SeqID_59970
MDPKKLSTKRSRRDAMAEGSSAAPEFDSHCFPSAEHQQCFQAADAPPPPHQADPTGSLGMERYLQHLVRQQAANHRGQVQINECLYRFSLSQQG

SEQ ID NO: 176749 - protein, 57 aa, Glycine max
  Coding DNA Sequence Number=SeqID_59971
MAVRLFPAADHPNAAVVFRPAPVWGAVLLDESSISRGPDALAGGDRCLAVAIPANNR

SEQ ID NO: 176750 - protein, 190 aa, Glycine max
  Coding DNA Sequence Number=SeqID_59972
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=1e-24, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MHAITFKGLRALAFRGLHVLTFRGLHALAFRGLHVVPFRGQHVLDFRGLHVLAFRGLHALSFKGLHVLAFRGLHVLAFRGLHALAFRGLHVLLFRGLHVLAFRGLDVLTFIGLHALTFRGLYVLPLRGLHILAIRGLYVLVFRGLHTLTFRGLHVLPFRGLRALAFRGLYVLTFRRLHVVAFKGRHTPRL

SEQ ID NO: 176751 - protein, 272 aa, Glycine max
  Coding DNA Sequence Number=SeqID_59973
  Gene Ontology: Mol. function=hydrolase activity; Cellular component =cytoplasm; Biological process=metabolic process
  Homolog annotation: Hit_ID=Q48FP7; Match level="QueryCoverage=98%, HitCoverage=79%, E-value=1e-111, Identity=73%"; Hit description =Lipase
  Pfam annotation: Domain name=Abhydrolase_3; Domain location=58-267; Score=327.2; E_value=2.9e-95; Accession=PF07859.3; Description =alphabeta hydrolase fold
  Pfam annotation: Domain name=Peptidase_S9; Domain location=73-270; Score=-80.5; E_value=0.055; Accession=PF00326.11; Description=Prolyl oligopeptidase family
  Pfam module annotation: Pfam domain module=Abhydrolase_3::Peptidase _S9; Domain location=58-267::73-270
MEQMKPKEARRVLEDAQRSVEVPLREVEISEKTIHVEGQDILLQLVRPARVKEALPVFMFFHGGGWVLGDFPTHERLVRDLVHSSGAAAVFVNYPRSPEVRYPEAINLAYAATEWVAEYGEKINVDGSRLAVVGNSAGGNMAAVVSLMAKQKGIPALRCQILLWPVTRAQFDTDSYHQFAEGHFLTRNMMKWFWDSYAPDKAQRKDIYASPLNATPDQLRGLPPALVQTAELDVLRDEGEAYARLLDAAGVEVTSTRYNGLIHDYGLLIRSP

SEQ ID NO: 176752 - protein, 96 aa, Glycine max
  Coding DNA Sequence Number=SeqID_59974
  Subcellular localization annotation: CTP_CleavageSite=57; ConfidenceScore=5.20e-01
MSCWACGWLRSTVFLGMGTPCAQKRRGGQDHSVVAGAQSRSRGQRGPFWPVGARVAAAMHHSGAPLHPLGAKSVIASKSGEIIFASPIRNPEVFRN

SEQ ID NO: 176753 - protein, 96 aa, Glycine max
  Coding DNA Sequence Number=SeqID_59975
MEANAVAVAATRAVAKVWWAKIWEVRAAPIMRKFKTSMPSHHMACIPTIHHPMWHTLPRRMSITPLPHSLKANNLNLIMHMSLNPWGRHMECPTTI

SEQ ID NO: 176754 - protein, 263 aa, Glycine max
  Coding DNA Sequence Number=SeqID_59976
  Homolog annotation: Hit_ID=Q3BW37; Match level="QueryCoverage=49%, HitCoverage=47%, E-value=3e-11, Identity=34%"; Hit description =Putative phage replication protein
MEGGGLMGVRRTALPFEGQFTQIPNEWLRDKRLSRKARGLLAEIMTHRVGWHVTTRTLTTTGPEGRDSVRAALSELVEAGYLRRGQSRGEGGTFGEIEYELSDPTVAGKSDHGEKTPGQTAVGFTVAGSAVDGKPATKNTRDQEDHLEEDQTPVVPRGDAMEEGLSALWNLWPTPRRGTTKKASSSFRTAVTANGGLKHIDVILAAARRDVAVWRTWAPGDVQFIPLLSTWLNQGRWEPQAAALPRGTARTYAQKQQDNTLSL

SEQ ID NO: 176755 - protein, 150 aa, Glycine max
  Coding DNA Sequence Number=SeqID_59977
KYAHRSTDFLCHLLFAGIAPARHLVDPEKSNRVLGFPALITRLGQFYRVPIAPNKVIRPPINRDFIKKYCAPQAGAGRDTTSTWGWPAAGNRRIAATSRAPQLIYKGWSIAYDPWLTNRRPSPKPKVSKSTRSMTDKSSGVQLKTLKKHY

SEQ ID NO: 176756 - protein, 124 aa, Glycine max
  Coding DNA Sequence Number=SeqID_59978
  Gene Ontology: Mol. function=hydrolase activity
  Homolog annotation: Hit_ID=Q1QYG1; Match level="QueryCoverage=88%, HitCoverage=30%, E-value=9e-20, Identity=49%"; Hit description =Fumarylacetoacetate hydrolase family protein
MAGVRSIDATAILPEDYENALLVGRVWSKSEGGPCPVLLKDGVLYDLTSVSPTMSELLEKTDLVEQLKDTGTFVALGALDAFLDGSAGDLLAPNDIQAVKAAGVTFADSMLERVIEEQAKGDPL

SEQ ID NO: 176757 - protein, 139 aa, Glycine max
  Coding DNA Sequence Number=SeqID_59979
  Gene Ontology: Mol. function=unspecific monooxygenase activity
  Homolog annotation: Hit_ID=O04892; Match level="QueryCoverage=61%, HitCoverage=21%, E-value=5e-16, Identity=51%"; Hit description =Cytochrome P450 like_TBP
PAHPGTAQPEVGSSGWKSTARRVVSGAPPAALENPEDRVPPTPGRTHNRIRSPRAGHGGPSPEPVGCRWTARAASAARAGRRVPVGGRIGNGPFGASSPGVEQSTQNCALNVKVKKFNQARVNGGSNYDSLKVAKCLVI

SEQ ID NO: 176758 - protein, 142 aa, Glycine max
  Coding DNA Sequence Number=SeqID_59980
  Homolog annotation: Hit_ID=Q47522; Match level="QueryCoverage=37%, HitCoverage=66%, E-value=2e-25, Identity=100%"; Hit description=LacZ protein
MTDRSGTKQRFAIVREQIVAKAFNNSQSLFDEIEFPSFFCCRGCESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 176759 - protein, 96 aa, Glycine max
  Coding DNA Sequence Number=SeqID_59981
MKFGNQELLVLTNEFHYPADKIKKALEPETMTIIINADQTKTCHKTYKDSVSPNVLEPINSLSLDNFKKIQKLLFRVHNNQTQISSLYIGVHAYFN

SEQ ID NO: 176760 - protein, 152 aa, Glycine max
  Coding DNA Sequence Number=SeqID_59982
MEEFDAQVDWPRDQPCSSRGGGAFTAQEPVTEEPPAPAPSSAVAEEETTPTQTPQPSPPPAPALEEIQPSTLDLNEEQPHEDWAKLSSWTKRISTAKRSFNALSTKENLAEHQHQGRTLTRLSMRLALSLISLTHAKREGGAKRNVVNSEPI

SEQ ID NO: 176761 - protein, 98 aa, Glycine max
  Coding DNA Sequence Number=SeqID_59983
  Homolog annotation: Hit_ID=Q8YE80; Match level="QueryCoverage=92%, HitCoverage=96%, E-value=1e-17, Identity=46%"; Hit description =Hypothetical Cytosolic Protein
  Pfam annotation: Domain name=DUF1330; Domain location=2-93; Score =151.0; E_value=3.1e-42; Accession=PF07045.2; Description=Protein of unknown function (DUF1330)
MPAYWIAHVTVKDPQQYQHYMDLAPQAFRQFNARFLARGEQAQTLEGPSFVKHVLIEFDDYATALACYHSPAYQLAKQQRRYVAEAMITIVDGLPPAH

SEQ ID NO: 176762 - protein, 103 aa, Glycine max
  Coding DNA Sequence Number=SeqID_59984
  Gene Ontology: Mol. function=endopeptidase inhibitor activity; Cellular component=outer membrane-bounded periplasmic space
  Homolog annotation: Hit_ID=Q2VU39; Match level="QueryCoverage=74%, HitCoverage=60%, E-value=7e-11, Identity=49%"; Hit description=Inh
  Pfam annotation: Domain name=Inh; Domain location=12-101; Score=43.6; E_value=6.7e-10; Accession=PF02974.5; Description=Protease inhibitor Inh
  Subcellular localization annotation: CTP_CleavageSite=30; ConfidenceScore=5.01e-01
MAVQIQTSWCTSSGRPTSLLTLSCKTATLNAESVESAGGYSLKFLSDCTPDVLPQEPVAWRPAPDGIALLDKDGLTVLFFSQEDDHYRSQIWAETGKILKRNN

SEQ ID NO: 176763 - protein, 71 aa, Glycine max
  Coding DNA Sequence Number=SeqID_59985
  Gene Ontology: Mol. function=oxidoreductase activity; Biological process=electron transport
  Homolog annotation: Hit_ID=Q6D6A5; Match level="QueryCoverage=99%, HitCoverage=19%, E-value=3e-15, Identity=59%"; Hit description =Putative NADH-dependent flavin oxidoreductase
MSLLFSGTQLGELSLENRIVIAPMCQYSAEEGQATAWHRIHLGQLALSGAGLLIIEATAVEAIGRITPGDL

SEQ ID NO: 176764 - protein, 194 aa, Glycine max
  Coding DNA Sequence Number=SeqID_59986
  Homolog annotation: Hit_ID=UPI00005F7DD5; Match level="QueryCoverage =58%, HitCoverage=58%, E-value=8e-33, Identity=59%"; Hit description =COG0265: Trypsin-like serine proteases, typically periplasmic, contain C-terminal PDZ domain
MDEALLAMMRSNGRNRAWAESMVNLEARNLIETANREAGFHIRDGLTRLQFVQEIRDVIEEQFSIARRAKSDEECMACVKNLRAETENLAEQGQMLRMNTAKLYAKVEFVRENNKIVGYVISAVHIVVSGAALFGGMIMMSTMTPLGILAGAILFVDGINGITKEASHLRYGDQSKSEGIFADSSMEAANYLEC

SEQ ID NO: 176765 - protein, 49 aa, Glycine max
  Coding DNA Sequence Number=SeqID_59987
MNLGIPRSCGSACHRSLGTRISFLNDHLEETPGPTKIGENHSKCINLTQ

SEQ ID NO: 176766 - protein, 122 aa, Glycine max
  Coding DNA Sequence Number=SeqID_59988
  Gene Ontology: Mol. function=ribonuclease H activity; Biological process=DNA integration
  Homolog annotation: Hit_ID=Q1SYR3; Match level="QueryCoverage=57%, HitCoverage=3%, E-value=3e-22, Identity=70%"; Hit description=RNase H, putative
MKNLFNKKVRLRKFHEGDLVRKKMSHAVKDNRGKWAPNYEGPFVVKRSFSGGALVLTNMDGEELPSPVNSDVGFLPAVIFSSRSSKKKRMGGQNHLRSWSDVGTKLKAETNQGMPPARGFQH

SEQ ID NO: 176767 - protein, 79 aa, Glycine max
  Coding DNA Sequence Number=SeqID_59989
  Subcellular localization annotation: CTP_CleavageSite=7; ConfidenceScore=5.07e-01
MASMDISAMVNSKIFPCNLAMRGSEEFVPFLDTTSRGSKVPPRTFLRRRHGPSVGLFTEGIKTEPICDAYAKDTMRECT

SEQ ID NO: 176768 - protein, 180 aa, Glycine max
  Coding DNA Sequence Number=SeqID_59990
  Gene Ontology: Mol. function=cobalt ion transporter activity; Cellular component=integral to membrane; Biological process =cobalamin biosynthetic process
  Homolog annotation: Hit_ID=Q05598; Match level="QueryCoverage=62%, HitCoverage=50%, E-value=1e-39, Identity=67%"; Hit description =Cobalt transport protein cbiQ
  Pfam annotation: Domain name=CbiN; Domain location=1-45; Score=2.1; E_ value=0.0002; Accession=PF02553.6; Description=Cobalt transport protein component CbiN
MITTLMLLAMALVLIVLPCFSDHGGEYDGSDAEAENQIQPAVYAPGLHWRIDDFLYFGLHETADSAVMTGLDRLSYQSHWAHVAPERKFLLWLVLMMLAFVLPPLGQGIVVALTAGLTCWLLRMSFWRWCRWMALPFGFMMVGVLTILFSVTRDPHTYGGQRPRGALLAGDHRFRDDRRQ

SEQ ID NO: 176769 - protein, 150 aa, Glycine max
  Coding DNA Sequence Number=SeqID_59991
PYLQVVDRNWMCGRLPEGLSDPINCVSRSALARVLFLYERDSIQICHSLGDALFSMNTPPLNDELCQSSPPTRPGETQSQAKPLPARMDSYLLRLDKVFASSSSRALIEEVAQPFFIYAKRNYFLFYSTGNGASRSIPKAGNAESRIRQY

SEQ ID NO: 176770 - protein, 65 aa, Glycine max
  Coding DNA Sequence Number=SeqID_59992
MERSERKTFNDKKANKAYVTWEDNNMDSSEEEDLLSKLTFKDLRKFGYLSHKHDYIGFFEEELVH

SEQ ID NO: 176771 - protein, 196 aa, Glycine max
  Coding DNA Sequence Number=SeqID_59993
PHHGYAAEGQAFCGIPLPNTLGGLQYHPQPQPLHFAMGRVPPTMVEREKFDHIEERLKVIEGGINYGFADMAELCLVLDVIIPPKFKVSNFNKYKGTTCHKNHLNMYCRKMGAYVKNEKLLMHFFQECLTGAAVTWYTNLEPSRVHSWKDLMVAFIRQYQYNFDMALNRMQQQNMCKKQHEYFKEYAKGRGIWQLK

SEQ ID NO: 176772 - protein, 95 aa, Glycine max
  Coding DNA Sequence Number=SeqID_59994
MAPPKEILTLIYHSSHIVDDPVQGSTYQSQLFDNDDLRGAMETIIQNPQLNSAEFYVVTELIPQPQPSSPQPSCPQLQLPPPQQLPYNNIDLNNP

SEQ ID NO: 176773 - protein, 123 aa, Glycine max
  Coding DNA Sequence Number=SeqID_59995
MAPTRHPLDPDKSNRALGFPALITGLCQSFGVPVAPSKATNHRAHVQTHDCLYQLSLSLQSQGFTSFPCPTLDQFRAEVAWPGDWPEAQAGEAPAEAPGEADEAREDEEMTDLLDFLGGSGAT

SEQ ID NO: 176774 - protein, 98 aa, Glycine max
  Coding DNA Sequence Number=SeqID_59996
  Gene Ontology: Mol. function=DNA binding; Biological process=DNA integration
KDKFSTKRKSKLSPRGDGPFQVLERINNNAYRLDLPEEYGVNTAFNISDLISFARGVDTEEEEPTDLRSNPLQGGGDDAILPRKGPVTKDMSKRLQED

SEQ ID NO: 176775 - protein, 104 aa, Glycine max
  Coding DNA Sequence Number=SeqID_59997
KIGEELVTQLAQASKVASSRSNSLLEEGSGRPKWARLLFVPPFLLNAPPSIFLRMRDARRPLNQEEGFARAMVALNWRGWWRCHNGKVVARVVDYDDGVIRVFR

SEQ ID NO: 176776 - protein, 290 aa, Glycine max
  Coding DNA Sequence Number=SeqID_59998
  Gene Ontology: Mol. function=monooxygenase activity; Cellular component=membrane; Biological process=electron transport
  Homolog annotation: Hit_ID=Q1WCN9; Match level="QueryCoverage=96%, HitCoverage=76%, E-value=2e-92, Identity=58%"; Hit description =Cytochrome P450 monooxygenase CYP76X3
  Pfam annotation: Domain name=p450; Domain location=4-281; Score=-7.3; E_value=1.2e-10; Accession=PF00067.12; Description=Cytochrome P450
MKEVGSPNLADCFPVLKVVDPHGIRRRTGSYFWKLLTIFKGLVDKRLKLRNEDGYCTKNDMLDAILNNAEENSQEMYRDKIERLSLDLFVAGTDTVTSTVEWAMAELLHNPNIMSKAKAELENTIGKGNLVEASDIARLPYLQAIVKETFRLHPAVPLLPRKAEVDLEMHGYTVPKGAQVLVNMWAIGRDPKLWDNNPSLFSPERFLGSEIDFRGRSFELTPFGAGRRMCPGLPLAIRLLFLMLGLLINSFDWMLEDGIKPEDMNMDEKFGLTLGKAQPVLAVPIFKPSN

SEQ ID NO: 176777 - protein, 2940 aa, Glycine max
  Coding DNA Sequence Number=SeqID_59999
  Gene Ontology: Mol. function=zinc ion binding; Cellular component =cellular_component; Biological process=protein modification process
  Homolog annotation: Hit_ID=Q9FN44; Match level="QueryCoverage=96%, HitCoverage=65%, E-value=0.0, Identity=48%"; Hit description=Genomic DNA, chromosome 5, P1 clone:MYJ24
MASSPESIFLEDFGQTVDLTRRIREVLLNYPEGTTVLKELIQNADDAGATTVSLCLDRRSHAAGSLLSDSLAQWQGPALLAFNDAVFTEEDFVSISKIGGSTKHGQASKTGRFGSLVELLLGMGFVVAFTGSMLGFRSEVLVVVVTGKWRGKVGFNSVYHLTDLPSFVSGKYVVLFDPQGVYLPRVSAANPGKRIDFTGSSALSFYRDQFSPYCAFGCDMQSPFSGTLFRFPLRNAYQAATSKLSRQAYSPEDISSMFVQLYEEGVLTLLFLKSVLCIEMYLWDAGEPEPKKIHSCSVSSVTDDTVWHRQALLRLSKSLNTTAEVDAFPLDFLIERINGDESERQKERFYVVQTMASASSRIGSFASSASKEYDIHLLPWASIAACISDNSQNNNILRTGQAFCFLPLPVRTGLSVQVNGFFEVSSNRRGIWYGDDMDRSGKVRSTWNRLLLEDLVAPAFMHMLLGIKELLGPTNIYYSLWPIGSFEEPWNTLVQQIYKNIGNAPVMYSNFNGGRWVSPSEAFLHDEKFTKSKDLGLALMQLGMPVVHLPNSLFDMLLQYSSSKVVTSGTDLVDDDVGKEAYDLPLLPLANGNFASFSEASKGVSCFICDELEYKLMRPVSDRVIDQNIPLNILSRLSGIAMSSKTNVILCNIHHFAQLFPAFFPADWKYRSKVFWDPESCQKPTSSWFLLFWQYLGKQTEILSLFCDWPIFPSTSGHLLRPSRQLKMINGSNLSDTVQDILVKVGCNILNPKYVVEHPDISNYVRDGSAGGVLESIFNAVSGPDVMHASFDSLVTEERNELRRFLLDPKWYVGRSMDEFSIRFCKRLPIFRVYGRDSAQDYQFSDLENPRKYLPPLDVPEIILVGIEFMVKSSNIEGDVLSRYYGVERMGKAQFYQQHVFNRVGDLQADVRDSIMLSVLQNLPLLSLEDISIRDSLRNLKFIPTLTGALKCPSVLYDPSNEELYALLEDSDSFPAGAFRESEILNILQGLGLRTSVSPDTVLECARCIERLMREDQQKAYLRGRVLFSYLEANALKWLPDQVMDNKGAVNRMMSRATTAFRSCNSKSDLEKFWNDLRLVSWCPVLVSTPFQSLPWPVVSSMVAPPKLVRPPKDLWLVSASMRILDGECSSTALLYGLGWMSPPGGGVIAAQLLELGKNNEIVSDQVLRQELALAMPRIYSILTGMIASDEIEIVKAVLEGCRWIWVGDGFATSDEVVLDGPLHLAPYIRVIPVDLAVFKKMFLELGIREFLQPADYANILCRMAVRKGSSPLDTQEIRAATLIVHHLAEVYHHEHKVQLYLPDVSGRLFLAGDLVYNDAPWLLGSDDPKGSFGNAPTVALNAKRTVQKFVHGNISNDVAEKLGVCSLRRMLLAESSDSMNFSLSGAAEAFGQHEALTTRLKHILEMYADGPGSLFEMVQNAEDAGASEVIFLLDKSHYGTSSILSPEMADWQGPALYCYNDSVFSPQDLYAISRIGQESKLEKAFAIGRFGLGFNCVYHFTDIPMFVSGENVVMFDPHASNLPGISPSHPGLRIKFVGRQILEQFPDQFSPLLHFGCDLQHPFPGTLFRFPLRTAGVASRSQIKKEAYTPEDVRSLFAAFSEVVSETLLFLRNVKSISIFVKEGTGHEMHLLHRVRRTCIGEPEFGSTEAQDVFNFFKESRHVGMNRVQFLKKLSLSIGRDLPYKCQKMLITEQSTSSCNSHYWITTECLGDGNAQKRTSETANSNYYNFVPWACVAAYLNSVKLDGDLVESSELEDDCMVSPDLFKSVSLPTHPLENFDGRAFCFLPLPISTGLPAHINAYFELSSNRRDIWFGSDMAGGGRKRSDWNIYLLETVVAPAYGHLLEKIASEIGPCNLFFSLWPKSLGSEPWASAVRKLYQFVAEFNFRVLYTEARGAELIKALSGASLPVITLPQSLLERFMEICPSLHFLTPKLLRTLLIRRKREFKDRDAMILTLEYCLHDLQESMQFDTLCGLPLLPVADGSFTSVDMKGVGERVYIARGDEYGLLKDSIPHQLVDCAIPEEVHRKLCYIAQTDGTNISFLSCQLLEKLLVKLLPVEWQHARQVSWTPGIHGQPSVEWLQLLWNYLKSYCDDLLIFSKWPILPVGDDCLMQLTQNLNVIRNDGWSEKMSSLLLKVGCLFLRHDLLLDHPKLEYFVQSATARGALNVFLAIAGKPQKIEGILTDVSEGELHELRSFILQSKWFSEEQIDDKHIEIIKQLPIFESYKSRKLVSLSNPIKWLGPTGVCEDLLNDKFIRTESEMERVIMKRYLGMKEPTKVEFYRDHIFNHISEFLPKQKVVSAILHDVQHLIKEDLSLKSSFSSAPFVLAGNGSWQQPSRLYDPRVPHLKKMLHGNVFFPSDKFLDPEILDSLVCLGLRTTLGFTGLLDCARSVSLLHDSGDTVASKHGGQLLDLLDALAFKLSNKGESNNDDQQGGVAVGSSSIMDDAFVYDGFPKDETSLTDIDSFLSSSTCDMVEEEFWSELKLISWCPVISDPPVRGLPWLKSNNQVVASPTSVRPKSQMWMVSSSMFILDGECDTTYLQTKVGWMDCPNVDVLTRQLFELSKSYQQHKIHSLLDPGFDAQLQKEIPCLYSKLQEYINTDDFNKLKTGLDGVSWVWIGDDFVSPNALAFDSPVKFTPYLYVVPSELSEYKDLLIKLGVRLSFGISDYLHVLQRLQNDVHGIPLSTDQLNFVHRVLEAIAECCLEKPLFEPFDNPLLIPNDFGVLMQAGDLVYNDAPWLENSSLIGRHFVHPIISNDLADKLGVQSVRCLSLVGDDLTKDLPCMDYNKVNELLAQYGDSEFLLFDLLELADCCKAKRLHLIYDKREHPRQSLLQHNLVINVLDASCNLVYAHHLRSSWLPPTYILYIGLISSQCGTWVFPNTPSHAQHIWAWCVDNMLGDPLNESRIGFGTILAFRNAYFICECGFGCNSTPKASS

SEQ ID NO: 176778 - protein, 84 aa, Glycine max
  Coding DNA Sequence Number=SeqID_60000
MGLSTSRMSSEACMPPNNGPRTKLGYKQTMLGLYTHFSRKMIENHVNMVVEVLVIKIFILANIGSHQAHAFKKRFSSSQGQVWK

SEQ ID NO: 176779 - protein, 80 aa, Glycine max
  Coding DNA Sequence Number=SeqID_60001
EKREVVATQLAQASWVASTRRHRLLLEPPGRPKMSQNFMDYATMPFLTFEMLRNFTDCATMLAFDFRHVAELHGLPNDGC

SEQ ID NO: 176780 - protein, 63 aa, Glycine max
  Coding DNA Sequence Number=SeqID_60002
MTCDCEMIIINNKISVGYWKSSKDGERENGVFTVMDEKPLQEQDYGHSVNPTASPNLDVTVLV

SEQ ID NO: 176781 - protein, 163 aa, Glycine max
  Coding DNA Sequence Number=SeqID_60003
  Gene Ontology: Mol. function=protein dimerization activity
  Homolog annotation: Hit_ID=Q10E61; Match level="QueryCoverage=61%, HitCoverage=17%, E-value=6e-20, Identity=56%"; Hit description =Expressed protein
SSPSRLATFKRRAEEVSVNSEAMLTLDVPTWWNSTYLMLDVVENFEQTFNHFEYVEAAYVLTLLTSEEGCPKEMDWKLARVFELYSRAREQEEEILSLREQIGIACMKELQLLNEKCKLERQFSELRMAVDEKQNEAISSASNDLVQRKGYLEENLKLAHDLK

SEQ ID NO: 176782 - protein, 222 aa, Glycine max
  Coding DNA Sequence Number=SeqID_60004
  Homolog annotation: Hit_ID=Q9MBK3; Match level="QueryCoverage=42%, HitCoverage=17%, E-value=3e-17, Identity=50%"; Hit description=Gp2, terminase
MASRARLVAVNRVVKAGALDEAGVDAAIVAQARDLARMLDKFDDAKPPTSPPLNMLRLYDSALTKLQRAVERNLSVKRGRKSVEPEASDAPDPDSPPSLKIVEESPLEKLRRKKQARATYGKHIGSTEPRIFTKPLRELTPETSHGFSVIEFALEVLGVRLYPWQRALLIRALELNEDGTYRFRKIFVIVGRQNGKTTLLTVLALWWLFMDADSFPEHLPAN

SEQ ID NO: 176783 - protein, 238 aa, Glycine max
  Coding DNA Sequence Number=SeqID_60005
  Homolog annotation: Hit_ID=Q10E61; Match level="QueryCoverage=91%, HitCoverage=34%, E-value=1e-24, Identity=35%"; Hit description =Expressed protein
MEDSKFTFFGSLHPQRFLYMPDRMGELTSVLESRADNGNHVVESPGSGNLTSHTHNDFMFQHNFPQQNLIGNEQSHQPMSNVAGYMHPALHSDVNWGLKTFNYQQTSNADRGISSFPHASIDKIGVQDKNMERNFGNGNFYQHPPDLDETASSVSEDGPGIENFQVSGDAIPGEKLLGCGYPVRGTSLCMFQWVRHLEDGTRQYIEGATNPEYVVTADDVDKLIAVECIPMDDKGRQV

SEQ ID NO: 176784 - protein, 391 aa, Glycine max
  Coding DNA Sequence Number=SeqID_60006
  Gene Ontology: Mol. function=RNA-directed DNA polymerase activity; Biological process=RNA-dependent DNA replication
  Homolog annotation: Hit_ID=Q1T0R3; Match level="QueryCoverage=38%, HitCoverage=94%, E-value=4e-21, Identity=33%"; Hit description =Hypothetical mitochondrial protein atmg00310
MTLADDALGVRASLEKLKKVAGKRRSTTSNSTQTGLPEVEKDGESDQRKEALLIGGSHQREVSTVAVIPMKSFYKEMLDLMAFQFPSLKFSPAVSSSAVVVSPLYRINCLPSAPLNFDTPYHVSFHTFPDYNFLKSTLLQFGFTDRKCDPSLFTYSTKSATVYILVYVDDIIITGSSPSMDGSFYRSIVAALQYVAMTHPKVPKKVVDKLVCLQRKFLWGGVADHNKIAWVKWDTVCLPKDKGGLGIKDVNTFNLALLAKWKWQLFQHQGQLWARVLESKYGGWRGLNEAPRTSRESILWRDLMMVTHHSEHGWEWQFTWGRPLFDNEIAMTVSFLKDVESKQIQSQRPDEWVWMADSSGHFSAKSAYNVMRGDSSEGAEDIVFEELWKIK

SEQ ID NO: 176785 - protein, 107 aa, Glycine max
  Coding DNA Sequence Number=SeqID_60007
MAPDCSGRCARKGRRQRWKHAGKGTVRHLHASENSDANDSWTAAAVAEKFPGKEGKSVGNDIARIKVHRKPEKSQQLMVAGNVVGKGEMDRRKRRNGSSKSETRLLE

SEQ ID NO: 176786 - protein, 328 aa, Glycine max
  Coding DNA Sequence Number=SeqID_60008
  Gene Ontology: Mol. function=transporter activity; Cellular component= integral to membrane; Biological process=transport
  Homolog annotation: Hit_ID=Q2P227; Match level="QueryCoverage=96%, HitCoverage=30%, E-value=1e-120, Identity=68%"; Hit description =Multidrug efflux transporter
  Pfam annotation: Domain name=ACR_tran; Domain location=1-299; Score= -582.7; E_value=0.012; Accession=PF00873.9; Description=AcrBAcrDAcrF family
MGMSVSDVYSTIQLMLAPVYVNDFFYEGRIKRVTMQADGPYRTGQESLKSFYSPSSLTTNADGTNAMIPLNTVVKSEWVSAPPSLSRYNGYSAINIVGSQAPGTSSGEAMQTMEAIVNDDLPAGFGYDWSGMSYQEILAGNAATLLLVLSIVVVFLCLAALYESWSIPVAVLLVVPLGVLGALGLSMLRGLPNDLFFKIGLITVIGLAAKNAILIVEFAVEQRAAGKTLRDATIEAARLRFRPILMTSFAFIMGVIPMAISTGAGANSRHAIGTGVIGGMLFATLLGLLMIPVFFVVVRRMLGDKLDEPSKEFMERQRDADAAHRPDR

SEQ ID NO: 176787 - protein, 94 aa, Glycine max
  Coding DNA Sequence Number=SeqID_60009
  Homolog annotation: Hit_ID=Q10E61; Match level="QueryCoverage=90%, HitCoverage=15%, E-value=1e-12, Identity=44%"; Hit description =Expressed protein
MTDISPVQGELVKLFANDQNKITCDSEMKHEIGTNLSKGEATFSVLLLRDSSENWEQATLFLRRSGYQIKINGTEATVVDEKFSKELSVCYSNF

SEQ ID NO: 176788 - protein, 492 aa, Glycine max
  Coding DNA Sequence Number=SeqID_60010
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=34%, E-value=3e-94, Identity=37%"; Hit description=Chromo
MAENTRLNDLQAEIKGQVDALKRMMDLLELRDCEQRAHMQSVQAEAQNHMDKIQKSLDLLLNSPVQSHSHGGSASNSSFCGAIPLSIALMVKDISLGFPHFDGHSSVLEWIFKAEKFFNYHRTPDADRVEIATMHFEKEVVPWFQVLQRMSAIHSWTELTKALESQFGPSPFDCPMADLFKLQQTVTVSDYYLKFMSLANRSSGLQDDALLNCFWSGLHTEIRRDVVAQAPTSLLRVVALAKLYEERYFPVSKTSSIPVRCYSPISSSSLSVNQNQNKSNAKNALPLLLPTPNVQPLKNVNVKKMSPAEMQIRREKGLQYMFLQLDETLIDTSVDPPPEPDPPVLLDEPVIDDHHLSLNALKGGKGIGTIRFLAYVDKLPVTVLIDGDSSDNFLHPRIAKFLKLPVEPAPMFKVMVGSGNYMATEGLVQNVVVQAQGNTLQLPDYLLPISGVDLILGAHWLKTIGPHVADYESLNLKFLHDGKFVTFQGDVD

SEQ ID NO: 176789 - protein, 55 aa, Glycine max
  Coding DNA Sequence Number=SeqID_60011
MPFMMPDLHLASMDESSEFGNYGFHLKDVMRSYKKCFSNKTFWTQALDDKRKGRA

SEQ ID NO: 176790 - protein, 439 aa, Glycine max
  Coding DNA Sequence Number=SeqID_60012
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=29%, E-value=2e-92, Identity=39%"; Hit description=Chromo
  Pfam annotation: Domain name=zf-H2C2; Domain location=71-112; Score =21.2; E_value=0.00055; Accession=PF09337.1; Description=His(2) -Cys(2) zinc finger
MVWSELCNKWLRKVAICIQTDDKLKALYEQCVANKGHFQEYAIKDGLLFWKRRVCLPFKEDLIKEVLNEFHSSKVGGHVGVSKTMARIASQFFWPGMRQSIRRFVRVCQICQQAKVEQALPVGLLQPLPIPQHVWDDVSMDFITNFPPSHVLFGNTCSKLKNNTCHELFISPVVRWTNGVLPWAQYWYNSSLGVARCTQHYCWCTHHLRNLTDQLDPYDLRITLTHTHHKCEKSAEAVLQHSSSFHQSIGMSPFKALYGKDPPAVMCYEISPTDLVSVQEQLRERDAILQQLKLNLLKAQQYMKTQADKRRRDIQFEVGELVLVKLQPYRKHSIALRKTQKLSMRYFGPFEVLEKIGNVAYKLKLPDTARIHPVFHISLLKKFVGSPSQQFIPLPLTTTECGPSVQPLKILDHHTIMRNASLVQQVLVQWNSQDVSAAT

SEQ ID NO: 176791 - protein, 568 aa, Glycine max
  Coding DNA Sequence Number=SeqID_60013
  Gene Ontology: Mol. function=motor activity; Cellular component =myosin complex; Biological process=signal transduction
  Homolog annotation: Hit_ID=UPI0000162C52; Match level="QueryCoverage =88%, HitCoverage=32%, E-value=1e-100, Identity=40%"; Hit description= XIA; motor/ protein binding
  Pfam annotation: Domain name=Pox_A_type_inc; Domain location=123-145; Score=2.2; E_value=39; Accession=PF04508.3; Description=Viral A-type inclusion protein repeat
  Pfam annotation: Domain name=Pox_A_type_inc; Domain location=291-313; Score=8.9; E_value=4; Accession=PF04508.3; Description=Viral A-type inclusion protein repeat
  Pfam annotation: Domain name=Pox_A_type_inc; Domain location=333-355; Score=5.9; E_value=11; Accession=PF04508.3; Description=Viral A-type inclusion protein repeat
  Pfam annotation: Domain name=Pox_A_type_inc; Domain location=6-28; Score=1.6; E_value=48; Accession=PF04508.3; Description=Viral A-type inclusion protein repeat
  Pfam module annotation: Pfam domain module=Pox_A_type_inc::Pox_A_type_ inc::Pox_A_type_inc::Pox_A_type_inc; Domain location=123-145::291 -313::333-355::6-28
AAKESKALEAAKNNLEMQVKELTSCLETEKRMREAKTQENKKLQHALQEMQLQLQEIEEAKKQENEKLKHALQEKELQFQEIEEANKQENEKLQHALQEKELQFQEIEEANKQENEKLQHALQEMERQFQEIEEAKKQENEKLKHALQEKELQFQEIEEAKKQENEKLQLALQEMELQFQETKAALIQEREAAKKVDEQTPTTQENSVNVVDSELINKLTTENEQLKELVNSLEKKSIQEFPVNVTDNELINKLSSENEHLKELINSLEKKTIQEFPVNVTDNEVSSKLITENEHLKDQVNSLERKIDEAERKYEESNRVSDERMNQIIETESKMIEIKTNVQRLEEKLSDMETENQVLRQQALLSSSSRRMSGKLAPATTPPLENGHQASQGSVPAKTFGAEDKESVDALFKCVTKDLGFSEGKPVAAFTLYNCLLHWKSFEAEKTSIFDHLIQLIGSELEDPDNNACMAYWLSNTSSLFFHLQQCLRVPTTRKPPTPTSFFGRMTQGFRSSNSLSSNAFDVEHQVDAKYPALLFKQQLAAYVEKIYGIIRESFKKDLSPLLSSCSK

SEQ ID NO: 176792 - protein, 947 aa, Glycine max
  Coding DNA Sequence Number=SeqID_60014
  Gene Ontology: Mol. function=motor activity; Cellular component =myosin complex; Biological process=protein amino acid phosphorylation
  Homolog annotation: Hit_ID=Q9ATB7; Match level="QueryCoverage=81%, HitCoverage=48%, E-value=0.0, Identity=73%"; Hit description=Myosin subfamily XI heavy chain
  Pfam annotation: Domain name=IQ; Domain location=635-655; Score=19.3; E_value=0.014; Accession=PF00612.17; Description=IQ calmodulin -binding motif
  Pfam annotation: Domain name=IQ; Domain location=658-678; Score=17.1; E_value=0.063; Accession=PF00612.17; Description=IQ calmodulin -binding motif
  Pfam annotation: Domain name=IQ; Domain location=683-703; Score=21.6; E_value=0.0029; Accession=PF00612.17; Description=IQ calmodulin -binding motif
  Pfam annotation: Domain name=IQ; Domain location=706-726; Score=14.6; E_value=0.36; Accession=PF00612.17; Description=IQ calmodulin-binding motif
  Pfam annotation: Domain name=IQ; Domain location=731-751; Score=18.8; E_value=0.019; Accession=PF00612.17; Description=IQ calmodulin -binding motif
  Pfam annotation: Domain name=IQ; Domain location=754-774; Score=19.9; E_value=0.0094; Accession=PF00612.17; Description=IQ calmodulin -binding motif
  Pfam annotation: Domain name=Myosin_head; Domain location=2-619; Score=802.4; E_value=2.6e-238; Accession=PF00063.11; Description =Myosin head (motor domain)
  Pfam module annotation: Pfam domain module=IQ::IQ::IQ::IQ::IQ::IQ::Myo sin_head; Domain location=635-655::658-678::683-703::706-726::731 -751::754-774::2-619
MSICSKMINEETSQSILVSGESGAGKTESTKMLMHYLAFLGGRAATEGRSVEQQVLESNPVLEAFGNAKTVRNNNSSRFGKFVEIQFDQKGRISGAAIRTYLLERSRVCQVSDPERNYHCFYMLCAAPQETFTAKGLMHFHLRWNPAAVIGGIGASLNKSKDRDVDKYKLGSPRTFHYLNQSNCIELDGLDDSKEYLATKRAMEVVGINSDEQDAIFRIVAAVLHLGNIEFVKGEEDETDSSKPKDEKSHFHLKIAAELLMCDEQSLEDSFCKRVMVTRGDTITKSLDPNAATLSRDALAKIVYSRLFDWIVDKTNNSIGQDPDSNNLIGVLDIYGFESFKTNSFEQFCINLTNEKLQQHFNQHVFKMEQEEYTKEEIDWSYIEFVDNQDVLDLIEKKPGGIIALLDEACMFPRSTHETFAEKLYQTFKDNKRFSKPKLSRTDFTINHYAGDVTYQTDFFLDKNKDYVVPEHAALLSASKCSFVSGLFPPLPEETTKSTKFSSIAAQFKLQLQSLLETLNATEPHYIRCVKPNNLLKPGIFENNNVLQQLRCGGVMEAIRISCAGYPTRKNFDEFVQRFTILEPKILKACPDEMTACKRLLDRANLKDYQIGKTKVFLRAGQMAELDACRAEVLGRSANIIQRKIRTFICRKHYILLQLSAIELQRVARGHLAQHQYECMRREAASLKIQKDFRMHMSRNAYKTIYASAVYIQTGMRGMAARNDLRFRKRTQASIVIQDHYRGYSARIYFQRLKKSAIAAQCSWRRTLARRELRKLKMLTLVLVREVRIERSRSVNLNSGSSSLDNSVHPNSAQSMNPNSQAQVNLTTQTTCEDNSANDYIGNRFSVVMVVGIFARTTIVVMVQAMVVVEVGLLMLEENYDPTLPPPASLAPTQSTSAPSAQTSQQVQHAQPIQYVLPSPQQSLTAFAQPQYVYLQPHQTDQQCSKQ

SEQ ID NO: 176793 - protein, 102 aa, Glycine max
  Coding DNA Sequence Number=SeqID_60015
  Gene Ontology: Mol. function=motor activity; Cellular component =myosin complex; Biological process=auditory receptor cell differentiation
  Homolog annotation: Hit_ID=UPI0000162C52; Match level="QueryCoverage =97%, HitCoverage=5%, E-value=4e-37, Identity=73%"; Hit description =XIA; motor/ protein binding
VVSKSANMYPKDPEFPPNGVEDMTRLAYLHEPGVLQNLHLRYAMNEIYTYTGNILIAVNPFQRLPHLSATSTMAKYKGAAFGEQSPHPFAIASSAYRYLVVA

SEQ ID NO: 176794 - protein, 253 aa, Glycine max
  Coding DNA Sequence Number=SeqID_60016
  Homolog annotation: Hit_ID=Q9FMY4; Match level="QueryCoverage=42%, HitCoverage=40%, E-value=7e-10, Identity=35%"; Hit description =Arabidopsis thaliana genomic DNA, chromosome 5, P1 clone:MKD15
  Subcellular localization annotation: CTP_CleavageSite=39; ConfidenceScore=5.13e-01
MAKPKGSSKPKTSIFLCCFGSSHAMESSPTKGSYDPIISEMKKKKKKKSTSTSWFSWRRIRLLKKSSAYKTVPLEASTSVHNHVPYSKSKSTFHHKPQAPTTNPSLPQLAPVLPGTPYYTPTQTRHGASKVEDTRQQSRASPASAKRQARRLSSSMQAQTTPKKAQNAYDPVVGMSVLVVTLVIMLFWGRLCAILCTSAWLYCTPRFRKSGGYVNDDEDLQTTKSKEVDLDSEEYKKKVIMEGLLGRNHRTMN

SEQ ID NO: 176795 - protein, 72 aa, Glycine max
  Coding DNA Sequence Number=SeqID_60017
  Homolog annotation: Hit_ID=UPI0000162C52; Match level="QueryCoverage =65%, HitCoverage=2%, E-value=3e-08, Identity=58%"; Hit description =XIA; motor/ protein binding
  Pfam annotation: Domain name=Myosin_N; Domain location=31-72; Score =33.8; E_value=6e-07; Accession=PF02736.9; Description=Myosin N -terminal SH3-like domain
MSHRLVCMPTTDSYNANITSNEAGQLSFVVGSHVWVEDPDLAWIDGEIQESNNEEITVMYESGSKVGPLNLL

SEQ ID NO: 176796 - protein, 81 aa, Glycine max
  Coding DNA Sequence Number=SeqID_60018
MIRSRVNLLQEEMIKRIKDGLLIKGKEGENHKELNWILGRSTMLILEFASGTIRTKCPWLGLNQVVLELEFGEQFKIISIN

SEQ ID NO: 176797 - protein, 123 aa, Glycine max
  Coding DNA Sequence Number=SeqID_60019
MAWDPVLRETRIWATWKYVSSDGGGQQGMSGTWRYVAGVRRPWGRQASSWQSTDKRNKDHKARRLVVAGQLLENEVKEAMRASGGWNIVEASGNRLPGCVIDYTEGWVTGNRLPDRDGGVANP

SEQ ID NO: 176798 - protein, 301 aa, Glycine max
  Coding DNA Sequence Number=SeqID_60020
  Gene Ontology: Mol. function=chromatin binding; Cellular component =chromatin; Biological process=regulation of transcription, DNA -dependent
  Homolog annotation: Hit_ID=Q946J8; Match level="QueryCoverage=92%, HitCoverage=62%, E-value=9e-19, Identity=29%"; Hit description =Protein LIKE HETEROCHROMATIN PROTEIN1
  Pfam annotation: Domain name=Chromo; Domain location=1-41; Score =10.0; E_value=0.064; Accession=PF00385.14; Description='chromo' (CHRromatin Organisation MOdifier
MWISNVANNRVRNGWPETANTWEPPENLESVPDVVEAFEESLKSGKHRKRKRKHVVHHTQPKKRLERSTTPYSLRRFSTGTAENHTQSAPPLIDPSLPNIPAFPRTVLFSDDVGNGAEGSSLRKATPSNANRSANGSEPNIKRTEENDYDPVLSELKTMTANGNDTDRLAIRIPEAKGSGPSGSNDQMDAKSKGVSMETNASGRCRGSKRRKCGSVKRFKKELYANEPANTENPVGLPVSTAEPEQTRDAGSGGNTNHARPASNIVNIIKPVGYSASVASGTQDVLVTFVASNDKVDQASG

SEQ ID NO: 176799 - protein, 379 aa, Glycine max
  Coding DNA Sequence Number=SeqID_60021
  Gene Ontology: Mol. function=RNA-directed DNA polymerase activity; Cellular component=mitochondrion; Biological process=RNA-dependent DNA replication
MVACSVELSKFGLRFKARGPIKGQCLANFLAELPPAKDNSEAWWTLHVDEASTSKGNDTSITLEGLDNISIEESISTKMSSQHRTFIQETLTSPTTDVTKSCSNQIDPSGWMSPIWAYLITDALPQEPVEARKGGQYDLALRAVCTKYVKKCKECQEFNHIHHALPKELHNITSPWPFTMWGMNILEPFPIAKSQIEFLLAMVDYFTKYGLPQAIMTRFGRQFTKMGRKQGHPRQATQKNVNNSQGAVGRRAPEHAMRIPLYSQVYHTRNHIQVNYNTNVMIPMEIGEPSLRISMFNVANNSESLAVELDLTEEVRSEPRIQEDACKQRITWKCISKRKKCSFKPNALVWRLQGDAMKDNSKGKLSPNREGSFYITESL

SEQ ID NO: 176800 - protein, 315 aa, Glycine max
  Coding DNA Sequence Number=SeqID_60022
  Homolog annotation: Hit_ID=Q8S8Z9; Match level="QueryCoverage=25%, HitCoverage=35%, E-value=5e-18, Identity=59%"; Hit description =Syringolide-induced protein 1-3-1B
  Pfam annotation: Domain name=Myb_DNA-binding; Domain location=228 -275; Score=53.6; E_value=6.7e-13; Accession=PF00249.21; Description =Myb-like DNA-binding domain
MFRGNNDDEFEFDGGFDFDKEEALYKELETLIHSENTAPSMMFPLEDATHVHSGDSDSDGGSDNNKLQVFELENSLVQLPPKLSSLSVPPPTESMLPHTQFHGGFDEWDDTLVYLPPIEETLDQLENTAPRLLSPSAEETLDHLLSLSTPMLLQELLESKNTAPAPSLLPLSTPMLLQDTLVHLPPLSLPDNTSPRVFTPAGHITLLPQTQTANRPSTSSASSSHNRCNRWTNEEHMLFLQGLAIYGKGDWKNIARYAVKTRTSTQVASHAQKYFLHLRASNKKGKRKSIYDTTLQDQVPPPHQHWVLPPNLATY

SEQ ID NO: 176801 - protein, 311 aa, Glycine max
  Coding DNA Sequence Number=SeqID_60023
  Gene Ontology: Mol. function=RNA-directed DNA polymerase activity; Biological process=RNA-dependent DNA replication
  Homolog annotation: Hit_ID=Q2HTR6; Match level="QueryCoverage=43%, HitCoverage=33%, E-value=6e-24, Identity=43%"; Hit description=RNA -directed DNA polymerase
MDYMDQRLPEISFYFYFGQQWKPTAEFIPQRGLRQGDPLAPFLFNVTLAYYNMQTTIFGTATMENVKAIKMMLRCFELMSGLKINFAKSSFGAFGTTEHWINNAASYLNCRRLSIPFSYLGIPIGANPRHSETWDAIGAEEGGGRAGKAIEVVLGFEEVQQCFTWEMALEPVSPLRDLSFICNLTEEGSWFNSKKKWKIGCDSKVLFWEEAWKEDGVSLKEKYPRLYQISQQQEVQQMEITTTTGEIVAAANFMEDIQGLVVQMQQQDTWTWGGDSIGKYSVGNAYTLLNKVLLSLTRDEVFKAIWKLKIP

SEQ ID NO: 176802 - protein, 89 aa, Glycine max
  Coding DNA Sequence Number=SeqID_60024
MQLNDSFYQYTLHHHLQDPNPYGLLPSSSEPLSHGLGIGPIFRRRQVLQMLKELPKGTKAELRMMETWQICLISSLEEVEFPDHDLLNL

SEQ ID NO: 176803 - protein, 69 aa, Glycine max
  Coding DNA Sequence Number=SeqID_60025
MVAYVPSGEFFVKVHSLEDRAVNYYGVKKTSDPEIDYKDKILKYDWPDPLKVFSTTHYDLITCLSERVT

SEQ ID NO: 176804 - protein, 357 aa, Glycine max
  Coding DNA Sequence Number=SeqID_60026
  Homolog annotation: Hit_ID=Q3IA99; Match level="QueryCoverage=24%, HitCoverage=11%, E-value=1e-29, Identity=72%"; Hit description =Disease resistance protein
  Pfam annotation: Domain name=TIR; Domain location=55-196; Score=71.2; E_value=3.2e-18; Accession=PF01582.10; Description=TIR domain
GSSRICDDEVVAFNGSATKFCSVGNGRGIGGRGASGLENLQCNRKKGGRNRGRVGVINNREKHKGSFETIHVQDSTGHEFATRMGNVFTIGKGTKPWISLPKVEHESNIDSIEESMIYDLVFSENYASSTWCLDELTKILDCKKRYGRVVIPVFYKVDPSIVRNQKETYAEVFFKHEHRFEDKIDKVHAWKSALTEACVSNSINPPSYVLVPVGVKTTSTKSPSTSINPSLKRPQQQNELHLQNFVVPGKPRSKRKRLSAPRTNKDPLSICELIMPKPKDNEEQQEEVVIMTKEDEEKVIINVSKEISFRDSELDECSNGQQQPMPRRYKSGRLLPEYRPAKSPTFVSYLHSNSHKK

SEQ ID NO: 176805 - protein, 123 aa, Glycine max
  Coding DNA Sequence Number=SeqID_60027
SNVLWGSLQEVEFASWCNHWTQRSNFLWGSLQEVGLPLGVITKHKGGRSFGVHCKKWNLLLDGSEGSNVAPHAEIEFDGYHFRSEEHQRLIEVIKDWSFLKERWVQLAEEECAEFQAKVARRR

SEQ ID NO: 176806 - protein, 82 aa, Glycine max
  Coding DNA Sequence Number=SeqID_60028
  Subcellular localization annotation: CTP_CleavageSite=19; ConfidenceScore=5.57e-01
MTTPLVSPPPPPPSDASMSPSTVKRTRKTTQLRSLATRLPGAERPVVNVDPAIGKVDGPHKKKLRTYLGIVARDKVDVTYET

SEQ ID NO: 176807 - protein, 117 aa, Glycine max
  Coding DNA Sequence Number=SeqID_60029
MVRGNYQWCQKTGIETPYNAKENLISELKLLLYNPFGIPNSIGACRPRIFFINEFLCFLEDEWQRNEERKRERRRHFKEKMSLEEAHHHRRPWIRAWRKKEMNEGRGREEHEILCSK

SEQ ID NO: 176808 - protein, 194 aa, Glycine max
  Coding DNA Sequence Number=SeqID_60030
  Homolog annotation: Hit_ID=Q1SWW3; Match level="QueryCoverage=29%, HitCoverage=5%, E-value=6e-17, Identity=65%"; Hit description =Disease resistance protein
MANGFIHLKKHYMLKMLVMMCGMSYIGDHFFKILSQMNLEKLQVSRCMIMHNLFQKRFVALQIGCLDGSAVSDKVNLELDSEGRGTVADVVMEATADGDMGDLLGADVGCTEGGELARIKIGVDVPILAVPRVHMPTPHSGRALCTRPCPLRRVASDNVSEIQEWKHCESRGGNRPGRPIEAYDLAYIKPDLLN

SEQ ID NO: 176809 - protein, 415 aa, Glycine max
  Coding DNA Sequence Number=SeqID_60031
  Gene Ontology: Mol. function=protein dimerization activity; Cellular component=nucleus; Biological process=regulation of transcription, DNA-dependent
  Homolog annotation: Hit_ID=Q1SR56; Match level="QueryCoverage=41%, HitCoverage=80%, E-value=8e-60, Identity=68%"; Hit description=HAT dimerisation
  Pfam annotation: Domain name=hATC; Domain location=311-394; Score =100.9; E_value=3.8e-27; Accession=PF05699.5; Description=hAT family dimerisation domain
MWKSNHQVVEYIVITGHFIDAGWNLQKRVLSFMKVPAPRCGIDVADAILQDGLSTIKDIIFNIRESVKYINHNDARLKAFCDVVEQKRLKERKLVIDCPTRWNSTFNMLSNALKFKIAFASYKEREPYYNYAPSLEEWNQVVKVCKLLEVFNLATHVISDSEYLTANLYLAEVWKVKQILDKEIEDEDLFMRKMVGPMKKKFDKYWGECNMLMAIISVLDPRGKFHMVSICFPLTYSKEVIDENIKKVKSSFEELYDEYVGLCLEESTSSVVNLDDNISSSSQFNTSVVTGFDEIMSMLHEKEVVSPIKSELKDYLDEGIYVPNTNSFSALDWWRNNNMKYRILSKMAVDILAIPISTVASESTFIAGGRVIDEFRSKLNEESVEALIYGGDWFRHKYNVKKKSKANITYYNFYK

SEQ ID NO: 176810 - protein, 87 aa, Glycine max
  Coding DNA Sequence Number=SeqID_60032
MAEVVLEGVLGHLSSPVGKELGLFLGFDQDLERLTRRMKRISEKLDELSEERKKLNWMRWFRREKVVSQRRKKWSYQVASNHLIIHH

SEQ ID NO: 176811 - protein, 241 aa, Glycine max
  Coding DNA Sequence Number=SeqID_60033
MALLIFGVVLFPNVDGLVDLAAIDAFLAFHHSKESPVVTVLADIYDTFDQSPLCVVGFAPIPPRCETHLPTTKPPFMRRKEGSKLGPILGKHKRGVGQLGVRKVWEVVRRKDRELRGSSNGTVDGYHRWLRAYTRGLDWLPKLRAAKEEEAEAPEESEEVQALKAELEKAQAVKERFKTRAVRIQRENDERMDINAATAKALEQETKRARKGKHARKELCGAATTSLNSGEKKETSHEWKA

SEQ ID NO: 176812 - protein, 140 aa, Glycine max
  Coding DNA Sequence Number=SeqID_60034
  Gene Ontology: Mol. function=protein binding; Biological process =defense response
  Homolog annotation: Hit_ID=Q1SWW3; Match level="QueryCoverage=90%, HitCoverage=15%, E-value=2e-21, Identity=38%"; Hit description =Disease resistance protein
MVEAVLEDLERFANLLTTFKVVLGDDEEKQFSNRAIEIWLQNLKDAVLELEDIMNEYAYEEVKYCLRLPEMVPERSGVIDWCQTNSLITKQKVYGSEKDTLKIVQFLFGKASRSENLSVYPIICLGELGKTTLGSTHLQS

SEQ ID NO: 176813 - protein, 67 aa, Glycine max
  Coding DNA Sequence Number=SeqID_60035
  Subcellular localization annotation: CTP_CleavageSite=45; ConfidenceScore=5.10e-01
MKSGDRRGYRMVIRIFRQPRFLLSSSGDIQARRRTRFFSTGRGRSSAMAWGSSAGWDIDWPNDVPLE

SEQ ID NO: 176814 - protein, 38 aa, Glycine max
  Coding DNA Sequence Number=SeqID_60036
MAPTRHPLDPEMSNMALGFPTLIRGLYQSYGVSITPSK

SEQ ID NO: 176815 - protein, 138 aa, Glycine max
  Coding DNA Sequence Number=SeqID_60037
MAPKKLSTKRSRKDATGEGSSATLDFNRHRFRSAKHQQRFKAIRGWSFHRERRVQLREDEYTDFQEEIARRHWTPLVTPMAKVEGSVDSLRRRCPQLVPGRPADFGGRPAVKAGMDHAHQHDYLHPDMDDTAAQQCLA

SEQ ID NO: 176816 - protein, 158 aa, Glycine max
  Coding DNA Sequence Number=SeqID_60038
  Gene Ontology: Mol. function=RNA-directed DNA polymerase activity; Cellular component=chromatin; Biological process=RNA-dependent DNA replication
MDLAQGFHQIRMVERDVPRTAFRTHQGHYEYVVMPFGLCNAPSTFQATMNELFQPFIRKFVLVFFDDIIIYSHDFQARLKHMEYVLQTLQQGVFHLKSFKCVVGQRRIEYLGHFVSFKETSEQHVYLAKLLGYNYMIQYKAGHNNVVADMFSRLTETE

SEQ ID NO: 176817 - protein, 99 aa, Glycine max
  Coding DNA Sequence Number=SeqID_60039
MGSRLEIRLQGKSWSLHTISMKSCATMWAVKWEGSDPKMGPLGEVIYNSHDDSGSLKVGRLSWRVNSEHCQGSSRAQAIRDLNSSDSTNSLFRPSKNLG

SEQ ID NO: 176818 - protein, 337 aa, Glycine max
  Coding DNA Sequence Number=SeqID_60040
MVEEALVFGKDECTCREDDVLKGEEWGCQKQLVHDPGVGCGTGPLLTGWSSGVSFGRGESQLDRQATPNIIFVPHNAITYKSRVNAIVDEVVRTTTVHKNNHGVPLIEPSTRRVAEAGGIKEWFIVILGSNKEKKLGTKMVVVLGEAGKRGRRGEEGKGEGEAGVSVWGREREERETGNKATKEEGGRLGGHRREKGQSGALMPKGKMPMMVASRYGTSTETSLVRHHQGKMIRPGDVRPWGFDAVDVSLSEAYALSKQHSLSEALSLLSELGESGRGSVKHARAQRAISSPNELFVSSSAKRAWLAKRAWLAKSKITNSHLAQKMVLSEPSRTESP

SEQ ID NO: 176819 - protein, 104 aa, Glycine max
  Coding DNA Sequence Number=SeqID_60041
MKNKKVVVAGALLSEAYVLSEQHLLSKTSARLASEENLEENLPCKHALNMPLACPTTYLSLLAPSAPDSLSQKSLTCEKLENLCNRDIREKRNRAREHQKPQLS

SEQ ID NO: 176820 - protein, 106 aa, Glycine max
  Coding DNA Sequence Number=SeqID_60042
MPLMRSRREGQRRRGDTWLVSVFVIIQIGVFIATMLVNDCWNNSHDDCVLQALRRNKKISAGALGRATAVWVLFELLEYHLLTLGEKSKFKGSIFRNQGGVFTIIT

SEQ ID NO: 176821 - protein, 283 aa, Glycine max
  Coding DNA Sequence Number=SeqID_60043
  Gene Ontology: Mol. function=transcription factor activity; Cellular component=nucleus; Biological process=regulation of transcription, DNA-dependent
  Homolog annotation: Hit_ID=Q8L701; Match level="QueryCoverage=95%, HitCoverage=89%, E-value=3e-28, Identity=29%"; Hit description =Putative Ap2 domain protein
  Pfam annotation: Domain name=AP2; Domain location=109-173; Score =137.2; E_value=4.4e-38; Accession=PF00847.10; Description=AP2 domain
MEYQRKTIITKLVKSSKFLPKVIRISVTDQDATDSSSDEEGEHARVKKVINEIKIVCVNNKKNHKNHDNDSSCCYANATKENESLRPQQQNINPLNKVGYMNQNQNLKQHKFRGVRQRPWGRWAAEIRDPTRRTRVWLGTFDTAEEAAMVYDKAAIKFRGAEAVTNFIKPRLKDHESVSLECDSVVNGTSSACASPTSVLVFQPWIEPPLLEETFKEEEVFNGLTTDVYCDDGFLFSNEALCDQPLPTTFCNVDCIDIPLDEDLESCKWDVDNYFSDDASWKQ

SEQ ID NO: 176822 - protein, 82 aa, Glycine max
  Coding DNA Sequence Number=SeqID_60044
  Subcellular localization annotation: CTP_CleavageSite=40; ConfidenceScore=5.22e-01
MNKQSQKKGQNGLFTKVYDPKFSSASNQLVWAKDLTSALSKQLAWASYSSLGRVEVFKSKQQQIRKLQLAWANLSALLGYFL

SEQ ID NO: 176823 - protein, 125 aa, Glycine max
  Coding DNA Sequence Number=SeqID_60045
MEDTLTQFMHVSISNQKSIDASIKNLVVQVGQLAKEVDPSQQPHRWGTVVGLKDNDEKKNKGVEKENEKNDEVGISEKVKNDDLGQIHHWIVVKLKQHVRNPFPRIFTVENFDITYELREIPLAL

SEQ ID NO: 176824 - protein, 352 aa, Glycine max
  Coding DNA Sequence Number=SeqID_60046
  Homolog annotation: Hit_ID=Q1SS72; Match level="QueryCoverage=48%, HitCoverage=12%, E-value=2e-44, Identity=48%"; Hit description =Integrase, catalytic region
  Subcellular localization annotation: CTP_CleavageSite=53; ConfidenceScore=5.34e-01
MATSGSSSEDDLTPPPPPPSLSHITMAQYQQLMNLLSKFSGPGGASSETTLTRANLTHSNPNQIHNSGFGSHFDMSTLKTISLVDLKEDLFHLIVGKDKSPSTNNITTTNTNTSKLWHFRLGHLSDPISYTLPTPPQFTPSTPITTNTEPTIPQPNGSPSPFPNPSTPPTIDTPNPNIIDQHIQEPPSNHALPRRSNRDTHPPSYLSDYQFQIPSLNSAQSSSTCTYPIQSFLSYTHVSPSHRHFLMTLSSEHEPTSFHEAVKHQCWRDAMKCEIKALQLNQTWDIVQTPSHVRPIGCKWVYKIKRLPNGCVERHKARLVAKGYSQIEGINYFETFSPVVKMATIRVFLALT

SEQ ID NO: 176825 - protein, 164 aa, Glycine max
  Coding DNA Sequence Number=SeqID_60047
  Gene Ontology: Mol. function=RNA-directed DNA polymerase activity; Biological process=RNA-dependent DNA replication
MRIEKFWDNLGINQDISKKLSATQGAFGFLRPDRISHAISLTLWHMLLPFLPRNPILSGSVKLYMPPIPIARSVFWEYLIQSESTVQGRWLMLGDFNDIILSLEVSEDMETIGGCFTWRKNIHQDGHVRKKLDRCLANPTWQGCPSLGGDPLVPKIIGKLGKIW

SEQ ID NO: 176826 - protein, 107 aa, Glycine max
  Coding DNA Sequence Number=SeqID_60048
  Gene Ontology: Mol. function=DNA binding; Biological process=DNA integration
  Homolog annotation: Hit_ID=Q1T192; Match level="QueryCoverage=85%, HitCoverage=14%, E-value=1e-13, Identity=47%"; Hit description =Polynucleotidyl transferase, Ribonuclease H fold
MQLSSKKCVFRVGGGLHNKLGSPKGRRQKEDANLLHKLSIPRSEKKCYQMIEKLALELIHSARQLRQYFQSHQVMVKIDHSLKQVLKKLSLIGRMVAWSVELFEFGL

SEQ ID NO: 176827 - protein, 129 aa, Glycine max
  Coding DNA Sequence Number=SeqID_60049
YGKTENSKQYPPLQRHAFVKWWSQFDTSKAAPEQVKNWFQSNPEFLKPADPETSLFLNQKSQLAAFLASSKSKESLAQNLKEVLQLLQQEGEEEPPKKEVESSENNDDQEDDPFYQNEDDCFGISLDDD

SEQ ID NO: 176828 - protein, 134 aa, Glycine max
  Coding DNA Sequence Number=SeqID_60050
MHVLTSVYAFGWRDIFWITLFLVVMLLDKSALFVRLISKVVGIFFYVVPLLNKFGGKRNFGLKLKELRIGLKEWLIVVTWRECRNVRDSRSSREDTNTRQHQERWQPPPNELLKCNIDATLFQEETTLALTCAL

SEQ ID NO: 176829 - protein, 161 aa, Glycine max
  Coding DNA Sequence Number=SeqID_60051
  Subcellular localization annotation: CTP_CleavageSite=91; ConfidenceScore=5.69e-01
MTTSFKTEPPSYSFFYNTNPSLMPHLNFSLPPRISTICLFSSPSPSFPLLPFVTPLLLPPSPPQAPFLLRLRLHRSLSFPFKRMFLHVGLSQQVVIAKHKGYVSGSLSDEGKVELGGDSGKSESSLEKGLVDRSDASHVDAKVDNMARCFRTNQRILVRKG

SEQ ID NO: 176830 - protein, 99 aa, Glycine max
  Coding DNA Sequence Number=SeqID_60052
MSPHVMQDGGSSQYCIIIMILQRILLGERAVYAMMLVFPPEFSPLKTILFGNLSQDTVEPLMEALEEDYKDGNEINESRQFIGGVLDLEKRINRLDTLT

SEQ ID NO: 176831 - protein, 141 aa, Glycine max
  Coding DNA Sequence Number=SeqID_60053
MASTVEKKYGAYNVILFRDSCGTKTTTLPLSCDRIGFIDEAMCAGGIDKRMMEKKKGRFQDRCELKPPQREVLPTEANSRWPFAIMRFRWGSRFVRLGHGAGLTIAGDAETRVEEGRTQPPWCSGNDNLFASFSGLGYDEP

SEQ ID NO: 176832 - protein, 105 aa, Glycine max
  Coding DNA Sequence Number=SeqID_60054
MPTCRAKLSASRGFSSTDRVVLSSSYSEPIVFGWRKCLCDDREMLVTLHGSKNTRGMESYCNHFRWADEIDGGIDEVVAKAVDEHKKRIVRMQKKDGMCHELQQC

SEQ ID NO: 176833 - protein, 75 aa, Glycine max
  Coding DNA Sequence Number=SeqID_60055
MGSEYDDDNTTRSVEENPLDADNFALQVGIKLKMKKTYCYNMAYRNKPDVHTHRHLRMQVTTRMKTMDRIQVSGC

SEQ ID NO: 176834 - protein, 789 aa, Glycine max
  Coding DNA Sequence Number=SeqID_60056
  Gene Ontology: Mol. function=metal ion binding; Cellular component =intracellular
  Homolog annotation: Hit_ID=Q9SSE5; Match level="QueryCoverage=99%, HitCoverage=99%, E-value=8e-70, Identity=54%"; Hit description=Zinc finger protein CONSTANS-LIKE 9
  Pfam annotation: Domain name=CCT; Domain location=738-776; Score =73.3; E_value=8e-19; Accession=PF06203.4; Description=CCT motif
  Pfam annotation: Domain name=zf-B_box; Domain location=1-47; Score =38.1; E_value=3e-08; Accession=PF00643.14; Description=B-box zinc finger
  Pfam annotation: Domain name=zf-B_box; Domain location=48-90; Score =3.0; E_value=0.058; Accession=PF00643.14; Description=B-box zinc finger
  Pfam module annotation: Pfam domain module=CCT::zf-B_box::zf-B_box; Domain location=738-776::1-47::48-90
MGYICDFCGDQRSMVYCRSDAACLCLSCDRNVHSANALSKRHSRTLLCERCNSQPAFVRCVEEKISLCQNCDWLGHGTSTSSSTHKRQAINCYSGCPSAAELSSIWSFVLEIAAISESTCEQELGLMSINENKCVGVPPEDQNVSGSDEVTDLPALNKSLVGASLMPESSSEPCILDQPAGPTNECLPKLYCPATKCPALSEDDNLYDDFNMDEVDLDLENYEELFGMALSHSEELFENGGIDSLFGTKGMSAGDSNCQEAIAAEEDREVGCENPAYEAWEQQDQALLTWLQSTLSTPILSHSLSHIKALTDALASVGSPIMIQEHVDSILEGLTPDYHLIIESKFERSNRAMNLHSENYTVPNKSSSQSDPESFSGFRGGSARSGYNKGGSSNGRCGGGSSGRGRTGAAVCHYRYDQYYQPNSALSLHDPMSADYSSHTSSQRNDTQHNGNFGQTCSEPRPSNNIQQLEPSEGPEQIFIGNGQGLKIHSSGSSIFTSPYNSSVSLSLNHLLHVPTITKNLISVSKFAKDNLVFFEFHANCCAVKSQVTNEVLLQGTVGPDGSYTFPNIQFHSSSTGVASYCLSTAVNSVNPATSKVNYPLDTCNKIDNSLESWSLSWHQSLYDQVVKSSDNVAPLQNKNASSPRGSSVGQVNAMQPACSNAASADSILSTKTEPILCFTGRQTQSNLSFSGVTGESSAGDYQDCGASSMLLMGEPPWFAPCPENSLQSANRSNAVMRYKEKKKTRMFDKKVRYASRKARADVRRRVKGRFVKAGDVYDYDPLSTTRSC

SEQ ID NO: 176835 - protein, 49 aa, Glycine max
  Coding DNA Sequence Number=SeqID_60057
MGFHKKMRKYEARKLPHGKEDNENKIVFSEFGGEASMDLLPKVRSFISQ

SEQ ID NO: 176836 - protein, 67 aa, Glycine max
  Coding DNA Sequence Number=SeqID_60058
MLMCNHQFSCVGLIELLCTIGRTPYGKNPKKFDIPSGCTMDELKDLIKQVAPHGIPPYGIHETQTVG

SEQ ID NO: 176837 - protein, 115 aa, Glycine max
  Coding DNA Sequence Number=SeqID_60059
HFPSVAECIADLEYDEFGYIQSIPTPHVDSWESFDEINDRWMHYSDHLAPATTSTHARSDEDEPRHAVEACHAIAERLERHLNLGIVTPGIETHEVIEQCLRIVRGVTEDRIVYV

SEQ ID NO: 176838 - protein, 99 aa, Glycine max
  Coding DNA Sequence Number=SeqID_60060
MEAERHKKRDNRLTSMKNESSQKNERRRGTHRRDEEAACGRRIARLRKNQAQLAEERGSAHGRRGIAKEGEEEGEWRKKKRLVHNFYKKIHRGIFDFSH

SEQ ID NO: 176839 - protein, 56 aa, Glycine max
  Coding DNA Sequence Number=SeqID_60061
MDGGKKWNQMKSGRWVQNKCCDKNNHSTLERCKLFIHSTTPAIAYMWRSMYGQHRG

SEQ ID NO: 176840 - protein, 64 aa, Glycine max
  Coding DNA Sequence Number=SeqID_60062
MGAYAKDEELLIHFFHESLTGVAVTCISTVLIWLQIGCNCRSCAKKSMIPSRNIPRGGGIWQLK

SEQ ID NO: 176841 - protein, 74 aa, Glycine max
  Coding DNA Sequence Number=SeqID_60063
  Homolog annotation: Hit_ID=Q9SD67; Match level="QueryCoverage=64%, HitCoverage=5%, E-value=1e-11, Identity=68%"; Hit description=FtsH metalloprotease-like protein
MEKYLPTPYVGGNVLKIMTRPCLKGVEEKTAKLKGSEKALVARHEASHVVVGTAVANLLAGQPHVEAIFIKYDL

SEQ ID NO: 176842 - protein, 82 aa, Glycine max
  Coding DNA Sequence Number=SeqID_60064
  Subcellular localization annotation: CTP_CleavageSite=38; ConfidenceScore=5.32e-01
MVNKSSLLHLDPKSPEAQAFNQIGQKSNGGSISPSPTTSAEGSSQNGRNQGTDETATAKKNSASYIWKRLLESLVAVAGLLI

SEQ ID NO: 176843 - protein, 148 aa, Glycine max
  Coding DNA Sequence Number=SeqID_60065
MASHKRKAIASVSQADYDRSRFISQEARDGYSDNVLARNILPERNVKLELIRRNKHKQLTNLTKGSIDVAIVKEFYANLYVPEDKEPKQVRVRGHLIKFDVDSLNTFLETPVVVEQGESLPSYSKFARLRPYPQELVARLCIPRKGFT

SEQ ID NO: 176844 - protein, 110 aa, Glycine max
  Coding DNA Sequence Number=SeqID_60066
  Subcellular localization annotation: CTP_CleavageSite=28; ConfidenceScore=5.61e-01
MPHVWHLLSMSGFTRTHKSRARRSEAPSSSAAPTPPTSAPSTSALPSPLAALVLPEPALEPAPDHAEFAGYGPAVASYGVWRSFFRRWPGQESNLLLWEGVRPLQPRILS

SEQ ID NO: 176845 - protein, 68 aa, Glycine max
  Coding DNA Sequence Number=SeqID_60067
MRLPGKESLLMGSPITINEILDVSISFLNDHLEETPGSTKIEENHSKCINLAQCGARKKVASARDFGG

SEQ ID NO: 176846 - protein, 85 aa, Glycine max
  Coding DNA Sequence Number=SeqID_60068
  Gene Ontology: Mol. function=unspecific monooxygenase activity
  Homolog annotation: Hit_ID=O04892; Match level="QueryCoverage=98%, HitCoverage=21%, E-value=3e-15, Identity=50%"; Hit description =Cytochrome P450 like_TBP
  Subcellular localization annotation: CTP_CleavageSite=18; ConfidenceScore=5.21e-01
AGHGGPSPEPVGCRWTARAASAARAGRRVPVGGRIGNGPFGASSPGVEQSTQNCALNVKVKKFNQARVNGGSNYDSLKVAKCLVI

SEQ ID NO: 176847 - protein, 141 aa, Glycine max
  Coding DNA Sequence Number=SeqID_60069
MHKALRLNAPLPYPYLVTLFLQHFNIPLDSEPYVPIKRSFLIGASVIASFGYIKEHDGSWVKKGARNVGEEGHEGEDSSLLSKIMDRFDGLQTFVGERFDTLELQVDMRFNEMESRITKVEEDVSYIRSSFDLPPPPPPSS

SEQ ID NO: 176848 - protein, 270 aa, Glycine max
  Coding DNA Sequence Number=SeqID_60070
  Gene Ontology: Mol. function=RNA-directed DNA polymerase activity; Cellular component=nucleus; Biological process=regulation of transcription, DNA-dependent
GTKAGTGPPLEVDGIDKLDIRGYAALAAPLTKLLRHGQFDWSQEADTAFQNLKNALTVVPVLALPDFSTPFMVETDTSGSGMGAVLTLGGHPLAYYNKQFFPKLLNSSTYVRELAAITATVKKWRQEIQCGGRRIITSHGGSSCFSLLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPP

SEQ ID NO: 176849 - protein, 77 aa, Glycine max
  Coding DNA Sequence Number=SeqID_60071
MVLGASSPFELVKVRHLELGNDHCHTIIVTMVLVRPTWALQNIPPEGCCFWRKQPGSPGRAELAWASWAATTSPILL

SEQ ID NO: 176850 - protein, 71 aa, Glycine max
  Coding DNA Sequence Number=SeqID_60072
MIECWNERKRMHEELPADGANDREAKRRKEANQEEANKQEREEDLFSLVRQRNGNCPNENFIYDKIALYIE

SEQ ID NO: 176851 - protein, 144 aa, Glycine max
  Coding DNA Sequence Number=SeqID_60073
MDPIERETVEEAMFQSVIKASLVEADTDIIEIKAGKELMMSKEPIRDTLPKQEKYALGIYGDREPMIKEFPPRQVVAPNPNSLIFKHQPTSTKMYPPGASIWKIREAEMPFSTPLDLQQLLGLMCALNVVLPWDHTKIGEMFQI

SEQ ID NO: 176852 - protein, 61 aa, Glycine max
  Coding DNA Sequence Number=SeqID_60074
MDKDTLGCSGQRGSRNLGKLASAGHLTFGALIWVITPDCHPHKSVRQSRSGRVGGNGCVLL

SEQ ID NO: 176853 - protein, 99 aa, Glycine max
  Coding DNA Sequence Number=SeqID_60075
MYHNNGKVTKSSNLRLFYTHHVDLIIEEVESDVKDKATSTSMVVQVYDPQLACAYASLLDGKHVRTREGLAQALKDHCAGEKEARKWFVIKEYFNKING

SEQ ID NO: 176854 - protein, 313 aa, Glycine max
  Coding DNA Sequence Number=SeqID_60076
  Gene Ontology: Mol. function=transporter activity; Cellular component= integral to membrane; Biological process=transport
  Homolog annotation: Hit_ID=P39398; Match level="QueryCoverage=85%, HitCoverage=62%, E-value=1e-95, Identity=65%"; Hit description=Inner membrane transport protein yjjL
  Pfam annotation: Domain name=DUF95; Domain location=33-185; Score= -35.7; E_value=0.014; Accession=PF01944.7; Description=Integral membrane protein DUF95
  Pfam annotation: Domain name=MFS_1; Domain location=1-278; Score= -53.9; E_value=0.092; Accession=PF07690.6; Description=Major Facilitator Superfamily
  Pfam module annotation: Pfam domain module=DUF95::MFS_1; Domain location=33-185::1-278
MGMFNAASMIGLSVAPPILAAMMLVMGWRGMFVTIGVLGMFLAIGWYLTYRDRDNNKLSGEEIHYLQAGSVASRKEPLSFAEWRGLFKQRTMWGMMIGFSGINYTAWLYIAWLPGYLQSTYHLDLKSTGLLAAIPFLFGAAGMLLNGYVVDALVRRGFDAVKVRKVSIVSGMLLSAAFTTFVTRATDTTSAVTLIGMALFCIHFAGTSCWGLIHANVTARMTASVGSIQNFASFVFASFAPPRADDMCGRHGGRRAGLPAAGQKTDHRWGVTPGFLLNALLWVRRLCAPLLHPPATPIPAAALSPESGSDQIN

SEQ ID NO: 176855 - protein, 50 aa, Glycine max
  Coding DNA Sequence Number=SeqID_60077
MEVEEPFLGLWLPLHYWVDIGQAGFVADLGVAFVDDWVFLADRVVGNEKG

SEQ ID NO: 176856 - protein, 273 aa, Glycine max
  Coding DNA Sequence Number=SeqID_60078
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=100%, E-value=1e-34, Identity=33%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=33; ConfidenceScore=5.02e-01
MPSPSAGYMSSPSDGYMPSPLEGYTSSPSEGCTASPSEGYTSSPLEGYMPSPSEGYTPSPSTDRTGLHVFSFRGLHVLACRGLHIPAFRGQHALAFRGLHALTFRGLHILAFRGLHVFTFSGLHVLACRGIHALTFRGLHGLAFKGIHALAFRGLHALAFRGLDALTFRGLHVLAFRGLDALTFRGLHVLAFRGLNILACRGLHVLAFRGLHALSFRGLHVLAFRGLHVFAFRGFHVLSCRGLHALAFRGLHALTFRGLHVLAFRELHALAFR

SEQ ID NO: 176857 - protein, 89 aa, Glycine max
  Coding DNA Sequence Number=SeqID_60079
MTKDAIHDVILASKTWLFIEKSQEVQANSPGQVVARLGKLLLSAEGIDSLMQSYPTRALDRRLQEDCARDAREGLRVLMSLRVDFGPMS

SEQ ID NO: 176858 - protein, 100 aa, Glycine max
  Coding DNA Sequence Number=SeqID_60080
MVVILPKEHLVVWFSSLHNRPDNYLKEIINSALKGLNDAPQPKSKASARWIVVKMSTIILGTFRNNWEAYFNDPRPLEPERLKALRIQWAQFYLRVRDQA

SEQ ID NO: 176859 - protein, 296 aa, Glycine max
  Coding DNA Sequence Number=SeqID_60081
  Pfam annotation: Domain name=F-box; Domain location=4-51; Score=45.2; E_value=2.3e-10; Accession=PF00646.23; Description=F-box domain
  Pfam annotation: Domain name=Kelch_2; Domain location=231-282; Score =29.8; E_value=9.3e-06; Accession=PF07646.5; Description=Kelch motif
  Pfam module annotation: Pfam domain module=F-box::Kelch_2; Domain location=4-51::231-282
MDPIIWSKLPPEILEYILSFLPLKTFLNLRSTCKGFWSLIFSPPFISKHCSPTASSPFSSFLLLSHPQFHRHFPLYDCTLGTWRNFSLSLSDSFHSFPSFSTLISSGGLFCLSDSTSCSLLVCNLLAKSSRKIQYPSFSLHLEHLTFVTTPTGYTIFVLFSEAASNCAFVYDSKVQTWKRFRGFAPVLGDNHQQQGVLFNGGLYFATPEPFSVVMFDLKSGRWERPVWELPSHHLTFVRLVSDGGGKLYLVGGVGSNGISRSIKLWELGGDGNYWVEVQSLPDLMCRKFVSVLGLC

SEQ ID NO: 176860 - protein, 102 aa, Glycine max
  Coding DNA Sequence Number=SeqID_60082
  Gene Ontology: Mol. function=oxidoreductase activity; Cellular component=vacuole; Biological process=response to oxidative stress
  Homolog annotation: Hit_ID=Q7XYR7; Match level="QueryCoverage=71%, HitCoverage=25%, E-value=2e-23, Identity=63%"; Hit description=Class III peroxidase
MKSKHSFNNLLHTHALISKLCVALLTIQLVDPPAVLPYFSAGASEGTNVSHPDHGGGEIGEKGGRVGAVEFLVGMDETLLLNEVLEVVVVKESGSGKVNGCK

SEQ ID NO: 176861 - protein, 108 aa, Glycine max
  Coding DNA Sequence Number=SeqID_60083
  Homolog annotation: Hit_ID=Q7XJR0; Match level="QueryCoverage=31%, HitCoverage=4%, E-value=3e-07, Identity=67%"; Hit description =Putative vacuolar protein sorting-associated protein
MATGPPTGAGEVHVLPRHRVELRHTVVVVVEELPFYCDGYVCHCWSTKRQWNEIFRNLPFCVRARRGSGSTKVGLLLLCTLHRRGNQTYVVLSKGANQVILFTWKVVI

SEQ ID NO: 176862 - protein, 193 aa, Glycine max
  Coding DNA Sequence Number=SeqID_60084
  Gene Ontology: Mol. function=voltage-gated ion-selective channel activity; Cellular component=mitochondrial outer membrane; Biological process=anion transport
  Homolog annotation: Hit_ID=Q5CZ53; Match level="QueryCoverage=88%, HitCoverage=62%, E-value=4e-53, Identity=56%"; Hit description=Pom30 protein
  Pfam annotation: Domain name=Porin_3; Domain location=5-193; Score= -35.1; E_value=1.1e-05; Accession=PF01459.12; Description=Eukaryotic porin
MSGKGPGFFSEIGKRGRDILTKDYNSDQRFTISSSTNSGLDLKSTLVKSRGLSSGDVAAEFKYKNKAVNVKVDTESNVLTTFTVSDVVPSAKTIASIRLPDYSSGKVEVQYLHEHVAFTLGVGLDRSPVIDFSGTMGTPSIAFGAETSYSTSVGKFMKYNAGLCLKMPSSNASMLDQYIKCIFAKPSIYGWNG

SEQ ID NO: 176863 - protein, 169 aa, Glycine max
  Coding DNA Sequence Number=SeqID_60085
  Gene Ontology: Mol. function=ribonuclease H activity; Biological process=RNA-dependent DNA replication
  Homolog annotation: Hit_ID=Q1T293; Match level="QueryCoverage=60%, HitCoverage=19%, E-value=3e-25, Identity=50%"; Hit description =Ribonuclease H
  Pfam annotation: Domain name=RnaseH; Domain location=49-160; Score= -18.9; E_value=0.0034; Accession=PF00075.14; Description=RNase H
MTPTPDMTRTQIHGHLSNISNSTLTPKSVSCWCRCRVRHQIQQGTGLYYGWVKCNTDGATIGSPGVAGCGGIFRNHHTKTFAAVIAIETACEKGWRNLWLECDSMLVVQAFKNENIVSWTLRNRWKNAIIKTRDMNLVVGHIYREGNTCADRGGVKDYSNLLALTLPLF

SEQ ID NO: 176864 - protein, 76 aa, Glycine max
  Coding DNA Sequence Number=SeqID_60086
MAVVVEVGKVVERMEVVMVSEPRVVAKVQERQDDTKVGELRCNGILRRGEIAHSLIVSILQRTTLLGQPCLEHDHE

SEQ ID NO: 176865 - protein, 360 aa, Glycine max
  Coding DNA Sequence Number=SeqID_60087
MEEDSKHALIVKGLVVAEQQKFSKTNLKAMKVALEQSLREAPEVDVEATNMRKQKRLAKSTANEDLSLDSFGISMNINKIMAETERRRESAVFAPMHPPIVNLVAQRLKDLSENNDDDEGLVQVALQNRKVVASNVPTPKKVKKAQPIAEPRASILPSAIPRWIKAKETMANPKIGDNEWVVSFTRNKKDLAFSSSNNESTNDTSIMLLCKSAPNTQLRPPFSPLHLERFKMEAPSEPLLDAQSFPLAFIHDNPTRVTPFYEAIFSKLVVRDIVFVLAPSWMQYDYLHSSFEAFKALPLDAIFHLPPPTWTHPVQLFVIKMPPHWLAPKTQYKEGTHSLQEMEPPKVQFEKMVHLWSPIT

SEQ ID NO: 176866 - protein, 123 aa, Glycine max
  Coding DNA Sequence Number=SeqID_60088
MAYPTSLHISRATGIKMVANRVCLRLLVWDAIKRKGFELYYKEQMPLRQMKKRDEEVVVAAITEKEVTATIQAKAYAKAMDKTIVCRVIIDLTNTGVMDGTGEVSNVAMVDEVEPPNPGPASK

SEQ ID NO: 176867 - protein, 66 aa, Glycine max
  Coding DNA Sequence Number=SeqID_60089
MHNKKSKVEHDQNYPEERTKVKMEEMNDDTKHQWELAMVDQKITTITKISVFFSRLLPSFPHQIET

SEQ ID NO: 176868 - protein, 83 aa, Glycine max
  Coding DNA Sequence Number=SeqID_60090
MRTRLSRVVSDNENERVRVIARVRVRTRARSENENESTKRERSGGTMSTSCREELSHNESREEEENGSCSATRRRKRVRECEN

SEQ ID NO: 176869 - protein, 129 aa, Glycine max
  Coding DNA Sequence Number=SeqID_60091
ETADKAQQVPANHREGREHAACRQDQQDQQRGDYARRHHIALHHAGGKVIRIELAVGHEGSDDIRPELPQHDRAPGKKQGKPDNKGACRTAEREHGNILQRVKNRGVKYSRYSAIPDALSAQQTARGAR

SEQ ID NO: 176870 - protein, 130 aa, Glycine max
  Coding DNA Sequence Number=SeqID_60092
  Gene Ontology: Cellular component=outer membrane; Biological process =regulation of conjugation
  Homolog annotation: Hit_ID=P13980; Match level="QueryCoverage=99%, HitCoverage=57%, E-value=3e-33, Identity=56%"; Hit description=TraT complement resistance protein precursor
  Pfam annotation: Domain name=TraT; Domain location=1-130; Score=34.3; E_value=2.5e-08; Accession=PF05818.3; Description=Enterobacterial TraT complement resistance protein
MDLRQAQGFLSSGYEGGVLGAALGSGITAYNSTSGGAILGVGLATGLAGMAADALVEDVNFTMQNCRNHGQRGGAASGHFRNQTADQQRRGQPHEIPDPVVSNANKVNLKFEEAKPVLEAQLAKSVAGIM

SEQ ID NO: 176871 - protein, 402 aa, Glycine max
  Coding DNA Sequence Number=SeqID_60093
  Gene Ontology: Mol. function=dihydrolipoyllysine-residue acetyltransferase activity; Cellular component=pyruvate dehydrogenase complex; Biological process=metabolic process
  Homolog annotation: Hit_ID=Q0WQF7; Match level="QueryCoverage=72%, HitCoverage=59%, E-value=8e-67, Identity=42%"; Hit description =Dihydrolipoyllysine-residue acetyltransferase component 1 of pyruvate dehydrogenase ...
  Homolog annotation: Hit description=complex, mitochondrial precursor
  Pfam annotation: Domain name=Biotin_lipoyl; Domain location=208-273; Score=24.6; E_value=1.4e-06; Accession=PF00364.12; Description =Biotin-requiring enzyme
  Pfam annotation: Domain name=E3_binding; Domain location=315-351; Score=45.4; E_value=2e-10; Accession=PF02817.7; Description=e3 binding domain
  Pfam module annotation: Pfam domain module=Biotin_lipoyl::E3_binding; Domain location=208-273::315-351
MKMQLSKQGLDPQNFSFWPAVLAKLLHFASVLDLATGGRHNPHHKREIEGLVGAMVLAEEDNHEILTDIVDGAGRGGCSMLCLGVKLLKLSSLAVLVINKPKEADRKTVGIIRKFVGSLSLSEPWTRELMVLGMPALSPTMTQGNIAKWRKKEGEKVEDENDIQNVPASVGGETGVEEKKPTLGGVSDERKSESTSSVVNASELPPHLLLEMPALSPTMNQGNIAKWRKQEGDKIETDKATLEFESLEEGYLAKILAPEGSKEVAVGHSIAITVEDASDIEAIKNSVSSSTNQQKAPQRGTKSEVKAQKNNITRISPAAKLLIAEYGLDAPTLNATGPYGTLLKGDVLSAIKSGKLSPKPASSKEKALSSQSHQQVAASQESKSDLKKSDAYEDFPNSQIRK

SEQ ID NO: 176872 - protein, 39 aa, Glycine max
  Coding DNA Sequence Number=SeqID_60094
MAMSVAQQVRAKVPLSWRKSTFADFIFRTGSSLKGFWGK

SEQ ID NO: 176873 - protein, 248 aa, Glycine max
  Coding DNA Sequence Number=SeqID_60095
  Subcellular localization annotation: CTP_CleavageSite=22; ConfidenceScore=5.11e-01
GLLAALLLRKNLPVPRFALPPPAAVTQGCLGVSVLDSPTISRTQDIALLSGLDPRRAFSLVMPRRPLSGDLSIWYFDLLLGWRQGSWMFFSIYHHYGPYGQIDVVRIIVCPFEKDECPTHVISAKGFVSEALYVLVLGAPVKGLTSDVWKYVVEVNSSEMQPEGNLSFDPHMAMVQIQTKDFLSCFDLSGSRLFKIFRIVTAPFIAIRKLPSSLKDGPSCFCLMETRVQVQTFRNQDMAGAGFEPAIF

SEQ ID NO: 176874 - protein, 78 aa, Glycine max
  Coding DNA Sequence Number=SeqID_60096
MTGPFNESISCILIRVDPWVHVLHFRGLHVLHFRGLHVLAFRGLHTLAFSGLRICTLRELKGLRPQDTQWTQRSPAGS

SEQ ID NO: 176875 - protein, 65 aa, Glycine max
  Coding DNA Sequence Number=SeqID_60097
MARIPDKIKSIDGSREMLKLAVRVTNLWFVGTPNKSEQAKMIIVDSEGYQIHVVCKADQLKSWKA

SEQ ID NO: 176876 - protein, 79 aa, Glycine max
  Coding DNA Sequence Number=SeqID_60098
  Homolog annotation: Hit_ID=Q8VZ40; Match level="QueryCoverage=70%, HitCoverage=8%, E-value=9e-12, Identity=60%"; Hit description=E3 ubiquitin ligase PUB14
NVAAVLWSLCTGDPLQLKLAKEHGAEAALQELSENGTDRAKIKAGSILELLQRMEGGPAIKSAATAEPGSQNGKKLEGG

SEQ ID NO: 176877 - protein, 328 aa, Glycine max
  Coding DNA Sequence Number=SeqID_60099
  Gene Ontology: Mol. function=nucleotide binding; Cellular component =mitochondrion; Biological process=translation
  Homolog annotation: Hit_ID=Q4K9M7; Match level="QueryCoverage=95%, HitCoverage=84%, E-value=5e-68, Identity=45%"; Hit description =ATPase, putative
  Pfam annotation: Domain name=AFG1_ATPase; Domain location=1-327; Score=263.0; E_value=5.9e-76; Accession=PF03969.6; Description=AFG1 -like ATPase
MAQRAAKENLTLDADQLALVANLQTLSQQLFRQQTAIQGLYVWGRTGRGKSFILDSFFASLPLREKRRVHFHHFFRELHQRLNAPSAPRLQEVVAQMTDNCRLLCFDEFHLHDPADAMLIKVLLEHLFARNIVLLATSNYPPDRLLANPLYHERFLPSINLIKRHMTVTALNGEQDYRERHASLENDFCQGKLLVQPTPSTRATLGLPDIALQAQALQVGYRTLQTASRQGAFLHFTFDQLCLAPTSVMDYLTLCEQHQNWLVEKVPPLARVSPAAQQRFINVVDILYEKQCRLILITDCGLETLVADVELDDIQRTYSRLQQLAREA

SEQ ID NO: 176878 - protein, 129 aa, Glycine max
  Coding DNA Sequence Number=SeqID_60100
MVTGFDIVSKYSRHLLRWGICVGLPSWATKVVHLTINILVLLLIFVDVKSNRQVHRVIKLIGQALEKRASAKRNIPGLSARKNLEEDELYRFAKGTASSLYAHRFSSSAKRERRAKPKITCWIKWPRNN

SEQ ID NO: 176879 - protein, 63 aa, Glycine max
  Coding DNA Sequence Number=SeqID_60101
MEGIDVVGIGSTISHKFTDVLHPWGTRGGPAKGFDAQDFLEEQSAQGSFVSHGRQNVLITVIG

SEQ ID NO: 176880 - protein, 222 aa, Glycine max
  Coding DNA Sequence Number=SeqID_60102
  Gene Ontology: Cellular component=membrane
  Homolog annotation: Hit_ID=Q6ZGZ0; Match level="QueryCoverage=49%, HitCoverage=28%, E-value=1e-24, Identity=50%"; Hit description =Putative purine permease
MADAPRAQKNPIICFCLERFFVSSDSVLSAIRVTDMVRTIIEFKINAVNFWELMKKVSTALKINWDAHTSAKVERGRYKSAHAYVRSIAAIIKPKTRYKKNVMGSFGLVLEGFQNTGKYVTRKIYHMLRGDKPKVTWRKIFYGNLVRLRAKFILWMTCLDKLPTKDRLHRFGVVTDSKCVFCGLIETCDHLFFECATTKKVWADILRWISIMRIPGGWHSEL

SEQ ID NO: 176881 - protein, 88 aa, Glycine max
  Coding DNA Sequence Number=SeqID_60103
MVTVDGPVAAPPKFLVLSLLHFLCLGDPLKHPRVGAIETSCNKRSKEGGGCRPTRPGEQGCFHQKAPSSVGTPGRPKWAYCYLHPPFY

SEQ ID NO: 176882 - protein, 120 aa, Glycine max
  Coding DNA Sequence Number=SeqID_60104
  Homolog annotation: Hit_ID=Q6ZGZ0; Match level="QueryCoverage=73%, HitCoverage=26%, E-value=5e-18, Identity=43%"; Hit description =Putative purine permease
  Pfam annotation: Domain name=TPT; Domain location=2-94; Score=-14.6; E_value=0.004; Accession=PF03151.7; Description=Triose-phosphate Transporter family
MIVGTIGGLVGLLVSGDWRTMGMEMKEFENGSVSYVMTLVCTSVTWQIGCVVVISNLELTIAPILAVMVFHDKIYGVKVIAFLLAMWGFLSYIYQHYLDDQKAKEDKSDCLEILKGNGEI

SEQ ID NO: 176883 - protein, 189 aa, Glycine max
  Coding DNA Sequence Number=SeqID_60105
  Gene Ontology: Mol. function=catalytic activity; Cellular component =endoplasmic reticulum; Biological process=metabolic process
  Homolog annotation: Hit_ID=Q1RVC0; Match level="QueryCoverage=86%, HitCoverage=62%, E-value=8e-61, Identity=61%"; Hit description =Sterol desaturase
MGGFPEPKGDHVARNHGRSKKGGNPEDQDLNPVSIGRDESNGCMVLMVDAVNLLVPPIVVQKPMDPVIGVILYEKKDNELEGADDEEEHVHDVFVALEGFGEGQVDFWLDLVGRDEGEALEFEEDEGEGDKGKDEEEEEEQNVVAVEEVIGLGGGVVEPEGLREGEHRHCNPRIAVCDFCGRGGCCAGC

SEQ ID NO: 176884 - protein, 128 aa, Glycine max
  Coding DNA Sequence Number=SeqID_60106
  Gene Ontology: Mol. function=translation initiation factor activity; Cellular component=nucleus; Biological process=translation
  Homolog annotation: Hit_ID=O65879; Match level="QueryCoverage=86%, HitCoverage=38%, E-value=5e-45, Identity=65%"; Hit description =Translation initiation factor
  Pfam annotation: Domain name=Helicase_C; Domain location=29-103; Score=81.9; E_value=2e-21; Accession=PF00271.21; Description =Helicase conserved C-terminal domain
MTNKFMTDPVRILVKRDELTLEVDWLTEKMRNNNFTVSSMHGDMPQKERDAIMGEFHAGTTRVLITTDVWARALDVSLVINYDLPNNRELYYIHRIGHSGRFGRKSLSLIFIWETVLHFRTILREPQL

SEQ ID NO: 176885 - protein, 280 aa, Glycine max
  Coding DNA Sequence Number=SeqID_60107
  Homolog annotation: Hit_ID=Q1SS26; Match level="QueryCoverage=62%, HitCoverage=21%, E-value=2e-07, Identity=23%"; Hit description =Unnamed protein product; no similarity, hypothetical start
  Subcellular localization annotation: CTP_CleavageSite=24; ConfidenceScore=5.54e-01
MAESSKKCKVSSTSVAAHRTSRPRATGASPTPIPPSLSSSTLFSSDEKCIQYSSLFQSHQILDPKYLDLEFFDGEIFDCYQVFQNIGLIPFMSLKLPYYPELVRVFYSNLKIQDGTLISEVHGIPMIIDESLFFSLTQLPNQGAPFEGTLVDNKKFDYSCHDARRMVCIDQVDMTGRLLAGSLTFDCRIMHYIIVRILMLRSSNLAQAFEEDMILMWAFLTNCPIDWAHLIRYRMHKALRSSAPLPYSQLVTLFLRLFEFLWILSLLCKLDVPLLLVSMR

SEQ ID NO: 176886 - protein, 101 aa, Glycine max
  Coding DNA Sequence Number=SeqID_60108
MKMKANKTRNESKVSDSNTYRLKTEEWTKNSGKPSWIGSRKGLGGVTKAPRLGFSSWKTWVVLAAQLAQASSGRPGELGCFLRKFLDASPKLLISPPFHTL

SEQ ID NO: 176887 - protein, 145 aa, Glycine max
  Coding DNA Sequence Number=SeqID_60109
MTIEESIHVFFDETNYIRQRKDILDDITDTLEDTHIHEEVHKDKEDGNSIDSQSKENQINMDLQREWRTSRYHPLDNITGDILKGVKKRLSHEVPKRSFNAIEEYGRASASRSRAKREISALSAAGVFSQAERTTGAKPESTYLR

SEQ ID NO: 176888 - protein, 201 aa, Glycine max
  Coding DNA Sequence Number=SeqID_60110
  Gene Ontology: Mol. function=DNA binding; Biological process=DNA integration
  Homolog annotation: Hit_ID=Q1SJY5; Match level="QueryCoverage=68%, HitCoverage=16%, E-value=6e-26, Identity=41%"; Hit description =Integrase, catalytic region
MTGDKSKLTDFVSKEGGYVPFGDKNKGRIMGEGNIGNQHKTQIKNVLYVDGLKHNLLSISKRIGNIYMLNIEHASFHELSCLVRKIDDSWRWHRKVVHINIHHLNHLVKKDLVIGIPKLKFEKNILCGACQKGKQVKNSSQKNSLEDEDAGFQDKDTTLEDETKVEDFEQSKEITAIPHKDLPKEWRTQRDLSLDNIIGDI

SEQ ID NO: 176889 - protein, 65 aa, Glycine max
  Coding DNA Sequence Number=SeqID_60111
MQSKKKDLELEANALIFVGGKHQVLKIFTLPCRFPLIYYCMMKLLSFAVGVLPDHVPKLLALLSP

SEQ ID NO: 176890 - protein, 311 aa, Glycine max
  Coding DNA Sequence Number=SeqID_60112
HPFQASYPRLILVVNLLLPWLIQDEATTSPSSSESEEAKGEESSEEIYPQEEGQPLMTNIKEASPLRQPPHLLLCKKTLVSTATPLGFEVIPQVNELLDEDPKRIKVIPDWPTSLSIREIWGCHDLTNFYKRFVPYLSILVAPLIELVRNYVPLREDVHERGVEGRIPEYEEPQDLRSNPFQGGGDDAILPPRVLDRRLQEDWARAAKQGPGVLMNLRVDVLSPWAKNFDTMSLKELVGTLEVHEQDKGLKKGKSLALSVQKTKKTSSSESSLKLTSNSLSRAISVESSSDEESEDKSDEDDELAFISGKI

SEQ ID NO: 176891 - protein, 200 aa, Glycine max
  Coding DNA Sequence Number=SeqID_60113
MMQSHALKVVAHLDNLSLYSENENIKLSHGNTPKVPSPFIRSFKVLTVRDLVQPRPIVNVNPTTGRGLSPHKEKFHSYLGVGKIDISEASNAKKRGYDLLDKNLMEEKRKKRKEEVILIEDSTMIVDPSSPIERHVKLKLTRRKLYRQMTSKDSLQEQMTQDHFVPHGREDILNIGIGRLEHPGRVYAAGGGVTINQYFG

SEQ ID NO: 176892 - protein, 174 aa, Glycine max
  Coding DNA Sequence Number=SeqID_60114
MKVELKEAIKKEFSQMASQHSPPIEADIQVFGSCVITKGSCVDTAINPSREEHVADVMPTMGLYVQDDHSTCLVALGKVYEGVSTIHNLPYVDDVIKVSVGKVYKGNTQVLFPTLEIQFMNESSIRLGHGFVYGFLEFQSIHNAKDRHDECQYYIETWVKEHKIEVYLRPYLKK

SEQ ID NO: 176893 - protein, 390 aa, Glycine max
  Coding DNA Sequence Number=SeqID_60115
  Gene Ontology: Cellular component=membrane
  Homolog annotation: Hit_ID=Q6ZGZ0; Match level="QueryCoverage=90%, HitCoverage=90%, E-value=4e-89, Identity=48%"; Hit description =Putative purine permease
  Pfam annotation: Domain name=DUF6; Domain location=39-178; Score=4.8; E_value=0.035; Accession=PF00892.11; Description=Integral membrane protein DUF6
  Pfam annotation: Domain name=Nuc_sug_transp; Domain location=100-307; Score=-170.2; E_value=0.028; Accession=PF04142.6; Description =Nucleotide-sugar transporter
  Pfam annotation: Domain name=TPT; Domain location=199-348; Score =174.2; E_value=3.4e-49; Accession=PF03151.7; Description=Triose -phosphate Transporter family
  Pfam module annotation: Pfam domain module=DUF6::Nuc_sug_transp::TPT; Domain location=39-178::100-307::199-348
MTEECTETELTHQQPHQRPRFRNYKRWWRVSLYIFLALGGQSAATLLGRLYYDSGGNSKWMATFVQTAGFPVLLPLFLYFPTTHDNSSNMSNDNFSETKPKLYTLVFLYIVFGLIVTANDLMYSYGLLYLPLTTYSLIGATQLVFNAVFSYFLNAQKFTAFIVNSIVLLSISVSLLAINGESNDPMGHSSKEKHMYMFGFISTLVASATFALHHCLVQVAFEKVIKRQTFSVILDMQLYPSLVASCCCVVGMFASGEWKSLDREIREYEDGKVSYVMVLFWTAVTWQISCIGLFGLIFEVSSLFSIVIDTMELPIVPFLAAIFFHDKINAMKVMAFVLALWGFLSYVYQQYQDDKKAKADTNTSDDDDNFVGGLRLQGVEEMKELQTNCL

SEQ ID NO: 176894 - protein, 136 aa, Glycine max
  Coding DNA Sequence Number=SeqID_60116
  Gene Ontology: Mol. function=unfolded protein binding; Cellular component=chaperonin-containing T-complex; Biological process =cellular protein metabolic process
  Homolog annotation: Hit_ID=Q653F6; Match level="QueryCoverage=54%, HitCoverage=13%, E-value=2e-27, Identity=81%"; Hit description =Putative t-complex protein 1 theta chain
MKTATSRPTFEVQNLNPSSLSLFLLHLQPWQGKPQLLSNINACTAVVDIVRTTLDPRGMDKLIHDDKGAVTISNDDATIMKLLDIVHPAAKILADIAKSQDSEVTLTSLRSHAMPLLSRSVHFRFIQMLYTVELEF

SEQ ID NO: 176895 - protein, 47 aa, Glycine max
  Coding DNA Sequence Number=SeqID_60117
MCYNYEENWGMNQDMVHGGREAGILMKLDHWKQRDSRHFAYSGHSII

SEQ ID NO: 176896 - protein, 140 aa, Glycine max
  Coding DNA Sequence Number=SeqID_60118
MKEKILLFGKILMTQGDKSKWLINEKFKRRYIFSSKLAKDSWYCAGCYLATKKLLCISWYKVVSSRNELSTFLHGIRLARERGFNFIEMHSDSLDAVKLINEGCARTILIAILWTLYVGYIPREGNIAADAFAKNGLQWK

SEQ ID NO: 176897 - protein, 175 aa, Glycine max
  Coding DNA Sequence Number=SeqID_60119
MVRSIGESGSEGEVSTSPPSDFEKMNELLRDDEVTTVKRNRNCNSQDNQPNVENNEDNDDVKVTKQEIKDIKIIAEWPHKMSCKFILAIPNSNHPDRILSHDYLFYFCSVDLFKCLLSSNRFVLSICRSHEVSKPYGGSDFVGDDVVVGVARLVQNEKIIGLTMPNVQVEEEKGK

SEQ ID NO: 176898 - protein, 144 aa, Glycine max
  Coding DNA Sequence Number=SeqID_60120
  Gene Ontology: Mol. function=protein binding; Cellular component =nucleus; Biological process=cell cycle
  Homolog annotation: Hit_ID=Q1SCC2; Match level="QueryCoverage=84%, HitCoverage=22%, E-value=1e-29, Identity=50%"; Hit description=Cullin
MSILGSHVLLAFLLTTYLSLFPFPQHVTTEGMALVKQVKDAASNKKALKEAFKVFCNKGVVGSSSVELLVSFYDNILKKVGREKLSDEAIEETLEKIKNRDEWVAKMKLIMVGKKLARRPLFDKSANDDHERSILKKLKQQCGG

SEQ ID NO: 176899 - protein, 84 aa, Glycine max
  Coding DNA Sequence Number=SeqID_60121
  Subcellular localization annotation: CTP_CleavageSite=33; ConfidenceScore=5.21e-01
MKVKPQCSLFTLFPHSINKNHSSSSPPSNFPLRSSADDDIIWTNHHLSVAQGPQSSDPKLPWLEVWLRLCSRPQCPLPSFIVEY

SEQ ID NO: 176900 - protein, 85 aa, Glycine max
  Coding DNA Sequence Number=SeqID_60122
  Gene Ontology: Mol. function=transition metal ion binding; Cellular component=mitochondrion; Biological process=DNA integration
MKAKKEARAWQHELYVLDTIGQQFEQTMLSTSRNVKNVKSSTIISLLPLRNFIASHLLGLLPYGEWIYLVHFEWLKVNSNPYVLL

SEQ ID NO: 176901 - protein, 115 aa, Glycine max
  Coding DNA Sequence Number=SeqID_60123
MAEANAGNSRQHELLCGITSPLVWESLRQNRSCLDATTRGNLMHKLTDATIEIIEVMASNAYNGVGNRRILKRPTGVHQVVTDPSSSSVEQKMDMLTKRMETHVGSCLSIGHLFK

SEQ ID NO: 176902 - protein, 112 aa, Glycine max
  Coding DNA Sequence Number=SeqID_60124
  Gene Ontology: Mol. function=GTPase activity; Cellular component =mitochondrion; Biological process=defense response to fungus
  Homolog annotation: Hit_ID=Q8S7E5; Match level="QueryCoverage=90%, HitCoverage=16%, E-value=9e-30, Identity=64%"; Hit description =Putative phragmoplastin
MSSHGGVQISERPNAHLLNCGHYSSKSRYSTSDAIKVSRKVDPAGERTFGVLTKLDLMDKGTNTLDVLEGGSYRLKNPRVGIVNRSQADINRNVDMIAARQQEHAFFTTSPD

SEQ ID NO: 176903 - protein, 72 aa, Glycine max
  Coding DNA Sequence Number=SeqID_60125
MWERVDEMNTMVSSSGTLSVACKVGHNKKKKEMNHYMDEFPNKLQQYILNIVDVTPNGNCGYKEITSLLGQG

SEQ ID NO: 176904 - protein, 88 aa, Glycine max
  Coding DNA Sequence Number=SeqID_60126
MDWNTFISFEVTMSPRWGNMDDGSKCFFYQFDLLYGTEPNDTGLRNDNADDVGGDDTNKQPQPSYLDFSSYFMPDEVFQEHDDLLNWA

SEQ ID NO: 176905 - protein, 167 aa, Glycine max
  Coding DNA Sequence Number=SeqID_60127
  Gene Ontology: Mol. function=GTPase activity; Cellular component =microtubule; Biological process=cell division
  Homolog annotation: Hit_ID=Q8S7E5; Match level="QueryCoverage=86%, HitCoverage=23%, E-value=2e-47, Identity=65%"; Hit description =Putative phragmoplastin
  Pfam annotation: Domain name=GED; Domain location=69-160; Score=68.3; E_value=2.5e-17; Accession=PF02212.8; Description=Dynamin GTPase effector domain
ELKRFPTLQAEIAEAANEGLERFHDDGKKTTLRLVEMESSYITVDFFGKLPQEVDKGKNSASSLLDDQYAKGHFQRIGSNVSSYVGMVSQTLRNTIPKAVVHCQVMEAKRSLLDRFYAQLGKKEERQLAWMLGEDSVLRERRLKQFFGRDKMNLELIYEGPLLMGKE

SEQ ID NO: 176906 - protein, 365 aa, Glycine max
  Coding DNA Sequence Number=SeqID_60128
  Gene Ontology: Mol. function=oxidoreductase activity; Cellular component=peroxisome; Biological process=electron transport
  Homolog annotation: Hit_ID=Q76FR9; Match level="QueryCoverage=98%, HitCoverage=97%, E-value=1e-169, Identity=79%"; Hit description =Hypothetical protein PsOPR5
  Pfam annotation: Domain name=Oxidored_FMN; Domain location=11-342; Score=317.8; E_value=2e-92; Accession=PF00724.10; Description =NADH:flavin oxidoreductase  NADH oxid
MATEADAPVIPLLTPYKMGNFNLSHRVVLAPLTRMRSYNNVPQPHAVLYYSQRTSPGGLLISEATGVSDTAQGLVHTPGIWRKEQVEAWKPIVNAVHAKGGVFFCQIWHVGRVSSPVFQPNGQAPISSTDKPLKQNGIEEAQVTPPRRLRTDEIPHIVNDFRVAARNAIKAGFDGVEIHGAHGYLLEQFIKDKVNDRSDGYGGSLENRCRFALEVVEAVVKEIGAERVGVRLSPFTEHAECGDSDPKALGLYLANALSKYNILYCHMVEPRMKNALEVVECPHSLMPMRKAFNGTFISAGGYDRKDGIDAVAKNRTDLVAYGRLFLANPDLPKRFGQDAPLNKYNRENFYTHDPVIGYTDYPFLE

SEQ ID NO: 176907 - protein, 79 aa, Glycine max
  Coding DNA Sequence Number=SeqID_60129
MKMTEIEAVSMLWVVETEGDKEKEQGQNRTDAKIEEQRQIQQVLDEYAQVFSEPKSVDQIQSPRKPKALRVYQKRNKAH

SEQ ID NO: 176908 - protein, 88 aa, Glycine max
  Coding DNA Sequence Number=SeqID_60130
  Pfam annotation: Domain name=DUF1723; Domain location=24-78; Score =25.6; E_value=0.00017; Accession=PF08330.1; Description=Protein of unknown function (DUF1723)
  Subcellular localization annotation: CTP_CleavageSite=41; ConfidenceScore=5.31e-01
MKNLSWLKVQTLVLKLVNDNLKTPKAAPLTKSKATRFYSTRSTPETHTFKFPHRKATITLQDMTLQLGLKIDGLPITGVITSDARVAC

SEQ ID NO: 176909 - protein, 163 aa, Glycine max
  Coding DNA Sequence Number=SeqID_60131
  Pfam annotation: Domain name=zf-CCHC; Domain location=43-60; Score =10.7; E_value=0.017; Accession=PF00098.13; Description=Zinc knuckle
MWDTLAIQSTNSLLRKKTKVGTKWKNSSKKVFKEKGDKDKSFIIGYGCKKLEHFKSECPNLGKPKDKNKQYKSKGKKGLMSTCEILDGTLSDEEGEGEANLCLMANTTSKESELDQEEIDFDNPELLKQAYHELLSNTSILSKAFENMQKGFKKLSKDHKELE

SEQ ID NO: 176910 - protein, 168 aa, Glycine max
  Coding DNA Sequence Number=SeqID_60132
  Homolog annotation: Hit_ID=Q1SX43; Match level="QueryCoverage=31%, HitCoverage=6%, E-value=4e-07, Identity=71%"; Hit description=IMP dehydrogenase/GMP reductase
MGKRYGLVIVNDYSRWTWVRFLAHKDESLSLSSLYYVKEFKMKKEHVVLQLEVIMGENLRMKISKFFVRKMGIWEPLFDQSLKVDKSILKVQNEKAQSLILLPLFDDVLYEVSQKKIVFALSLKLEKQVNYEMTFVWPLNKRRGQKKKKDKGSKRSKTDPKDVCNYCK

SEQ ID NO: 176911 - protein, 298 aa, Glycine max
  Coding DNA Sequence Number=SeqID_60133
LKSLEGFLVQDVSGIVLEGLNSLRRHEVHYDDGDNHRIVLVDGTHALEFLIHKRHRRKTSLKGCIEKINVDVPDGKAASDGVDYTSNVLGGFLLRWSLAPAWGLPGLLTNWAKYPAYGYLHVECFLENHGAIGCYGCVTLVPGPFGEKLALVWLVPLVRLVCLKLGVYFALVVLLSGLIVYKLAGCKARSMECNATSKLRFWIWMVVHPNLSMNFLRDLSFACHRLAKAAKSVTEVSRLRPHRVLTTDECERIDMRPWGMFYRSPTVGAKCSYQNPKLSHVRVDVVEWGPELHTSTRI

SEQ ID NO: 176912 - protein, 104 aa, Glycine max
  Coding DNA Sequence Number=SeqID_60134
  Pfam annotation: Domain name=GRP; Domain location=1-58; Score=-29.8; E_value=0.087; Accession=PF07172.2; Description=Glycine rich protein family
MIAAMTIVVATNMIIVVATASSGRGNSHVGGDNGDHGGDNNGGGGNDNDGGNKHVSGAVMAETVMTVVVVKVCGSNAFQDYFDDAKESRVKQVPKNQESSKIQE

SEQ ID NO: 176913 - protein, 151 aa, Glycine max
  Coding DNA Sequence Number=SeqID_60135
MQALTLKIETLMRAQAQVPITTLVFPTCERCGLCIGQSGNLLSQPEPNLKGEDVNALMTRNKRIQEDSKKREDYFPNFANDIITKKDQTPGKVEVHTNENPMANKEGEKEVLIPPHGSVPFPQRLKDKSKDGQFSRFFEMLKRVDNNIPFT

SEQ ID NO: 176914 - protein, 114 aa, Glycine max
  Coding DNA Sequence Number=SeqID_60136
MEATKATIASGISVLETVVLTPGSIAAGEGASYNGPRAQIVCSYLYVGWGVNGQQQPKYLKLTAMWLKIPLGTKSSFSVFNQKLPINHSPNPTQITNKELEELTSKLECLMSRQ

SEQ ID NO: 176915 - protein, 114 aa, Glycine max
  Coding DNA Sequence Number=SeqID_60137
  Gene Ontology: Mol. function=nucleic acid binding; Cellular component= ribonucleoprotein complex; Biological process=mRNA catabolic process, nonsense-mediated decay
  Homolog annotation: Hit_ID=O22791; Match level="QueryCoverage=67%, HitCoverage=19%, E-value=7e-25, Identity=65%"; Hit description =Putative RNA-binding protein
  Pfam annotation: Domain name=RRM_1; Domain location=8-77; Score=77.4; E_value=4.3e-20; Accession=PF00076.12; Description=RNA recognition motif. (a.k.a. RRM, R
MDSDQGKLFIGGISWDTTEDKLKEHFGNYGDALSTSIMREKNTGKPRGFGFVVFADPNILDRVLEDKHVIDGRTRKVKLRNTTLIYKSQCTADITGNHKGLNCSRGLFMEVGLI

SEQ ID NO: 176916 - protein, 284 aa, Glycine max
  Coding DNA Sequence Number=SeqID_60138
  Gene Ontology: Mol. function=dihydroxy-acid dehydratase activity; Biological process=branched chain family amino acid biosynthetic process
  Homolog annotation: Hit_ID=Q9LIR4; Match level="QueryCoverage=53%, HitCoverage=28%, E-value=3e-44, Identity=57%"; Hit description =Dihydroxy-acid dehydratase
MERKEKRVTAVRVYVTAGDGNVAIVPLHYHDGLDVVGNEVPGLEALAHATSAHGDGIADANSVEAEGNHAGGGNAVTHGLGEVEEVHVAGVALVLDPGDIDLRLGHVVLGDTNAIEHGLGGALLLGLHDVVLVQLHRLGRGFHDDGGVNGDGDKGMGGVEECGLHSESAEKWTVVNEGTQVFFEDVVKDLGLSIKLGVISGAQKELRTAQPEKLMPEIADEEWAEVQPGVCPWNSDQQQPGLLYIPEKMSHTLSIDKWNNVPYIGGRHGACEATENLPTSDEVF

SEQ ID NO: 176917 - protein, 195 aa, Glycine max
  Coding DNA Sequence Number=SeqID_60139
MSHKENLIYELHTRKGTWKIVVRITDLWQARKQNSKQTIEMVLMDQTGSKIGATLWQELFTELWDKIVDNQSAYRVNPAPYLVYFLKTTSVKEIHHPEIPSNVYLITLFTDIIAGLAPRHTLVDIVGVIVDLIDFKTVNPPHRMTVRLRDNSNYDILITVWEDYAIQLHDVIDKNLLLQEPLVVILTLGKIKDAT

SEQ ID NO: 176918 - protein, 43 aa, Glycine max
  Coding DNA Sequence Number=SeqID_60140
MKYRYSKNEKVSVLLVSSSVNSSVFMAMGVPGKRSNVIQLYEH

SEQ ID NO: 176919 - protein, 46 aa, Glycine max
  Coding DNA Sequence Number=SeqID_60141
  Gene Ontology: Mol. function=nucleotide binding; Cellular component =membrane; Biological process=small GTPase mediated signal transduction
  Homolog annotation: Hit_ID=Q9LFT9; Match level="QueryCoverage=91%, HitCoverage=20%, E-value=3e-16, Identity=97%"; Hit description=GTP -binding protein
MYLEDRTVRLQLWDTAGQERFRSLIPSYIRDSSVAVIVYDVASMPF

SEQ ID NO: 176920 - protein, 92 aa, Glycine max
  Coding DNA Sequence Number=SeqID_60142
RVHLLGLLTENKRGYISCGSVLVEGTSTRLFKENKGGYIPCGSLLHDTRAKRACPARSSGHTISRRMRTLARDNCLPMWLLVLSGLACTERS

SEQ ID NO: 176921 - protein, 114 aa, Glycine max
  Coding DNA Sequence Number=SeqID_60143
VSQHLHLCNFTIAAPHPELRVACGSFLRTRPGCGTDTVFEGTCKFITTYLGPSCVLRQVAFSLSRELELPKNNYRVHEWNRKFQIGITQEGLELELQDEGEPKYVMVMVSRQVI

SEQ ID NO: 176922 - protein, 39 aa, Glycine max
  Coding DNA Sequence Number=SeqID_60144
HADGVQAKHKHQAEDNTEWNLILDTSSSEDLSDVAASVG

SEQ ID NO: 176923 - protein, 429 aa, Glycine max
  Coding DNA Sequence Number=SeqID_60145
  Gene Ontology: Mol. function=DNA binding; Cellular component=nucleus; Biological process=regulation of transcription, DNA-dependent
  Homolog annotation: Hit_ID=Q1T199; Match level="QueryCoverage=100%, HitCoverage=48%, E-value=1e-58, Identity=54%"; Hit description =Homeobox
LVIQYVKHRAVLGAKYHRIDWTSISDLPASPIACMRRMNSLNSNMRFRKASCEGILNNSSPDAEIQITSLNKEAWDDFENKNIKMALDEILRCKMMAKLGASSQKGQLQYDGWSDANANANGLVGGTGNERFELSQHFLQSVSKSPFPFNTGKQAVKFSAWLEERGKDLTEVGANLAEDLQCGDIFHLLALVSSGELSISPFLPDNGVGEAEDLRSAKRKYDTTESSYSDKAKKSKSFFGVEGEIISRREKGFPVVYAAIQKAGDQGLSMGEISQVINLPGAEIDVLIVDALQAFGQALKVNAYDTVRVVDVLYRHKYFLTPMSDFHLRVVQPSSSKTIEKSDHTCELYESEERDTTSVDTSRNEGCKQNRLGLSRVNHKKETLEFSSSKSCVPILPWVNGDGIINNIVYRVLRRRVLGIVMQNPGILE

SEQ ID NO: 176924 - protein, 102 aa, Glycine max
  Coding DNA Sequence Number=SeqID_60146
MEAKAQKWWSRGENLQNLWVLHFLNEGGEFWVERNSPSLVFMFPGAGVLAQSSSARPGELIPSPFFLGKTQAASQLRFPLFQSWAWDDDPSIMVLASTRVHP

SEQ ID NO: 176925 - protein, 90 aa, Glycine max
  Coding DNA Sequence Number=SeqID_60147
MEECSGFPVLFGGANSNPPNDGGKDKILGLELIARLQNNGLKDKIFLGLELIARLQHRTRGIRHLTRIHGVDLTNEIEDTCPRRSIKKEI

SEQ ID NO: 176926 - protein, 146 aa, Glycine max
  Coding DNA Sequence Number=SeqID_60148
MVYPSGSRRESLKHVVKGLNPNQCIYGENLVEKEIPPMSANKLGLNHERFQFDSFELDEPEDAGRYIVRKSIKSARDLVCFPFEQNPIILYLLHTMYRGRENLPLLTAHYMMQPYPPRVLDRRIQKDWAIATEEGPKVLMNLKVDF

SEQ ID NO: 176927 - protein, 112 aa, Glycine max
  Coding DNA Sequence Number=SeqID_60149
METIGNMPKVLKNLESMSLEELVGTLKVHQQELQQDEGLRREKSLALSSQKNKKEQSSRKQVRRSSSKVLKVNDYIIQASPNPFMTNTKEPRKIREPKKRNFPITDILDSRK

SEQ ID NO: 176928 - protein, 100 aa, Glycine max
  Coding DNA Sequence Number=SeqID_60150
MYIRVLKGTTDTGLVYHRDMSCALAGYSDSEYAVDLDARRIVTTIICLVKDQVHHERTKYFDIRYHFICVKKRLKIQKVDTTSSVEHLITSNGVFNLVVH

SEQ ID NO: 176929 - protein, 169 aa, Glycine max
  Coding DNA Sequence Number=SeqID_60151
  Gene Ontology: Mol. function=nutrient reservoir activity; Cellular component=apoplast; Biological process=auxin mediated signaling pathway
  Homolog annotation: Hit_ID=Q1SKM2; Match level="QueryCoverage=98%, HitCoverage=100%, E-value=7e-70, Identity=64%"; Hit description =Cupin region
  Pfam annotation: Domain name=Cupin_1; Domain location=18-157; Score =126.8; E_value=6.1e-35; Accession=PF00190.13; Description=Cupin
  Pfam annotation: Domain name=Cupin_2; Domain location=41-119; Score =30.1; E_value=7.8e-06; Accession=PF07883.2; Description=Cupin domain
  Pfam module annotation: Pfam domain module=Cupin_1::Cupin_2; Domain location=18-157::41-119
MKVVYFLVAILALTSSLVSAYDPSPLQDFCVAAKEKDGALARIDFAPKGLNAPHTHPRGTEILIVLEGTLYVGFVTSNQDGNRLFTKVLNKGDVFVFPIGLIHFQMNMGNGNAVAIAGLSSQNPGAITIANALFKVNPPISSEVLTKAFQVDKTIIDYLQKLSWYDNNN

SEQ ID NO: 176930 - protein, 187 aa, Glycine max
  Coding DNA Sequence Number=SeqID_60152
MSYVTDASVVGSLMYLKGTTNIGIIFHGDMSCAFPLMGLASGSKSIPESIRTESLEVYFGNCTMIKMEESSGFPVLFGGENSNPPDDGGKDKILGLQLSARLQNNGLKDKIFQGLEPIARLQHRTRGLRHLTRIHGVDLTNETQDTCPKRSIKKEIYEEVLGISYSTVSQSEKVVAHDLKKSHILVQ

SEQ ID NO: 176931 - protein, 102 aa, Glycine max
  Coding DNA Sequence Number=SeqID_60153
MGLASGSTSIPESIRTESLEVYFGNYTMIKMEKSSGFPVLFGGENSNPPDDGGKDKILGLQLSARLQNNGLKDKIFLGLELIARLQHRTRGLRHLTRIHGSE

SEQ ID NO: 176932 - protein, 243 aa, Glycine max
  Coding DNA Sequence Number=SeqID_60154
  Gene Ontology: Mol. function=nucleic acid binding; Cellular component= intracellular; Biological process=DNA integration
  Homolog annotation: Hit_ID=Q1S1X7; Match level="QueryCoverage=54%, HitCoverage=12%, E-value=9e-21, Identity=38%"; Hit description =Integrase, catalytic region; Zinc finger, CCHC-type; Peptidase aspartic, catalytic
MELEQLYVKNLFLHGRLEEDILMQQPEGFEDMGVAEKIMSMEIKNYRVEKKLFMCQKEYIQKSESKKKYMSYVTYASVVGSLMYSMVCTRLDLAQTVNIVVSSYMGNPEMEHWQAVKNILRYLKGTTNIGIIFHGDMSCAFPLTILQDTMDLSTTKEEYMAKWQHCPSPPDRILHSGGIVLRRRDGVLCGGSVVLCLCDGVFRGGGAVLCCRDGALLSGFCISVAEVQNSKSQDPIEVNENDK

SEQ ID NO: 176933 - protein, 70 aa, Glycine max
  Coding DNA Sequence Number=SeqID_60155
  Homolog annotation: Hit_ID=Q1RTI7; Match level="QueryCoverage=63%, HitCoverage=4%, E-value=2e-11, Identity=84%"; Hit description=IMP dehydrogenase/GMP reductase
MEGTTLRDCSMVTLTVGLETLASLMTLLTLGSLRMDMISCSNSTFTLRSGGERGWWEELRDGRKRLEEPE

SEQ ID NO: 176934 - protein, 177 aa, Glycine max
  Coding DNA Sequence Number=SeqID_60156
  Subcellular localization annotation: CTP_CleavageSite=36; ConfidenceScore=5.13e-01
MAFLGETSSQTVVNSTLGFIFPNGSIVHNDSGVSFQASTPVPIRVLNECDFQTLKTRIHNTLKLTDKQFLDEIYYRQPFTYASNQFRFQCMQLKDDADVNTMLMCNHEFSFVGPIEFLCSIARTPDGKNLKNFDIPTGCTMDELKDLIKQVAPRGIPPYGVDETQMDVMKVLIESNY

SEQ ID NO: 176935 - protein, 91 aa, Glycine max
  Coding DNA Sequence Number=SeqID_60157
MPQAVLRRIKSIQRKILWGEVDDHKKIPWNCWVKMYSPKSHGGLGIKDISIFNDALIANKMRLLKRWEYGKGKIGYGTLGGTKLVPMGKSD

SEQ ID NO: 176936 - protein, 94 aa, Glycine max
  Coding DNA Sequence Number=SeqID_60158
MEEFDTQMACPRDQPSSSRGGGASVAQEPVTDEPPAPAEEETTPDHTPQPSPSSASTPEETQPSALDHNEDHHRRSRTFKFLHFEHFSLFLVIL

SEQ ID NO: 176937 - protein, 335 aa, Glycine max
  Coding DNA Sequence Number=SeqID_60159
  Homolog annotation: Hit_ID=Q28658; Match level="QueryCoverage=42%, HitCoverage=75%, E-value=2e-17, Identity=36%"; Hit description=Small proline-rich protein 3
DTRPRLKGLHVLTFRGLHVLAFRGLHVLTLRGLHVLTFRGLNVIAFRGLHTLAVRGLHALAFRGLHVLAFRGLHVLTFRGLHALTVRGLHALAFRGLHILAFRGLHILTFRGLYVLAFRGLHVLAFRRLHVLTSEGYTNCASTARGGGRSPALMRRLSHNYYAYQGKILPRPLQGDECGSCASVLGFPALITGLCQFYGVPIAPNKVIKPPINRDFIKKYCAPRQGQGEVHHNSLGTANNRQQRHRYHLQSPPTLIYKGWSVAYAMWPTSRRPSPKQKASKNTDSRAWNISSVSRPSKDGHSSDRDRGSRGMMNFCTSLEEAKPYNQDRQTCDSS

SEQ ID NO: 176938 - protein, 89 aa, Glycine max
  Coding DNA Sequence Number=SeqID_60160
MATNKNLTAPEAFENGPNLSIPHMEKGQGELKPWRLSGGMHGTSINSWHCLHILVKSRDSTNSSRQAPLWLLGSVPRYGGYLFLHVALA

SEQ ID NO: 176939 - protein, 123 aa, Glycine max
  Coding DNA Sequence Number=SeqID_60161
VAAWIVWKVEHPKVVNAIVAFAEATRSNHGLSSRSTTTKKEELAKVIANLQARLKESESKLKEFELKKGFYKDVRKARFFTIDLDLGLFDPFKDVKDGKLLDEEEIAATKEDVNEEQDVGANV

SEQ ID NO: 176940 - protein, 81 aa, Glycine max
  Coding DNA Sequence Number=SeqID_60162
MGLTSLWRRETHQGQTLGLMAFRLSARNASVLDFGETCQGLYAQLSKFATTLNEPSQLCPCFPARGSFLASPQTRHTRSPS

SEQ ID NO: 176941 - protein, 167 aa, Glycine max
  Coding DNA Sequence Number=SeqID_60163
MVIDATVWKEVVGLDMGGVHKFDEMPDGFNKMWTYREMLLDSARNLRNCLGVGGMTARDRMLVYLITYILTPRSSNHAQMLESLYMVDYEFPYVVFAPRFIDYFNVNVLNEIMDFTKASSEITERHLKKLGMRFVDHEWIMTREAVVGNIEQVEEDAEVEAPSIESF

SEQ ID NO: 176942 - protein, 195 aa, Glycine max
  Coding DNA Sequence Number=SeqID_60164
MTKKLPYYPELVQVFYNNLEIHEGVIFFEVNKIPIVVDQSLFYSLTKLSSQCVPFEGTFVDDWKPIYSSLDSHKMHFKVPLTNEPSVKVKRSFTIGAIAVASFGYKKDLDGQWIHKQDYQENAPDERTPSPPPSDPSSALLNDVLNEIRDLRALMVKGLIPWILASLVLRMTWDLSATALILPPILSITISYINY

SEQ ID NO: 176943 - protein, 132 aa, Glycine max
  Coding DNA Sequence Number=SeqID_60165
MVIYATVWKEVVGLDIGGVKKSDEVDVSKDIINYTKASCEITERHLKKHGVRYANHECIMAYELAVGNIDEVERDDEAEAQHESAPQWSPFESLTIHKMDAMLYLHQEHSTEVHNFLENINTRLENIKTRPT

SEQ ID NO: 176944 - protein, 115 aa, Glycine max
  Coding DNA Sequence Number=SeqID_60166
MDVASDVALQYAHQPSKSTLALEHGHTILSSLTTGRQLGIIYKGSYTTVTTPTIKDPKLSHSIITRSPPQVLITEGTYSLTCEIVEPILAMSTLMSVNSKFCLQLKFKLTVNYFP

SEQ ID NO: 176945 - protein, 129 aa, Glycine max
  Coding DNA Sequence Number=SeqID_60167
MIPRVSSRMSHLMDYAGRKIAHNEILKDIVIEKDYPEIIVSECTHLLDFLYAMIAPKLEEQSDLVQLEDQHRDKEDNEKSIVNYAKQFLSEVWRDKEATKADDGNLSSDNVINKPPLMEEIVIPSVKEL

SEQ ID NO: 176946 - protein, 303 aa, Glycine max
  Coding DNA Sequence Number=SeqID_60168
  Subcellular localization annotation: CTP_CleavageSite=48; ConfidenceScore=5.23e-01
MGKSSEKPISSVALLAANNSDKKKMLSRNNFEPTNKDDSRPTRTCLVPTNKLSGPPMWMSSGLEIDLKGYLTHVALGYKDFMRLKHSFGDANPLVLLEEKNATLKIEAADVGLGYFPIHPLHVQHLLGLVREPQMVGTRRSGSEDEVPRQPMWDLGISQYTPFTPSTYWAWCVNHKWWVLVAAEANERYISCTPRIEAADVGLRYFPNMKKAYEDVAKLSEEYISCTPRIEAADRKRMRGPRVRACSDTIRCETWVFSQYTPFTPSTYWAWCVNHKWWVLVAAEANERYISCTPRIEAADVGL

SEQ ID NO: 176947 - protein, 56 aa, Glycine max
  Coding DNA Sequence Number=SeqID_60169
MERYKIASAKTFQEKLQNRKLEHMVDQLIRLEHRIRACYHRNFSLVHFDFLERGDK

SEQ ID NO: 176948 - protein, 183 aa, Glycine max
  Coding DNA Sequence Number=SeqID_60170
  Pfam annotation: Domain name=DUF584; Domain location=30-183; Score =129.0; E_value=1.3e-35; Accession=PF04520.4; Description=Protein of unknown function, DUF584
MASRKSFLSNPNRYIFPTTSDTHLSQTQEGMFELDEAELWNNHNHSSTTTDQGKKGLPSSGSRSVLKRASRNHNNNNGGRDRITTPASLPVNIPDWSKILKEDYKEHPKYWESEDEKEEEDDDDDEEHNNVVGEQNHGFRNIRVPPHVYLARTRGASLSVHEGIGRTLKGRDLRSVRNAIWKK

SEQ ID NO: 176949 - protein, 414 aa, Glycine max
  Coding DNA Sequence Number=SeqID_60171
  Homolog annotation: Hit_ID=Q10Q32; Match level="QueryCoverage=46%, HitCoverage=35%, E-value=4e-33, Identity=41%"; Hit description =Expressed protein
  Pfam annotation: Domain name=PPR; Domain location=276-310; Score =12.4; E_value=0.25; Accession=PF01535.11; Description=PPR repeat
  Pfam annotation: Domain name=PPR; Domain location=311-345; Score =15.9; E_value=0.099; Accession=PF01535.11; Description=PPR repeat
  Pfam module annotation: Pfam domain module=PPR::PPR; Domain location =276-310::311-345
MPLLLSFPFQFHTCLHKLCYCPFPRTNAYVSTRDNYLGIVFLSQSKYSIGSTGFHEATPLSRDTVAAVVDFGLCEEECDGSVVFEGSETVDTNPFVSKEELPPWGEVELEDGDVEIREEFDTSLVSEEQLHSWGEVELDDDDDRGVEGVNAYFVSKKELTPWGEAEEIDGGVDDNAEDNVERRVNGEAYFGAKKELPPWGEVEDAATDDFDNSVERRANGVVYFGAKEELPPWGEVEVEEDGHRDSRPVETTPSAIEGIGLMNEHGALFLEELDENVLSSRILVLSRTNKIRSAMEYFRSMELSAISPNIHACNSLISSLMRNGWFDDSIKVFNFTRAKGITTGHTYSLILMAHAKAHGCDSALRFFRELESECDVEKDFDAIVYNTMISTCRNVENWSEIERLWRSMKANGCA

SEQ ID NO: 176950 - protein, 56 aa, Glycine max
  Coding DNA Sequence Number=SeqID_60172
MPPSLSAEKGQSYPVPEKLTRGPTQCFSPNTPSEQTIICKILLLNIFLANCPMDIL

SEQ ID NO: 176951 - protein, 54 aa, Glycine max
  Coding DNA Sequence Number=SeqID_60173
MALGVMAARPGELLLQPEVFSIFFTEMLNDPSSCTVTGVEQLNSTSEDQKINKR

SEQ ID NO: 176952 - protein, 164 aa, Glycine max
  Coding DNA Sequence Number=SeqID_60174
  Gene Ontology: Mol. function=protein kinase activity; Biological process=protein amino acid phosphorylation
  Homolog annotation: Hit_ID=Q2QZ78; Match level="QueryCoverage=88%, HitCoverage=30%, E-value=4e-28, Identity=42%"; Hit description=AT hook motif-containing protein, putative
  Pfam annotation: Domain name=DUF889; Domain location=34-162; Score= -5.3; E_value=3.9e-11; Accession=PF05970.5; Description=Eukaryotic protein of unknown function (DUF889)
MVDKCYFEALDKTLRDIMRIIDEVDIAFRGKVIVFGGDFRQILPVIPRGMCSNIVHATINASSLWDHYFAKWILEIGDGNHGQPNDGYATIEIPPALLILKYIDPIDAIVQSTYANLTNHFMDPQFLQSRAILASINELVEQQNDYDLSIILGSLILLIFYPFT

SEQ ID NO: 176953 - protein, 227 aa, Glycine max
  Coding DNA Sequence Number=SeqID_60175
  Gene Ontology: Mol. function=nucleic acid binding; Cellular component= beta-galactosidase complex; Biological process=DNA integration
SSKGIVLTQRKYALSLLEDTGFLGCKPSSLPMYPNLKLSMLNGELLTDPSMYRRLLGHLMYLTISRPDITFVVNKLSQYMQNPRTPHLDVVHHLLQYIKGTPGQGLHFPTSNSFNLSAYADADWGSAWTHADQHLAEYRALSSISSEVIWLRRLLLHFEITIPSIMFFCDSKSVIDLASNPAHHERPKYIDIDYHFIRELVQSNILKLVHEVSYYGCIKGWKLVRIA

SEQ ID NO: 176954 - protein, 305 aa, Glycine max
  Coding DNA Sequence Number=SeqID_60176
  Gene Ontology: Mol. function=nucleic acid binding; Cellular component= membrane; Biological process=DNA integration
  Homolog annotation: Hit_ID=Q1SFD6; Match level="QueryCoverage=82%, HitCoverage=19%, E-value=1e-29, Identity=33%"; Hit description =Integrase, catalytic region
  Subcellular localization annotation: CTP_CleavageSite=52; ConfidenceScore=5.24e-01
MGAMDDSNPFLIQPSDNPGLSPMTHPLSSKNYNSWKKAIKMAFLGKNKFGFMDATLQQGSMSVSSYYSMLRSIWESISELKPRHSWTCNGICHWHDYVQMEYAMHFLMGLNESYGSIRGQILSIDPFPSITLIFSLVVQEEKQREIGASVSTFNSTNDASQSHAFAAKDSKYQSDHKFNANSKNQPLYAHCGRLRHTQDKCFKLHGFPPNYKKNKPSSSNTESKTVNQVSTPIYVPDFHLTAQQYGQLMSLLQAQTSNVVIPNIESSNTCMVLSAPLTKFPQKFWIVDSSASTHIVCSIDLFDSY

SEQ ID NO: 176955 - protein, 58 aa, Glycine max
  Coding DNA Sequence Number=SeqID_60177
MPIRSGSNMPITFTAESNYELVEVQKALLLEVEAYLASRLHFMEPDNGGDHDMVDGVE

SEQ ID NO: 176956 - protein, 102 aa, Glycine max
  Coding DNA Sequence Number=SeqID_60178
  Gene Ontology: Mol. function=transferase activity; Biological process= RNA-dependent DNA replication
  Homolog annotation: Hit_ID=Q1SI60; Match level="QueryCoverage=83%, HitCoverage=25%, E-value=5e-17, Identity=43%"; Hit description =Immunoglobulin-like
MITFYNIISPKINHFLWRVLRQCLPTRARLITKGVECPLHCYFCSQSYENEWHIFFACDKAKEVWQAAGLWHLIHPKAGSAEGFKDLLSTFSIIFNNMKFRS

SEQ ID NO: 176957 - protein, 56 aa, Glycine max
  Coding DNA Sequence Number=SeqID_60179
SGTGDNFLAPLIFETRQGRVLRFRNEGGISKYGPLVMPTQKRFGKKKNNECTTSIQ

SEQ ID NO: 176958 - protein, 697 aa, Glycine max
  Coding DNA Sequence Number=SeqID_60180
  Gene Ontology: Mol. function=endonuclease activity
  Homolog annotation: Hit_ID=Q5ZE24; Match level="QueryCoverage=95%, HitCoverage=72%, E-value=3e-68, Identity=31%"; Hit description =Endonuclease/exonuclease/phosphatase family protein-like
  Pfam annotation: Domain name=Exo_endo_phos; Domain location=14-683; Score=-9.3; E_value=0.047; Accession=PF03372.13; Description =EndonucleaseExonucleasephosphatase family
MGKGHCTQPYPSICKEAVSGFEVDRFHELEEELKPKGYSGIWKEHNTVKNTNKNEQIHAWKETCACVGTGTETCGCQKMPGLATILVSCGSQVGSKQSLTGSSKVVVCNIHVLYNPNRGEIKLGQVRVLLDKAKAVSKLWNDAPVAICGDFNCTPKSPLYNFISEQKLDLSGIDRNKVSGQASATIHASKLYYGPNSSEISANGSVQATSTEGDKEDIEQNNSRLDTRDLDTKCHSLDNQHTQTVSDMSVNSCTNVDCGKESDAYAGKDTQETSVDHSKVSCEVGSIKEPNPSYSEGRIHIDHVNGDIHDITPVTFSAPEEVHSDATWLGSNEHIPNAVPTSNKELLIEESNLHVPEGNKHVEFDCAPTSLQEDDQSSKMRIDLESIDLDNIEISSTKPSSQTSVSCVFEDEDSPSHEEIDNDQNNSSSTSYLVDKLHHLSNITFPPDMKEKSFFDEMDKTIIGGESEDGSRFVSSLHNAGEVAFDLGSSMKSDLEKPYQSEELDSASNNLLLPVESIEMEDYLSPRQISESINSEQATYTPALWTPMEIETATGNADCTFLEHPLQLRSTYTEAMDCSGTRDPHGEPLVTSYNRRFLGTVDYIWRSEGLQTTRVLAPISKHAMQWTPGFPTKMDGVHKWVFWDFSFTRYHYVLPPTQIRGYCCEVATSEKWGSDHIALVTELAFLKDSTDTSNDVK

SEQ ID NO: 176959 - protein, 162 aa, Glycine max
  Coding DNA Sequence Number=SeqID_60181
  Gene Ontology: Mol. function=DNA binding; Cellular component =chromosome; Biological process=chromosome organization and biogenesis (sensu Eukaryota)
  Homolog annotation: Hit_ID=Q9C944; Match level="QueryCoverage=60%, HitCoverage=73%, E-value=1e-45, Identity=93%"; Hit description =Probable histone H2A variant 3
  Pfam annotation: Domain name=CBFD_NFYB_HMF; Domain location=63-128; Score=10.6; E_value=0.016; Accession=PF00808.13; Description=Histone- like transcription factor (CBFNF-Y) and archaeal histone
  Pfam annotation: Domain name=Histone; Domain location=57-131; Score =76.5; E_value=8.5e-20; Accession=PF00125.14; Description=Core histone H2AH2BH3H4
  Pfam module annotation: Pfam domain module=CBFD_NFYB_HMF::Histone; Domain location=63-128::57-131
MTGHVQISLVNMEGPWTNVCLLVVLPILVEVGVCVYVQSMLSSFGAFGWSVVLVSLRRFFGPFLFPVGRIHRLLKSRVTAHGRVGATAAVYSAAILEYLTAEVLELAGNASKDLKVKRITPRHLQLAIRGDEELDTLIKGTIAGGGVIPHIHKSLINKSSKE

SEQ ID NO: 176960 - protein, 342 aa, Glycine max
  Coding DNA Sequence Number=SeqID_60182
  Gene Ontology: Mol. function=nucleic acid binding
GTSFVVQVEGTSTWVVVTENQRGYISCGSVQVEGTSTWLFKENKGGYIPCGSLLVKVFTRLKEISRTAGCLGTGCRHGLLPNQILEAREQPIVAMLEWIRVYTMTRFAKNRKLGEKQKAKGQKVCPRPMKRLDQEVLAYSKWSVVWGGGPKFEVQKYPLAFKVDLDEKSCSCRNAMAAMFDRRLLPSDSVHPYYHVNTYINCYAPILEPINGEDMWQQTGLPTVLPPQVRVPIGIPKKARRRENDEAPKPHKLKRTNTSLRKTKPLQQVSKPNPPALNNLILNHSKQAICTLNNLKPKHQQLQKATLGPNYRSRVKASNEGKASHHPTTIARCCEECILEEN

SEQ ID NO: 176961 - protein, 49 aa, Glycine max
  Coding DNA Sequence Number=SeqID_60183
MTLFHSPPPSHKLSNPTTQVPKNVVIVDAKARACSGPGAIDGHNGEGES

SEQ ID NO: 176962 - protein, 485 aa, Glycine max
  Coding DNA Sequence Number=SeqID_60184
  Gene Ontology: Mol. function=nucleic acid binding; Cellular component= nucleus; Biological process=DNA integration
MSTTEQQIFYRQLGIRLDKDLVKVWNDDGARKIVKIVMDLIQKHVEVYIDHTSHMTEGVLLTIDEGGKPIVEGDLGNDVIDGKDSDGKVDKVDLDDRDKETDEDKGDDDNYDENDSDDEDDLDAKYDTDKLESNIASEEDDDYYALTIAPINGKDISIKPVSKRFQPHEMGRDFNFEVGMEFDSISQFKAVIKEYANLHGFGVKFKKNDNVRCRVICQDGCQWVAYVSKVGGSTTYSMKTYNEKHTCARSSGGKLASSKWIAEKLIEPLKYTPNMSINAVIQKVSERYYVKISSKKAYWARRIAKEKVQGNYAKQYNKLWDYANEVRRSQPDSMLLLLTEPSAYGSGELFMRFYMCHVVKQGFLQACRPIIGLDDCFLKTPFGGILLVAMGQDPNDQYYPLNVVVVESENKDSWKWFLQNLLNDIGHEKKWVFILDQQKVSKEAHDWLMQLDLRFWSKAHMSEYSRCDMIMNNIVEASFIMMNQV

SEQ ID NO: 176963 - protein, 300 aa, Glycine max
  Coding DNA Sequence Number=SeqID_60185
DSQSELVDVKMGDCLEEMICDLGQESFQQAQARMYDTLQSDSKKPLYSGKTIGVNVEDDDSTLESCLTLFSKKMSRNVNGEEEVDDILANRNDHDEGELINIVHMVTPPSSPPPPPESATPSSSSSSKKTRKATQLRSLATRPIEVKRTVVHVDPVTRKVDERWRQIKLNLTSKWALTHSKEGEDDKVYEKYEIRKEIVASFVRAIEILHGRKHRPFRNKTLHLKCCLDSLEEQASQGSFVTHGRQDVLTIAINRPKHPSHVHATEANVMIKYYFGPAPRGSRTSSSMAIEDLEQLTQKI

SEQ ID NO: 176964 - protein, 101 aa, Glycine max
  Coding DNA Sequence Number=SeqID_60186
MECKKKQGRCRKYLRHSSKMHTRKRISATSTLSALPRISKTVRDWRLAHPAAKPNYESSIPEWIWGLAQDNTLSAAINFSKEEVALSASSPPSPLLKVYFQ

SEQ ID NO: 176965 - protein, 85 aa, Glycine max
  Coding DNA Sequence Number=SeqID_60187
  Subcellular localization annotation: CTP_CleavageSite=67; ConfidenceScore=5.40e-01
MPTFCVCAFCCCASSTFCIFLASSCIPSQSKLSANMLLFFSPLNKAKRSCYAKPLLCVKEVELSAPCCAKLNSLTAKRESAALSP

SEQ ID NO: 176966 - protein, 338 aa, Glycine max
  Coding DNA Sequence Number=SeqID_60188
  Gene Ontology: Mol. function=voltage-gated potassium channel activity; Cellular component=membrane; Biological process=potassium ion transport
  Homolog annotation: Hit_ID=Q1S419; Match level="QueryCoverage=99%, HitCoverage=39%, E-value=1e-100, Identity=55%"; Hit description =Cyclic nucleotide-binding; Ion transport protein
  Pfam annotation: Domain name=Ank; Domain location=132-164; Score =47.5; E_value=4.4e-11; Accession=PF00023.20; Description=Ankyrin repeat
  Pfam annotation: Domain name=Ank; Domain location=2-34; Score=6.8; E _value=3.3; Accession=PF00023.20; Description=Ankyrin repeat
  Pfam annotation: Domain name=Ank; Domain location=35-67; Score=39.7; E_value=9.7e-09; Accession=PF00023.20; Description=Ankyrin repeat
  Pfam annotation: Domain name=Ank; Domain location=68-100; Score=30.9; E_value=4.5e-06; Accession=PF00023.20; Description=Ankyrin repeat
  Pfam module annotation: Pfam domain module=Ank::Ank::Ank::Ank; Domain location=132-164::2-34::35-67::68-100
MDLPISLLFAASRGDDMLLQQLLKKGSDPNEPDKNGKTALHITASKGRDHCVALLLEHGANPNIKDLDGNVPLWEAIKGGHDSVMKLLIDNGADISSGDVGSLACVGVEQNNLELLKHIVQCGGDVTQSTSNGTTALHAAVCEGNVEIVKFLLEHGADIDKQDGSGWTPRFLADQQCHEEIINVFKKVGHKKTPHAIPTTSFFERYQSEPTIPGIPQGSKPPNEEPTWFDNHQRRRVSPFHNSFFGIMSNANYDKKDSTTASQSSHISREELLARVTLSCPKKGEHAKKLIFLPKSLEELLHIGAEKFDYSATRILSKEGAEIEDIYVIRDGDLLILA

SEQ ID NO: 176967 - protein, 134 aa, Glycine max
  Coding DNA Sequence Number=SeqID_60189
  Gene Ontology: Mol. function=voltage-gated potassium channel activity; Cellular component=integral to membrane; Biological process=potassium ion transport
  Homolog annotation: Hit_ID=Q5NT80; Match level="QueryCoverage=70%, HitCoverage=10%, E-value=3e-25, Identity=64%"; Hit description =Potassium channel NKT1
MSSSRQRKTKMFGMCGGDYNDDDKDDADKREIDEAREDGSQYSLTGILLPSLGATAVRNDSGRPKLRRYIVSPYNRRYKLWNKFLLILVFYTAWMCPFEFGFLEKSMGAVAITDNVVNGFFCHRHCSHLLRCLP

SEQ ID NO: 176968 - protein, 59 aa, Glycine max
  Coding DNA Sequence Number=SeqID_60190
MAIYLAWNFFSYSCLTVHVQERELASGNSLRGYIHLVDLAGSYKGNRKLSLRVLQHSPN

SEQ ID NO: 176969 - protein, 55 aa, Glycine max
  Coding DNA Sequence Number=SeqID_60191
MVIDYNFQNSNFKTLSKSRFAKLSSGDQTCEEEQRSGGVKEFKWWWHMGAQAIVA

SEQ ID NO: 176970 - protein, 86 aa, Glycine max
  Coding DNA Sequence Number=SeqID_60192
  Gene Ontology: Mol. function=structural constituent of ribosome; Cellular component=ribonucleoprotein complex; Biological process =translation
  Homolog annotation: Hit_ID=Q9ZNS1; Match level="QueryCoverage=58%, HitCoverage=33%, E-value=1e-12, Identity=65%"; Hit description=40S ribosomal protein S7
MFITRILYMHRTLPFQDVILIATRRIVRPPKKGSDVQAMLEDIILAAEIVGKRVRYRIYGSKIMKVKITTINSALTHAICGNLKVA

SEQ ID NO: 176971 - protein, 114 aa, Glycine max
  Coding DNA Sequence Number=SeqID_60193
  Gene Ontology: Mol. function=nucleic acid binding; Cellular component= nucleus
  Homolog annotation: Hit_ID=Q0PJL8; Match level="QueryCoverage=54%, HitCoverage=26%, E-value=1e-18, Identity=89%"; Hit description=MYB transcription factor MYB52
MKRMRTFFSITVAVSEGGDIGGVIGQVTLGGGAQERFRFPMLALFLMIDPSVSLTSKSFTPPPPREGHVRGVMAVVVAIILLRAIRGGVVVLQRRGEDAKRSVGGTKREGFVVV

SEQ ID NO: 176972 - protein, 92 aa, Glycine max
  Coding DNA Sequence Number=SeqID_60194
  Gene Ontology: Mol. function=protein serine/threonine kinase activity; Biological process=protein amino acid phosphorylation
  Homolog annotation: Hit_ID=O24431; Match level="QueryCoverage=76%, HitCoverage=13%, E-value=3e-23, Identity=76%"; Hit description =Calmodulin-like domain protein kinase isoenzyme gamma
MASFIQRIKDFKYIRLGYGALTLGKELGRGQSRVIYLCTEDSIGLQYAYKSILRRKFMSKADKEDMKREIQIMQHLSGQSNIVEFKSPFEDK

SEQ ID NO: 176973 - protein, 63 aa, Glycine max
  Coding DNA Sequence Number=SeqID_60195
MQRRSFWNLANFFDTFAYQTAALSEQETRLVSQQGSLSRLRLGLARGYVRFARYADQKSCNSR

SEQ ID NO: 176974 - protein, 46 aa, Glycine max
  Coding DNA Sequence Number=SeqID_60196
MFGLDEIEEMCETITKLNVELLAKAYKERTLEEKMLQLMENHDQQS

SEQ ID NO: 176975 - protein, 67 aa, Glycine max
  Coding DNA Sequence Number=SeqID_60197
MGSASRVESSNYSYYFKENGTRWHRIIYTTFLQIQELFLSKETLGTEPLPIVRGMTYILLGEYGAYL

SEQ ID NO: 176976 - protein, 194 aa, Glycine max
  Coding DNA Sequence Number=SeqID_60198
  Gene Ontology: Mol. function=oxidoreductase activity, acting on NADH or NADPH, quinone or similar compound as acceptor; Cellular component=photosystem II; Biological process=electron transport
  Homolog annotation: Hit_ID=Q9M3I5; Match level="QueryCoverage=99%, HitCoverage=62%, E-value=9e-88, Identity=88%"; Hit description =NAD(P)H-quinone oxidoreductase chain H, chloroplast (EC 1.6.5.-) (NAD(P)H dehydrogenase, chain H)
  Pfam annotation: Domain name=Complex1_49kDa; Domain location=110-194; Score=-144.6; E_value=0.0074; Accession=PF00346.9; Description =Respiratory-chain NADH dehydrogenase,
MGPHHPSMHGVLRLIVTLDGEDVIDCEPILGYLHRGMEKIAENRTIIQYLPYVTRWDYLATMFTEAITVNGPEQLGNIQVPKRASYIRVIMLELSRIASHLLWLGPFMADIGAQTPFFYIFRERELIYDLFEAATGMRMMHNFFRIGGVATDLPYGWDPCFGLPEYNGISVKWIIMNVTKNLIGKFNGKKKEIP

SEQ ID NO: 176977 - protein, 119 aa, Glycine max
  Coding DNA Sequence Number=SeqID_60199
  Homolog annotation: Hit_ID=Q4KHV2; Match level="QueryCoverage=36%, HitCoverage=12%, E-value=5e-17, Identity=93%"; Hit description =General amino acid ABC transporter, permease protein
MHAFGQEQGQHHRGHEQHGDQRHTAPELDEGDADDLDRRQVGTSPQCQQDTQIKLIDTVDLEGGPVGKPVVPAALMNRPTRGERRFAYWALAECILAYYVGTDEGVSEVLHVAGEKRLH

SEQ ID NO: 176978 - protein, 278 aa, Glycine max
  Coding DNA Sequence Number=SeqID_60200
  Gene Ontology: Mol. function=transporter activity; Cellular component= 1-2nm peptidoglycan-based cell wall; Biological process=transport
  Homolog annotation: Hit_ID=Q4KHV2; Match level="QueryCoverage=41%, HitCoverage=31%, E-value=4e-55, Identity=93%"; Hit description =General amino acid ABC transporter, permease protein
  Pfam annotation: Domain name=BPD_transp_1; Domain location=7-197; Score=15.6; E_value=0.0012; Accession=PF00528.12; Description =Binding-protein-dependent transport s
MKHFTDTLISANIGTKAGTGPPLEVDGIDKLDLGILLALGRRSNLPAIKVICVTFIEFWRGVPLITVLFMSSVMLPLFLPEGMHFDKLMRALIGVILFQSAYIAEVVRGGLQAIPKGQYEAAAAMGLGYWRMMGLVILPQALKLVIPGIVNVFISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 176979 - protein, 113 aa, Glycine max
  Coding DNA Sequence Number=SeqID_60201
MSSSINQGIPHRRIAQSSKVQGRSALVQAEAFAKVMDDTLVRGIIIDLTTTGVMDETPKASNTTLANKVELNALEPGSKQSTTSNEGAFRDKDELDVAIIYSTSLGPTPLNYA

SEQ ID NO: 176980 - protein, 256 aa, Glycine max
  Coding DNA Sequence Number=SeqID_60202
  Gene Ontology: Mol. function=transferase activity, transferring nitrogenous groups; Cellular component=intracellular; Biological process=biosynthetic process
  Homolog annotation: Hit_ID=UPI00003CCD49; Match level="QueryCoverage =54%, HitCoverage=34%, E-value=3e-34, Identity=55%"; Hit description =COG1167: Transcriptional regulators containing a DNA-binding HTH domain and an ...
  Homolog annotation: Hit description=aminotransferase domain (MocR family) and their eukaryotic orthologs
VPPVQLLTGWCVTAKAPPDISAGKCSGHAARRVPFAIQAAQLLGRAIGAGLFAITPAGERGMCCKAIKLGGRFDQQAAVLVDQHLGDQIQPLLAAGGDQHLIGRHGGTLLAQLGGDPLAQLGQAFAGRVLQRRLGDHAAFGQHAGAGGAHGFDGEGLGRRQAAGKVEDAGALGHLQDLADRRGVHGVGTIKLIDTVDLEGGPVGKPVVPAALMNRPTRGERRFAYWALAECILAYYVGTDEGVSEVLHVAEKKGCT

SEQ ID NO: 176981 - protein, 157 aa, Glycine max
  Coding DNA Sequence Number=SeqID_60203
  Gene Ontology: Mol. function=RNA-directed DNA polymerase activity; Biological process=RNA-dependent DNA replication
MEEMGKLDHLKERLRAIEGSEDYAFANLEELFLVPNIITPPKFKVPDFDKYKGTTCPKNHLKTCCQKMVAYAKDEELLIHFFQESLTGVAVTWYANLEPSRVHSWKDLTVVFVRQYQYNFDMVLDRMQLQNMCKNGHGYFKEYAQRWRDLPAQVAPQ

SEQ ID NO: 176982 - protein, 134 aa, Glycine max
  Coding DNA Sequence Number=SeqID_60204
  Homolog annotation: Hit_ID=Q9AY32; Match level="QueryCoverage=44%, HitCoverage=90%, E-value=2e-25, Identity=96%"; Hit description=RRNA intron-encoded homing endonuclease
STLEDPTRSWTLGWVDRSASGVHRSARPFCRRCAPVLNWPGRASGADSDPIVLAFGIGVMINRDSRGHSYFIVRDTVLVSTINDADQGSADVAFRTPLAPYEKSKSLGSGGSMVARLKLKGIDGRAPPGVEPAA

SEQ ID NO: 176983 - protein, 291 aa, Glycine max
  Coding DNA Sequence Number=SeqID_60205
  Gene Ontology: Mol. function=transferase activity
  Homolog annotation: Hit_ID=P0ACA1; Match level="QueryCoverage=66%, HitCoverage=95%, E-value=3e-49, Identity=50%"; Hit description =Hypothetical GST-like protein yibF
  Pfam annotation: Domain name=GST_C; Domain location=186-283; Score =43.2; E_value=9e-10; Accession=PF00043.15; Description=Glutathione S- transferase, C-terminal domain
  Pfam annotation: Domain name=GST_N; Domain location=91-162; Score =15.7; E_value=0.027; Accession=PF02798.10; Description=Glutathione S- transferase, N-terminal domain
  Pfam module annotation: Pfam domain module=GST_C::GST_N; Domain location=186-283::91-162
MKLNTSDKMLKEVEQSVIPLLAERYQNIQTTKEENFSVGKQKFRRVYSEQTVNGQKVVSTLVLSVFNKRVVTLQMLSPAKTPEVHQALVQQIIDTLAVNPFVRKISVMLLEKGIAFEFVNDPPYEPGSRVKELNPLGKVPVLIADDGEVFYDSPVVAEYLELLTVEPAFLPADRAAALRVRQVAALADGVTEAAATLFRESRRAPEKQDENWMLRQRDKLTHGLDALEALARDKTWLNAERLTLADIATGCALGYLNFRRILPNWCVGRPALVKLAERLFARESFARTAPP

SEQ ID NO: 176984 - protein, 905 aa, Glycine max
  Coding DNA Sequence Number=SeqID_60206
  Gene Ontology: Mol. function=formate dehydrogenase activity; Cellular component=cytoplasm; Biological process=cellular respiration
  Homolog annotation: Hit_ID=Q663U7; Match level="QueryCoverage=67%, HitCoverage=59%, E-value=0.0, Identity=88%"; Hit description=Formate dehydrogenase-O, major subunit (Formate dehydrogenase... precursor (EC 1.2.1.2))
  Pfam annotation: Domain name=Sod_Fe_C; Domain location=829-899; Score= 51.9; E_value=2.6e-13; Accession=PF02777.8; Description=Ironmanganese superoxide dismutases, C-term
  Pfam annotation: Domain name=Sod_Fe_N; Domain location=739-827; Score= 179.7; E_value=7e-51; Accession=PF00081.12; Description=Ironmanganese superoxide dismutases,
  Pfam module annotation: Pfam domain module=Sod_Fe_C::Sod_Fe_N; Domain location=829-899::739-827
RFARGVRAFPVPLQPAAGVDDRAVLFGEAGGWQAEHFGLDLRRIHLVELAVVLPEVGGLGVQRIDGHQELQLGQRSHHLVFVRERRHRVKALAEVAVDLALRHHLEVLQHVVAFVPLRQPVKAPAVVLLRLVAVEGLHHADEEFRVVAPVVNLARQQRLRRVGLQVGVEIGLFLRRQRQVARQALRQQAEIGQTLNVGVATQRVDAAARHAHVAEQQLDHRHGADVLRADRVLSPAQGVQERSGFIRDAGFGDVFAHLEEIVLRRAADVGHHVRRVAAHVLFQHVPHAARILQRDVALGEAVLVELVVPGGFVVLAVFRVVAAEQAVFEGKIFPHQQAGVGVGLDVLAVELVVGHQIQQHARQESDVGPGADRRVEVRHRCGSGKARIDHDQLGIVVYFGFHRPAEPHRMRFRRITAHDDNQIRVLDINPVVGHRTATKCWSKTCYRWSVSDTRLVVYGKHAESATKFLRQKTGFVAGGRGAQHAGGQPTVDGNALIVGFDEVGVAVFFHQLGDAGKGVVPADALPFVRSWRPVFRVLEAAFAVDEVNQAGAFRAKRAAVYRMIRIPFDMENAFFGVFGAITKAVHQQPTADGTIRTGITGLAGAQHAATVVPAIPPAQILKNCLLLTCMGVSFTLDCHIVQRRLPASAANANVTVVMLATNAGHITTACLWLLHTRAHSVNALAHFDTFRRWRSLQYRDSQGIDNHFQYHLINYNDPTAYAVLTLCAAHTPLEMMIMSYSLPSLPYAYDALEPHFDKQTMEIHHTKHHQTYVNNANTVLEAYPELAKYSVEELIQDLDKVPADKRTFMRNNAGGHANHSFFWKNLKTGTTLGGDLKAAIERDFGSVEKFQEEFEKAAATRFGSGWAWLVLKDGKLAVVSTANQDSPLMGEAVAGASRFPIIDLD

SEQ ID NO: 176985 - protein, 141 aa, Glycine max
  Coding DNA Sequence Number=SeqID_60207
  Gene Ontology: Mol. function=DNA binding; Biological process =regulation of transcription, DNA-dependent
  Homolog annotation: Hit_ID=Q7CFP8; Match level="QueryCoverage=99%, HitCoverage=76%, E-value=1e-52, Identity=73%"; Hit description =Repressor for mtl
  Pfam annotation: Domain name=MtlR; Domain location=1-129; Score =165.1; E_value=1.8e-46; Accession=PF05068.3; Description=Mannitol repressor
VFRKDDYAVKYAVEPLLSGSGPLGELSVRLKLMYGLGVISRHEYEDAELLMAMREELNHDGAEYRFVDDEILGPFGELHCVAALPPAPTFLQPGEADEALIAMQRQRYQQMVRSTMVLSITDLIAGIGAKQPSRLSPLGRG

SEQ ID NO: 176986 - protein, 408 aa, Glycine max
  Coding DNA Sequence Number=SeqID_60208
  Gene Ontology: Mol. function=transferase activity, transferring nitrogenous groups; Cellular component=intracellular; Biological process=regulation of transcription, DNA-dependent
  Homolog annotation: Hit_ID=UPI00005F88D5; Match level="QueryCoverage =55%, HitCoverage=46%, E-value=1e-66, Identity=61%"; Hit description =COG1167: Transcriptional regulators containing a DNA-binding HTH domain and an ...
  Homolog annotation: Hit description=aminotransferase domain (MocR family) and their eukaryotic orthologs
  Subcellular localization annotation: CTP_CleavageSite=37; ConfidenceScore=5.41e-01
MTPLNARSFQATWSALRNRSPSTAHSSTQGKFSTTKPAMTLSDRHVDHHQPGLGVDRLKQRAVEETHWPHLLFGQVGAADHRQREADDAGPAERQRQQRDNDSQLHRAAGADAEQHRQGAAQAEVDARRGQQQVVGAGGNRHDGDVADKGGVQHGRFLENDGNNERISIIAAMGETVTLLDETPDTRYLQLADTLAEAIRRGTLLPGDRLPSVRRCAQTHRHAAGAEDGLGAQRPHRAAGGRRAGADRYCVRRPAESGLHQHCAGLPADQRFLSRRQAGAHAVLSAAPSTGSDRTVFVAARQPAAASADRPPFDDAGHAAGAGRRGADPRLHGGVAAGAARHHQTGRLRRAGVTDLLLPAAAAGQPGAESAGNPHRSAAGAVAGRAGAAIERDSAERGDCHAHGQNPL

SEQ ID NO: 176987 - protein, 97 aa, Glycine max
  Coding DNA Sequence Number=SeqID_60209
  Subcellular localization annotation: CTP_CleavageSite=64; ConfidenceScore=5.69e-01
ATTTATTTISHRFLAPPTPLGNTSPRIASRSSPSSRNLRPSLLCRYAVMILVKCIILLVALDVVKSAGDGFFRRFYTSFAPSTLEISFNFTMASSIS

SEQ ID NO: 176988 - protein, 118 aa, Glycine max
  Coding DNA Sequence Number=SeqID_60210
  Homolog annotation: Hit_ID=Q4J923; Match level="QueryCoverage=100%, HitCoverage=49%, E-value=5e-42, Identity=66%"; Hit description =Conserved Archaeal protein
MPVSYEVLTKFIGQKVKDIYGREFGYLIHVYSEIDGSITGIEVAQGSSILTMGPERIKLDGDSILILPDWKAEAIRILSLMEKIRKRQRALEELYNKQEIPKSDYDDMKRKLDTEMLK

SEQ ID NO: 176989 - protein, 82 aa, Glycine max
  Coding DNA Sequence Number=SeqID_60211
MEQKEVGDIVGDKPQSVTIIIFRDQAMPHHCWWNPNVANISIMSSLAAKASLKKPHTTAWVVRDFMRWVHKFSSIMTLQSKA

SEQ ID NO: 176990 - protein, 172 aa, Glycine max
  Coding DNA Sequence Number=SeqID_60212
  Gene Ontology: Mol. function=acyltransferase activity; Cellular component=endoplasmic reticulum; Biological process=triacylglycerol metabolic process
  Homolog annotation: Hit_ID=Q1MW30; Match level="QueryCoverage=87%, HitCoverage=30%, E-value=1e-59, Identity=74%"; Hit description =Diacylglycerolacyltransferase-1b
MYLHPSYPRTPYIRKGWLFRQLVKLIIFTGVMGFIIEQYINPIVQNSQHPLKGNLLYAIERVLKLSVPNLYVWLCMFYCFFHLWLNILAELLRFGDREFYQDWWNAKTVEDQNDFQVSCWDEIHVNTPCSQMDDPPPIFSMFKARYTKGFVSLCLPSRVATKIITFNIVELK

SEQ ID NO: 176991 - protein, 61 aa, Glycine max
  Coding DNA Sequence Number=SeqID_60213
  Gene Ontology: Mol. function=protein serine/threonine kinase activity; Cellular component=barrier septum; Biological process =protein amino acid phosphorylation
  Homolog annotation: Hit_ID=Q8LR51; Match level="QueryCoverage=62%, HitCoverage=8%, E-value=1e-14, Identity=100%"; Hit description =Casein kinase I-like
MEPRVGNKFRLGRKIGSGSFGEIYLGTNIQTNEEVAIKLMSSIISELIPASYFLEGDEVPS

SEQ ID NO: 176992 - protein, 358 aa, Glycine max
  Coding DNA Sequence Number=SeqID_60214
  Gene Ontology: Mol. function=sequence-specific DNA binding; Cellular component=nucleus; Biological process=regulation of transcription, DNA-dependent
  Homolog annotation: Hit_ID=P41152; Match level="QueryCoverage=92%, HitCoverage=90%, E-value=2e-63, Identity=40%"; Hit description=Heat shock factor protein HSF30
  Pfam annotation: Domain name=HSF_DNA-bind; Domain location=23-185; Score=214.3; E_value=2.8e-61; Accession=PF00447.8; Description=HSF -type DNA-binding
MTAPLTGRRRRKPMEGLHEVGPPPFLKKTFEMVEDPHTDPIVSWSQTRDSFIVWDSHEFSKSLLPKYFKHSNFSSFVRQLNTYGFRKVDSDRWEFANEGFQGGKKHLLKNIRRRCKYNKLHQGAFNMMKPCVDSEVEKLKKDQNILKVEILKLRQQQENSHVQLTNVQERIRCAEVKQYQMMYFLTRMARRPAFVEQLVHKIRRKREIDGNEMVKRPRLMGTPCHVPFPKTMETTPDFDHRHQQGHKQFATLQSELNGLLSETVNTGRMEHPTPSPLEDELCSSLQGLRAHGISRASAQDASSSAYHVMSEKLMRENSIVDEELDVNDSNIYLELEDLITKPTDWSVGSASGLVEQTS

SEQ ID NO: 176993 - protein, 60 aa, Glycine max
  Coding DNA Sequence Number=SeqID_60215
MTSFPLSLYHERNLPLQQRSKPEADVVWELGESPMGCDVGEVRGREMHDDKGIKEVTIVK

SEQ ID NO: 176994 - protein, 44 aa, Glycine max
  Coding DNA Sequence Number=SeqID_60216
MREESGVSLRLSISGNSVRQPRFHASYFLFLATCTDIIKLRQLR

SEQ ID NO: 176995 - protein, 39 aa, Glycine max
  Coding DNA Sequence Number=SeqID_60217
MAIFSVMVMDMHGFKLGIIGTSQILSFSSKVKLMVDDAG

SEQ ID NO: 176996 - protein, 145 aa, Glycine max
  Coding DNA Sequence Number=SeqID_60218
  Gene Ontology: Mol. function=sequence-specific DNA binding; Cellular component=nucleus; Biological process=regulation of transcription
  Homolog annotation: Hit_ID=Q1RWH4; Match level="QueryCoverage=80%, HitCoverage=25%, E-value=2e-33, Identity=55%"; Hit description=WRKY DNA-binding domain, putative
  Pfam annotation: Domain name=FLYWCH; Domain location=2-63; Score= -0.1; E_value=0.073; Accession=PF04500.7; Description=FLYWCH zinc finger domain
  Pfam annotation: Domain name=WRKY; Domain location=28-65; Score=41.0; E_value=4.2e-09; Accession=PF03106.6; Description=WRKY DNA -binding domain
  Pfam module annotation: Pfam domain module=FLYWCH::WRKY; Domain location=2-63::28-65
MGKKACQQTYLRRRETQLGEGKEYKCMNYYRCTSAGCPVRKHIETAVDNSDAVIITYKGVHDHDMPVPKKRHGPPSAPLVAAAAPASLNSLQVKKSDSPQNKKISTQWSVDTEGELTGEALELGGEKAMESARTLLSIGFEIKPC

SEQ ID NO: 176997 - protein, 52 aa, Glycine max
  Coding DNA Sequence Number=SeqID_60219
MISWKLYLLDVLLKHNWENFGGVDDAEELKKKGFRKVGLEVPGILSHSEDEH

SEQ ID NO: 176998 - protein, 134 aa, Glycine max
  Coding DNA Sequence Number=SeqID_60220
  Homolog annotation: Hit_ID=Q9AWW1; Match level="QueryCoverage=67%, HitCoverage=28%, E-value=2e-23, Identity=54%"; Hit description =Esterase/lipase/thioesterase family protein-like
MIGQLISLPGGLSSLEYTLSMESDGSFQYGYYWREAEDLRAVIQHFHESNRGVSAIVGHSKGGGVVLLYASKYHDIKTVVNLSGRYDLKVGIEERLGKDHIERIRKDGFIDVTRILKMKIKMQTISTIFFKYAR

SEQ ID NO: 176999 - protein, 295 aa, Glycine max
  Coding DNA Sequence Number=SeqID_60221
  Gene Ontology: Mol. function=hydrolase activity
  Homolog annotation: Hit_ID=Q9AWW1; Match level="QueryCoverage=81%, HitCoverage=69%, E-value=4e-55, Identity=46%"; Hit description =Esterase/lipase/thioesterase family protein-like
  Pfam annotation: Domain name=PGAP1; Domain location=76-246; Score= -80.9; E_value=0.0093; Accession=PF07819.3; Description=PGAP1-like protein
  Subcellular localization annotation: CTP_CleavageSite=46; ConfidenceScore=5.10e-01
MITVLTGPVGTLPHQVFESRKHSQPIFSDFSRKLVRISRKTLSLKMAQAAQNPTRQQKVIITNKYGNKLVGILHESGTKEIVILCHGLRSTKEDDIIINLAAALENAGVNSFRFDFTGNGESEGSFEFGHYWREVDDLHDVVQHLHRENPKVIAIIGHSKGGSVVLLYASKHHDIKTVVNLSGRYDLKAGLEERLGKDYLERIRKDRFIDVMQLGNLSFNHTKVPWLLEHVEVFDYRVTMESLMDRLDTNMHEACLQIDKECRVLTVHGSSDPVIPVGDASEFAKIIPNHKLIII

SEQ ID NO: 177000 - protein, 156 aa, Glycine max
  Coding DNA Sequence Number=SeqID_60222
MHKALRANAHLPYPQLVTLYLQDFNIPLDDESFVKVKCSFAIGAAVVASFGYRKDIDGQRVRKQDLPPTPNERTPSPPPQRNSSSSLLQDVLSELQGSGFCWGRDIRKGSERAAQRYFLYSFQMVVIIKKGENVNSHDPSKHNCVIDYQEAIIDYQ

SEQ ID NO: 177001 - protein, 344 aa, Glycine max
  Coding DNA Sequence Number=SeqID_60223
  Gene Ontology: Mol. function=cytokinin dehydrogenase activity; Cellular component=endoplasmic reticulum; Biological process =electron transport
  Homolog annotation: Hit_ID=Q9LTS3; Match level="QueryCoverage=97%, HitCoverage=60%, E-value=2e-97, Identity=52%"; Hit description =Cytokinin dehydrogenase 3 precursor
  Pfam annotation: Domain name=Cytokin-bind; Domain location=71-343; Score=482.2; E_value=6.1e-142; Accession=PF09265.1; Description =Cytokinin dehydrogenase 1, FAD and cyto
MYYIFNGCGKGDLVTCSAENNSELFYAVLGGLGQFGIITRARIALGPAPTRANNFKEKTKTDKFHAYIWLVKWLRLLYNDFSAFSGDQEHLISFNGINETNAADYVEGFLLQNQPPLDLSFYPEPDHPRITSLVTQYGIIYVIELVKYYDNSTQEHVDEDVNFWVEELKFVPTFMFEKDVSYEEFLNRVHADELFLRSQGLWDIPHPWLNLFVPASRISDFDEGVFKGIILQQNITAGLVIIYPMNRTKWDDNMSAVTPHDDVFYVVSFLHSTGFDKLEEFQAQNQQILQFCANAGIGIKQYLPQNKTQEEWEKQFGPKWKTFKERKAQFDPNSILSPGQGIFN

SEQ ID NO: 177002 - protein, 159 aa, Glycine max
  Coding DNA Sequence Number=SeqID_60224
MKGAFPSIFEVKKRNTKLEFGNFTIPPLLVNLNLMKEAWPVRYLHSLWSVKLRCLVRTRNSEFDSGVALGLGRKKSHTVWKKNNSMELVEAPWHNNYSLYHMEWNRIKPLYYFTIFRSLLLAAPPKTPKQTKLPLQPTTQASNSNVGKKVQMESKMKTK

SEQ ID NO: 177003 - protein, 552 aa, Glycine max
  Coding DNA Sequence Number=SeqID_60225
  Gene Ontology: Mol. function=cytokinin dehydrogenase activity; Cellular component=endoplasmic reticulum; Biological process =electron transport
  Homolog annotation: Hit_ID=Q9LTS3; Match level="QueryCoverage=96%, HitCoverage=96%, E-value=1e-168, Identity=54%"; Hit description =Cytokinin dehydrogenase 3 precursor
  Pfam annotation: Domain name=Cytokin-bind; Domain location=266-544; Score=577.5; E_value=1.3e-170; Accession=PF09265.1; Description =Cytokinin dehydrogenase 1, FAD and cyto
  Pfam annotation: Domain name=FAD_binding_4; Domain location=70-216; Score=67.7; E_value=3.6e-17; Accession=PF01565.13; Description=FAD binding domain
  Pfam module annotation: Pfam domain module=Cytokin-bind::FAD_binding _4; Domain location=266-544::70-216
MALHYPFPTYFILLLVTITRLIYTVGKTEQWKAPILTELDINNISHKLHDDPEIIQMASRDYGHIVHEFPLAVFRPSSIDDIATLIKSSYNSFAPFGIAARGQGHSTHGQAMARDGVVVDMANLRKQRNGVAISVSKDPLMGHYADVGGEQLWIDVLHTTLKHGLAPVSWTDYLYLTVGGTLSNAGISGQSFRYGPQISNVHEMDVITVSVVVESKTGIVFVYNMGKGEFVTCSSQKNLELFHAVLGGLGQFGVIARARIALEPAPKRVKWVRLLYSDFFAFTKDQERLISINGRKQKNALDFLEGMLLMNQGPINNWRSSFFPLSDHPRISSLITEHSILYCLEVAKYYDEQTEINVDKEIQVLLQGLAYIPGFYYEKNVSYVEFLNRVRSGELKLQSQGLWDVPHPWLNLFIPKSQILDFNSRVFKDIVLKRNISSGPVLVYPTNRNKWDDRMSASIPDEEVFYTVGFLHSSGFDTWKAYDAQNSEILEFCRDAGIKVKQYLPNHSTQEDWTNHFGAKWIKFLERKHQFDPRMILSPGQKIFHKQLQPAF

SEQ ID NO: 177004 - protein, 351 aa, Glycine max
  Coding DNA Sequence Number=SeqID_60226
  Gene Ontology: Mol. function=sequence-specific DNA binding; Cellular component=nucleus; Biological process=regulation of transcription
  Homolog annotation: Hit_ID=Q1RWH4; Match level="QueryCoverage=99%, HitCoverage=96%, E-value=3e-83, Identity=44%"; Hit description=WRKY DNA-binding domain, putative
  Pfam annotation: Domain name=WRKY; Domain location=201-259; Score =109.7; E_value=8.2e-30; Accession=PF03106.6; Description=WRKY DNA -binding domain
MAQRRSPQPLPEPDTKGNDSHQKPQHNKETDRVAESPSAAESQRGELRSSDEPRTESNLETLGRGVSSSVETLAAQSPTDVNCVVDVTDLQGSSTALNSGAKAESKETVGSPEKEIIDRGAVQPLQTQTEDRLQVSACSTPLSDLSPTSVTQSLSIVSSPTIPKQKISTPKVNNAHVPEVDKKNPSGRKTLSSVSIARTSASDGYNWRKYGQKQVKSPTGSRSYYRCTHSDCCAKKIECCDDSGHVIEIVYKSEHSHDPPRKTNSIRENKFLSSSEPIVENSVPEQPIKVLKDADPSISSKESLQEAPCSTDKKRQNTSNISGNAGDVGISADGYRWRKYGQKMVKGNPHP

SEQ ID NO: 177005 - protein, 58 aa, Glycine max
  Coding DNA Sequence Number=SeqID_60227
MSHHRQTPGPGGFNSMSRINSPKSSELDISSRMNMQDQNQISTTIEITTPNDRTKKGS

SEQ ID NO: 177006 - protein, 428 aa, Glycine max
  Coding DNA Sequence Number=SeqID_60228
  Gene Ontology: Mol. function=transposase activity; Biological process= transposition, DNA-mediated
  Homolog annotation: Hit_ID=UPI00005459F6; Match level="QueryCoverage =79%, HitCoverage=45%, E-value=4e-49, Identity=32%"; Hit description =PREDICTED: similar to Kruppel-like factor 7 (ubiquitous)
SLEDYSSFFFPDMDPKRRGNDTAFNDLLNSLIHLDNKQTLMDPTQFQFDSSPPTKRPRRAIEDIHNVTVQQQQQQQRRLWVKDRSKDWWDRCNQPDFPEEEFRRYFRMSKATFDMICQHLDSAVTKKNTMLRQAIPVRQRVAVCIWRLATGDPLREVSKRFGLGISTCHKLVLEVCSAIKTVLMPKFLHWPNEAEMKPITQKFESLSGIPYVGGSMYTTHIPIIAPKSNVNAYFNKHHTERNQKTSYSITVQGVVDSKGVFSDVCIGWPGSLSDDQVLEKSALYQRATMGTLKDVWVVGNSGHPLMDGVLVPYTHQNLTWTQHAFNQKVGEIQSIAKDAFARLKGRWSCLQKRTEVKLEDLPVLLGACCVLHNICEMRDEEMDPHWKFEIFDDEMVAENNVRSNAAEQARDQIAHYLLHHGRAGTNFL

SEQ ID NO: 177007 - protein, 100 aa, Glycine max
  Coding DNA Sequence Number=SeqID_60229
MRECNWRWRESKGKLELGRVELPDSELELQIRTRRSHGVRCFDHDRQQLDRLQITLLPIFSLFPNLGSPFNQGRFRNTAVPTPYNWQCVTHMCYDYYGIM

SEQ ID NO: 177008 - protein, 735 aa, Glycine max
  Coding DNA Sequence Number=SeqID_60230
  Gene Ontology: Mol. function=ubiquitin thiolesterase activity; Biological process=ubiquitin-dependent protein catabolic process
  Homolog annotation: Hit_ID=Q1RWI2; Match level="QueryCoverage=99%, HitCoverage=80%, E-value=0.0, Identity=57%"; Hit description =Ubiquitin carboxyl-terminal hydrolase, putative
  Pfam annotation: Domain name=UCH; Domain location=1-231; Score=124.4; E_value=3.3e-34; Accession=PF00443.19; Description=Ubiquitin carboxyl- terminal hydrolase
MRSGISRNFRNARQEDAHEYMVNLLECMHKCCLPSGIPSESPGAYEKSFVHKIFGGRLRSQVKCHQCSYCSNKFDPFLDLSLEIFKADSLQKALSNFTAAEWLDGGEKEYHCQRCKQKVKALKQLTIHKAPYVLTIHLKRFHAHDTGQKIKKKVQFGCALDLKPFVSGSNDGDVKYSLYGVLVHAGSSTHSGHYYCYVRTSNNMWYTLDDNRVSHVSEREVLNQQAYMLFYVRDRKSIVPRKPVDIAKKENMKTNLNVNRESSTSNHVLKEYPNGTVENKAEKGALVLQKHSVILAENLIQSKRHGSELSSEAQAQKDSPDGLSVAKSELGCLSSLDHSGKDYSLPHNLKSLAAPVGKNNLRNENVFSKEGIKDSPSIVPSSTNPQNVELTTEWKSQSLKKNLVKIVDVATPQDSSTNMTNGICPKTSLIHLKVNHQLGTSAIGSVCEKASSVVHEDLVGSQGLVLNKSVNTSLNTESLNQKPLKKSKKKFLKYQVSWMHLRPIFYYMAYLGPRKKNHKRIKRRTLSMKNPNKDKLDKLAFSSEDAKPDVFPCLSSCSDSKATKAGYRPSANFKSSDESLIETRAEGEFRKRIDHSCAVLASAAQIENISGSGSVVSQFEARQADSAQDSTRDQMHNGLMSMPNGGPEETVVARWDDIELPSSQHLESKNDKTVSIGYVGDEWDEEYDKGKRKKIRGFKHSFGGPNLFQEIAVEKSKFKRAKFDQSCSGNPPFRI

SEQ ID NO: 177009 - protein, 175 aa, Glycine max
  Coding DNA Sequence Number=SeqID_60231
MTHKLFFYLKLSNGIELTILRKRRNRRGRGSEEEEGFRVSTWKWLEKPLKGFLTGRNTIFLDSKGGAAVVVVDEEGSGGFGGSVWITMVSAIGGVREASKREEKKKTRKKQRVSASGKRRPGPGPGIECIYMCGLENPGSVIEQLGHSNLNRVDRGGQTSNQDRFLLILTFNYGI

SEQ ID NO: 177010 - protein, 188 aa, Glycine max
  Coding DNA Sequence Number=SeqID_60232
MDHKFSSSRKLKGPGIPTTILRCAPDSCVVYIVARDRIISKLADFSSSRSCETSPRNFVSTKVNKADNRAGIGREMSGISSFSTEPKILRNFRFLSISERSYIGLQSSSRRDSFENTTKNEEENPENCGDDIETISLHSFDFIPSAQREQLVMQEEVERLQLELQNTITMYKQVCGELVQAQNEVRVG

SEQ ID NO: 177011 - protein, 314 aa, Glycine max
  Coding DNA Sequence Number=SeqID_60233
  Gene Ontology: Mol. function=protein serine/threonine kinase activity; Cellular component=ubiquitin ligase complex; Biological process=protein amino acid phosphorylation
  Homolog annotation: Hit_ID=Q5Z7K5; Match level="QueryCoverage=96%, HitCoverage=43%, E-value=1e-106, Identity=54%"; Hit description=S -receptor kinase-like
  Pfam annotation: Domain name=Pkinase; Domain location=42-294; Score =65.0; E_value=2.4e-16; Accession=PF00069.15; Description=Protein kinase domain
  Pfam annotation: Domain name=Pkinase_Tyr; Domain location=42-256; Score=4.2; E_value=1e-12; Accession=PF07714.7; Description=Protein tyrosine kinase
  Pfam module annotation: Pfam domain module=Pkinase::Pkinase_Tyr; Domain location=42-294::42-256
MAELDVLKESIEKQRIVDTLLSNDRRYRKYTMDEIKLVTNFFAEDLIIGEGGYGKVYKCNLDHSPVAVKVLHQDAINKKDEFLKEVEILSQLHHPNMVLLFGACPESGCLVYEYKENGIFEMACGLSFLHNSKPEPIVHRDIKPGNVLLDRNYVSKIADIGLAKLLVEVVPDNVTEYRESILAGTLHYMDPEYQRTGTVRPKSDVYAFGVITLQLITGRHARGLIVTVELAQVALKCSALRCRDRPEIDTEVLPVLERFSDAANSSTRMGINSVSVPSQYYCPILQEIMDDPYIAADGFTYEYIAIKAWLSKHN

SEQ ID NO: 177012 - protein, 391 aa, Glycine max
  Coding DNA Sequence Number=SeqID_60234
  Gene Ontology: Mol. function=voltage-gated potassium channel activity; Cellular component=voltage-gated potassium channel complex; Biological process=potassium ion transport
  Homolog annotation: Hit_ID=Q1RWI6; Match level="QueryCoverage=99%, HitCoverage=88%, E-value=0.0, Identity=91%"; Hit description=BTB/POZ
FINRNPDCFAILLDLLRTGELHVPPNIPEKLLYREALYYGLLDHVRAAKWGPFDGNRLRLSRSLQGQAPGDGTAVRAGPDGGCCVAHGSMVHVYDWMLEEHRPLNLDYQRVNDVGWVDSDNVVIGVSERLGRGDGGMGLFSSHTGELRYKFHVCHDNQVKSYTAGALSFSSDYKIFSSCKGRSNEYGVGVWDQVTGKQIDFFYEPLGWSLGDADKLQWMEGSNCLLVATMFPRKDNCYISLLDFRDKKMVWCWSDVGAPFAVDEKRVRDAIAMEDNNSICVVNEFEDLGFMDLRSSAANSIRWSSRSRLMKGKMPEEPCYPKLALHGGQLFSSMNDCISVFCGPEWVLTSRLRRSYGGSICDFSIGGDRLFALHSEENVVDIWETPTPPII

SEQ ID NO: 177013 - protein, 1146 aa, Glycine max
  Coding DNA Sequence Number=SeqID_60235
  Gene Ontology: Mol. function=actin binding; Biological process=actin cytoskeleton organization and biogenesis
  Homolog annotation: Hit_ID=Q1T5L0; Match level="QueryCoverage=99%, HitCoverage=99%, E-value=0.0, Identity=67%"; Hit description=Actin -binding FH2; Quinonprotein alcohol dehydrogenase-like
  Pfam annotation: Domain name=Extensin_2; Domain location=449-753; Score=-136.7; E_value=0.058; Accession=PF04554.4; Description =Extensin-like region
  Pfam annotation: Domain name=FH2; Domain location=777-1105; Score =380.7; E_value=2.3e-111; Accession=PF02181.13; Description=Formin Homology 2 Domain
  Pfam module annotation: Pfam domain module=Extensin_2::FH2; Domain location=449-753::777-1105
MLRKLFFRKPPDGLLEICERVYVFDCCFTTDAWNEENYRVYMDGIVGQLRENLPDASILIFNFREEDTKSQMANIMSEYDITIMDYPRHYEGVPVLKMELIHHFLRSGESWLSLSQHNVLLMHCERGGWPVLAFMLAALLIYRKVYTGEQRTLDMVYRQAPHELLHLLRNVALDWPPLDRALMLDCIIIRFFPNFEGEGGCHPIFRIYGQDPFSADKNPKMLYSTPKRSKNVRAYKQGECELIKIDINCHIQGDVVIESINLNGNMDREKMMFRVMFNTAFVRSNILMLNRDEIDILWDAKDHFPKDFRAEILFSEMDAAAAVIADGTSCFEKEGLPIEAFAKVQEIFSHVDWMNPKDDAALNVLQQMRASAMNDRLDTVSDQYVENGTLLHEKSPRTPQGNLSEARQGLSSTKRSPDNDKSRKDDKTNKVEGIPQQPNTSNIMYQETARSSERTMESNKCPTGPTNLDIKLQAPHPALSSSVDTAFPPRTPPLRPRSTSAKEVHDSPRQTESPPSYLLPLQSKHQSQDRSSNPTPGTQLSSTVHSKSPEDTISHPSSSAITSPQLSPSLSSKNVNEIPPIRTRLESSPSQPPTPPPPPTPPLKDHRLVRAKPPPPPPPPPKKEVHVKAGPLPSPLSPMNVESQVRGGPSPPPPPLPKEERPVTFNAPPPPPPPCLSGKVAGSTIAPPPPPPPAPPPPLSRASLPSDHINSSLQESAPPPAAPAPPPPPGAPAVPPPPGKGGLKSGSPFPLSLSVSGDGNNVSGPTSSKGRILSRTINSKNNTKKLKPLHWLKLSRAVQGSLWAETQKSGEASKAPEIDLSELENLFSAAVPSGPAKKSNVQSSAGPKSDKVQLIEHRRAYNCEIMLSKVKVPLHDLMSSVLALEESALDTDQVENLIKFCPTKEEMELLKGYNGEKEKLGRCEQIRNSVKLKRIMQTILSLGNALNQGTAKGSAIGFRLDSLLKLTETRARDKKMTLMHYLCKVLDDQLPDVLDFSKDVANLEPAAKMQLKFLAEEMQAINKGLEKVVQELSTSENDGPISETFCKKLKKFLGSAEADVRSLASLYSSVGRNVDQLILYFGEDPARCPFEQVVSTLLNFTRMFNKAHEENRKQLELEMKKTAESEKKKCESERILPTAIRTGNVK

SEQ ID NO: 177014 - protein, 571 aa, Glycine max
  Coding DNA Sequence Number=SeqID_60236
  Gene Ontology: Mol. function=phosphoprotein phosphatase activity; Cellular component=intracellular
  Homolog annotation: Hit_ID=Q1RY25; Match level="QueryCoverage=31%, HitCoverage=48%, E-value=2e-26, Identity=39%"; Hit description =Reticulon
  Pfam annotation: Domain name=Reticulon; Domain location=334-500; Score=-50.7; E_value=0.0022; Accession=PF02453.8; Description =Reticulon
MDVSRRRLGVRCSVVAGSVWESRMKSDEVGGGVKVFTGEQSAEEGGNGGTCRLKRSQIGSVVATGKRKTWKSEGLENNHIQIAIGKSEPQKNGGNSSSSQQCKDLNISSDSIKKSPIQARKKRSGVGESFEKNAGKLRKNKSDLIKNVGDGDAGNAIQPRKGKSELDHVLDESRNDGLAGGSARVVILNGKNDCDENCKDFGVCLEKVISSNSGNVGMIKCSPVHVDDDDEDDVVEEEVDDEEIDIEMEKGSFDVKEISVPESKVVNETERKEVVNVAAKQKIVNEPEPKKVVSTNRQFHQKNERPVSVPISVKPSLPIRKLSTIHQNFSKADSIDLIMWRDISRSAFIFGIGTFAIVLSSYAKDINLSLISVMSYIGLVYLAVIFLYRSLICRGVIDVEDTNYVLREEEAIWVLKLILPYLNEFLSKLRAMFSGDPGTTIKMWQLHNHLEDGQIRLLWSFYRAKNLLLVFCTVNCIRKLLDSSIPGCLGFLLSQKGCGSWHFWPCLEFVISGCSHLVRYYQQHYLVREELVENEAGCDETWQEPAGVKVGMQRQQSTHKIFETQKVKKVF

SEQ ID NO: 177015 - protein, 248 aa, Glycine max
  Coding DNA Sequence Number=SeqID_60237
  Gene Ontology: Mol. function=acyltransferase activity
  Homolog annotation: Hit_ID=Q1MW30; Match level="QueryCoverage=97%, HitCoverage=55%, E-value=1e-76, Identity=67%"; Hit description =Diacylglycerolacyltransferase-1b
MAISDEPETVATALNHSSLRRRPTAAGLFNSPETTTDSSGDDLAKDSGSDDSISSDAANSQPQQKQDTDFSVLKFAYRPSVPAHRKVKESPLSSDTIFRQLQSHAGLFNLCIVVLVAVNSRLIIENLMKVVVVLHIIITSASLFYPVLVILRCDSAFLSGVTLMLFACVVWLKLVSYAHTNYDMRALTKSVEKFLNLNILLDLAVAYGSWRSSARYSEHGLSLQCKLQELSIFPGCPYIMLPGSSTFK

SEQ ID NO: 177016 - protein, 185 aa, Glycine max
  Coding DNA Sequence Number=SeqID_60238
  Gene Ontology: Mol. function=protein binding; Biological process=DNA repair
  Homolog annotation: Hit_ID=Q664A4; Match level="QueryCoverage=53%, HitCoverage=62%, E-value=4e-36, Identity=74%"; Hit description =Hypothetical protein yfjY
MAVRDNDRGGIMLQCALHDFTRMHLGAGNATAKQGLMGQQAMLIVEIERHKDFALQPGHLQAQPVAHHERGGEGFSRFAQMLLQQCQCTLNGALGGQGQTGGCRGLVDDAHNGVAFGMAEGVIPQAIVVFGHGIAFGAAGMVAVSDEASNDAGGLMPHRCAIAIQGVKEHVLAFAGRDNKRRRRY

SEQ ID NO: 177017 - protein, 158 aa, Glycine max
  Coding DNA Sequence Number=SeqID_60239
  Homolog annotation: Hit_ID=Q3KCJ9; Match level="QueryCoverage=35%, HitCoverage=14%, E-value=5e-17, Identity=71%"; Hit description =Integrase, catalytic region
MARWRADSAGCGQDVLNGGMWPIEQLADLVQGIALAPAIPHHRLLCFGVVDPRSLLHGQHSLRQVQSLCCIDRLNSQLVAVLRSPVVVDSFGPRVSHPRKQRPIDAKTVRMTRHTETIEVITRNQRRRRWSAPEEAILVRKTYEPRMSVSLAAREERV

SEQ ID NO: 177018 - protein, 123 aa, Glycine max
  Coding DNA Sequence Number=SeqID_60240
VDYLLQSLQLVAPPDSIPTVEQCNEWVAWPRTQPPPHRDDEDPAAQVPHQPSDESSESSTPEPLIRKRRVVLTKEAVATPEKSPEATLEPPTPMADTTSPQQAANPSTPEVQTTQSCLQTLLP

SEQ ID NO: 177019 - protein, 147 aa, Glycine max
  Coding DNA Sequence Number=SeqID_60241
FIHDWSASIGYGALYGFLEPQCIHNASSRRQECENYIGRWLKEAGKQIYIAPYLNQAHWQLVVLCLGNNLVVWFCSLRKKSDAAIKGAVNSAMKSVTKTAEGKPPQHGPQWIEAKSHVQTGNYECGYYVMQWIWCIVSGGLKDDWIH

SEQ ID NO: 177020 - protein, 44 aa, Glycine max
  Coding DNA Sequence Number=SeqID_60242
MKIKWTISNNASPKEENSISGFAIIKRVGDLAWPQIDLHSLWLI

SEQ ID NO: 177021 - protein, 606 aa, Glycine max
  Coding DNA Sequence Number=SeqID_60243
  Gene Ontology: Mol. function=protein transporter activity; Cellular component=nuclear pore; Biological process=protein import into nucleus, docking
  Homolog annotation: Hit_ID=Q9LUT8; Match level="QueryCoverage=80%, HitCoverage=33%, E-value=1e-121, Identity=45%"; Hit description =Arabidopsis thaliana genomic DNA, chromosome 3, P1 clone: MGD8
MAVTLFLREQEPEFVTTLVRTRILPLYTVAVSLPYLVASANWVLGELGSCLPEEMSTEVYSQLLMALVMPDRQGPSCYPVRVSAAGAITTLLDNDYMPPDFLPLLQVIVGNIGNDETESESESSILFQLLSSIMEAGDEKVAVHIPHIVSSIVSPVSKWLTSNLEPWPQVVERAIAALAVMGQTWEDSRPEESESDESRQNWALGQVAIARAFAALLQQAWLTPLCTLDQQDQQAPPSSCIEDLSTLLQSVLLSIDENHMIQELKVSELLSVWSEMIAEWHAWEESEDLSIFEVIKEIVNLDCRYKLKNFVVKEMPPLPAPPVPERSIVEGIGAFISEAIKQYPSATLRACSCVHILLHCPTFSPETEGVKQSLAIVFSQTAFSRFIEVQSTPNALWKPLLLAISSCYLCYPDIVEGILEKGKHGGFKIWASALCHVSNRSFEPGLTAEAEMKLIVMTLARLIEQLLKQGNSGDEIQNCFTSLLEVSVRLKEAHDGKEDEQGSDNDENEDDEDEDEDSDDDYDEDSGSEEYEETEEEFLNRYAKAAEALENGSAIIEEGDDEDQELGLELDKYHHVLTRGLVLPSELVMNFLNAFPGYGSYFQQYR

SEQ ID NO: 177022 - protein, 480 aa, Glycine max
  Coding DNA Sequence Number=SeqID_60244
  Gene Ontology: Mol. function=galactosyltransferase activity; Cellular component=membrane; Biological process=protein amino acid glycosylation
  Homolog annotation: Hit_ID=Q67X53; Match level="QueryCoverage=81%, HitCoverage=61%, E-value=4e-91, Identity=46%"; Hit description =Putative beta-1,3-galactosyltransferase
  Pfam annotation: Domain name=Gal-bind_lectin; Domain location=171 -367; Score=120.8; E_value=4e-33; Accession=PF00337.12; Description =Galactoside-binding lectin
MKKWYGGLLIMALGMMLLFLYNVKGIQPQKQSAKQSAYNFFHNHTPGDSINGSSNLPVNSSEVELKRVTTPAKRPHLVHVAGLDDLYDMKNLSKEETNSVLIWDSLRSLLSRSDALAETAQGVKEASVAWKELLSIVEKDKASKINKMDGPENQNCPFSVTSPGKAVPDSGITLDLPCGLVVDSSITLIGIPNNRSFQIDLAGLEQEGEPNPPIILHYNVSLPGENMTEEPYIVQNTWTSDLGWGKEERCPARGSANIQEVDGLVLCNIQAVRSNNKGNANVDQPASDIPSNISSESVHRTANFPFAEGNPFTSTLWVGSEGFHMTVNGRHETSFAYREVLWMQKLEPWLVSSIKVAGSLSLLSILAKGLPVTEDNDIVVDIENLKAPSIARKRLALLIGVFSTGNNFERRMALRRSWMQYEAVHSGEVAVRFFIGLHKNNRVNFELWTEAQAYGDIQLMPFVDYYSLISLKTIAICIMG

SEQ ID NO: 177023 - protein, 715 aa, Glycine max
  Coding DNA Sequence Number=SeqID_60245
  Homolog annotation: Hit_ID=Q9LUT8; Match level="QueryCoverage=90%, HitCoverage=39%, E-value=1e-126, Identity=45%"; Hit description =Arabidopsis thaliana genomic DNA, chromosome 3, P1 clone: MGD8
  Pfam annotation: Domain name=YTH; Domain location=442-532; Score =214.8; E_value=1.9e-61; Accession=PF04146.6; Description=YT521-B -like family
MSVSVTFSVFMTSWIFGGSSGMEMYDVSETRNADAYLIEGTDLNLHLTSPNIQQFQAMFNDGAPEFVADQNLYYPAATNYGYYCTGFESPGEWEDHHRIFGVDGPDIQYTGAQNESFPYVYYTPSYGFAQSPYNPYNPYIPGAMIGVDGSFGGAEQYYSLPNYQNTISSPAYIPVVQPDNFPNSSVDSSFDTSASVSRPDGKGLKHKFNSASGSFTRNSSKSLSNPTSSLARISEGPRDNTGVKKDLTSGRGFLNMASSPVHQARSIDASTHAVDISNGNVLSHSNQLKIASPLSSGFSDYGSNANGQSVVAKLRPKVHVGKGLSEVNGSSDVLGEQNRGPRISNYKSKFPLAVKAYANKGDDNTQENIIISTDQYNREDFPVNYENAKFFVIKSYSEDDVHKSIKYNVWSSTPHGNKKLQSTHEDAKRIASGNFGSCPIFLFFSVNASGQFCGVAEMIGPVDFNKDMDFWQQDKWSGSFPVKWHIIKDVPNANFRHIILENNENKPVTNSRDTQEIMYSKGLEMLKIFKNHNLKTSLLDDFMYYENRQKIMQEEKAKLLIRSFKNPLVLPTLEPPRKLNFVIDIPPVGDEKNAKMDDEVDSLKQISSAGHIVSSSEITSTTSVDEKAEKGSVDKEDIASVLKIGSVTITPKQVETKPSGISVANKEPLDVITVGSMQIRVNGFAESSGFLKIGTIPLDPRTLQLDGGSRVKNGS

SEQ ID NO: 177024 - protein, 711 aa, Glycine max
  Coding DNA Sequence Number=SeqID_60246
  Gene Ontology: Mol. function=DNA binding; Biological process=DNA methylation
  Homolog annotation: Hit_ID=Q9LUU0; Match level="QueryCoverage=89%, HitCoverage=94%, E-value=1e-113, Identity=37%"; Hit description =Arabidopsis thaliana genomic DNA, chromosome 3, P1 clone: MGD8
MAGNSNRREGKPVMVPKTEDLGYELPPYTSFSGDVGALQKSNSQSSDSLDSLFDDKDPPEISNVNQAKEEPDELSGVIDDKRGSLLMMNFSVEEVELAIHKLGDEASIPELVDFIFAWQIAKKLKKEPDDITFTYYGRGNEVTNEKLFGIMAKTLQLFEMGFSENEVSSAIDKLGSEAPISELANFIFAEQNGIDYVMEYKFPTTSTYSVGIKEEPEMDLYGTAEVKVEDFSNEPPQSSQVNLEETYNEDMVKEEEGIDAFPSYVSDQYLDVVENGRGKRPKYEHDDDSITCLEPSWVEERVDVVVAEMSRRPKPNPSRCLSSVAAKPPFFLFGNVSNISYDSWTKMSKFLYGIEPEFANAQSFSALDRIEGYIHNLPVENRFHILPKPPMTIEDAMPLTKKWWPPWDSRKQLSSIYCETNGIAQTCDRLGNILADSGGVLTSELQKDILRYCRGLNLVWIGKFKLGPVEPEQLELILGYPLNHTRASEGNVAERLKSLKYCFQTDTLGYHLSVLRPIFPHGLTMLSLFSGLGGAEIALHRLGIKIKVVVSVETSETKRKILERWWRQSGQTGTLVQLEDIQKLTSKKLEGLISKFGGFDLVIYQNPCSNLSSRLLAGVGLPALEFSVFCECVRVLQRIRATSTQNTAASANIILFPSNSTAAVVGSPPRCRKPNTSSRCPTSSGRSSEASWEDVEEMLRFHDPRIHQSKC

SEQ ID NO: 177025 - protein, 149 aa, Glycine max
  Coding DNA Sequence Number=SeqID_60247
  Homolog annotation: Hit_ID=Q1SKD7; Match level="QueryCoverage=66%, HitCoverage=26%, E-value=4e-11, Identity=35%"; Hit description =Ankyrin
MAPRKLASKRSRKDKAAEGTSSAPEYDSHHFMSAEHQQRFEAIKGWSFLRERRIQLRDDEYTDFQEEIVRRRWASLVTPMAKFDLDIVLEFYANAWPTEEGPVPGISFSAGGGPGVRVWPEEEPGRWVWRLPGTLWTRISPTGPWDFPL

SEQ ID NO: 177026 - protein, 58 aa, Glycine max
  Coding DNA Sequence Number=SeqID_60248
MEKKESTEETSCSKQKMENLSKGKTQRQVKLEETDHKNEEKKQMGEGGHVSPPGAWAQ

SEQ ID NO: 177027 - protein, 38 aa, Glycine max
  Coding DNA Sequence Number=SeqID_60249
MAPSLYSDVLCLSNAGKGRRSVSRDPILHSRPFLSTYK

SEQ ID NO: 177028 - protein, 267 aa, Glycine max
  Coding DNA Sequence Number=SeqID_60250
LHVLTIRGLHALTSRGLHVLALRGLHALTLGTTYPHRQRTTRPRLWGHALTFRGLHVLAIIGLHSLAFERRHVLNFRGLHALAFRGLHVLTFRASSFLLTVPGPPPDIGGGPTVRAQPEREAITQLLCIPGQDFIRAAQHSAQRPQRQSPPAKVSVGLCRPDMGIAPTRHPVDPEKSNRALGFLALVTGLYQSYRVLVPPRQGHIIIGIAPARHPVDPKKSNRAFIKKYCVSRQAQGETPQQPGDGRQRATDAPPSPLEFTSAHPQK

SEQ ID NO: 177029 - protein, 345 aa, Glycine max
  Coding DNA Sequence Number=SeqID_60251
  Gene Ontology: Mol. function=hydroxymethyl-, formyl- and related transferase activity; Cellular component=membrane; Biological process=purine base biosynthetic process
  Homolog annotation: Hit_ID=Q2KUD7; Match level="QueryCoverage=65%, HitCoverage=55%, E-value=1e-98, Identity=80%"; Hit description =Phosphoribosylglycinamide formyltransferase 2
MAIRTSSRGDHAQVAVHRLGGVHEEGGRAGGGQRRRDLAGHMAGLADAADHDAAAAGQQHGDDLREAVVEPGGQVQDALAFDLQRPARRCQRGLGRCGGMVGHQGILISGCGFAPGWGHSQSRPRHAPVPPGHPRHAARVGRTGQRGHHRPAAAGRGSHCGGPVCGRTRTPGGASRARGVDDGSRSPGKGHPAGAAARYCPRNRGHCHQFAGAARIGRRGAGHADRPGGATDHEPRGHPPPGGRDPGPAHVALCLRRHGRRVAPGHRWRHRLSLRHLAGHVLIRQGPVPHQGPRQRHVRLALPPGRRPGLGRPRLLLGLRSLLLPNHPVDVPGARRRWACRDPLL

SEQ ID NO: 177030 - protein, 155 aa, Glycine max
  Coding DNA Sequence Number=SeqID_60252
  Homolog annotation: Hit_ID=UPI0000DA424C; Match level="QueryCoverage =68%, HitCoverage=56%, E-value=2e-08, Identity=35%"; Hit description =PREDICTED: similar to Cornifin B (Small proline-rich protein 1B) (SPR1B) (SPR1 B)
MSLPSAVHVSSTFESGAPRMSLPSAVRQFSILHFYSETHECHCLALFMCPPPSSLEPRECHCLALFANSPFSTFSETHECHCIALFMCPPPSSLQPCECHCLALFMCPPPLSLEPRECHCLALSMCPPPSSLEPRECHCLALFANSPFSTFFGAP

SEQ ID NO: 177031 - protein, 74 aa, Glycine max
  Coding DNA Sequence Number=SeqID_60253
MTLLLSNILPSDRNANLPLQKYQLVCVVSTWGSHPQDTQWTRKSPTGPWGFQLWLRASISPTGCPYPPGKVTSS

SEQ ID NO: 177032 - protein, 159 aa, Glycine max
  Coding DNA Sequence Number=SeqID_60254
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=99%, E-value=2e-13, Identity=23%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=52; ConfidenceScore=5.71e-01
MARTCSPLKGRTYSPLKVRACSPQKVRTSSPLNVRACSPLKVRTSNPLMARTCSPLKGRTCSPLKVWTCSPLKVWTYSPLKTRACSFMKVRTCSPLKAKTYSPLKVKMSIPLKARTCSPLNRRTCIPLKVRTGSPLKARAWNPLMVSTCRPLMVRSGIL

SEQ ID NO: 177033 - protein, 133 aa, Glycine max
  Coding DNA Sequence Number=SeqID_60255
  Gene Ontology: Mol. function=nucleic acid binding
MAQPPPRERTLREMAAPDFTYESLCIQYPDEDVPYVLKTGLIHLLPKFHGLAGEDPHKHLKEFHIVCSTMKPPDVQEDHIFLKAFPHSLEGVAKDCLYYLAPRSITSWDDLKRVFLEKIFPASRTTTIRKDIS

SEQ ID NO: 177034 - protein, 436 aa, Glycine max
  Coding DNA Sequence Number=SeqID_60256
  Homolog annotation: Hit_ID=Q7W3K2; Match level="QueryCoverage=46%, HitCoverage=98%, E-value=2e-85, Identity=72%"; Hit description =Putative exported protein
LGTFLADGHDLPLVGGRRAVLVARGVFAHFQIVGGERHQAARHVDVAREDALLFHVVVVQRIRQDRGGGGVGRAVGLAARLVLRAGDLHVRGGRYLQLACLVVVVHTLAVHARASLDDLGRQVGVHHVFVGQQDQLLAAHVQHVVVGVGLAVHVGVAIHDDALAALLHDGGLGHAHGDGTGFALADGPRLGDVVRIVVGEMLGVIAFQPVDGATGRVGAQHHEIARPGVHFVRDAARRIRLDGPLRVVGGPIRAGDQHQQQEQRDQGRETIFHQVCEARLGARLLDGARAEQPRRGQESAQPALGSQQQVAALADRATAARLRGDPVGRLADIARRIRHAGGEARALHCRQVDDVVAHVAGLVQLDRAALRKFGQCGTLVAHALHDLGNAQFGGAARHDRAGAAGHQSDLQAAFHQQAQPVAVQRMEAFLHFAASP

SEQ ID NO: 177035 - protein, 78 aa, Glycine max
  Coding DNA Sequence Number=SeqID_60257
  Subcellular localization annotation: CTP_CleavageSite=38; ConfidenceScore=5.17e-01
MDCEIYLLPISVTARNFHGSRKPASFGFSARLGTSHIVQQRVPNISKRPINGCISSNYNPRTKLGYDNCPSLLTSHRR

SEQ ID NO: 177036 - protein, 100 aa, Glycine max
  Coding DNA Sequence Number=SeqID_60258
  Pfam annotation: Domain name=zf-CCHC; Domain location=10-27; Score =21.9; E_value=0.00024; Accession=PF00098.13; Description=Zinc knuckle
KKGEDSSLAPKCYECDQPGHRRFNCPIFKRRMEKSDKRNFKEKKAYITWEDNNMDSSSDSENEIINMGLMVKDYESEEEIMSSNYDLSISFDELQDALND

SEQ ID NO: 177037 - protein, 88 aa, Glycine max
  Coding DNA Sequence Number=SeqID_60259
  Gene Ontology: Mol. function=RNA-directed DNA polymerase activity
  Homolog annotation: Hit_ID=Q1SJY5; Match level="QueryCoverage=51%, HitCoverage=4%, E-value=3e-10, Identity=69%"; Hit description =Integrase, catalytic region
MATPMSTACYLDKDEVGQSVDIKKYRGMIGSLLYLSASRPDIMFSVYIDAILPRKGPVTRAMSKRLQEDWARAAEEGPRILMNLRVDF

SEQ ID NO: 177038 - protein, 130 aa, Glycine max
  Coding DNA Sequence Number=SeqID_60260
MSLATLFGKLQEHQMELMRLNQHEENDKKKKGIALKASSSIQEESDKKDLNEIEEVYCPSFKKRREKSDRKTLNDKKAKKAYITWEDNGMDSSSDSENEIINLGLMAKDYESEKEMHSMTCIKNLSNLPN

SEQ ID NO: 177039 - protein, 78 aa, Glycine max
  Coding DNA Sequence Number=SeqID_60261
MTRVMSKMTATATKSISLKPLGRDGTGRCHLVEEIPIVVPRYAVKPLARVTLESTDQRFTYTKNCKYKSLNLTYIKQG

SEQ ID NO: 177040 - protein, 111 aa, Glycine max
  Coding DNA Sequence Number=SeqID_60262
MTVPFDFEPFVKVKRSFSIGVNVVSSFGYHKERDGSWVKKDALVQATEDRSPSPPPQRDDSSSFMHSILDRLDGLHTFVGERFDSLDSRIDAMDARFAGMDTRITKLEEDV

SEQ ID NO: 177041 - protein, 78 aa, Glycine max
  Coding DNA Sequence Number=SeqID_60263
MAENLHGIIHGNVSDVLRKDYTIIPFLAFGIVRNLTDCVTSGTLWKFTYCATAGAKYLEAVKQRLHAIKKWSLDEIRV

SEQ ID NO: 177042 - protein, 67 aa, Glycine max
  Coding DNA Sequence Number=SeqID_60264
TYIHKETCFRCRSLKEIKNYEKYGSPPRRHKVKTQAKEESNDKTKNETEYWLKFTDNYKLMSRTESD

SEQ ID NO: 177043 - protein, 199 aa, Glycine max
  Coding DNA Sequence Number=SeqID_60265
  Gene Ontology: Mol. function=ATP binding; Cellular component =chloroplast
  Homolog annotation: Hit_ID=Q2PMM5; Match level="QueryCoverage=99%, HitCoverage=8%, E-value=1e-113, Identity=100%"; Hit description =Protein ycf2
MVERKNPYLTRLLTIPMNSIGPKNDTLEESSESSNINRLIVPLLYLPKGKKISESYFLDPKESTRVLPITKKYIMPESNWGSRWWRNWIGKKSDSSCKISNETIAGIEISFKEKDIKYLEFLFVYYMDDPIRKDHDWEFFDRLSPRKRRNIINLNSGQLFEILVKDWIYYLMFAFREKIPKEVEGFFKQQGTGSIIQSN

SEQ ID NO: 177044 - protein, 90 aa, Glycine max
  Coding DNA Sequence Number=SeqID_60266
MSHAVKDSRGKWAPNYEGNFMVKRAFSGGALILTNMDDEELPSPEQNGLRPRSKVKTSQWQKSTNDRIATDRSLPLPGTKQAENVAARQP

SEQ ID NO: 177045 - protein, 82 aa, Glycine max
  Coding DNA Sequence Number=SeqID_60267
  Gene Ontology: Mol. function=oxidoreductase activity, acting on NADH or NADPH, quinone or similar compound as acceptor; Cellular component=chloroplast; Biological process=ATP synthesis coupled electron transport
  Homolog annotation: Hit_ID=Q71L29; Match level="QueryCoverage=66%, HitCoverage=14%, E-value=6e-16, Identity=96%"; Hit description=NADH dehydrogenase subunit B
MDEYASIRVMLVWVIAMRFPNIMLRIARISRRRCHSSDEKYYFRSNRKKSNDWSGRVRVEKRIPHFFLSFKTVHETFISHGS

SEQ ID NO: 177046 - protein, 45 aa, Glycine max
  Coding DNA Sequence Number=SeqID_60268
STKRNTPGLSARKTLEEDELYRLELEAGADLRASDEFVSDCEIIE

SEQ ID NO: 177047 - protein, 135 aa, Glycine max
  Coding DNA Sequence Number=SeqID_60269
MILDASTGGTMMSKSPEEAIVIIDSIAASDYQSHHDRAPTQRKEEKAHYLQNQARPQQNFQGSYQGYRGGSGSNQPYGRRPQNSSPTNTSCAGPSNNSYGGSSSRGPQQHQAQPDRMSKMEDTLTQFMQKFGLEN

SEQ ID NO: 177048 - protein, 557 aa, Glycine max
  Coding DNA Sequence Number=SeqID_60270
  Gene Ontology: Mol. function=transferase activity, transferring glycosyl groups; Cellular component=nucleus; Biological process =multicellular organismal development
  Homolog annotation: Hit_ID=Q96301; Match level="QueryCoverage=78%, HitCoverage=48%, E-value=0.0, Identity=61%"; Hit description =Probable UDP-N-acetylglucosamine--peptide N- acetylglucosaminyltransf erase SPINDLY
  Pfam annotation: Domain name=Sel1; Domain location=299-330; Score =12.1; E_value=0.49; Accession=PF08238.2; Description=Sel1 repeat
  Pfam annotation: Domain name=Sel1; Domain location=408-439; Score =8.8; E_value=1.3; Accession=PF08238.2; Description=Sel1 repeat
  Pfam annotation: Domain name=Sel1; Domain location=442-473; Score =8.4; E_value=1.5; Accession=PF08238.2; Description=Sel1 repeat
  Pfam annotation: Domain name=TPR_1; Domain location=158-189; Score =2.8; E_value=2.5; Accession=PF00515.18; Description=Tetratricopeptide repeat
  Pfam annotation: Domain name=TPR_1; Domain location=190-223; Score =19.5; E_value=0.012; Accession=PF00515.18; Description =Tetratricopeptide repeat
  Pfam annotation: Domain name=TPR_1; Domain location=224-257; Score =30.0; E_value=8.1e-06; Accession=PF00515.18; Description =Tetratricopeptide repeat
  Pfam annotation: Domain name=TPR_1; Domain location=265-298; Score =8.4; E_value=0.53; Accession=PF00515.18; Description=Tetratricopeptid e repeat
  Pfam annotation: Domain name=TPR_1; Domain location=299-332; Score =37.5; E_value=4.5e-08; Accession=PF00515.18; Description =Tetratricopeptide repeat
  Pfam annotation: Domain name=TPR_1; Domain location=333-366; Score =47.9; E_value=3.3e-11; Accession=PF00515.18; Description =Tetratricopeptide repeat
  Pfam annotation: Domain name=TPR_1; Domain location=374-407; Score =4.9; E_value=1.4; Accession=PF00515.18; Description=Tetratricopeptide repeat
  Pfam annotation: Domain name=TPR_1; Domain location=408-441; Score =28.5; E_value=2.4e-05; Accession=PF00515.18; Description =Tetratricopeptide repeat
  Pfam annotation: Domain name=TPR_1; Domain location=442-475; Score =42.8; E_value=1.2e-09; Accession=PF00515.18; Description =Tetratricopeptide repeat
  Pfam annotation: Domain name=TPR_1; Domain location=476-509; Score =26.9; E_value=7.2e-05; Accession=PF00515.18; Description =Tetratricopeptide repeat
  Pfam annotation: Domain name=TPR_1; Domain location=510-543; Score =45.4; E_value=2e-10; Accession=PF00515.18; Description =Tetratricopeptide repeat
  Pfam annotation: Domain name=TPR_2; Domain location=158-189; Score =3.4; E_value=13; Accession=PF07719.7; Description=Tetratricopeptide repeat
  Pfam annotation: Domain name=TPR_2; Domain location=190-223; Score =15.8; E_value=0.15; Accession=PF07719.7; Description=Tetratricopeptid e repeat
  Pfam annotation: Domain name=TPR_2; Domain location=224-257; Score =21.6; E_value=0.0029; Accession=PF07719.7; Description =Tetratricopeptide repeat
  Pfam annotation: Domain name=TPR_2; Domain location=265-298; Score =6.2; E_value=6.2; Accession=PF07719.7; Description=Tetratricopeptide repeat
  Pfam annotation: Domain name=TPR_2; Domain location=299-332; Score =22.8; E_value=0.0012; Accession=PF07719.7; Description =Tetratricopeptide repeat
  Pfam annotation: Domain name=TPR_2; Domain location=333-366; Score =37.1; E_value=5.9e-08; Accession=PF07719.7; Description =Tetratricopeptide repeat
  Pfam annotation: Domain name=TPR_2; Domain location=408-441; Score =18.6; E_value=0.022; Accession=PF07719.7; Description=Tetratricopepti de repeat
  Pfam annotation: Domain name=TPR_2; Domain location=442-475; Score =32.3; E_value=1.7e-06; Accession=PF07719.7; Description =Tetratricopeptide repeat
  Pfam annotation: Domain name=TPR_2; Domain location=476-509; Score =17.9; E_value=0.038; Accession=PF07719.7; Description=Tetratricopepti de repeat
  Pfam annotation: Domain name=TPR_2; Domain location=510-543; Score =39.0; E_value=1.7e-08; Accession=PF07719.7; Description =Tetratricopeptide repeat
  Pfam annotation: Domain name=TPR_4; Domain location=299-324; Score =1.8; E_value=23; Accession=PF07721.5; Description=Tetratricopeptide repeat
  Pfam annotation: Domain name=TPR_4; Domain location=333-358; Score =9.7; E_value=2.6; Accession=PF07721.5; Description=Tetratricopeptide repeat
  Pfam annotation: Domain name=TPR_4; Domain location=442-467; Score =0.5; E_value=33; Accession=PF07721.5; Description=Tetratricopeptide repeat
  Pfam annotation: Domain name=TPR_4; Domain location=476-501; Score =5.3; E_value=8.7; Accession=PF07721.5; Description=Tetratricopeptide repeat
  Pfam annotation: Domain name=TPR_4; Domain location=510-535; Score =5.4; E_value=8.4; Accession=PF07721.5; Description=Tetratricopeptide repeat
  Pfam module annotation: Pfam domain module=Sel1::Sel1::Sel1::TPR _1::TPR_1::TPR_1::TPR_1::TPR_1::TPR_1::TPR_1::TPR_1::TPR_1::TPR _1::TPR_1::TPR_2::TPR_2::TPR_2::TPR_2::TPR_2::TPR_2::TPR_2::TPR _2::TPR_2::TPR_2::TPR_4::...
  Pfam module annotation: Pfam domain module=TPR_4::TPR_4::TPR_4::TPR _4; Domain location=299-330::408-439::442-473::158-189::190-223::224 -257::265-298::299-332::333-366::374-407::408-441::442-475::476 -509::510-543::...
  Pfam module annotation: Domain location=158-189::190-223::224 -257::265-298::299-332::333-366::408-441::442-475::476-509::510 -543::299-324::333-358::442-467::476-501::510-535
  Subcellular localization annotation: CTP_CleavageSite=57; ConfidenceScore=5.30e-01
MIALGAIKRVVPGWLREKPVLSPSAQCCNQRSSVRALSLGFGRHRTTVSERELLRCVATTTSNQQQQQLTSSSKLLHSPLFHSKNHAPLLQVKCVTGVLLLQLHESVVQMAWTEDNDENNGREKKMVGENGFLIVSEPSPAGSGGDGVSVSTRYEGKDDVLFANILRSRNKFVDALALYERVLESDGGNVEALVGKGICLQMQNMGRLAFESFAEAIRMDPQNACALTHCGILYKDEGCLVEAAESYQKALQVDPSYKAAAECLAIVLTDIGTNIKLAGNTQEGIQKYFEALKIDPHYAPAYYNLGVVYSEMMQYDMALTFYEKAASERPMYAEAYCNMGVIYKNRGDLEAAITCYERCLAVSPNFEIAKNNMAIALTDLGTKVKLEGDINRGVAFYKKALHYNWHYADAMYNLGVAYGEMLKFDMAIVFYELAFHFNPHCAEACNNLGVIYKDRDNLDKAVECYQLALGIKPNFSQSLNNLGVVYTVQGKMDAAASMIEKAIIANPTYAEAYNNLGVLYRDAGDISLAINAYEQCLKIDPDSRNAGQLKVAIAGAT

SEQ ID NO: 177049 - protein, 316 aa, Glycine max
  Coding DNA Sequence Number=SeqID_60271
  Gene Ontology: Mol. function=binding; Cellular component=membrane; Biological process=multicellular organismal development
  Homolog annotation: Hit_ID=Q96301; Match level="QueryCoverage=92%, HitCoverage=31%, E-value=1e-109, Identity=67%"; Hit description =Probable UDP-N-acetylglucosamine--peptide N- acetylglucosaminyltransf erase SPINDLY
HVEELVRLPDSFLCYTPSPEAGPVCPTPALSNGFVTFGSFNNLAKITPKVLQVWAKILCAIPNSRLVVKCKPFCCDSVRQRFLSTLEKLGLEPLRVDLLPLILLNHDHMQAYSLMDISLDTFPYAGTTTTCESLYMGVPCVTMAGSVHAHNVGVSLLSKVEVIGYEVNTPNSLGNLIAKNEDEYVKLALKLASDISALQNLRMSLRELMSKSPLCDGAKFILGLESTYRQMWRRYCKGDVPALKCMELLQQPVSSNNPSSKNSEPTRATNSSEGSPESVKANGFSSTQPPKLNFLNCEENGGSLNHSSKQGIVGSS

SEQ ID NO: 177050 - protein, 38 aa, Glycine max
  Coding DNA Sequence Number=SeqID_60272
MALVGGYLVLSLPFSIVAIVRPHAVGPRLSLIILDTGK

SEQ ID NO: 177051 - protein, 133 aa, Glycine max
  Coding DNA Sequence Number=SeqID_60273
  Subcellular localization annotation: CTP_CleavageSite=52; ConfidenceScore=5.76e-01
MNQITATTPTSATTFVDLKVLQSPTSTAINSSVTSTLRHCSCSPSLPPGCASCTMVVANQLDLLEQAIFCCVSDMRKDGIVVSRSERGRVVIIFVAAGEGLRCWLLVGFLVLGGEDAMCLLLVGGRDEDKRTK

SEQ ID NO: 177052 - protein, 79 aa, Glycine max
  Coding DNA Sequence Number=SeqID_60274
  Pfam annotation: Domain name=DUF588; Domain location=1-64; Score= -8.8; E_value=0.017; Accession=PF04535.3; Description=Domain of unknown function (DUF588)
MTIYPFIKVFLTLATAGGASAAAIVYLAHNGDQDTNWLAICNQFGDFCAQTSAAVVSSLVAVLVLVLLIVMSALAIGKP

SEQ ID NO: 177053 - protein, 200 aa, Glycine max
  Coding DNA Sequence Number=SeqID_60275
  Homolog annotation: Hit_ID=Q67X40; Match level="QueryCoverage=68%, HitCoverage=74%, E-value=4e-24, Identity=42%"; Hit description =Integral membrane family protein-like
  Pfam annotation: Domain name=DUF588; Domain location=36-185; Score =200.5; E_value=4e-57; Accession=PF04535.3; Description=Domain of unknown function (DUF588)
MSTTIDVPAETTSKNNIGNGIRKVPGAPPRPEGGWKKGLAIIDFVLRLGAIASALGAAATMATSDETLPFFTQFFQFEASYDSFSTFQYFVIAMAFVGGYLVLSLPFSIVTIIRLHAAGPRLFLIILDTVFLTIATSSAAAATAIVYLAHNGNQDSNWLAICNQFGDFCQAISGAVVASFVAVVLFVLLIVMCAVALRNH

SEQ ID NO: 177054 - protein, 195 aa, Glycine max
  Coding DNA Sequence Number=SeqID_60276
  Homolog annotation: Hit_ID=Q67X40; Match level="QueryCoverage=86%, HitCoverage=92%, E-value=8e-23, Identity=37%"; Hit description =Integral membrane family protein-like
  Pfam annotation: Domain name=DUF588; Domain location=31-180; Score =192.6; E_value=9.5e-55; Accession=PF04535.3; Description=Domain of unknown function (DUF588)
MSTTIDVPESNNVAKEKVLLLGARPRPGGWKKGVAIMDFILRLGAIAAALGAAATMGTSDQTLPFFTQFFQFEASYDSFTTFQFFVITMALVAGYLVLSLPFSIVVIIRPHAVGPRLFLIILDTVFLTLATASGASAAAIVYLAHNGNQDSNWLAICNQFGDFCAQTSGAVVSSLVSVVIFVLLIVMSALALRRN

SEQ ID NO: 177055 - protein, 89 aa, Glycine max
  Coding DNA Sequence Number=SeqID_60277
  Gene Ontology: Mol. function=binding
  Homolog annotation: Hit_ID=Q1S238; Match level="QueryCoverage=72%, HitCoverage=14%, E-value=3e-14, Identity=63%"; Hit description=IMP dehydrogenase/GMP reductase
MYLVDFVPTRVSNTTIKAVLRRVGEESSRQPRSDRRVRCGGCSDSATPMQRTVDIGTRSDDVAEPVSSGREQGAYNECGCGEVVDDNNI

SEQ ID NO: 177056 - protein, 574 aa, Glycine max
  Coding DNA Sequence Number=SeqID_60278
  Gene Ontology: Mol. function=RNA-directed DNA polymerase activity; Cellular component=chromatin; Biological process=chromatin assembly or disassembly
  Pfam annotation: Domain name=Chromo; Domain location=457-514; Score =20.7; E_value=0.0035; Accession=PF00385.14; Description='chromo' (CHRromatin Organisation MOdifier
  Pfam annotation: Domain name=rve; Domain location=245-401; Score =46.4; E_value=9.6e-11; Accession=PF00665.16; Description=Integrase core domain
  Pfam module annotation: Pfam domain module=Chromo::rve; Domain location=457-514::245-401
  Subcellular localization annotation: CTP_CleavageSite=61; ConfidenceScore=5.11e-01
MAPDPDKIEATLSWPTPTSPTTLCSFLGLMGFYRKFIRNYAAVASPLTTLLRNDQFSWSPAAEHAVHHLKQLMTQAPVLATPNFSLPFTIEIDASGSAMGAVLLQDGHPIAYYNKYKPGSANIVVDALSRIPSSEAICLSLIMPHLTFLDNLCQSLLQDPQYVDLLHQIQVCLDSYSDFTIHKDLIFRQGHIWIPFPTPFIALLLEELHSSLIGGHTSATKTLHHLRQNFDWPHIRQTLLQPLPIPSQVWEDLSLDFITGLPSSQGYTVIPVVVDRFSKGAHFSALPTHHTAYKVAWLFFDIVCKLHGFPRSLVFDRDLIFISGFWQELFCLFGTKLRMSTAYHPQTDGQTEILNQTLEHAGVSPFKVIYGKPPPTIIQYIQGTSSIYVVDSLLTTRDAALQRRLRKAQEVMKKTADKHPRDVQFVGNDWVLERIGPIAYKLQLSASSGFTPNHPLITPLTIVDWKYDESVSPPIKKVLVQWDGLAPKDTSWELWDELRHTYNLEDKAKENNKEAQLPSGGFSEIPLVLFLVVFLEPIGISTSFQEELLADMKAIGIAYNKGCLHLWVNVTHPL

SEQ ID NO: 177057 - protein, 124 aa, Glycine max
  Coding DNA Sequence Number=SeqID_60279
MVVEICSELRFSITSVSIYNETHWDIRLKSNGHWNLLRASVSNFELLDIIWDSIKHPVKSNHRLNFLIASVLNFERLDILWDTIGHTSQKLLSFEFAQSFCFQLRASRYITGLNRTSESKVIVV

SEQ ID NO: 177058 - protein, 190 aa, Glycine max
  Coding DNA Sequence Number=SeqID_60280
  Pfam annotation: Domain name=C2; Domain location=10-91; Score=13.5; E_ value=0.015; Accession=PF00168.20; Description=C2 domain
MEAKSHSQTLEITVMSGENISVDQSSVAANVYVVVGAESLNSCTTKMVNEDGGVHAWNETFLLDVPSYARSVTFEVQCKKYKGVRPIGVARIALSDFLGGNNVVSESVPQMYCYGLRNWEGRRNGVIHFSVRVVTLGDNLCSETKEEKETKMVNSKETEHEVMGFQVNSKNSNDVVIGIPVRWSYQSAIV

SEQ ID NO: 177059 - protein, 126 aa, Glycine max
  Coding DNA Sequence Number=SeqID_60281
  Subcellular localization annotation: CTP_CleavageSite=37; ConfidenceScore=5.17e-01
MNHFFRKSSRKRFFRSGRRLVTSGRTLLPETFRKNPSSGNFPENVLPELPEEPLTGLPEVSAVSLLSPFFPASSPLVFYPKVTILSKGELGRLTSFAEKKKTRFALALPEKKKQFAEKGEQASRKE

SEQ ID NO: 177060 - protein, 46 aa, Glycine max
  Coding DNA Sequence Number=SeqID_60282
MKHLQGTIQTLACVIDTWQSTSEGTSSFTPPKVWDLGGKAKSCTLV

SEQ ID NO: 177061 - protein, 69 aa, Glycine max
  Coding DNA Sequence Number=SeqID_60283
MRVIDPSITCSYHHCSQSNAPAGNQSQVCTVAGYYSTTRPSFVDCYPWLPYGVNHKCKALIDGCHRISS

SEQ ID NO: 177062 - protein, 183 aa, Glycine max
  Coding DNA Sequence Number=SeqID_60284
  Homolog annotation: Hit_ID=Q6EPW3; Match level="QueryCoverage=72%, HitCoverage=50%, E-value=2e-10, Identity=34%"; Hit description=F-box protein-like
  Subcellular localization annotation: CTP_CleavageSite=62; ConfidenceScore=5.51e-01
MPRALSSPTPSPPRTHFPPIKLLFLQTILTARQNSSQPGDRNRDRVVPVLAFQNRPGRPEARGENGGEVPGRRGHVSGAGRKPEADVDFGGPHGETCGGCLEWKGSGVGETLAERGGGGADVDGVQMNGRDSLVILQGVLEGERRWKKKKEEGGEGYRVFLKRKKERKEGKMASLTNLARQLG

SEQ ID NO: 177063 - protein, 252 aa, Glycine max
  Coding DNA Sequence Number=SeqID_60285
MLFKSDAGIQFPMKHGQLSCLKCHNVGHVSDTSTLLHSWDLFYMCQALFISLLRLSAPLESLIREKLSAKHPEAYEWFWSEQVPAAVASFVNKLEGDGRFTAAIALSGKNMGLSSASDISLLLLALTCIAAIAKLGPSRVSCSQFFSMITEISGSLMDMMVGLIPVSQAYNSIKNIGLHREFLVHFGPRAASCRAKEKWGSEEVVFWVNLAQKQLQQAIDKEKIWSRLTTSESIELSIPDSGAERLTPKSIF

SEQ ID NO: 177064 - protein, 63 aa, Glycine max
  Coding DNA Sequence Number=SeqID_60286
MQKLIKERMENNVVNFVGLNKVKWWLDRNIEMAITEATGLQMRGFQNEVKGLVLKFNLGSRIT

SEQ ID NO: 177065 - protein, 347 aa, Glycine max
  Coding DNA Sequence Number=SeqID_60287
MSNNHLKRCPYAGSEYGPRVCDAQTTQPNPWVGVFTKAVLQLHSLTPILHRLHGSYTAQHQQQLASVKVIDFSLSLLLVANYDYNYDSSSLRRKVSDLHCVLLSKWGSSRKGCLIRHDVLSSSNYGLLGFRKCYLVISKPRRGAHLLPFASSDDGVTVNGSLQASTGTDLEKMRVELNRSLEDEEFCDGLVQALYDAARVFELAIKEHKSFSRMSWLSTAWLGVDQNAWVKALSCQFLPILVGLPVLADICGGGGVRKFHIVYLSSWDTTYISVGQLHLVPIGFKLKSNSSMVYGGDIHSFHYISLDPTIFGVGEGIEKSHIVYLSHKGVIYILVELLNLIWFYDEI

SEQ ID NO: 177066 - protein, 205 aa, Glycine max
  Coding DNA Sequence Number=SeqID_60288
  Gene Ontology: Mol. function=RNA-directed DNA polymerase activity; Biological process=RNA-dependent DNA replication
MDMWPIVIQKFKKKLALWKNKQIGDSKEVPFGGGGDEEKRKIPWVAWDDICKSKNGGGLGVKNLKFFNEALFETVCPFRQLQPESVQHLFLSCGVVSNIWNKCYSWISLNFGTVNPAMLEGHFWHITGLGRSKYELEVWKSIWSNVLLCIWNKRNKCIFQQALVDWKLMMDELKFTAWSSLYNKYSSFKYSFVQWNYNTSTCLIG

SEQ ID NO: 177067 - protein, 144 aa, Glycine max
  Coding DNA Sequence Number=SeqID_60289
MILLYRFNIIVWLGDIVGAGWGVAPWYGGDGGNANVCRHIGGAKESQWTHYGTEKVGFTMVQWWLDCVRGGSHLHRFGRADGVMVVLCVARVGIAGVGVTGEKGGWGCREWGRVKEGWGHREIQILGVCRRVGGAGKGIRKGLH

SEQ ID NO: 177068 - protein, 671 aa, Glycine max
  Coding DNA Sequence Number=SeqID_60290
  Homolog annotation: Hit_ID=P53927; Match level="QueryCoverage=23%, HitCoverage=78%, E-value=8e-07, Identity=30%"; Hit description =Probable RNA-binding protein YNL110C
  Pfam annotation: Domain name=RRM_1; Domain location=173-243; Score =43.8; E_value=6e-10; Accession=PF00076.12; Description=RNA recognition motif. (a.k.a. RRM, R
VTKQSHMHRSKHEGPPNAEAVRQAFDVCSHWMQSFIKYSTWLESPSNVKAAEFLSTGHKKLMECMEELGMIRDKALETEGKKAAHRRRSTVQSTIKESGSFDEALKSVEETVVRLEKLLQELHVSSSSSGKEHLKAACSDLEKIRKLWKEAEFLEASFRAKADSLQENDIQSFYFTRFPEDATEKELWLHFKKFGDVREVFISRQRNKNGKRYGFVRFKGMEDVHSLEKKLDNIIFSGLKMYVNIPKYGRVRDAQIVPEAKRTEEKQQKGKEEPSRRHPFPRTTQGSWPGTTDTQLQWEDQVVKTIAVKDHGLRVEDDLLWGIEADISPKYMGDDIVLLLGLTDDRAQQMVEEEIEGGVSSFHSLEKWNPKLRPGCQLTWVNCWGIPLVAWDTEQIRKIVVGIGEVVDVDDDVEMLRRLDRARVLIKTPWKPLIQHTVNVHIQGEVYGVHLVEEGGICSEMHHCRRGSEYGSSEEIETDVSDVGMPLKEDRRRSALEDGLTVNPTENQAQTVAPEFVQVAHKGAQLAHAAHGVAKVADVMTDETGMTKTSACKPGKKEAQWIPYWAWTQNERHTNQCGLRSTIQRKVAKKRGNLDGRRKRNVTTTWKRKAVVEIADQGENMKQAATDIWNIAKQLGVTGAADQGRFVEKILIMEERDRKEAERLGKKSDNP

SEQ ID NO: 177069 - protein, 136 aa, Glycine max
  Coding DNA Sequence Number=SeqID_60291
  Gene Ontology: Biological process=intracellular signaling cascade
  Homolog annotation: Hit_ID=Q2QXS1; Match level="QueryCoverage=72%, HitCoverage=23%, E-value=1e-25, Identity=51%"; Hit description =Expressed protein
MRFQEYNLTVEYYRTPFLCVIGRPPQNSSSNVRSTIRLDELHWYFNKWVEADVLVFNSGHWWNPDKTIKLGIYFQEGGRVNKTMNVKEAFRRSLQTWKSWTLHNLDPRSFVFFRSYSSVHFRQVHKHNSSSKACFM

SEQ ID NO: 177070 - protein, 54 aa, Glycine max
  Coding DNA Sequence Number=SeqID_60292
MAVAVRLDGEMNVFDDVSKTKSTAPVIVQKHNRLDCFFVDNKGYVDRESASKQE

SEQ ID NO: 177071 - protein, 631 aa, Glycine max
  Coding DNA Sequence Number=SeqID_60293
  Homolog annotation: Hit_ID=Q84MH1; Match level="QueryCoverage=80%, HitCoverage=82%, E-value=1e-140, Identity=51%"; Hit description =Expressed protein
  Pfam annotation: Domain name=RAP; Domain location=581-630; Score =44.5; E_value=3.7e-10; Accession=PF08373.1; Description=RAP domain
  Subcellular localization annotation: CTP_CleavageSite=65; ConfidenceScore=5.29e-01
MEGLLNSLHNQSCLKPFGFTPRLGYTFPVITRTGHLNRKPESCTLRSNCAQLGRDTSTSSRGAIVAALYSNDKGEGSNTDWESEFLGELDPFGYRAPKKREKEKRSMLLEATDGMDWCVRARKEALKSIEARGMAHLMENMVTVKKKKKKDKKKLESKKKIVKKIEKIEDLDFSLEEDLPQPMETEIDVGDLKRRVSIFNDGMFIEKKEKTKEEFVNRLSQFSGPSDHRKELNLNKAITEAQTADDVLEVTYETIVAVAKGLIPSPLSPLNIATALHRIAKNMEKVSMMRTRRLAFARQREMSMLVSIAMTALPECSAQGVSNISWALSKIGGELLYLSEMDRIAEVALTKVPLLQCSILLLIFSQSFQKRASDIIHTFQEQELAQLLWAFASLYEPADPIFDSLDIVFKDHSQLRGCIGEKTSNNHEQISVDRSGASNGSLGSPVLTLTRDQLGTIAWSYAVFGQMARSFFSHVWKTLSHYEEQRISELYREDIMFASQVHLVNQCLKLEFPHLQLSLCGELEDKVALSGKTKRFNQKITSSFQKEVGHLLVSTGLEWVKEFVVDGYTLDAVIVDKKLALEIDGPTHFSRNTGVPLGHTMLKRRYITAAGWKVASISYQKHIELSNKTIV

SEQ ID NO: 177072 - protein, 77 aa, Glycine max
  Coding DNA Sequence Number=SeqID_60294
MAIQALQANAANTNGGTCANVDSPVIGSCDIPSMSPCRQRLGHVIALQETRALLLHWLGQSEACSRSHALQIASALV

SEQ ID NO: 177073 - protein, 211 aa, Glycine max
  Coding DNA Sequence Number=SeqID_60295
  Gene Ontology: Mol. function=nucleoside-triphosphatase activity; Cellular component=signal recognition particle, endoplasmic reticulum targeting; Biological process=SRP-dependent cotranslational protein targeting to membrane
  Homolog annotation: Hit_ID=Q9SWS7; Match level="QueryCoverage=73%, HitCoverage=42%, E-value=1e-67, Identity=83%"; Hit description =Chloroplast SRP receptor homolog, alpha subunit CPFTSY
  Pfam annotation: Domain name=SRP54_N; Domain location=73-155; Score =19.1; E_value=0.0038; Accession=PF02881.9; Description=SRP54-type protein, helical bundle domain
  Subcellular localization annotation: CTP_CleavageSite=46; ConfidenceScore=5.87e-01
MATTSASFASFSVILRPSSSNPQFFLFNVAPRTGTSHSRTRSTRFRCSAGQTGFFTKLGRLIKEKAKSDVEKLFSGFSKTRSNLAVIDELLLYWNLADTDRVLDELEEALLVSDFGPRITIKIVENLREDIFSGKLKSGNEIKEALKRNVLELLTSKGSKTELQLGYRKPAVIMIVGVNGGGKTTSLGKLAYRLKNEGAKLFVGQQEVPFS

SEQ ID NO: 177074 - protein, 789 aa, Glycine max
  Coding DNA Sequence Number=SeqID_60296
  Gene Ontology: Mol. function=protein serine/threonine kinase activity; Cellular component=plastid chromosome; Biological process =positive regulation of transcription, DNA-dependent
  Homolog annotation: Hit_ID=Q8S5U6; Match level="QueryCoverage=66%, HitCoverage=82%, E-value=8e-44, Identity=24%"; Hit description =Putative indole-3-acetate beta-glucosyltransferase
  Pfam annotation: Domain name=PPR; Domain location=191-225; Score=4.7; E_value=2.1; Accession=PF01535.11; Description=PPR repeat
  Pfam annotation: Domain name=PPR; Domain location=226-260; Score =40.8; E_value=4.8e-09; Accession=PF01535.11; Description=PPR repeat
  Pfam annotation: Domain name=PPR; Domain location=261-296; Score=2.2; E_value=4.1; Accession=PF01535.11; Description=PPR repeat
  Pfam annotation: Domain name=PPR; Domain location=297-331; Score =27.2; E_value=5.8e-05; Accession=PF01535.11; Description=PPR repeat
  Pfam annotation: Domain name=PPR; Domain location=332-367; Score=4.6; E_value=2.2; Accession=PF01535.11; Description=PPR repeat
  Pfam annotation: Domain name=PPR; Domain location=368-402; Score =37.2; E_value=5.6e-08; Accession=PF01535.11; Description=PPR repeat
  Pfam annotation: Domain name=PPR; Domain location=403-437; Score =31.8; E_value=2.4e-06; Accession=PF01535.11; Description=PPR repeat
  Pfam annotation: Domain name=PPR; Domain location=438-472; Score =47.4; E_value=4.8e-11; Accession=PF01535.11; Description=PPR repeat
  Pfam annotation: Domain name=PPR; Domain location=473-507; Score =34.3; E_value=4.3e-07; Accession=PF01535.11; Description=PPR repeat
  Pfam annotation: Domain name=PPR; Domain location=508-542; Score =41.0; E_value=4.2e-09; Accession=PF01535.11; Description=PPR repeat
  Pfam annotation: Domain name=PPR; Domain location=646-680; Score=3.5; E_value=2.9; Accession=PF01535.11; Description=PPR repeat
  Pfam module annotation: Pfam domain module=PPR::PPR::PPR::PPR::PPR::PP R::PPR::PPR::PPR::PPR::PPR; Domain location=191-225::226-260::261 -296::297-331::332-367::368-402::403-437::438-472::473-507::508 -542::646-680
  Subcellular localization annotation: CTP_CleavageSite=66; ConfidenceScore=5.69e-01
MASTPTPRPHFSSVPPIPSNNNQRHHHNQNRSHHRRNNNRNRWSSSSTRFYSSPASSAGAGAGVPSAAATASAAFSSSLSPWLGAQKTRLAPEFSGRRSNRNPGKMNSGGPRAVPNNQQHSKAAEEVLHSLTNAGNDVSAIDSVLLHYRLYVAEDYVYLLKEFANTGDLLLATRTYDFAMSRATDNTFMGKLTSNMIRTLGRLKKIELALDLFEESRTRGYGNTVYSFSAMISALGRNNRFSEAVSLLRSMGKFGLEPNLVTYNAIIDAGAKGELTFEIVVKFLEEMIAAGCMPDRLTYNSLLKTCVAKGRWKLCRDLLAEMEWKGIGRDVYTYNTYVDALCKGGRMDLARHAIDVEMPAKNIWPNVVTYSTLMAGYSKAERFEDALNIYDEMKHLLIRLDRVSYNTLVGLYANLGWFEEAVGKFKEMECCGIKNDVVTYNALIEGYGRHNKYVEVQKLFDEMKARRIYPNDLTYSTLIKIYTKGRMYAEAMDVYRELKQEGMKTDVVFYSALIDALCKNGLIESSLRLLDVMTEKGSRPNVVTYNSIIDAFKIGQQLPALECAVDTPFQANEHQIKPSSSRLIVGNFQDQKTDIGNNDEIMKMLEQLAAEKAGLTKKDKRSRQDNFFIVQIFQKMHEMEIKPNVVTFSAILNACSCCETFQDASKLLDALRVFDSQVYGVAHGLLMGHRQGIWDQTQTLFDELEHLDSSTASAFYNALTDMLWHFGQKLGAQMVVIEGRNRNVWKGGWSTESLDLHLTSCGAACAMVHTWLLELRTTVFGGQKLPPIL

SEQ ID NO: 177075 - protein, 91 aa, Glycine max
  Coding DNA Sequence Number=SeqID_60297
  Homolog annotation: Hit_ID=Q2QN32; Match level="QueryCoverage=81%, HitCoverage=15%, E-value=2e-13, Identity=56%"; Hit description =Lipase, putative, expressed
MPCLGRYGHEPYKTRMEEARTIDEVAFNVRGLSIDCFIPPAGLRTTSISEACELPQYERVKNSLAVHRAKVVVLEKSHNCSIDSMIWKMEI

SEQ ID NO: 177076 - protein, 104 aa, Glycine max
  Coding DNA Sequence Number=SeqID_60298
  Subcellular localization annotation: CTP_CleavageSite=73; ConfidenceScore=5.22e-01
MKKIFFISKNAQRSTTPNVQKATFKNAACKPRVETYPLQHCTLATLHASLGQNLSRQWDRRDLLTGCQVSRVLASSNGGSYVDYVSPVTMAASNQFPTWTVSRL

SEQ ID NO: 177077 - protein, 112 aa, Glycine max
  Coding DNA Sequence Number=SeqID_60299
  Subcellular localization annotation: CTP_CleavageSite=63; ConfidenceScore=5.22e-01
MYNSPGILIALLFITVGIGFNTKQPARRSSNEHQATTSNQHPAATKKTNQQQRATEEETMCVRRSKKNEEKRRSKGKTRGRGRRQNRRGRRRSRSEAAQRRKGEDESLFLMY

SEQ ID NO: 177078 - protein, 82 aa, Glycine max
  Coding DNA Sequence Number=SeqID_60300
  Gene Ontology: Mol. function=nucleoside-triphosphatase activity; Cellular component=signal recognition particle, endoplasmic reticulum targeting; Biological process=SRP-dependent cotranslational protein targeting to membrane
  Homolog annotation: Hit_ID=Q9SWS7; Match level="QueryCoverage=69%, HitCoverage=15%, E-value=2e-21, Identity=86%"; Hit description =Chloroplast SRP receptor homolog, alpha subunit CPFTSY
  Pfam annotation: Domain name=SRP54; Domain location=5-82; Score= -70.2; E_value=4.1e-06; Accession=PF00448.13; Description=SRP54-type protein, GTPase domain
MRFIPLSSILQPNEWSVTNMFSFQVVGVTVLILTKLDGSARGGCVVSVVDELGIPVKFVGVGEGVEDLQPFDAETFVNAIFI

SEQ ID NO: 177079 - protein, 129 aa, Glycine max
  Coding DNA Sequence Number=SeqID_60301
  Gene Ontology: Mol. function=glutathione transferase activity; Biological process=auxin mediated signaling pathway
  Homolog annotation: Hit_ID=Q9FQE1; Match level="QueryCoverage=93%, HitCoverage=53%, E-value=1e-42, Identity=70%"; Hit description =Glutathione S-transferase GST 17
  Pfam annotation: Domain name=GST_C; Domain location=1-96; Score=12.3; E_value=0.013; Accession=PF00043.15; Description=Glutathione S -transferase, C-terminal domain
MCNCNVMLGKAGWVAMSTSGDEQEEAMKEAKEMMEKIEEIKGKNYFGGDNIGYLDIALGWIAYLVPVWEEVGSMQIIDPLKFPATIAWMTNFLSHPVIKDSLPPRDKMLVYYHSRRKELSSTSLGLFKV

SEQ ID NO: 177080 - protein, 90 aa, Glycine max
  Coding DNA Sequence Number=SeqID_60302
MASGVSITHPRAALVTTIRSFMDKDWCLSFQHTLREGNFVADGRPQAGPLLASRLNDARKEQGTGGLHDANGDRTKAMNVPIWDQDPPYK

SEQ ID NO: 177081 - protein, 174 aa, Glycine max
  Coding DNA Sequence Number=SeqID_60303
MEEVSIVTSQSLSKNIYSILGNLCEMIINLLLLELLRRWKPESKSFLIQDRPETKKFPRVLHWLEKTYFTDKDLKSKFNESQFVETLSPFDHELKINVVCEAFASMPDSDGEGNIGALEWCELQPAENLEVEQHQEEVEIMQQLAVEQHPDATDDLEESYLYALALAVNIFVFT

SEQ ID NO: 177082 - protein, 77 aa, Glycine max
  Coding DNA Sequence Number=SeqID_60304
  Homolog annotation: Hit_ID=Q1SAV4; Match level="QueryCoverage=58%, HitCoverage=11%, E-value=2e-08, Identity=58%"; Hit description =Integrase, catalytic region
MSEWDRTTTPPSLMVLVQWQGFALEDTSWEDWNALQSAYDLKDEVTFGGKGIDSNSNQGNNRPKRDMRRPTYLEDYA

SEQ ID NO: 177083 - protein, 155 aa, Glycine max
  Coding DNA Sequence Number=SeqID_60305
MPGDVVPQGCVDLGETPGKGWRTRCHAPAKGAVWRIKGAAREGSYANVVADLCRSAKGKSDGVVTNQKGCRHGGGRQLPEKPVMTGTLFRKGEKGRRKAEASRQNKCDDHKGLPESENIGKKFARKGVASIKIHRGQQVPDGLSPVGTVFFTPST

SEQ ID NO: 177084 - protein, 46 aa, Glycine max
  Coding DNA Sequence Number=SeqID_60306
MEVATFKNNTLIVETMVCSYPYHNFHGDLGAELSDLPLIVNDAPNP

SEQ ID NO: 177085 - protein, 79 aa, Glycine max
  Coding DNA Sequence Number=SeqID_60307
MWSIKVNWYSAHAVAGQHPNWGGWLYPTSTKWTIQLSRTIRGGQTAQIGHPRDAISGLEVLGHSNSCTSTYISPRDFLL

SEQ ID NO: 177086 - protein, 329 aa, Glycine max
  Coding DNA Sequence Number=SeqID_60308
  Gene Ontology: Mol. function=DNA-directed RNA polymerase activity; Cellular component=mitochondrion; Biological process=transcription
  Homolog annotation: Hit_ID=Q8L6J3; Match level="QueryCoverage=73%, HitCoverage=27%, E-value=3e-88, Identity=57%"; Hit description=DNA -directed RNA polymerase 2B, chloroplast/mitochondrial precursor
MDFGVQWVVGVNLPASPGVNWHCIHALGTSKLVSSFLIYFYSSHSHSLASGYVLGTAKNMVIPYMPMLVPPVNWSGYDKGGHLFLPSYVMRTHGARQQREAVKRAPRKQLEPVFEELWKDFFHKNTHDQALDTLGHTKWRVNKKVLSVVDRIWASGGRIADLVDRDDVPLPDKPVTDDEEKIKKWKWKCKSLQKENRERYSQRCDIELKLAVARKMKDEEGFYYPHNLDFRGRAYPMHPHLNHLGSDLCRDKPLQGRRWWLKAEDPLQCLAVCITLTEALRSSSPETFISHIPVHQVLFTEITTLFMGNTACICPSPYPHCWEPCALGH

SEQ ID NO: 177087 - protein, 123 aa, Glycine max
  Coding DNA Sequence Number=SeqID_60309
MDLGGNPLYKVNATLLRGVGKTQDKITSSLVYVFACVRKESRCSSRSVVSSYHSSFHDAVDKGVLTSSSPCWMVYVGETWIILSVDCALGMRFPLSALNQCASRVLFTLGVSHTNFELIVVSI

SEQ ID NO: 177088 - protein, 115 aa, Glycine max
  Coding DNA Sequence Number=SeqID_60310
MTYVALASLQQTNDESLWKFMDRFGCIVVQIHNLNPEVALHSMLLALRPVAWTSCANKSKVTSRWKRCPSSGTRCDKLDKSATSENEAPRPTHTSQTKGTSRTSASLYQKCGVPK

SEQ ID NO: 177089 - protein, 413 aa, Glycine max
  Coding DNA Sequence Number=SeqID_60311
  Gene Ontology: Mol. function=DNA-directed RNA polymerase activity; Cellular component=mitochondrion; Biological process=transcription
  Homolog annotation: Hit_ID=Q8L6J3; Match level="QueryCoverage=75%, HitCoverage=27%, E-value=7e-80, Identity=53%"; Hit description=DNA -directed RNA polymerase 2B, chloroplast/mitochondrial precursor
  Subcellular localization annotation: CTP_CleavageSite=11; ConfidenceScore=5.01e-01
MWRHAAKHACRGSIRQSFHPSRLLSLSHGSIFSPKREAFLYSVARLNCIGRGDFQFQFGAKGYSGVAEAASSTDVEEDGVFVDEIQQLLLQEMNDEVESQLVEEEGAPIDEIQQLLLHEMHKEERNELVEEQAAPGDGIRGLFQGMKKEKQKKVVGYNRWQNEGKGVGQCRYQELRRRQVKIETETWEEAAKEYRELLMDMCEHKLAPNLPYMKSLFLGWFEPLRDAIVKEQEMYGEGKNRTAYVPYFVQLPADKMAVIAMHKLMGLLMTGTEHATVGTARVVQAACGIGDAIENEVRIHKFLEKTKKKKGDRSKKNKASESVADIKEEQKLRKKVIDLMKKQKLVAVRGLVKGKDDTKPWGAAIKTKVGSRLIELLMQTAYIQPPPDQLLDAAPDIRPAFVHSFRTVAKVSA

SEQ ID NO: 177090 - protein, 96 aa, Glycine max
  Coding DNA Sequence Number=SeqID_60312
MENWEIAGQRKQKRIIEIIGDLNRTGIMLHRILADLNRSSLYKPSTFQSFSIGNIKLFSLEKLSRAFLALYPNMLYFTNGLDQNEGQWSVQRDQQP

SEQ ID NO: 177091 - protein, 302 aa, Glycine max
  Coding DNA Sequence Number=SeqID_60313
MSPSIVALAAGEGGQLAVEVGPIAGVVEVAPDDPSSVLAKRNQDDGAGVLGHKKSMAFFSLCALRQATGLTLGSIRSSKIVPIAKLDAPAALAGLIVTPSSTFAECQCGAPEMSSPPSSTTWIPTSTVLASILKIFDKNGQRHQEVLSKVASLEAEIAKWRTTARTVWRMERPKVASATVAFTEAMNSNHQLSSKICSVLAKLLRIRLGGDELLECSLEDWLKESKSKIEEFELRATREREASKELEEGLLMYKKKAEDLGHFDPFKDVKDGVLLDEEDIAAEEEDVDEEQDVKEQGDDANV

SEQ ID NO: 177092 - protein, 118 aa, Glycine max
  Coding DNA Sequence Number=SeqID_60314
MGSSCLTGLIPLKSLSVKVIGVNVLDIMKVMLARLVGLPSIGESIRNGVDYTSNLLGGFIFPVLANVVDRVLLVVSLSSLIFYFISSSVCVLISMLILLVSFRSHSCLVDVWPLNKLC

SEQ ID NO: 177093 - protein, 107 aa, Glycine max
  Coding DNA Sequence Number=SeqID_60315
MGYEVLGVTCNSLSGARSPYETVVATTESPREAMTKKDAKKMADRVPGNGHFDDGDGGHQCRLQVNHMRVGVTGKLVSRIMGEVLGERRGSRHRIWEKRLWQWRGLV

SEQ ID NO: 177094 - protein, 329 aa, Glycine max
  Coding DNA Sequence Number=SeqID_60316
  Gene Ontology: Mol. function=peptidase activity; Cellular component =integral to membrane; Biological process=aromatic compound metabolic process
  Homolog annotation: Hit_ID=Q2QTQ5; Match level="QueryCoverage=88%, HitCoverage=75%, E-value=1e-103, Identity=64%"; Hit description =Expressed protein
GADDVTGKLKMTGVATRENVDVLKLCTRRGNSVVAMYIRNPSASLTMLYSHGNAADLGQLYDLFSQLSLHLRLNLLCYDYSGYGQSSGKPSEQNTYADIEAAYKCLVEMYGAKEEDIILYGQSVGSGPTTDLATRLPNLRAVILHSPILSGLRVIYPVKKTYWFDIYKNIDKIPLVNCPVLGTADDVVDYSHGKQLWEHCKQKYEPLWIKGGNHCNLELYPQYIKHLKKFITAIETSSHKKTGSGPVPDQLDRPRNSTDFREKPRLSMDLRETLRRSIDFKEKPRTSTDHKEKSRAGPDKKDKSRKSVDRSEKACNGAEIPEKARNSID

SEQ ID NO: 177095 - protein, 67 aa, Glycine max
  Coding DNA Sequence Number=SeqID_60317
  Subcellular localization annotation: CTP_CleavageSite=49; ConfidenceScore=5.45e-01
MAFKVLFPVMLFQAQHFLQAFSVFFFLTFNSLLNLRLMPIAFPLSLKALAFINKKQETWYKACQSGK

SEQ ID NO: 177096 - protein, 156 aa, Glycine max
  Coding DNA Sequence Number=SeqID_60318
  Gene Ontology: Mol. function=phosphoinositide binding; Cellular component=multivesicular body; Biological process=cell communication
  Homolog annotation: Hit_ID=Q9FG38; Match level="QueryCoverage=60%, HitCoverage=23%, E-value=5e-42, Identity=88%"; Hit description =Sorting nexin-like protein
  Pfam annotation: Domain name=PX; Domain location=44-148; Score=76.3; E_value=9.6e-20; Accession=PF00787.14; Description=PX domain
MWHLGFSKCVDNMVCDSFNESRIDFDIILECSIFSCLRNAEILGALISALKILGIGCIFRTNFPEYQGPEKIVIRRYSDFVWLRDRLFEKYKGIFIPPLPEKSAVEKFRFSAEFIEMRRQALDVFVNRIASHHELKQSEDLRLFLQAEEEVMPHSQ

SEQ ID NO: 177097 - protein, 102 aa, Glycine max
  Coding DNA Sequence Number=SeqID_60319
  Subcellular localization annotation: CTP_CleavageSite=37; ConfidenceScore=5.71e-01
MEQQQQQRTLSGSSQSPRSPSSSSQPFLSVSVTDPVKLGNGVQAYISYRVITKFWIGNFSLNLSRVLILRVDGGRWSFGSTQLRPRLLISKSVEDEIVVLCD

SEQ ID NO: 177098 - protein, 118 aa, Glycine max
  Coding DNA Sequence Number=SeqID_60320
MGSNLPTHPHRPIDLMGVVLQTISPYRSFLKILRGGAVFYVIFTLHASQIAMHAGDFTREGYVASRHCHWQHSQWLSPRLGRHRGAGGAGVAEGITIVTSDLRFGYRHCCWQFALREL

SEQ ID NO: 177099 - protein, 139 aa, Glycine max
  Coding DNA Sequence Number=SeqID_60321
MAERGHGMYYTPPTFSQYPTQMYQYPFKGHHTDISASKHSFGGVAETHLHFSWPTMTPSQQHDAPIPTPNAPLGTQWNVPRAIPDIGDLLGADLHHQFSVEADQVETGRHRDRRNPDRQAQRWDRSCDTSSRHHGYHNE

SEQ ID NO: 177100 - protein, 71 aa, Glycine max
  Coding DNA Sequence Number=SeqID_60322
MKLHLRINFIRMNHTDERYRLINTTDELHLYQYRKGNASNAINGDVKFTSTVEDQSTTKVLNALNHQMRRE

SEQ ID NO: 177101 - protein, 73 aa, Glycine max
  Coding DNA Sequence Number=SeqID_60323
MTLDLLFVMDRPVTWNILDQGVEPQYNLLHVDGWAVGQEGEAPLPRSLLTLGLHVSDAEVEVTTLILGPPGSE

SEQ ID NO: 177102 - protein, 112 aa, Glycine max
  Coding DNA Sequence Number=SeqID_60324
  Homolog annotation: Hit_ID=Q2QMW0; Match level="QueryCoverage=51%, HitCoverage=12%, E-value=2e-11, Identity=55%"; Hit description =Expressed protein
MEVAITTGYVASGSGEKPLTLAKGSITWQKGRFGENTIISNIDIGFVGNVGSCTKINRPVDIITVVGGQGYSLHVDIQYLDARWEVLVVLPLRDCFAQEINMLCRLDGFVVL

SEQ ID NO: 177103 - protein, 172 aa, Glycine max
  Coding DNA Sequence Number=SeqID_60325
AVPSSNLHSYQILNSSSSINGNCMLPKSEELEDMDCVGHSSESRSGVCVAQSVENGGFGGGGRCCKQASPPRSGGSRNTSPMSRAGSRNTSPSRQKVVKTKPRGLDEETLATFGKVVHADIQMEDNIWAMLPEDLLHEILARCPITWAVSPYVLEEHADPPVFSLQLATESL

SEQ ID NO: 177104 - protein, 122 aa, Glycine max
  Coding DNA Sequence Number=SeqID_60326
  Subcellular localization annotation: CTP_CleavageSite=36; ConfidenceScore=5.19e-01
MFHTPDNSAKPSEAVKYASFQALHESRSHVDDKKVTSMLSPSPSRLMLRPRSSRVTLDLLSIMEEPVTTIRILGIEIQPYLPPPPGSVRILGVELRPYLPPPGPLLEIDAPVSNANMKRQPS

SEQ ID NO: 177105 - protein, 177 aa, Glycine max
  Coding DNA Sequence Number=SeqID_60327
  Gene Ontology: Mol. function=protein binding; Cellular component =nucleus; Biological process=regulation of transcription, DNA -dependent
  Homolog annotation: Hit_ID=Q39090; Match level="QueryCoverage=76%, HitCoverage=31%, E-value=2e-11, Identity=29%"; Hit description =Protein UNUSUAL FLORAL ORGANS
MAYCDSRLYLETLSPLGLMMYRLDTGHWEHIPAKFPRSLLDGYLVAGTQKRLFLVGRIGLYSTLQSMRIWELDHNKITWVEISRMPPKYFRALLRLSAERFECFGQDNLICFTSWNQGKGLLYDVDKKIWSWIGGCALQSYNNQVCFYEPSKISYSQAVMNSMPDCECWFSSIDRFL

SEQ ID NO: 177106 - protein, 53 aa, Glycine max
  Coding DNA Sequence Number=SeqID_60328
MGLFCLTGDLQQARARLSKLFRFQMAVLFSNGRALDGVNGYSKWCWRDHAIWI

SEQ ID NO: 177107 - protein, 95 aa, Glycine max
  Coding DNA Sequence Number=SeqID_60329
MSRYMCYAKVQSLALAIIKVSNTSGVDRKVLVWDLEDVLGVTCNSLSGARSPYETVVATTESPREAMTKKDAKIMADRVPGNGHFDDGDGGHQCR

SEQ ID NO: 177108 - protein, 148 aa, Glycine max
  Coding DNA Sequence Number=SeqID_60330
  Homolog annotation: Hit_ID=Q1T493; Match level="QueryCoverage=95%, HitCoverage=26%, E-value=1e-20, Identity=36%"; Hit description =Nucleic acid-binding, OB-fold, subgroup
MDLKENCTYVMHNFKVLKNNGQYRVCDHQFKLVFIGVTVVRECVLGDIPFRKYRFTGFADVVAGQFERGLLVDIIGVVEEVVFQQVSGKGRRVVFKLKNLSQQLLSCTLWDDYCLQFLKFLDDYEGDGPITVLLSHCRIKEAQGISSS

SEQ ID NO: 177109 - protein, 79 aa, Glycine max
  Coding DNA Sequence Number=SeqID_60331
MPQPFSTDTEISGYLFDFLFAAQDASTSSLLWAVALLELHAELLAKVRDMTLRRWHRLLTKLVIVSNNSVMDCEIYVID

SEQ ID NO: 177110 - protein, 149 aa, Glycine max
  Coding DNA Sequence Number=SeqID_60332
MELTAIIWSKEVGGGGEQDEDLETIGKNLFKEKLKLLKTKLWGWHVEVFDGLGANINSKVEELEVVKTRLCVRVEDVGGRRLILSKEFWRSLKKWPKNIGFIYLYEIQAKSMKIKVLDDSQCIVIGRYCLNIQSSEEKCFDTSLIVQRQ

SEQ ID NO: 177111 - protein, 202 aa, Glycine max
  Coding DNA Sequence Number=SeqID_60333
MGLFWYVKCMQTNSFIGEFALAATRGENATAIGRMQWVYEENDGVIFECSKKAIQIKRRISFNALKKKLEIRFLVSGKYVALQICDDEDVETILESFQQQDQMSDMELYIEKDVAGGSMFHSANSLTSCGNKLSNNEAQPPRNVSNLHGDEDDDDDYLVSNSYVEESLDEDDSVDGISDTDDEVTDMIQPVRIVHPAECIIY

SEQ ID NO: 177112 - protein, 158 aa, Glycine max
  Coding DNA Sequence Number=SeqID_60334
MGKLRNQVRQHKGKLYFADGLTRLRTELQIYESVTINFLAYDHPSKFDLHFTPPLDQQKCKRRRATRKHIWTYEITQSMLGAPYPLQLSASVTQCLIHCGDHMTILRRFGPPLQWNVVVLDKGIGDKYVTLPWYKFLQEGDFSHGDELSFYYRRAEKI

SEQ ID NO: 177113 - protein, 160 aa, Glycine max
  Coding DNA Sequence Number=SeqID_60335
MKRRNTDQMMKITLLSTLLLGCLLVMTVQGDSSAGVVPAVTVVEEGNKNKLGVSSQKEPFVRSGAGHVRKLGLGGKKFGTNEVTSVDSKNGKGAYGGETSKISGATYSDGICDFDEREGDHKIVKCKGKKSIKSRMLKMDGYVAFTDDYHGPRHHLPKHN

SEQ ID NO: 177114 - protein, 323 aa, Glycine max
  Coding DNA Sequence Number=SeqID_60336
  Gene Ontology: Mol. function=succinate-CoA ligase (ADP-forming) activity; Cellular component=cytoplasm; Biological process=metabolic process
  Homolog annotation: Hit_ID=UPI000066CF8A; Match level="QueryCoverage =99%, HitCoverage=85%, E-value=1e-131, Identity=71%"; Hit description= Succinyl-CoA synthetase, beta subunit
  Pfam annotation: Domain name=ATP-grasp_2; Domain location=2-195; Score=296.3; E_value=5.6e-86; Accession=PF08442.1; Description=ATP -grasp domain
  Pfam annotation: Domain name=Ligase_CoA; Domain location=239-323; Score=88.5; E_value=2e-23; Accession=PF00549.10; Description=CoA -ligase
  Pfam module annotation: Pfam domain module=ATP-grasp_2::Ligase_CoA; Domain location=2-195::239-323
MNIHEYQGKQILKSFGVRVQEGIVADTPEQAVEAAKKMKEDYNSDWVVVKAQIHAGGRGKGGGVKLAKNLDEVKQRATDIIGMQLVTPQTGPEGESETKEFYMSVLLDRAKGRNIVMYSTEGGMDIEEVAEKTPHLIFKEEIDPKVGLQGFQARKIAFNLGLSGAAHKEMVKFVAALYKAYDSTDSSMFEINPVLKTSDDKILAVDAKVNLDENALYRHPDYAAMRDVTEEDPTEVEAGESNLNYVKLDGNVGCMVNGAGLAMATMDIIKLAGGEPANFLDVGGTANAETVKAGFNIILKDPNVKAILINIFGGIVRCDRVAQ

SEQ ID NO: 177115 - protein, 192 aa, Glycine max
  Coding DNA Sequence Number=SeqID_60337
  Gene Ontology: Mol. function=5-methyltetrahydropteroyltriglutamate -homocysteine S-methyltransferase activity; Cellular component =cytosol; Biological process=methionine biosynthetic process
  Homolog annotation: Hit_ID=Q8ZAL3; Match level="QueryCoverage=97%, HitCoverage=24%, E-value=5e-74, Identity=76%"; Hit description=5 -methyltetrahydropteroyltriglutamate--homocysteine methyltransferase
GSRSAPAILGKHEAVQVLAEILHHIVALGFTVHQHVQSEALLLDDRLFDVLTDAGAVVVAVQTALFEVQTQATDLGGLRERTDGGGRPGRQVETFALRPGALGVSAVAFAVLRGDRRQAALDLWVVHAARLTAGADRRAVGVQFGPFRRVRRVQRRAQQRQLGAFLQREGEPAFHFFVQTAFHAQIDRAVQQ

SEQ ID NO: 177116 - protein, 172 aa, Glycine max
  Coding DNA Sequence Number=SeqID_60338
MTTLTQIWMTLLLSNILPSDHNADLPLWKDRAHKTPSGPGEVQQGPGVSSSGYGPQSVLQGARPPQQGIAPVRHLVDPEKSNRVLGFPALIMGLCQFYRMPFAPSRVISPLLSQPTLWREGNARAHGYIFHERKMRGVATNFYSRKMSKKPERRGLRTLSVKGSGVVFMHGE

SEQ ID NO: 177117 - protein, 46 aa, Glycine max
  Coding DNA Sequence Number=SeqID_60339
LHRWRPRRRLKNWSSALSASTTAQCEEPTWRPGLARIWRLSAHLVT

SEQ ID NO: 177118 - protein, 278 aa, Glycine max
  Coding DNA Sequence Number=SeqID_60340
  Homolog annotation: Hit_ID=Q6ESI7; Match level="QueryCoverage=16%, HitCoverage=3%, E-value=8e-13, Identity=65%"; Hit description =Putative tripeptidyl peptidase II
YDDKGPAIDAVVWYDGEVWRVALDTHSLDDDPDCGKLANFIPLTNYSALGPWHGVIANDACVRLCLHAWAMQCMEAPMFLENECALLRDAFGWYCFTLLCIIHEYKQVLYTEPPLSTTERSVVEAGPNASYLTKKEESAFKDGAYLNNVFESGHSKTVFTSATSLKVSILRRCLRQQRLRMPTFKDGAEAFPGYMSFMESLAKKRKCKEDVFYEVKKTVGMSCMSQVIRSEQIPIQVSCPGVQFPFVGGDTFGTDNDAAAESRVNDDYIVDITATQEA

SEQ ID NO: 177119 - protein, 179 aa, Glycine max
  Coding DNA Sequence Number=SeqID_60341
  Homolog annotation: Hit_ID=Q2HU72; Match level="QueryCoverage=29%, HitCoverage=8%, E-value=2e-18, Identity=81%"; Hit description =Steroid nuclear receptor, ligand-binding
MLRIYGVVYKGCDHVSNETITLKKICRDCYPNANVLAFYDEDDEFDGNDVVDLLPNSFDGNDVVDLLPNSFDLVAGEDLFEEFIRSSESQGYLHGAIVAVVLGIIIDMPVIPVVAIFKGLYMLFKGWKRLFHDLIGHEGPFLETICVPFADLAIVLWPLTVVGAVLASVLASFVLGGYA

SEQ ID NO: 177120 - protein, 169 aa, Glycine max
  Coding DNA Sequence Number=SeqID_60342
  Gene Ontology: Mol. function=protein serine/threonine kinase activity; Cellular component=membrane; Biological process=protein amino acid phosphorylation
  Homolog annotation: Hit_ID=Q40543; Match level="QueryCoverage=70%, HitCoverage=28%, E-value=8e-51, Identity=80%"; Hit description =Protein-serine/threonine kinase
  Pfam annotation: Domain name=Pkinase; Domain location=3-166; Score= -58.2; E_value=4.3e-05; Accession=PF00069.15; Description=Protein kinase domain
  Pfam annotation: Domain name=Pkinase_Tyr; Domain location=1-154; Score=-64.7; E_value=1.7e-08; Accession=PF07714.7; Description =Protein tyrosine kinase
  Pfam module annotation: Pfam domain module=Pkinase::Pkinase_Tyr; Domain location=3-166::1-154
MMPTGEVVAVKMLGPNSKQGEKEFQTEVLLLGRLHHRNLVNLLGYCIDKGQFMLVYEFMSNGSLENLLYGEEKELSWDERLQIAGDISHGIEYLHEGAVPPVVHRDLKSANILLDHSMRAKSWHKKPSITTKQEDEHDNQVSQTRRVMQQINIVIKEEEGCNKPSVIFK

SEQ ID NO: 177121 - protein, 626 aa, Glycine max
  Coding DNA Sequence Number=SeqID_60343
  Gene Ontology: Mol. function=phosphotransferase activity, alcohol group as acceptor; Biological process=protein modification process
  Homolog annotation: Hit_ID=Q9SI52; Match level="QueryCoverage=99%, HitCoverage=98%, E-value=0.0, Identity=61%"; Hit description =Expressed protein
  Pfam annotation: Domain name=PI3_PI4_kinase; Domain location=156-414; Score=259.4; E_value=7.6e-75; Accession=PF00454.17; Description =Phosphatidylinositol 3- and 4-kinase
MAVATFKGPPSECCGNGKMERKPSGRRRVFVQTETGCVLGMELDRRDNAHTVKRKLQVAFNVPTEASSLICGDMVLKNDLSVVRNDSPLLLTRTFLHRSSSTPCLSPTGRDLLQRDQSGPIEVIGCSDMFSGTKQLVKDIMKAIKVGIEPIPIQSGLGGAYYFRNSNGENVAIVKPTDEEPYAPNNPKGFVGKALGQPGLKRSVRVGETGFREVAAYLLDHDHFANVPFTALVKVTHSIFNVNDRVNGSMHHNKKQISKIASLQQFIPHDFDASDHGTSSFPVAAVHRIGILDVRILNTDRHAGNLLVRKLEGFGRFDQVELFPIDHGLCLPETLEDPYFEWIYWPQASIPFSDDELDYIYHLDPFRDSEMLRMELPMIREACLRVLVLCTIFLKEAAAFGLCLAEIGDMMSREFQGLHEEPSELELICIEAKKLLDQEELFSYEAEVEDKDVIQFQLDCEDRDLDFTTNIEEKLTVMPPFQVGATNGIIRNTLSRLEESVMEDEAESEGELPFGGDEYNGPVGNGVPNVSRLSVSVKNTRTGEKSRQQMGVKQKSGFLAGTSSGNTTVNELPASSCFVKLTDMDEERWNQFLENFQRLVIPAFVNCKRGNVSKKQRQRLGTSCQF

SEQ ID NO: 177122 - protein, 258 aa, Glycine max
  Coding DNA Sequence Number=SeqID_60344
  Gene Ontology: Mol. function=RNA-directed DNA polymerase activity; Cellular component=chromatin; Biological process=chromatin assembly or disassembly
DKGLCYYCDDKWATGHRCSPRIHLLIAEDDVTLPPSPDSPHESSPSSPPPDSPFQLSLNAMSGMPAPKTFRVYGSVLRHRFSILIDGGSTHNFVQLRVARFLGLRAVPISPLPVMVGHHLPHRPFRVGPPGRRYCTRSSVVTRIGPVHPHGPPSPFIGGRSCYTTHSFGPSIETNASDPSSFHPLPFVPCTPLFPHTLIPYFFLPRPSRIYLPLPRPHLLIHQISAPLCRTYPITSPSDHFPSYPPTPGLQTQYRQTL

SEQ ID NO: 177123 - protein, 830 aa, Glycine max
  Coding DNA Sequence Number=SeqID_60345
  Gene Ontology: Mol. function=RNA-directed DNA polymerase activity; Cellular component=chromatin; Biological process=chromatin assembly or disassembly
  Pfam annotation: Domain name=Chromo; Domain location=749-802; Score =16.7; E_value=0.01; Accession=PF00385.14; Description='chromo' (CHRromatin Organisation MOdifier
  Pfam annotation: Domain name=rve; Domain location=447-603; Score =100.1; E_value=6.5e-27; Accession=PF00665.16; Description=Integrase core domain
  Pfam annotation: Domain name=zf-H2C2; Domain location=388-429; Score =6.6; E_value=0.048; Accession=PF09337.1; Description=His(2)-Cys(2) zinc finger
  Pfam module annotation: Pfam domain module=Chromo::rve::zf-H2C2; Domain location=749-802::447-603::388-429
MAEEDIPKIAFRTHSGHYEYCVMPFGLCNAPATFQATMNELLRPFLRKFVAVFFDDILVYSPSWNEHLRHLEFVFQALTDGSFFLRASKCVFAKTKLQYLGHVISATGVDPDPSKLSAMQDWPIPTTTTDLRGFLGLTGFYRRFIRGYALLDAPLTSLLRKDNFHWDDDAQSAFLKLKQVMTTAPVLVPPDFTIPFDVETDASGLAMGAMLSQNAHPIAFFSKIFCPKLQCSSTYVRELHAIAAAVRQWRHYLLGHPFTIITDHQSLKDLMNQAIQTPEQQHYLAKLLGYEYTIRYRPGSGNGAADALSRLGPPGKCLILSAPQLDCMTEFKNSIIQSPEYRALREQVLQDPTLHPDYDLSADWLRFRGKIWIPANNPFIPMLLYEYHSTPLGGHMGITKTLRRLRDTFYWATMSRDVHRFISTCSICQQVKSPCRKPASLLQPLPIPSGIWEDLSLDFISGLPSSHNFTTILVVVDRFSKGTHLGALPSKYSAHKVAQLFIDTVYKLHGFPRSLVSDRDPVFLSAFWRELFRLSGTKLRYSTAYHPESDGQTEVLNRTLEQYLRSFVHDRPGTWFSFLSLAEWSYNTSALTSTGISPYELTYGKPPPSLPPFTPGSSPIEVADTLLSTRQAMHAKFHQRLLKAQSTMKLYADRNRRNVSFQVGDWVYLRLRPYRQLSLRPHYSKLAKRFYGPYQILERIGHVAYRLQLPTDSKLHPVFHVSLLKLHHGPPPADGDPLPPNTVDHHPLVEPLLLLDWKWNTDHTPPSRMVLVQWRGLDPEDTSWEDWDSLRTTYNLEDEVDFPGEGIDSNTAQSRPKRTHRIPARYRDSA

SEQ ID NO: 177124 - protein, 186 aa, Glycine max
  Coding DNA Sequence Number=SeqID_60346
  Homolog annotation: Hit_ID=Q2HUI1; Match level="QueryCoverage=46%, HitCoverage=15%, E-value=9e-07, Identity=33%"; Hit description =Phytochrome kinase substrate 1-like protein, putative
  Subcellular localization annotation: CTP_CleavageSite=54; ConfidenceScore=5.39e-01
MYPAIYRHNSKDSFDGASASTFTSISTTATATATRFFYGRRNIDEGSTTPMIIECYELSEVSIEWRMTTVEGHNDIVVEEKWKRKGGNNLFGELLVLGHLRGSKIHCFRSFSLGFNYQMGIIIAFGVEYVVSLPDGKALKVKEESLLPANLDLLDGVHGLMQPSGKDTSANTLSWFFYMLCKNPLI

SEQ ID NO: 177125 - protein, 195 aa, Glycine max
  Coding DNA Sequence Number=SeqID_60347
  Homolog annotation: Hit_ID=Q1SM49; Match level="QueryCoverage=53%, HitCoverage=44%, E-value=1e-09, Identity=35%"; Hit description =Peptidase S1 and S6, chymotrypsin/Hap
MYDQLDEASRTTTRQIASAGSMSTSLVHQFVTDDTYQETSPRASWWLTSKAHMNGITGAPYRARCDALTITYVSWLPYTEHRGVRAFELISSFQGQLRWGPMVVTARPERVVSADYMEWFFRISHPFMIPTQAGDQPRDAPAADPEEYIQSPSPQVPVAFDPPRHVVDDYDGYEVIAQRLERMLNLRMVTAGTEL

SEQ ID NO: 177126 - protein, 187 aa, Glycine max
  Coding DNA Sequence Number=SeqID_60348
MASKKRKEPATPSQVRYDRSRFTSPEAWERYIDIVVPRKLLPERNMVIYHTEFDELKEELERRKRDEELSSFDEGSIDVAIVKEFYANLYDPEDKSPKRNTFLKSPIIIKEGVTLSAYSRFTLSRPDPQELVVKLYMSLAFSFWRGEDSAAQELVPAEEPVPDLEDEPFPPEPFIFEIDPVAQEEAA

SEQ ID NO: 177127 - protein, 677 aa, Glycine max
  Coding DNA Sequence Number=SeqID_60349
  Gene Ontology: Mol. function=RNA-directed DNA polymerase activity; Cellular component=chromatin; Biological process=chromatin assembly or disassembly
  Pfam annotation: Domain name=rve; Domain location=341-487; Score =79.4; E_value=1.1e-20; Accession=PF00665.16; Description=Integrase core domain
QGVAPDPDKIAAMLAWPVPTSPTALCGFLGLTGFYRKFIQGYALVASPLSNLLRKDQFQWSPATNSAFQLLKSSMTKAHILTTSDFSIPFTIETDASASAIGVVLIQDSHPIVYYNKVLCPRLRRASAYVRELHAITSAVRKWHHYLLGSSFTILTVHKSLKDLMSQVIQTSEQQTYLSKLLGYDYTIKYKPGKANVVADALSRIAPAGTCLSLSVPHYDFLDKLHATLLQDAQYVDLISQIRSDPASYPDLLLHKDLILRQGRIWLPFSTPFSSMLLEEFHSLPLGGHTGISKTLHCLRQSFDWPLIRADVRCFVSQCPTYQQTKYENKRVAGLLHPLPIPSNVWEDLSLDFITGLPQSHGFSKAAHFGALPAHHAAYKVALLFIDMVCKLHGFPRSLVSDRDSIFISSFWRELFRLSGTKLRMSTAYHPQTDGQTEVLNRILEQYLRAYVHHRPSDWFHFLSLAEWSYNTTWHSSLGVSPFEIVYGKAPHTIAQYVQGTSPIDVFDHMLKDRTELHATLQRHFCKAQEAMKASADKLCRDVHFEIGTGSHRPSGLQASAATFFPHTSSFPCIPLETASWAILDYNCHIAIYREQPPTLASKDTSWELWDKLRVAYDLEDKVVFKEGGVDSNNKIPDPQTETNNSISNIPDPQTETNNNISRPKRDTKKPNYLSDY

SEQ ID NO: 177128 - protein, 78 aa, Glycine max
  Coding DNA Sequence Number=SeqID_60350
MANPGMHDFEYGNTIGVRKLTKKWAPSATAADKSQTLCGGATIFMQQATSLQCGGAMTNDEHEDEEKGRAWWCEKREL

SEQ ID NO: 177129 - protein, 677 aa, Glycine max
  Coding DNA Sequence Number=SeqID_60351
  Gene Ontology: Mol. function=nucleic acid binding
  Homolog annotation: Hit_ID=Q9LI68; Match level="QueryCoverage=91%, HitCoverage=99%, E-value=0.0, Identity=65%"; Hit description=Auxin -independent growth promoter protein-like
  Pfam annotation: Domain name=DUF246; Domain location=97-538; Score =262.3; E_value=9.9e-76; Accession=PF03138.5; Description=Plant protein family
MKSKMKWVGLLGLVLSAFSIFIHFLLARFTQMGVAEYESSVTIFSWRPVFEKPIPPTNTPSYRKLWGPVKRLESLYPDSNPRGHYADPVSETNGFIFVRIQGGFHEIRNSICDVVVVARLLNATLAMPEIQSTTSSKGISSQFKSFAYLYNEEQFVLSLAKDVTVVRTLPKDLKGARRKKEIPVFKVPYSASPFYYFHHVLPVLKKHSVVELVVSEGGCLKATLPPNFEEYQRLRCRVSFHALQFRQEVQELSAKILQRQEEFHCHLSFKLRAPGRPFIAFDPGMTRESLTYHGCAELFQDVHTELIQHKRSWMIKRGIVKGKLSVNSAEERLKGSCPLMPQEIGILLRAYGYSKDAIIYVSGGEVFGGQRTLIPLHAMFENVIDRTSLSTPWEMIRLYGKEVNLVDTPGPPPFVEEVTKHAAWKSAGPRPRPLPPPPARPKSYNIEGWWGWVAESDNEPDSTVIELRTNAHKLLWEAIDYVICVEADVFIPGFDRDGKGHPNFASLVMGHRLYLSAASKTFRPDRKEVAKLLDEIRDHGHHANHTWLESVRRHLKKTLLDGIMEASNKSKLLSFLSHPVPECSCSRDSFEVSKNSSSPLTSQLVTSLGVAHRCPAWMDTGPISQSKDKENEEDVYEDDSVSELFFKQNAENHEGDSEVNIKEENQFEDQEDDSGER

SEQ ID NO: 177130 - protein, 132 aa, Glycine max
  Coding DNA Sequence Number=SeqID_60352
MNRSKRESILALREEWMESIFVFKAEWLWVKRFTASSNLSMVAWQVLCSGMVGRITIWKVITKHVMELRKIESRLSSGSVNQVDQIQSTLRESETVLLLWFQKLGSKWHVLGDPDSSYFHGDQIQSTSGREW

SEQ ID NO: 177131 - protein, 1948 aa, Glycine max
  Coding DNA Sequence Number=SeqID_60353
  Gene Ontology: Mol. function=ubiquitin-protein ligase activity; Cellular component=signal recognition particle, endoplasmic reticulum targeting; Biological process=ubiquitin cycle
  Homolog annotation: Hit_ID=Q2HSG3; Match level="QueryCoverage=99%, HitCoverage=40%, E-value=0.0, Identity=78%"; Hit description =Putative zinc finger in N-recognin, putative
MAEVAAARPRNWQKYCLRHGDILSFLMNGIFYFGEESVIQTLKLLNFAFYTGKDVGHTPQKMESGDISSNKSGTVSQESKKKKKGEDGAESGSEKSYLDMEAAVDVFTDKSSNILKQFIDCFLLEWNSITMRAEAKLVLYGVWHHAKPTFKETILKELLQKVKFLPMYGQNIVEYTELVTWLLGRSSDTSSKHKISELVDQCLTPDVIRCIYETLHSQNELLANHPNSRIYNTLSGLVEFDGYYLESEPCVACSTPEVPYSRMKLDSLKSETKFTDNRIIVKCTGSYTIQTVTMNVHDARKSKSVKVLNLYYNNRPVTDLSELKNNWSLWKRAKSCHLAFNQTELKVEFPIPITACNFMIELDSFYENLQALSLEPLQCPRCSRPVTDKHGICSNCHENAYQCRQCRNINYENLDSFLCNECGYSKYGRFEFNFMAKPSFTFDNMENDEDMKKGLAAIESESENAHRRYQQLLGFKKPLLKIVSSIGDSEIDSQQNPSVQQMMVSLPGPSCKINRKIALLGVLYGEKCKAAFDSVSKSVQTLQGLRKVLMNYLHQKLSDTSVGSRFVVSRSPNNCYGCATTFVTQCLELLHVLARHPNSKKQLVSAGILSELFENNIHQGAKAARVQARIVLCSLSEGDVNAVNELNSLIQKKVLYCLEHHRSMDIAVTTREELLLLSEVCSLADEFWESRLRVVFQLLFSSIKLGAKHPAISEHVILPCLRIISQACTPPKPETLDKEQSLGKSSANTKDESNQNVSGSLTGAVTVSGTKTFPDSSERNWDATSKTRDIQLLSYSEWERGASYLDFVRRQYKVSQAVKGTGQRSRPQRHDYLALKYALRWKRRAGKAAKSDLSVFELGSWVKELVLSACSQSIRSEMCTLISMLCAQSSSRQFRLLNLVVSLLPATLSAGESAAEYFELLFKMVDSEEALLFLTVQGCLRTICTLITQEVSNVESLERSLHIDITQGFILHKLIELLGKFLEVPNIRSRFMRDDLLSEILEALIVIRGLIVQKTKGSMTKNPYSSVEIGPLMRDVKNKICHQLDLLGLLEDDYGMELLVAGNIISLDLSIAQVYEQVWKKSNQSSNVTNSNLLSPNAVNSSRDCPPMTVTYRLQGLDGEATEPMIKELEEDREESQDPEVEFAIAGAVRECGGLEILLGMIQRLRDDFKSNQEQLVTVLNLLMYCCKIRENRRALLKLGALGLLLEAARRAFSVDAMEPAEGILLIVESLTLEANESDNISITQSALTVTSEEAGTGEQAKKIVLMFLERLSHPLGLKKSNKQQRNTEMVARILPYLTYGEPAAMDALVQHFSPYLQDWGAFDHLQKQHLDNPKDDHIAQQAAKQRFTLENFVRVSESLKTSSCGERLKDIILEKGITKTAMTHLKDSFAYTGQAGFKNSAEWAQGLTLPSVPLILSMLRGLSMGHLLTKKCVDEEGILPLLHALEGVAGVNEIGARAEYLLDTLSNKEGKGDGFLEEKVCKLRHATKDEMRRRALQKREELLQSDFLFPSELSLISDTRGLECTENCFQMEANALLCPGRSQEGYSLRPADLLGAYSYSKRVNLGVGSSGSARGGECVYTTVSYFNIIHFQCHQEAKRADAALKNPKKEWDGATLRNNESLCNSLFPVRGPSVPLAQYVRYVDQYWDNLNGLGRADGSRLRLLTYDIVLMLARFATGASFSADSRGGGRESNSRFLPFMIQMARHLLDQGNPSQRRTMARAVSAYISSSSSDLRPSSPSGTQPTPGTEEIVQFMMVNSFLSESYESWLQHRRAFLQRGIYHAYMQHTHSRSAIRAPSVTAPAHGVESGSMGQSATTETGQSDDLLSIIRPMLVYTGLIEQLQHFFKVKKSTGATPPTRTDGASSTTEGEDESGNLEGWEVVMKERLLNVKELLGFPKEMLSWLDEINSATDLQEAFDIVGVLAEVLSGGFTQCEDFVQGAINAGKS

SEQ ID NO: 177132 - protein, 499 aa, Glycine max
  Coding DNA Sequence Number=SeqID_60354
  Gene Ontology: Mol. function=nucleotide binding
  Homolog annotation: Hit_ID=Q93ZR8; Match level="QueryCoverage=94%, HitCoverage=93%, E-value=0.0, Identity=71%"; Hit description =Putative auxin-independent growth promoter
  Pfam annotation: Domain name=DUF246; Domain location=102-450; Score =737.4; E_value=9.1e-219; Accession=PF03138.5; Description=Plant protein family
MVLKWGKDYCCDTKGIKMELKVEKHETLIIRPRIKMWMARAITIVLLWTSLVQLIALGELLGPSLLRGMPYCFSSPSVDKFLAPAKAVLPPKRIYRNNGYLLVSCNGGLNQMRSAICDMVAIARHLNVTLIVPELDKASFWADSSDFKDIFDVDHFITSLRDEVRIIKILPPKIKKRVELGLLYSMPPISWSNISYYENQVLPLLLKHKVIHLNRTDARLANNGLPAEIQKLRCRVNFNALRFTTQIEELGRRIVKVLREKGPFLALHLRYEMDMLAFSGCTHDCDSKEEEELTRMRYAYPGWKEKVINSELKRKEGLCPLTPEETALVLSALGIDHNVQIYIASGEIYGGEKRMASLLGEFPNLVRKETLLEPSELMYFQNHSSQMAAVDYLVSLESDIFIPTYDGNMAKVVEGHRRFLGFKKTILLDRRLLVNLIDQYYNGLLSWDEFFTAVKEAHAYRMGSPKRRIIIPDKPKEEDYFYANPQECLQLLDEPLEST

SEQ ID NO: 177133 - protein, 68 aa, Glycine max
  Coding DNA Sequence Number=SeqID_60355
MEFIRFGVVRPTAIGAIVGLLELPLIENLGLLALPQIFEDTESLSSFTSIFKLRNIKTPKWPNPQHNW

SEQ ID NO: 177134 - protein, 262 aa, Glycine max
  Coding DNA Sequence Number=SeqID_60356
  Gene Ontology: Mol. function=transporter activity; Cellular component= integral to membrane; Biological process=transport
  Homolog annotation: Hit_ID=Q6QIL2; Match level="QueryCoverage=92%, HitCoverage=89%, E-value=1e-52, Identity=47%"; Hit description=NIP2
  Pfam annotation: Domain name=MIP; Domain location=28-236; Score =210.0; E_value=5.4e-60; Accession=PF00230.10; Description=Major intrinsic protein
MADSLSVNFDSSIKSEFSTEQAHKTTHEAKHSPSNIQKAIAEVVGTYILIFAGCGAALVNEKLPLTIVGIAMVSGLGLTVATYSVGHVSGGHFNPAVTIALAAVRKVQFKLMMGATLAPLTLKVLYHDKADIGVTVTKYLSSTSDLEAIVWEFITTSILMLTIRGVATDHRGSKDLTGVAIGISVLINVIIAGPITGASMNPARSLGPAIVSGDYKNIWVYIISPILGAVSASTLYKFLEVNKPVKPEPCHCNICNHNHLPF

SEQ ID NO: 177135 - protein, 603 aa, Glycine max
  Coding DNA Sequence Number=SeqID_60357
  Gene Ontology: Mol. function=ubiquitin-protein ligase activity; Biological process=ubiquitin cycle
  Homolog annotation: Hit_ID=Q2HSG3; Match level="QueryCoverage=97%, HitCoverage=12%, E-value=0.0, Identity=78%"; Hit description =Putative zinc finger in N-recognin, putative
  Pfam annotation: Domain name=ZZ; Domain location=368-411; Score=43.8; E_value=5.7e-10; Accession=PF00569.8; Description=Zinc finger, ZZ type
MVGFRVHVGNTSASHIPSSISIFQRVVKFDEGMRSWYDIPFTVAESLLADEEFTISVGPTFNGSTLPRIDSLEVYGRAKDEFGWKEKMDAVLDMEARVLGSNSSLSGSAKKRRSMQSAPIQEQVIADGLRLITKFYSSCKQQDCSRFEEARTELGKLKCKPLLEIIFECDREPILQASASRVLQAVFPKKEIYHQVKDTMRLRGVVKSSLLLSSRLGIGGAAGSWIIEEFTTQMRAVCSEVVDVLVQVLWGILDFEQPDTQTMNNIVMSAVELIYCYAECLALHGKDAGVHSVAPAVVLLKKLLFSSNEAVQTASSLAISSRLLQVPFPKQTMLATDDAVDSVVSVSGPADPSTGNNQIMIEDDTITSSVQYCCDGCSTVPILRRRWHCTVCPDFDLCEACYEVLDADRLPPPHSRDHPMTAIPIEVDSVGDGNEFHFTADDVSDQNLLPVPVDSNMQNSSPSIHVLEPNDSGDFAASLTDPVSISASKRAINSLLLSELLEHLKGWMDMTSGVQAIPVMQLFYRLSSAVGGPFIGSSKPDSLDLEKLIKWFLHEKNLNRSLVAKTRSSFGEVAILVFMFFTLMLRNWHHPPPRWSHAKTEWN

SEQ ID NO: 177136 - protein, 332 aa, Glycine max
  Coding DNA Sequence Number=SeqID_60358
  Gene Ontology: Mol. function=ubiquitin-protein ligase activity; Biological process=ubiquitin cycle
  Homolog annotation: Hit_ID=Q2HSG3; Match level="QueryCoverage=92%, HitCoverage=6%, E-value=1e-144, Identity=84%"; Hit description =Putative zinc finger in N-recognin, putative
RRDSRHSKDKKISLGEDKVISHGIDLLQLKKAYKSGSFDLKIKVDYSNSKELKSHLASGSLVKSLLSVSGRGRLAAGEGDKVAIYDVGQLIGQATIAPVTADKTNVKPLSKNIVRFEIVQLAFNPVVENYLLVAGYEDCQVLTLNPRGEVIDRLAIELALQGAYIRRVDWVPSSQVQLMVVTNRFVKIYDLSLDNFSPMHYFTLSDDMIVDAVLCPASQGRMFLLVLSENGNILRLELSVKGNAGAVPLKELVQLQGKEIHAKGSSLYFSSTYKLLFVSFQDGTTVVGRPSPDAASLVEMSSVYEEQEMYATFSGFNLTYSWYDCIQTTIKG

SEQ ID NO: 177137 - protein, 424 aa, Glycine max
  Coding DNA Sequence Number=SeqID_60359
  Homolog annotation: Hit_ID=Q2HSG3; Match level="QueryCoverage=95%, HitCoverage=8%, E-value=1e-156, Identity=69%"; Hit description =Putative zinc finger in N-recognin, putative
MATAVEDLIVERYVFSLCWDIPYVGSEADHTIKSWDQDHPVDPSNMLHFFHFSHLLHGHPEGMGKFTISPDVILSLLQHLNAALPIPEGIEQLGWYFLRSGMWLSLVISFINVGIWRYYMDNGISGHGLTWTGNAMGDEKYVKVAGSMISSMIESGQFPLLVKLFSSLLNKYLQVCQNAFLDILNDKQKLTPGFSPFLLLKHTEMDQSLQDELLERSGSNAGELQFVLSLISRLDAVVDKKASGILSRASWECLLHGFPFNLSTPSSTMFSCVLSIRGIVFVLDGLLRIKEAGSIINLEDEILGQVLDAVMIIKYDRTFESVHGKCDTIYHSLSAELDLSCYEDLILMKQMEGFLMDVNAGGASDCSVHEWIICKIIEILNSLRKDPSKSVIFHFYLGVENVPEKMNRLLHLHLGDCLVLGKML

SEQ ID NO: 177138 - protein, 599 aa, Glycine max
  Coding DNA Sequence Number=SeqID_60360
  Gene Ontology: Mol. function=ubiquitin-protein ligase activity; Biological process=ubiquitin cycle
  Homolog annotation: Hit_ID=Q2HSG3; Match level="QueryCoverage=79%, HitCoverage=9%, E-value=0.0, Identity=78%"; Hit description=Putative zinc finger in N-recognin, putative
MAADSLAVLAEALSPPVSPGDFLSKLRSDDAVLLGLNAFCSVLRRGLQSSDDGTSLFLSWTDAQIHAISSLAHAIASASRSLSVEQAEGVLVAIVQQSIEFALCYLENSGVTSDDLGIQNNMIHLLEMALVDGINMVADILQPTTASALIDMLPMVDDCCGSFVDDYKKCHLEGFKCSKEEKSMDWLLKTLASEHVPHDRQESGFIEQTYYQYFNNFVFLSQHWAVVHGKCTPRLILLCNKLAKVKDVFDERAVSQNFRRRLSFILRMLKILGSLLKDVPYVDYDASLMGAVATFSNTLSSLFRIKFEFVNTCATTEGSFESIILMVIEEFLHSVQVIFGNSNVAQNIQTCIIAAILESLDSSVWTYDKSAPNLKPPLAYFPRFVVYTLKLITDLKRQRHLVPFEWKDFDVELVGSSTDSQIGSPSCLVHLEPVPLLKGFTFEELLKLIFPVSSQWIANLMQLALFLHCEGLKLKPKLERSHSSLAKVAGTSEVENAVCHEDEALFGDLFSETGRSVGSTDGCEQPPVAALISSSSYQNMPTQAAIELLNFLKTCIFYTEWHPSLYVDACNKLSSRDIDILLSLLNCQGCCSEDNMSDS

SEQ ID NO: 177139 - protein, 395 aa, Glycine max
  Coding DNA Sequence Number=SeqID_60361
  Gene Ontology: Mol. function=oxidoreductase activity; Cellular component=chloroplast; Biological process=electron transport
  Homolog annotation: Hit_ID=Q6F6Y2; Match level="QueryCoverage=69%, HitCoverage=71%, E-value=4e-92, Identity=59%"; Hit description =Putative flavoprotein monooxygenase acting on aromatic compound
WHSLSPHDNPQDVSHFEQQALAAENIALSAVPPRYRSSYFRHIWGGGYAAGYYAYIWTQMLADDGYQAFVERGGLTRENGQRFREQILSRGNSSDLQHLWLAWRGPPSGAAGWPARLSQRTAFNGVAHAGQHALAGFLFQSGIPFRGDRRIFGVGDITTLARFQHQITGARHAPRLIAQQAVLNAQRVGGQGLRQYHRIFHGRTAALTDIRRGAVCRIPQQRHTPSDKATEGFDIMNLHAIGGLCVNAGDQPLDRFGPAGKIAAQIVFYRCAILRQPFRQRDIKEKVEAVTAHRHQRDALALADKRGPLIGGRDAFIDSDQAIPVDVACVAALDVFAQHVMANHRVGAVGGHHKIPFSLAAVIKPGGHAAGMLLHSHNAFAKANAFAAVAVDQQR

SEQ ID NO: 177140 - protein, 122 aa, Glycine max
  Coding DNA Sequence Number=SeqID_60362
  Subcellular localization annotation: CTP_CleavageSite=53; ConfidenceScore=5.52e-01
MYPSLFSLNNLVGVPSTRTDPQEMYPLLFSVTTTQVDVSSTCTTKDVPSNVLRQSSQAVSPLKFCEWGNKRILRREKGDTKEFKRLVLRSFGKEIRETQKEFRWLVLGEFFLAKGEGNEKDE

SEQ ID NO: 177141 - protein, 278 aa, Glycine max
  Coding DNA Sequence Number=SeqID_60363
  Gene Ontology: Mol. function=rRNA binding; Cellular component =nucleolus; Biological process=rRNA processing
  Homolog annotation: Hit_ID=Q2V9A2; Match level="QueryCoverage=99%, HitCoverage=73%, E-value=1e-108, Identity=70%"; Hit description =Putative RNA processing factor 1-like
  Pfam annotation: Domain name=Brix; Domain location=52-250; Score =228.9; E_value=1.1e-65; Accession=PF04427.8; Description=Brix domain
  Subcellular localization annotation: CTP_CleavageSite=49; ConfidenceScore=5.05e-01
LFAGNDADEFGSILNQQQTPKILITTCRFHSTSYEARTPQSLAVSGVRHASMSVSDTDMTPRGPAFISELLSVIPNAHYFKRGTYDLKKIVEYAKKKDFTSVIVVHTNRREPDALLIIGVPDGPTAHFKLSKLVLRKDIKNHGNPTGHKPELVLNNFTTRLGHRVGRLIQSLFPQDPEFKGRRVVTFHNQRDFIFFRHHRYIFETKEVKKTESKGKKDKEGKSENVPEQKTIARLQECGPRFTLKLISLQHGTFDTKGGEYEWVHKPEMDTSRRRFFL

SEQ ID NO: 177142 - protein, 427 aa, Glycine max
  Coding DNA Sequence Number=SeqID_60364
  Homolog annotation: Hit_ID=Q1T2S5; Match level="QueryCoverage=72%, HitCoverage=78%, E-value=7e-40, Identity=37%"; Hit description =Cyclin-like F-box; F-box protein interaction domain; Galactose oxidase, central
MGSVAEVTLRWNMSDKLGNLKHPHQTMMQLFYLTAWSVFLLFYRNEFNRTSNWSYVKRGGFSPRADKENEEAHSDSPSGVDQRSSSEIAGEIRSAFQAELEKDSSAVHLILPPSSPPRHRFEYDYYADSHDKPDILGSCRGLILLYYPRNSDHIIWNPSLGVQKRLPYLAYDVTFCPLYGFGYDPSTDDYLLIVIGLHDSEHYKYDTDGSEDDECKGKCQIFSFKTDSWYIVDIFVPYKDLGGKFRAGSLFGDILHWLVFSKDKKVPVILAFDLVQRSFSEIPLFDNFAMEKYEVDSLRRVMGGCLSVSCSVHDGATDEIWVMKEYKVQSSWTRSVVIPSSGFSPICINKDGGILGSNICGRLEKLNDKGELLEHLIYGGEQCLCSARLQSAVYRESLLSLHSVIGVTRIGVTRKDDHEETTEHDQQ

SEQ ID NO: 177143 - protein, 658 aa, Glycine max
  Coding DNA Sequence Number=SeqID_60365
  Gene Ontology: Mol. function=binding; Cellular component =intracellular; Biological process=metabolic process
  Homolog annotation: Hit_ID=Q2HSF0; Match level="QueryCoverage=99%, HitCoverage=100%, E-value=0.0, Identity=75%"; Hit description =Tetratricopeptide-like helical
  Pfam annotation: Domain name=PPR; Domain location=145-179; Score =13.6; E_value=0.18; Accession=PF01535.11; Description=PPR repeat
  Pfam annotation: Domain name=PPR; Domain location=250-284; Score =23.1; E_value=0.001; Accession=PF01535.11; Description=PPR repeat
  Pfam annotation: Domain name=PPR; Domain location=353-387; Score =37.6; E_value=4.3e-08; Accession=PF01535.11; Description=PPR repeat
  Pfam annotation: Domain name=PPR; Domain location=388-422; Score =11.0; E_value=0.37; Accession=PF01535.11; Description=PPR repeat
  Pfam annotation: Domain name=PPR; Domain location=424-457; Score =11.9; E_value=0.29; Accession=PF01535.11; Description=PPR repeat
  Pfam annotation: Domain name=PPR; Domain location=490-524; Score=3.0; E_value=3.3; Accession=PF01535.11; Description=PPR repeat
  Pfam annotation: Domain name=PPR; Domain location=79-113; Score=4.2; E_value=2.4; Accession=PF01535.11; Description=PPR repeat
  Pfam module annotation: Pfam domain module=PPR::PPR::PPR::PPR::PPR::PP R::PPR; Domain location=145-179::250-284::353-387::388-422::424 -457::490-524::79-113
  Subcellular localization annotation: CTP_CleavageSite=39; ConfidenceScore=5.41e-01
MWVLQIPQFVRHVPSQSHLCYTSHVSSRVPVSFVSLNPSANLINDINSNNNQLIQSLCKGGNLKQALHLLCCEPNPTQQTFEHLIYSCAQKNSLSYGLDVHRCLVDSGFDQDPFLATKLINMYYELGSIDRALKVFDETRERTIYVWNALFRALAMVGHGKELLDLYIQMNWIGTPSDRFTYTYVLKACVVSELSVCPLRKGKEIHAHILRHGYEANIHVMTTLLDVYAKFGSVSYANSVFCAMPTKNFVSWSAMIACFAKNEMPMKALELFQLMMFEACNSVPNSVTMVNMLQACAGLAALEQGKLIHGYILRRQLDSILPVLNALITMYGRCGEVLMGQRVFDNMKKRDVVSWNSLISIYGMHGFGKKAIQIFENMIHQGVSPSYISFITVLGACSHAGLVEEGKILFESMLSKYRIHPGMEHYACMVDLLGRANRLGEAIKLIEDMHFEPGPTVWGSLLGSCRIHCNVELAERASTVLFELEPRNAGNYVLLADIYAEAKLWSEAKSVMKLLEARGLQKLPGCSWIEVKRKVYSFVSVDEHNPQIEEIHALLVKLSNEMKAQGYVPQTNVVLYDLDEEEKERIVLGHSEKLAVAFGLINTAKGETIRIRKNLRLCEDCHAVTKFISKFANREILVRDVNRFHHFRDGVCSCGDYW

SEQ ID NO: 177144 - protein, 196 aa, Glycine max
  Coding DNA Sequence Number=SeqID_60366
  Homolog annotation: Hit_ID=Q2HSF1; Match level="QueryCoverage=88%, HitCoverage=39%, E-value=1e-62, Identity=68%"; Hit description=WD40 -like
  Pfam annotation: Domain name=WD40; Domain location=4-42; Score=25.0; E_value=0.00026; Accession=PF00400.22; Description=WD domain, G-beta repeat
MQCHLTNFVPHCNSNQVTCLAYGTSENLLITGSEDGMVRVWNARTRNIVRMFKHAKGPVNNILVVRRENDSSNHISSNVQASSRKQGSNLPPPLEKYANSIDDDLDMKTMISLGGGRRSVDPSYLSSHVISNYIKELQHQGSAAASEMEMEKLKHDYQKSVQMANQLKKMNENLHQFCVKELLDGGQARTLDEDQN

SEQ ID NO: 177145 - protein, 111 aa, Glycine max
  Coding DNA Sequence Number=SeqID_60367
MNFHRKLDKSVLAEEPLTMVRATISTDDTCVLATPTTQTRMIHHKRRRRRNTVEVGGDGIEGPQGHPLIFGSLNLLLLCYVGLHRPPPIVQSVYAKTLSLEIGTRLSEEMN

SEQ ID NO: 177146 - protein, 131 aa, Glycine max
  Coding DNA Sequence Number=SeqID_60368
  Homolog annotation: Hit_ID=Q2V9A2; Match level="QueryCoverage=56%, HitCoverage=22%, E-value=7e-12, Identity=49%"; Hit description =Putative RNA processing factor 1-like
MGGKRRKSDDDDDVEAEASASGWKKKTRTTEKEEKEKKEPLRPSMIKNKEKRSELHAKLKQQKKLDKRAKAKARDAALKRALDLGEEPPEKKVPRTIENTRELDETVCKPDDDEVLIVVLYQQEWGLWGQK

SEQ ID NO: 177147 - protein, 342 aa, Glycine max
  Coding DNA Sequence Number=SeqID_60369
  Gene Ontology: Mol. function=hydrolase activity; Cellular component =endoplasmic reticulum; Biological process=traversing start control point of mitotic cell cycle
  Homolog annotation: Hit_ID=Q9M3Z3; Match level="QueryCoverage=82%, HitCoverage=69%, E-value=1e-138, Identity=84%"; Hit description =Putative PTS protein
DNIFGYDSSDSATSLDAAFAPAIASNIPWVAVLGNHDQEGTLSRAGVMNHIVGMKNTLSKFNPPEVHIIDGFGNYNLDVGGVQGTDFENKSVLNLYFLDSGDYSQVSTIFGYDWIKPSQQLWFQRTSAKLKKAYISKPVPQKDAAPGLAYFHIPLPEYASFDSSNMTGVKQEPDGNGISSPSVNSGFFTTLLAAGDVKAVFTGHDHINDFCGNLMNIQLCYGGGFGYHAYGKAGWPRRARVVVASLEKTGKGSWGDVKSIKTWKRLDDQHLTGIDGEVLWSKSTGAQETRGLVDMEEYRAVHRKIFKELRKTVLEVQSEFKSILLWQSKLYTWKKMNVKKRC

SEQ ID NO: 177148 - protein, 273 aa, Glycine max
  Coding DNA Sequence Number=SeqID_60370
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=27%, E-value=1e-138, Identity=87%"; Hit description=DNA -directed RNA polymerase beta chain
  Pfam annotation: Domain name=RNA_pol_Rpb2_6; Domain location=32-264; Score=34.1; E_value=1.1e-15; Accession=PF00562.18; Description=RNA polymerase Rpb2, domain 6
MVATGNSLALNRDIRRNRLSSPIPSRISYDCMGTASLIPFIEHNDANRALMSSNMQRQAVPLSQSEKCIVGTGLERQVALDSGVSAIAEHEGNIIYTNTDRIFLFGNGDTLSIPLTIYQRSNKNTCMHQKPQVRRGKCIKKGQILADGAATVDGELALGKNVLVAYMPWEGYNSEDAVLINERLVYEDIYTSFHIRKYEIQTHMTSYGSERITNKIPHLEAHLLRNLDKNGIVILGSWVETGDILVGKLTPQMAKESSYSPEDRLLRAILGIQ

SEQ ID NO: 177149 - protein, 99 aa, Glycine max
  Coding DNA Sequence Number=SeqID_60371
  Gene Ontology: Cellular component=integral to membrane
  Homolog annotation: Hit_ID=Q9FHY3; Match level="QueryCoverage=59%, HitCoverage=38%, E-value=2e-23, Identity=79%"; Hit description =Arabidopsis thaliana genomic DNA, chromosome 5, P1 clone:MJC20
MARGSVFVGKENNGCHFITECKNVTEKAKIKLNDRKQEKEGYSKVCEINDGPSDARRTTEDREYEDPRKEKDEDVTGPNARVREPIRVPVQIRRWHRLH

SEQ ID NO: 177150 - protein, 115 aa, Glycine max
  Coding DNA Sequence Number=SeqID_60372
  Homolog annotation: Hit_ID=Q9FHY3; Match level="QueryCoverage=36%, HitCoverage=27%, E-value=4e-12, Identity=76%"; Hit description =Arabidopsis thaliana genomic DNA, chromosome 5, P1 clone:MJC20
MEFITTDPDQVEVFKCLASWRAFEWAKTVIFQELIISKSALKGYIHLVFQLRSSKAGGPTSTEENIVESHLRWFDHVLDSLTHNRLSESNVLIQHCCSDCAGCCKVPPHAQGQDI

SEQ ID NO: 177151 - protein, 605 aa, Glycine max
  Coding DNA Sequence Number=SeqID_60373
  Gene Ontology: Mol. function=transcription factor activity; Cellular component=nucleus; Biological process=negative regulation of transcription from RNA polymerase II promoter
  Homolog annotation: Hit_ID=O80734; Match level="QueryCoverage=97%, HitCoverage=97%, E-value=1e-161, Identity=49%"; Hit description =Expressed protein
  Pfam annotation: Domain name=DUF654; Domain location=224-604; Score =367.6; E_value=2e-107; Accession=PF04910.5; Description=Protein of unknown function, DUF654
MSARLMKKVLNEQHHLPQHVSGEEEEEEEENDSEPITRSSINPFDLLNDNDSEPENQGDELMSTNERLASYDDEEESSSLKPTAEVSTSNPKSKKKKKKKNKDSAVANKTGEDKELDLILENLSLNVNSSAEQPVSTKDKNKSVKQQAASILQVDPKCLNAENELRRIFGSKVVKSFVSSNQVGSSRQMRGVRGRVHYNLKKSVLVTPSDSWLRCDDSLSMQFLEIKNGYNYFRYVHSPSYSQSQRAFEAAKAINDINGIASILQHHPYHIDSLLTMAEYFAVLGEQQMSADAIARCLYALECAWHPMFNPLQGNCRLKFKHDTNKPIFTALFTHMKNLDRRGCHRSALEVCKLLLSLDSDDPMGAIFCIDYFALRAEEYAWLEKFSEEYKSDNSIWLFPNFSYSLAICRFYLEREACKDDCMDAEKASSSDLMKQALMLHPSVIKKLVAKVPLKDRTWTDILKHAFFWLPDLQKLLSGAAKLVIETLESNKSELKDWACVRKEAFSSEKNEYGHLLVSEFSDSLSSIPRENLQQFMGVPRMMEGMQDENQFANLPGNGHAPRGVANRNALAVLFESMLPWVTYEDGVDGEPDDNQHDDHRQDNQ

SEQ ID NO: 177152 - protein, 332 aa, Glycine max
  Coding DNA Sequence Number=SeqID_60374
  Gene Ontology: Cellular component=integral to membrane
  Homolog annotation: Hit_ID=Q0AAT9; Match level="QueryCoverage=75%, HitCoverage=77%, E-value=6e-20, Identity=30%"; Hit description =Hypothetical protein precursor
  Pfam annotation: Domain name=DUF1295; Domain location=67-313; Score =278.1; E_value=1.7e-80; Accession=PF06966.3; Description=Protein of unknown function (DUF1295)
MASGRNLKNAVIAFLVPLPSIFFYLSFLNHYDSAKSPSFWSTLWSWCYHHPLLLANALFFLNVNVLFWLIGLIQSSHWMIDPYWTVIPVMLVHYYATHPLAPYDLWRSKIVILLTWVWSVRLTHNYFRRERWQWGAREDWRFTEMSQQYGKQWWWVSFFAVYVSQQNTSNLLVELPVWFDCCSIDLSVFLMPLNMWDLVATVVCLCGIVIAYFADTQLYEFVSRNNKLKGLGKPVVSVLDSGLWYYCRHPNYFGEQLWWWGLVVFAWSLGVGWTFIGAFVNTMCLAYVTRLVEDRMLKQESRAEAFRVYQNTTSVWIPWFKSSPSGVKNKNA

SEQ ID NO: 177153 - protein, 65 aa, Glycine max
  Coding DNA Sequence Number=SeqID_60375
MERSLIDAASGGALGDMTPAEAKNLIGKMASNSQQFSARSDAIVIRGVHEVATKFMPQISYGSTH

SEQ ID NO: 177154 - protein, 294 aa, Glycine max
  Coding DNA Sequence Number=SeqID_60376
  Homolog annotation: Hit_ID=Q4WSF1; Match level="QueryCoverage=45%, HitCoverage=53%, E-value=2e-13, Identity=32%"; Hit description =Membrane protein, putative
MRAKLFVFPIRGRNWCFSRTIDHSLSASHASSQSPSTLKDLWTNINVGDKPLNTKTELFVDYIANKMNNAWIGLEKAPEGSFKNKIHGLGLRLLSRVKPSEIFLKSISKEITSVEIIYPSSLNAQLVRRRLRHIAVRGAIIHRKYFYGSVLLIPLSAACGILPLPNVPFFWVLFRTYSHWRALQGSEKLLQLVSDGNKTSNTYTQTEHKNSKSQSHSSNEPCWMLGCESDFKGGLNTILQVGTNYKLDCLVLKPSKELDNLVRLEGLSQHAIVNICKIYDLNTKDVIKYQKSIF

SEQ ID NO: 177155 - protein, 287 aa, Glycine max
  Coding DNA Sequence Number=SeqID_60377
  Gene Ontology: Mol. function=protein-tyrosine kinase activity; Cellular component=integral to membrane; Biological process=protein amino acid phosphorylation
  Homolog annotation: Hit_ID=Q1SUC1; Match level="QueryCoverage=96%, HitCoverage=40%, E-value=2e-84, Identity=61%"; Hit description =Protein kinase
  Pfam annotation: Domain name=LRR_1; Domain location=109-131; Score =15.2; E_value=0.24; Accession=PF00560.23; Description=Leucine Rich Repeat
  Pfam annotation: Domain name=LRR_1; Domain location=133-154; Score =12.0; E_value=1.6; Accession=PF00560.23; Description=Leucine Rich Repeat
  Pfam annotation: Domain name=LRR_1; Domain location=155-177; Score =2.4; E_value=1e+02; Accession=PF00560.23; Description=Leucine Rich Repeat
  Pfam annotation: Domain name=LRR_1; Domain location=39-58; Score =10.5; E_value=3.2; Accession=PF00560.23; Description=Leucine Rich Repeat
  Pfam annotation: Domain name=LRR_1; Domain location=61-80; Score =12.4; E_value=1.3; Accession=PF00560.23; Description=Leucine Rich Repeat
  Pfam annotation: Domain name=LRR_1; Domain location=85-107; Score =12.0; E_value=1.6; Accession=PF00560.23; Description=Leucine Rich Repeat
  Pfam module annotation: Pfam domain module=LRR_1::LRR_1::LRR_1::LRR _1::LRR_1::LRR_1; Domain location=109-131::133-154::155-177::39 -58::61-80::85-107
MVMIPVDSLGKASLALAIDKLPGRSLSGSLGYQLEPLSSVTNLDLSNNNIGGTIPYQLPPNLQYLNLANNNFNGAIPYSLSEKTSLVILNLGHNQLQQALNVDFQKLSSLSTLDLSFNSLTGDLPQTMSSLSSIRTMYLQNNQFTGTIDVLANLPLGTLNVGNNHFTGWIPEQLNNIIQKDGNEWSSGPAPPPPPGTPPVVSRNRNHKSGGHSPSDAGSSDGGGKKSGIGGGGIAGIVISILVVGAIVAFFLVKRRSKKSFNDVEKLDNQPLAQHEVHGPHFILAYY

SEQ ID NO: 177156 - protein, 48 aa, Glycine max
  Coding DNA Sequence Number=SeqID_60378
MNDVDSDGDTMTFTTRNVAVALVTDEPNVFASVIRTIMLKEDKLVVKG

SEQ ID NO: 177157 - protein, 811 aa, Glycine max
  Coding DNA Sequence Number=SeqID_60379
  Gene Ontology: Mol. function=nucleic acid binding; Cellular component= chromatin; Biological process=DNA integration
  Pfam annotation: Domain name=zf-CCHC; Domain location=253-270; Score =17.0; E_value=0.0015; Accession=PF00098.13; Description=Zinc knuckle
  Pfam module annotation: Pfam domain module=RVT_2::zf-CCHC; Domain location=460-651::253-270
MAHDASISDGALSFNIMIHMLNIRLTPSNFILWRRQLQGQALYGHIDGFTPALPAMLTSADGSPSSIVNPAFTSWKQQDQQLVSLLLASLKEETLAEVLHCETSQQIWTTLESLFGGDSKIREIAIRDQLLHLKKDSSSVLMGRPINDLDQLHWFLQGLGPTFTSFDTSQLVMLPLPTFRYLVSAAESFEFYINAMEVVPSQAAFYSYTHRPSHPSHTHSSFGDHSSYGSRAPYSGQKGHGRGGRGCGNRHPIYCQICRGEGHYATLCPQRYNGAPPSSANIVESFVVSCNIASPNNSDWYLDTDAFAHVTPSSSTLDAMEPYSGNHKVLVGNGNVLPISHIGSHRFNSTLHLLDILVVLGLQKNLISISKLTRDFPVDVIFTNNSFLLQKRDTKEILAQGRREHNLYVLEHEDTSPIVLAPPDEPQSDMVRTVPAGHPMVTRAKDGFKSAAKHPGWLAAMNDELTTLHCNKTWELGFTQTPGLDYDHTFSPVVKASTVHVILTLAVMQHWPLHQLDVNNAFLNGLLSNPVYMEQPPGFIDPRFLHHVCHLQKALYGLKQARLAWFQRFGSFLLHLGFVSSKANPSLFIYHHNTATLYLLVYVNDIILTGSNQFSIQTILAKIRVKFAIKDLGRLSYFLGLEPIASPLASGIQLTSTGDPFPDPTLYRSLVGALQYLTITCPDLLYVVNSVSQFLPAPTIDHFQAIKRILRYVKGTLSYGLSFTRGSSLLVLGYSNVEWAHCVETRHSTYGYSIFLEAAKLMWFTHLLRNLHVCSAPPTLLCDNKRATFLSQNPVAHKRANHVDIDYHFVH

SEQ ID NO: 177158 - protein, 302 aa, Glycine max
  Coding DNA Sequence Number=SeqID_60380
  Gene Ontology: Mol. function=sequence-specific DNA binding; Cellular component=nucleus; Biological process=regulation of transcription, DNA-dependent
  Homolog annotation: Hit_ID=Q6Q4E9; Match level="QueryCoverage=99%, HitCoverage=72%, E-value=4e-62, Identity=72%"; Hit description =PHAVOLUTA-like HD-ZIPIII protein
  Pfam annotation: Domain name=MEKHLA; Domain location=226-302; Score= -13.3; E_value=3.1e-06; Accession=PF08670.1; Description=MEKHLA domain
  Pfam annotation: Domain name=START; Domain location=3-223; Score =92.9; E_value=9.8e-25; Accession=PF01852.10; Description=START domain
  Pfam module annotation: Pfam domain module=MEKHLA::START; Domain location=226-302::3-223
LFAIAQETLVKFLSKATGTTINWVQMIGMKPGPNSIGIVVSRNCSGVAARAYGLVRLEPTKVAEILKDRPSWYCDCRCLNVLSVVSTGNGGTIELMYMQTYAPTTLAAARDFWTLRYATSLEDGSLMIYERSLTSSTSGPTGPAALNFIRAEMLPTGESDLNDYNLRLVLTIAFQFTFENHLRDNVTVMARQHVHNVVRSIQRVAMAIAPSRLSSQLGSKSLPGPPEALTLARWICKSYRLHTWTELFSVESTSGDAILKQVWHHPDAVLCCSVKTDASPVFTFANQLDLTCLKPLLLLFKT

SEQ ID NO: 177159 - protein, 277 aa, Glycine max
  Coding DNA Sequence Number=SeqID_60381
  Gene Ontology: Mol. function=RNA-directed DNA polymerase activity; Biological process=RNA-dependent DNA replication
MVGQGGKLLRSMGGPHFVQVQNKHSFPQYGLPPNYTPLNVAHTPNEDDNNSASMPIESQHPQYDHAHVSQPIGETHEASRDHNLVDSEPCLEYFTEGQAFCGVPLPKSLEGPQYLPQPQPLPFVMGIVPLAMVEREKFNHIEERLRAIEGGGGHAFADMAELCLVPDVIIPPKFKVLDFDKYKGTTCPKNHLKIYNKKMGSYSKNEKLLMHFFQENLTGATVTWYANLEPSRVHSWKDLMVSFIRQYQYNSDMASNRMQLHNLCKKKHESFKEYAQR

SEQ ID NO: 177160 - protein, 212 aa, Glycine max
  Coding DNA Sequence Number=SeqID_60382
  Gene Ontology: Mol. function=protein serine/threonine kinase activity; Cellular component=cytoplasm; Biological process=protein amino acid phosphorylation
  Homolog annotation: Hit_ID=Q8S5V9; Match level="QueryCoverage=68%, HitCoverage=35%, E-value=4e-42, Identity=49%"; Hit description =Putative serine/threonine kinase
  Pfam annotation: Domain name=Pkinase; Domain location=1-197; Score= -79.4; E_value=0.00079; Accession=PF00069.15; Description=Protein kinase domain
MVILRPLSFRHSKSRGGQRQIMVIPHTFSPSRLDCVRGHAETNYGHSAPCVNQEERTRQYQDDVGRSPENLLLDLNGVLKVTDFGLSTYAQQEDELLRTACGIPNYVAPEVLNDRGYVGSTSDIWLCGVILFVLMAGIKVPELLKDEWFKKGYKQTTFIMEEDINVDDVAAAFNDSKENLVTERKEKPVSMNAFEHISRSQSFNLENLFEKQ

SEQ ID NO: 177161 - protein, 78 aa, Glycine max
  Coding DNA Sequence Number=SeqID_60383
  Homolog annotation: Hit_ID=Q6IM82; Match level="QueryCoverage=41%, HitCoverage=68%, E-value=7e-09, Identity=81%"; Hit description=DVL19
  Pfam annotation: Domain name=DVL; Domain location=36-54; Score=41.0; E_value=4e-09; Accession=PF08137.3; Description=DVL family
MAEFQNYNKCKQVTNKVVQAKRKGYGISSKCASLVKEQRARLYILRRCATMLLCWKLLAMHGLPAQLGWASFTVGLSF

SEQ ID NO: 177162 - protein, 202 aa, Glycine max
  Coding DNA Sequence Number=SeqID_60384
  Homolog annotation: Hit_ID=Q9AVH2; Match level="QueryCoverage=61%, HitCoverage=67%, E-value=2e-47, Identity=56%"; Hit description =Putative senescence-associated protein
EGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPCESNELLPFVPHEISVLVELILGHLRYLLTDVPPQPNSPPDN

SEQ ID NO: 177163 - protein, 103 aa, Glycine max
  Coding DNA Sequence Number=SeqID_60385
  Gene Ontology: Cellular component=chloroplast
MNGAKRSAEAVGCKKESVGERSALEGRTRASSAGQSGSENVNLSNANVGENPMPRKPKSSSVSQSSSTRHYNTEVIHAILPGKAQTTFNKWELDEILPRKGIG

SEQ ID NO: 177164 - protein, 158 aa, Glycine max
  Coding DNA Sequence Number=SeqID_60386
  Homolog annotation: Hit_ID=Q69RP1; Match level="QueryCoverage=40%, HitCoverage=24%, E-value=3e-12, Identity=48%"; Hit description =Ribosomal protein-like
MATPLGVAKEEEWYIVIVKKNCTTVIRILIYGSPADNMDKYVRMGETIAVECLERFVSDICTIFGNEYLKRSNNKDTKRLLKMGATCGFSGHQICKNVTFLQMVTQLAKGIALGRKWQCWCRTSDVVSCGACRPWIFFINGVICFLKFNGSGMKKEER

SEQ ID NO: 177165 - protein, 461 aa, Glycine max
  Coding DNA Sequence Number=SeqID_60387
  Homolog annotation: Hit_ID=Q1RW53; Match level="QueryCoverage=72%, HitCoverage=85%, E-value=1e-37, Identity=32%"; Hit description =Cyclin-like F-box; F-box protein interaction domain
  Pfam annotation: Domain name=FBA_1; Domain location=301-443; Score= -41.2; E_value=0.0079; Accession=PF07734.3; Description=F-box associated
TYQGNPCGVYPYLSSFTGSGVFQNSVAYIKRSTPSQVHIKEIGFKRWGGLLKRRGSLENGGGGLRWFKSEGNLLRNPYITYIGFSLSLRLVAEKQHGEAHFVCDSASGIDQRNSSAIADPQFTHFDLAASPTHRLILRSNYYDNFNYIESIDIESLIKTCRQHIVYFPSPPRDHHDDGEYYDVHNQPQILGSCRGLVLLHYWGSSEELILWNPSLGVHKRFPKTYFPYGIHDEYVYGFGFDASTDDYGLILIEFPEFSFGETAVFLFSFKTGSWKRDIPVSASYNDLDDIFSVGDEFKAGSLLNGVLHWLVFSKERKVPVIIAFDLIQRSFSEIPLFNHLTTENYHVCRLRVVGGCLCLMVLGREAAEIWVMKEYKMQSSWTKSTVIPTFDFYPICAAEDGGIFGSNCEGLVKHDDNGELFDYHISAEGQRLYCANPAMYQESLLSLPCANRNETREDDQH

SEQ ID NO: 177166 - protein, 102 aa, Glycine max
  Coding DNA Sequence Number=SeqID_60388
  Subcellular localization annotation: CTP_CleavageSite=38; ConfidenceScore=5.14e-01
MPGGVGARRTMTSVGASRGGKERCKPQVGRNDASVAVVAMSSATEAAMARREAFGHAFCFGEKTARPRLQWQGGKLLDTFCFGEKSFSQEEDRKMLKKIERC

SEQ ID NO: 177167 - protein, 78 aa, Glycine max
  Coding DNA Sequence Number=SeqID_60389
MSLILITWEQIQGIKFERDMRDISRASMDLYGMLREHAVSSNLVYKAIRSSKLHLYRQNSKTSIIGSESIIFHFFANN

SEQ ID NO: 177168 - protein, 331 aa, Glycine max
  Coding DNA Sequence Number=SeqID_60390
  Homolog annotation: Hit_ID=Q1T2S5; Match level="QueryCoverage=90%, HitCoverage=95%, E-value=2e-34, Identity=32%"; Hit description =Cyclin-like F-box; F-box protein interaction domain; Galactose oxidase, central
  Pfam annotation: Domain name=F-box; Domain location=1-48; Score=39.6; E_value=1.1e-08; Accession=PF00646.23; Description=F-box domain
  Pfam annotation: Domain name=FBA_1; Domain location=152-303; Score= -34.5; E_value=0.0021; Accession=PF07734.3; Description=F-box associated
  Pfam module annotation: Pfam domain module=F-box::FBA_1; Domain location=1-48::152-303
MENHTLPMDLMREILLRLPVRSVSRFKCVCKSWLSIISDPQFGNSHYDLAAAPSHRLILRSKCYSLEVQSIDTDAPPDTCSAAMYLLLPLQSPPPKPNDYDNYDDDYLLIMIPFHWKTEIQVFSFKTNSRNRKMIKLNVPYQGIGSKFSIGSLLNETLHWLVFSKDKWVDVIIAFDLIKRSLSEIALFDHLTKKKYEMFSLRVIGGCLSVSCSDQDWAMTEIWIMKEYKVQSSWTKSFVIPTYGFSPICITKDGGILGSNMRERLEKHNDKGELLEHLACVAAAGEEYYCANQDQQSAMYRESQLFPNLGSVNGNDNLAFAGCTQPMDNIS

SEQ ID NO: 177169 - protein, 126 aa, Glycine max
  Coding DNA Sequence Number=SeqID_60391
MRLIVKLVVMKEIGVAWGSRRCTARSKRTVSSPPCINGASVSEKGMLYRSHWQSEKNFSDQLQRLSLSEHEMRYARTSRSSEEREKVRVRWQGGRKGGRIWLVATAKERGGRFLCGRFDSLLRERY

SEQ ID NO: 177170 - protein, 397 aa, Glycine max
  Coding DNA Sequence Number=SeqID_60392
  Homolog annotation: Hit_ID=Q1T2S5; Match level="QueryCoverage=98%, HitCoverage=100%, E-value=5e-44, Identity=35%"; Hit description =Cyclin-like F-box; F-box protein interaction domain; Galactose oxidase, central
  Pfam annotation: Domain name=F-box; Domain location=3-50; Score=41.7; E_value=2.5e-09; Accession=PF00646.23; Description=F-box domain
  Pfam annotation: Domain name=FBA_1; Domain location=226-380; Score= -42.8; E_value=0.011; Accession=PF07734.3; Description=F-box associated
  Pfam module annotation: Pfam domain module=F-box::FBA_1; Domain location=3-50::226-380
MENQTETLPRDLIREILLRLPVKSVLKCKRVCKTWLSLISDPKFGISHYDLAAAPCHRLVFKSKGFLVNSIDVDAPLFMNSAELNFLSTPPSPPHGAAHHHNNHKYIILGSYRGILLLYFLFHYDLILWNPSIGVHQPLTYFKFDFTTIAIRSYGFGYDSSTNNHCLVLIILDESEDDDDDDDDDDDDDDDCMVEIRVCSFESASSVSYKDIFFPYHYINNKFYAGSFFNEALHWLVLTDDEDVPVIVAFDLIQRSLSDTIPLFDHFTVEKYKVQSFGVMGGCLSVCCLVQGCATAEIWMMKEYKVQSSWTKYMVIPIYKIPNYHFSPICITKDGHILGSNTGRRLEKRNHKGELLEFLTYAGGGDWCCFNLLSAMYRESLLLPSDIIGEPSEDDQE

SEQ ID NO: 177171 - protein, 72 aa, Glycine max
  Coding DNA Sequence Number=SeqID_60393
MGLTGEIPESLSEVKRLTFVGLSDNNLTGTHTLKFNVPPTKRIEGQGFAELQYGILRYMGTITDSGHFHSCH

SEQ ID NO: 177172 - protein, 363 aa, Glycine max
  Coding DNA Sequence Number=SeqID_60394
  Homolog annotation: Hit_ID=Q9FMB4; Match level="QueryCoverage=99%, HitCoverage=42%, E-value=1e-139, Identity=70%"; Hit description =Arabidopsis thaliana genomic DNA, chromosome 5, TAC clone:K15E6
LDVWAKEREVAGLKASLNTLMSEIQRLNKLCAERKEAEDSLKKKWKKIEEFDARRSELETIYTALLKANMVMFCYFSISCTSEIQLWHIYSLSLGMDAASFWSQQPLTAREYALSTIIPACAAVAEASNNAKDLIEKEVSTFYRSPDNSLYMLPSSPQALLEAMGASGPPGQEAVANAEISAAILTARAGARDPSAIPSICRVSAALHYPAGLEGSDAGLASVLESLEFCLKLRGSEASVLEDLLRAINLVYIRRDLVQSGEALLNHANLVQQEYEKTTKFCLSKADEQEKTIMEEWLPELKNAVLSAQQSLEDCKYVRGLLDEWWEQPASTVVDWVTVDGQNVTAWHNHVKQLLAFCDKELL

SEQ ID NO: 177173 - protein, 277 aa, Glycine max
  Coding DNA Sequence Number=SeqID_60395
  Gene Ontology: Mol. function=ATP-dependent helicase activity; Cellular component=intracellular; Biological process=RNA processing
  Homolog annotation: Hit_ID=Q1KL58; Match level="QueryCoverage=98%, HitCoverage=25%, E-value=5e-32, Identity=40%"; Hit description=Dicer- like 2 spliceform 1
  Pfam annotation: Domain name=DUF283; Domain location=38-120; Score =48.4; E_value=2.4e-11; Accession=PF03368.5; Description=Domain of unknown function
MESLCHSSLPCDPLEGDQFDEETYCVASTEAFANLSSSISLIHLYCSRLPADGYFKPTTRWDKETRTLYVPKSCPLQHIRVEGDKKLLKNIACLEACKQLHKIGALSDNLVPDIVIEEAKVEEFGNEPYDENQPTFAPFGLVLLCKKFHVTILIILIDHNMNKLTTGLDKCYLEDDLEIDYLLLPALGKRQYAAVNWLAVNSVNPSEVSCNYHEPHIRTKNGLVCSCKLQNALVCTSHPIGKISFYIITGIMELDGNSPMELRGGGTTTYKKYYQQH

SEQ ID NO: 177174 - protein, 345 aa, Glycine max
  Coding DNA Sequence Number=SeqID_60396
  Homolog annotation: Hit_ID=Q2HSE9; Match level="QueryCoverage=87%, HitCoverage=64%, E-value=7e-76, Identity=52%"; Hit description =Pollen Ole e 1 allergen and extensin
  Pfam annotation: Domain name=DUF1210; Domain location=32-270; Score= -49.5; E_value=0.031; Accession=PF06735.2; Description=Protein of unknown function (DUF1210)
  Pfam annotation: Domain name=Pollen_Ole_e_I; Domain location=32-156; Score=32.9; E_value=1.3e-07; Accession=PF01190.8; Description=Pollen proteins Ole e I family
  Pfam module annotation: Pfam domain module=DUF1210::Pollen_Ole_e_I; Domain location=32-270::32-156
MSWFLVILFLSLTFGTTHSETSHHKKLPSAVVVGTVYCDTCFQQDFSMGNHFISGASVAVECKDGYGRSKPRFRKEVKTDDHGEFKVQLPFSVSKHVKRIKGCTVKLINSSEPYCAVASAATSSSLRLKSRKQGQHIFSAGFFSFKPLRQPNLCNQKPSIQNIKGLDYAKHIFPPKIDPSFPPPLQDPKTPGGLLPPIPGLPDLPPLLPPLPLLPPLSGILSPLVPAGITNEFPNVQPSDQKLVDPNNLIFPPNPFQPTPSVPNPLQQPPLIPNPLEPSGPSPLVPNPFQPPSSATSPPLFPFPTVPGLTPSPPSLALPIPFPPLFPPPSSPGTPSASSAKNASP

SEQ ID NO: 177175 - protein, 432 aa, Glycine max
  Coding DNA Sequence Number=SeqID_60397
  Homolog annotation: Hit_ID=Q9FMB4; Match level="QueryCoverage=99%, HitCoverage=54%, E-value=1e-153, Identity=65%"; Hit description =Arabidopsis thaliana genomic DNA, chromosome 5, TAC clone:K15E6
MGYRPLGTYAAGKSHLPSVDSIRRICRGNMIPVLNFLVTRAKSEKTVRNIRRNITVHGGADGAGEAKEEVRGKGARKKERSLAAVVDGSETATTREAALQERDLAAKEVERLRNVVRRQKKDLRARMLEVSREEAERKRMLDERANYRHKQVMLEAYDRQCDEAAKIFAEYHKCLCYYVNQAMDSQRSGVDSSVEMAKSEKEAVYSTVKGSKSADDVILIETTREKNIRKACESLVDHMVEKIRSSFPAYEGSGIHLNPQTETAKLGFDFDGQIPDEVRTVIVNCLKSPPQLLQAITAYTLRLKSLISREIEKIDVRADAETLRYKYENNIVMDVSSSDGSSPLQYQLYGNGKIGVDVPPGGSQNQLLDRQKAHVQQFLATEDALNKAAEARDMCEKLMKRLHGGTDVSSRSLGIGSNSQNVGSLRQLEVLL

SEQ ID NO: 177176 - protein, 178 aa, Glycine max
  Coding DNA Sequence Number=SeqID_60398
  Homolog annotation: Hit_ID=Q1S8I5; Match level="QueryCoverage=80%, HitCoverage=85%, E-value=2e-15, Identity=35%"; Hit description =Probable Ta11-like non-LTR retroelement protein [imported] -Arabidopsis thaliana
MWDRHMLKGVLKLDVFTPKAKTPKSPSGLLPPDSGFPSIREKEKGLESQFHCLCESGCGRLLARWQILEAWIDERKGFQSHNGPSMENEGRTREESRDMVMRLATWNFDRKLVVLSDLDQDKSPSMVYLNCCPFWVRIYDLPLNLRVKRVAQTIANTIPQFMEWNKNEQNRLGRFVRV

SEQ ID NO: 177177 - protein, 38 aa, Glycine max
  Coding DNA Sequence Number=SeqID_60399
VVLNSRSIVPNVTQQVLVITCSSAFLSALVRTGYYTCP

SEQ ID NO: 177178 - protein, 134 aa, Glycine max
  Coding DNA Sequence Number=SeqID_60400
  Gene Ontology: Mol. function=zinc ion binding; Biological process =ubiquitin cycle
  Homolog annotation: Hit_ID=Q1SR15; Match level="QueryCoverage=88%, HitCoverage=52%, E-value=3e-51, Identity=83%"; Hit description=Zinc finger, RING-type; RINGv
  Subcellular localization annotation: CTP_CleavageSite=40; ConfidenceScore=5.03e-01
MTSTASLDNSLSDMYRSPPRPLPYDADPRFFRSQREGLVSRREKGSSHLNEESEPLRGDVDADSESLNSGGKWNDTSEDGSKEYRSKSSVRLSSAKLTTGAGVVYSSSEEEDVCPTCLEVSKVEKIPNRGWLLY

SEQ ID NO: 177179 - protein, 65 aa, Glycine max
  Coding DNA Sequence Number=SeqID_60401
  Gene Ontology: Mol. function=sequence-specific DNA binding; Cellular component=nucleus; Biological process=regulation of transcription, DNA-dependent
  Homolog annotation: Hit_ID=Q1SAB2; Match level="QueryCoverage=93%, HitCoverage=24%, E-value=3e-24, Identity=93%"; Hit description =Transcription factor, MADS-box; Transcription factor, K-box
  Pfam annotation: Domain name=SRF-TF; Domain location=9-59; Score =107.9; E_value=3e-29; Accession=PF00319.9; Description=SRF-type transcription factor (DNA-binding and dimerisation domain)
MGRGRVQLKRIENKTSQQVTFSKRRSGLLKKANEISVLCDAQVALIMFSTKGKLFEYSSERSDMS

SEQ ID NO: 177180 - protein, 468 aa, Glycine max
  Coding DNA Sequence Number=SeqID_60402
  Gene Ontology: Mol. function=ubiquitin-protein ligase activity; Cellular component=intracellular; Biological process=protein modification process
  Homolog annotation: Hit_ID=Q1SAA9; Match level="QueryCoverage=77%, HitCoverage=100%, E-value=1e-129, Identity=56%"; Hit description =Regulator of chromosome condensation/beta-lactamase-inhibitor protein II
  Pfam annotation: Domain name=RCC1; Domain location=183-241; Score =25.4; E_value=0.0002; Accession=PF00415.9; Description=Regulator of chromosome condensation (RCC1)
  Pfam annotation: Domain name=RCC1; Domain location=20-75; Score=7.6; E_value=0.11; Accession=PF00415.9; Description=Regulator of chromosome condensation (RCC1)
  Pfam annotation: Domain name=RCC1; Domain location=244-296; Score =23.2; E_value=0.00092; Accession=PF00415.9; Description=Regulator of chromosome condensation (RCC1)
  Pfam annotation: Domain name=RCC1; Domain location=299-358; Score =14.5; E_value=0.019; Accession=PF00415.9; Description=Regulator of chromosome condensation (RCC1)
  Pfam annotation: Domain name=RCC1; Domain location=361-403; Score =2.1; E_value=0.42; Accession=PF00415.9; Description=Regulator of chromosome condensation (RCC1)
  Pfam annotation: Domain name=RCC1; Domain location=78-127; Score =42.3; E_value=1.6e-09; Accession=PF00415.9; Description=Regulator of chromosome condensation (RCC1)
  Pfam module annotation: Pfam domain module=RCC1::RCC1::RCC1::RCC1::RCC 1::RCC1; Domain location=183-241::20-75::244-296::299-358::361 -403::78-127
MDIDAIFGTIRPVSVPRKSAIYVWGYNQSGQTGRKGKEDQLRIPKQLPPELFGCPAGTNACWLDVACGREHTAAIASDGSLFTWGANDFGQLGDGTEERRKHPEKVKQLESEFVKSVSCGAHCSACIAEPRENDGSISTRRLWVWGQNQGSNLPRLFWGAFKPNTIIREVSCGAVHVVALSDEGLLQAWGYNECGQLGRGVTCEGLQGAHIISSYAKFLDEAPELVKIAKVSCGEYHTAAISDKGEVYTWGLGNMGQLGHSSLQYGDKELLPRRVVTLDGIFIKDVACGGVHTCALTQGGALYTWGGGQSGQLGLGPQTGLFSCVANDSQTFFRNIPVLVVPKGVQLVACGHSHTLISMSDGRIHGWGYNNYGQAANEKCTYAWYPSPVDWKLAAGGGHSAVLTDACSLKELCEFVLADSMTLSNAAKVEDIAYRTGSDALVRLCGRLREYMLAGGALEQKEEMNSKI

SEQ ID NO: 177181 - protein, 220 aa, Glycine max
  Coding DNA Sequence Number=SeqID_60403
  Gene Ontology: Mol. function=sequence-specific DNA binding; Cellular component=nucleus; Biological process=regulation of transcription, DNA-dependent
  Homolog annotation: Hit_ID=Q1SAB2; Match level="QueryCoverage=99%, HitCoverage=74%, E-value=1e-43, Identity=50%"; Hit description =Transcription factor, MADS-box; Transcription factor, K-box
  Pfam annotation: Domain name=K-box; Domain location=39-131; Score =102.4; E_value=1.3e-27; Accession=PF01486.8; Description=K-box region
MEDVLERYERYTHTALTGANNNESQPCVVVIIHMNGSEYEYTSFHGNWSFEYIKLTAKVEVLDRNVRNFLGNDLDPLSLKELQSLEQQLDTALKRIRTRKNQVMNESISDLHKRARTLQEQNSKLAKMKEKAKTVTEGPHTGPETLGPNSSTLNLTSPQLPPPPQRLVPSLTLWHNTFGQILVLQVCIETFQGRALVEETGKAQTVPSGNSLIPPWMLHI

SEQ ID NO: 177182 - protein, 48 aa, Glycine max
  Coding DNA Sequence Number=SeqID_60404
  Subcellular localization annotation: CTP_CleavageSite=28; ConfidenceScore=5.08e-01
MKLMSSSRHMIWESMASKRSSIKAQRSRSSMRTSFNKEEEVSRCGGGE

SEQ ID NO: 177183 - protein, 97 aa, Glycine max
  Coding DNA Sequence Number=SeqID_60405
MEHVLCQSQNQLELDAFGAKKEQGPEEVEADIPGKPDPYFPKDPAQICFKYSRIMRGTSEKKLVRIDVSADTGIVDVGKNNIDKAIAASRDKCNFEV

SEQ ID NO: 177184 - protein, 268 aa, Glycine max
  Coding DNA Sequence Number=SeqID_60406
  Gene Ontology: Mol. function=isomerase activity; Cellular component =endoplasmic reticulum; Biological process=cell redox homeostasis
  Homolog annotation: Hit_ID=Q8LAM5; Match level="QueryCoverage=34%, HitCoverage=70%, E-value=2e-28, Identity=48%"; Hit description =Protein disulfide isomerase-like
KPPEEVEGLQGHSGAKLVKGAFQVEVSHPVVVESVQFSRRFLYRLNLFVKGALQVEVPHRLVDPMNEEEDDGEILNIVLVCQFVFDGGVDLGKNDVIGLEHDGRSGILRREGLAVAAPGCVELDHEKAIVLDDDGEVALLQNNDILVVHLGLLDTSSDEWSKPVKSSQSHSLSASSSSNWWGSRKWSCGEVVAASLVRERNEKRVARERETNSLVKEGARKARKHGREEKAKIVSERDVFSETIFEMLAIITRLPPLSKRQQFFNNHH

SEQ ID NO: 177185 - protein, 111 aa, Glycine max
  Coding DNA Sequence Number=SeqID_60407
  Subcellular localization annotation: CTP_CleavageSite=22; ConfidenceScore=5.33e-01
MAESSKKRKGSSSTTTAVGQCRHDTSGDPPAPNPPSFSSHRSLTLFSSNDQHQRYYSQFSNRVILDPKYLDDGVIFSEVHQIPIVVDQSLFYSLTKLSSQGVPFEGTLVDD

SEQ ID NO: 177186 - protein, 65 aa, Glycine max
  Coding DNA Sequence Number=SeqID_60408
METTTWLTGLLPLKSLFVKMPFSRLPGLSSIGKVVIDGVDYTSDVSGRFMFWWRLSLMLLLSWSA

SEQ ID NO: 177187 - protein, 86 aa, Glycine max
  Coding DNA Sequence Number=SeqID_60409
  Subcellular localization annotation: CTP_CleavageSite=27; ConfidenceScore=5.49e-01
MGVSKLPMDLGGNPPYQRFACVRKVSRCSSGSVVPSYRSRLSGFHHKGMSASMMWLTKGYWRTVRVAGRQGVGGWLVALGMYDMSL

SEQ ID NO: 177188 - protein, 268 aa, Glycine max
  Coding DNA Sequence Number=SeqID_60410
  Gene Ontology: Mol. function=RNA-directed DNA polymerase activity; Biological process=RNA-dependent DNA replication
RLEVSPDIVHPYASPLLCFIGERVETRGYVDLMTTFGQGKLSRSFTIRYLLVDATTSYFALIGRKTLKELGAISSMPHLTTKFPTLTWEIEPAMPHPIVAECTQVMTVDEGSHVRALTVYQASLGGEFDIDPRYDTFDKGLKPIEELVQLQLRPKPGQRMRLNRDLSNHEHRRLADVLHKNADLFAWQPFDMSGIHLSIMADVLSFLDAYSGYKQIRMHTLDKDKMTFITEDANFCYKVMLCDLKNAGTTYQRLMDRVFKQQIDRNVE

SEQ ID NO: 177189 - protein, 82 aa, Glycine max
  Coding DNA Sequence Number=SeqID_60411
MSVKNLAGSLGVHGKTNYTLEYKLGSRCFVRLLQPCEIDTSLKEHSNRVYLPQGLNSEESVRTFPSQFRSNLENILARRLYQ

SEQ ID NO: 177190 - protein, 57 aa, Glycine max
  Coding DNA Sequence Number=SeqID_60412
MDKFDIFVPHPLVITSLLPLEYGCKPLVVKTTIGTSEPYIGAMRGIVHEPQVNLGAD

SEQ ID NO: 177191 - protein, 76 aa, Glycine max
  Coding DNA Sequence Number=SeqID_60413
  Gene Ontology: Mol. function=sequence-specific DNA binding; Cellular component=nucleus; Biological process=regulation of transcription, DNA-dependent
  Homolog annotation: Hit_ID=O22456; Match level="QueryCoverage=85%, HitCoverage=26%, E-value=7e-28, Identity=93%"; Hit description =Developmental protein SEPALLATA3
  Pfam annotation: Domain name=SRF-TF; Domain location=9-59; Score =121.8; E_value=2e-33; Accession=PF00319.9; Description=SRF-type transcription factor (DNA-binding and dimerisation domain)
MGRGRVELKRIENKINRQVTFAKRRNGLLKKAYELSVLCDAEVALIIFSNRGKLYEFCSSSRFIRSSNMAHDLVDI

SEQ ID NO: 177192 - protein, 361 aa, Glycine max
  Coding DNA Sequence Number=SeqID_60414
  Gene Ontology: Mol. function=zinc ion binding
  Homolog annotation: Hit_ID=Q94IQ6; Match level="QueryCoverage=75%, HitCoverage=83%, E-value=6e-71, Identity=49%"; Hit description =Putative methyl-binding domain protein MBD111
  Pfam annotation: Domain name=MBD; Domain location=177-271; Score =18.3; E_value=0.00048; Accession=PF01429.10; Description=Methyl-CpG binding domain
  Pfam annotation: Domain name=zf-CW; Domain location=115-168; Score =85.7; E_value=1.4e-22; Accession=PF07496.5; Description=CW-type Zinc Finger
  Pfam module annotation: Pfam domain module=MBD::zf-CW; Domain location=177-271::115-168
MAFFLIKNFIKLENQMHRGKFSLTPKNEVKDLTGSSLTSYKHSSLLDPIDVSSSSDDENDLPNDDVSNQLVLYDPVANGNNAIELAPDPLQCEHPLLPRSKPSHSVPRVLPSVGAFTVQCASCFKWRLIPTKEKYEEIREHILEQPFVCQKAREWRPHVSCDDPEDISQDGSRVWAIDKPNIAQPPAGWERLLRIRAEGSSKFADMYASIIDPLFLSVIGIETPLYYIAPSGKRLRSMVEIQKFLMEHPEYTRDGVTLSQFSFQIPRPLQENYVRKRPARLTSSYEVSEPVEHEQVSPLAWVDPEGHGRRLGLPAPPFMESHDIDPISISRPSKRQATHKGHFRCNELAGKSSVETVHLSS

SEQ ID NO: 177193 - protein, 274 aa, Glycine max
  Coding DNA Sequence Number=SeqID_60415
  Gene Ontology: Mol. function=DNA binding; Cellular component=nucleus; Biological process=regulation of transcription, DNA-dependent
  Homolog annotation: Hit_ID=Q9LRU5; Match level="QueryCoverage=41%, HitCoverage=41%, E-value=9e-44, Identity=71%"; Hit description=MYB -related transcription factor-like protein
  Pfam annotation: Domain name=Myb_DNA-binding; Domain location=12-59; Score=51.8; E_value=2.2e-12; Accession=PF00249.21; Description=Myb -like DNA-binding domain
  Pfam annotation: Domain name=Myb_DNA-binding; Domain location=65-110; Score=45.2; E_value=2.2e-10; Accession=PF00249.21; Description=Myb -like DNA-binding domain
  Pfam module annotation: Pfam domain module=Myb_DNA-binding::Myb_DNA -binding; Domain location=12-59::65-110
MGSLATQKGWRKGPWTGEEDKLLSEYVSLHGDGRWSSVAKFTGLNRSGKSCRLRWVNYLRPGLKKGQLTPLEEEIIIELHATLGNKWSTIAKYLSGRTDNEIKNYWRTHFGKRERSKHKKKLQRPKVKRVLKQLKHKQQQEQQPQEYDIKSIMSHEETVNETKSFETQNCKQQEMGFMYPTTEHQYTVPNSLHEGFSSTWQDSTLVDDDSWFSLWDFDEPQGFSDYVDQFSKCAMPNQATFRVGGDYSMQNDVKTSRFDDAYDNDLFYGKDMFG

SEQ ID NO: 177194 - protein, 66 aa, Glycine max
  Coding DNA Sequence Number=SeqID_60416
MESLVIEKEEFKSEKDVFERGVSKWVCRNRGDMLNNITRFFKEITMSNFASKFGLSTIEKFEVINI

SEQ ID NO: 177195 - protein, 172 aa, Glycine max
  Coding DNA Sequence Number=SeqID_60417
  Gene Ontology: Mol. function=oxidoreductase activity; Cellular component=proton-transporting two-sector ATPase complex; Biological process=ATP synthesis coupled proton transport
  Homolog annotation: Hit_ID=Q1T6K5; Match level="QueryCoverage=94%, HitCoverage=53%, E-value=9e-31, Identity=39%"; Hit description=2OG -Fe(II) oxygenase
  Pfam annotation: Domain name=2OG-FeII_Oxy; Domain location=26-126; Score=123.2; E_value=7.3e-34; Accession=PF03171.10; Description=2OG -Fe(II) oxygenase superfamily
MARCSEVVAKYAQEMRTLGVKILELDSPLLLAHHYPPCPEPSLTLGAPKHRDPDLATVLLQEKDINALQVFKDGEWIVVEPIPYAFVVNISLMLQIISNGRFIGAEHRVVTNSGIARTTVAYFIRPTNEQIIEPAKLWLSSGARPIYSSITFEEFVRNFMSKGPDIEQELLL

SEQ ID NO: 177196 - protein, 42 aa, Glycine max
  Coding DNA Sequence Number=SeqID_60418
MVAWWEQKVKGNKGDVEKAEMVMTDEVKIGGVVNNKNRWCKK

SEQ ID NO: 177197 - protein, 114 aa, Glycine max
  Coding DNA Sequence Number=SeqID_60419
  Gene Ontology: Mol. function=phospholipase A2 activity; Cellular component=vacuole; Biological process=lipid catabolic process
  Homolog annotation: Hit_ID=Q1SMB2; Match level="QueryCoverage=85%, HitCoverage=86%, E-value=2e-20, Identity=42%"; Hit description =Phospholipase A2
  Subcellular localization annotation: CTP_CleavageSite=27; ConfidenceScore=5.16e-01
MVPAPSFKYVLFFCCTFAFNLLSTPVRALNIGAETTGVAVSVGKECSRQCESSFCSDDYLSQECSQTFINCMNNFKNSKAPTFKGNTCDVDDVIEVIHVVMEAALLAGRVLHKP

SEQ ID NO: 177198 - protein, 82 aa, Glycine max
  Coding DNA Sequence Number=SeqID_60420
  Gene Ontology: Mol. function=metal ion binding; Biological process =metal ion transport
MVVIHEKRLRKCLTKLKGIEKVEVDCNSQQVVVTRYAHKNKILKAMRKSGLKADFLYAQNDLLNAYVSASYANLRFNNFSIF

SEQ ID NO: 177199 - protein, 439 aa, Glycine max
  Coding DNA Sequence Number=SeqID_60421
  Gene Ontology: Mol. function=hydrolase activity; Cellular component =integral to plasma membrane; Biological process=nucleotide metabolic process
  Homolog annotation: Hit_ID=Q1S008; Match level="QueryCoverage=94%, HitCoverage=90%, E-value=0.0, Identity=73%"; Hit description=Type I phosphodiesterase/nucleotide pyrophosphatase
  Pfam annotation: Domain name=Phosphodiest; Domain location=50-378; Score=438.3; E_value=1e-128; Accession=PF01663.12; Description=Type I phosphodiesterase  nucleotide pyrophosphatase
  Pfam annotation: Domain name=Sulfatase; Domain location=48-421; Score= -54.2; E_value=0.024; Accession=PF00884.13; Description=Sulfatase
  Pfam module annotation: Pfam domain module=Phosphodiest::Sulfatase; Domain location=50-378::48-421
MGEEEESALLLSRSKRSSSTFTYCILLLIASMFLLAVYFSSSATAKLHHPVVILISSDGFRFGYQFKAPTPNIRRLIQDGTEAESGLIPVFPTLTFPNHYSIVTGLYPPHHGIVNNVFFDPLTGQQFTMQSHEPKWWLAQPLWETVLLNNLSAATYFWPGSEVHKGPWTCPTAFCQPYNGSVPFQDRVDTVLNYFDLPSHQIPSFITLYFEDPDHQGHRVGPDDSEITQSVARIDAIIGSLIQGLEQRGVFQDVHIIMVGDHGMVGTCDTKLVFLDDLAPWIQIPRDWVQYFTPILSIRPPPSVDPAHVVAKMNEGLNSGKVENGAKLKVYLKEDLPERLHYSDSDRIPPIIGLADEGFKVEQNRTGKKECGGAHGYDNAFFSMRTIFIGHGPRFARGKKIPSFENVQIYNLVTSILDIKGAPNNGSDSFPDSVLLPPA

SEQ ID NO: 177200 - protein, 82 aa, Glycine max
  Coding DNA Sequence Number=SeqID_60422
  Gene Ontology: Cellular component=mitochondrion
MFQFTRLSLACPWIQQQFERLTYIGNPRIYAYFQTPRSISSLTTPFLVSGCLGSSYRRTGNGELPPPPFFFRPTLALKNTGF

SEQ ID NO: 177201 - protein, 69 aa, Glycine max
  Coding DNA Sequence Number=SeqID_60423
MDVDKILPSSSTLGWHSLKVKGEAPRDEEGRSKRRNASGSLKISVDPGIPDIGQPFELLLNPRAGKRQP

SEQ ID NO: 177202 - protein, 133 aa, Glycine max
  Coding DNA Sequence Number=SeqID_60424
MEGESEFKSQDMMRVLHLSQSKKTWEDNRQSSDTIKRIKTREKIFKTLRSLANGRLIAAKHLVITNSSNTRHNVVYFVNPTKESLIEPAKPLISLTSPVFRSMTFGEANDLICIDNVKSTKGLDCVKYKFSDA

SEQ ID NO: 177203 - protein, 122 aa, Glycine max
  Coding DNA Sequence Number=SeqID_60425
AVQYAKQRRNRRRWRTAAAVVQRERPAVANGSEAILKGTTTAACRNAFDGSGGDLRCSTRPRAAFDGAWWSCDSATAVRPHWVLHIHEQNSHLHCAQFDKVAPRSNKASFAILNVQPSGPSG

SEQ ID NO: 177204 - protein, 107 aa, Glycine max
  Coding DNA Sequence Number=SeqID_60426
MHEIMQSGTRFSCRQGGKFGKVPEVITIKIERLHWRRHRYIRRMSRTLVVLVQLRQGRVENSFQKAIVTNSSGKDFMIHLYHNYGKAFFVNNYYSEWFNKDSEIATP

SEQ ID NO: 177205 - protein, 391 aa, Glycine max
  Coding DNA Sequence Number=SeqID_60427
  Homolog annotation: Hit_ID=UPI00006A0F25; Match level="QueryCoverage =23%, HitCoverage=17%, E-value=9e-07, Identity=35%"; Hit description =tRNA-splicing endonuclease subunit Sen54 (tRNA-intron endonuclease Sen54) (HsSen54).
MEGKTRGCSSSEDSDGEIYLQNASDEEELGSSSGSMPKLQFRNVKSKGCWNEEMGMGEVIEKNGKMWITTGIVRSGKIYSSIEETLYLMELGALDIVDNDGRSISLTEMYEKVASGKSGCCWELFEVYRHLKSLGYIIGRHGVAWSLKSIKSSHKAAAVEVTEESKQLEDTDSKSELSINKLWVLLTSALRTLVKKLKGESIYVEIIGERKKSHEQCNFVHSNKNISPFSFLANAVQALVSTCHKLFGELQEFMVADMLLHCVTCGRQCGYVISQSRILRIDKGIVPVCSLIGFKGDSHLGLGGIVLIPGGASVNEQLVVLYHVSPVRVQNPPSRAEIEALEKQCGGIPLKICLVTEGRLVGSNDVQESCRSCGKVIKQMGSTSKIRFLSN

SEQ ID NO: 177206 - protein, 61 aa, Glycine max
  Coding DNA Sequence Number=SeqID_60428
  Gene Ontology: Mol. function=oxidoreductase activity
  Homolog annotation: Hit_ID=Q8LKP6; Match level="QueryCoverage=98%, HitCoverage=18%, E-value=9e-09, Identity=47%"; Hit description =Putative flavanone 3-hydroxylase
MPADVKIHESPKDPNGSCKIYTSSARTTKDVVEYWKDTLSHPCQPSGEFKDYWPEKPVGYR

SEQ ID NO: 177207 - protein, 301 aa, Glycine max
  Coding DNA Sequence Number=SeqID_60429
  Gene Ontology: Mol. function=methyltransferase activity; Biological process=metabolic process
  Homolog annotation: Hit_ID=Q8S0I2; Match level="QueryCoverage=83%, HitCoverage=85%, E-value=1e-114, Identity=75%"; Hit description =Methyltransferase-like
  Pfam annotation: Domain name=Methyltransf_11; Domain location=145 -235; Score=34.8; E_value=3e-07; Accession=PF08241.2; Description =Methyltransferase domain
  Subcellular localization annotation: CTP_CleavageSite=57; ConfidenceScore=5.37e-01
MTNFVGLRLHTRLPLPVLGDVSATATSTTLSRAVLKKWNWRVKGPRRMLLGLGVSFLSMAGSKSFIALARITAGPSVDEILKNVEWPDQFPFKEEDFQRFDETPDSLFYEAPRFVTHIDDPAIAALTKYYSKVFPPSNTPGVSILDMCSSWVSHFPSGYKQELVVGLGMNEEELKGNPVLTEYAVQDLNVNTKLPFADNSFDIITNVVSVDYLTKPLDVFKEMCRILKPGGLAIMSFSNRCFWTKAISIWTSTGDADHVMIVGSYFHYAGGFEPPQAVDISPNPGRSDPMYIVYSRKLSTA

SEQ ID NO: 177208 - protein, 62 aa, Glycine max
  Coding DNA Sequence Number=SeqID_60430
  Gene Ontology: Cellular component=integral to membrane
  Homolog annotation: Hit_ID=Q9ZUN5; Match level="QueryCoverage=87%, HitCoverage=31%, E-value=8e-19, Identity=80%"; Hit description =Putative senescence-associated protein 5
MKERGSNPTPFVTAEEVFCLSIFEGTACNEIDPDDCSRAGSGHCSTSSNLGLPLDSQDLSTV

SEQ ID NO: 177209 - protein, 348 aa, Glycine max
  Coding DNA Sequence Number=SeqID_60431
  Gene Ontology: Mol. function=alkaline phosphatase activity; Cellular component=integral to membrane
  Homolog annotation: Hit_ID=Q0A7L6; Match level="QueryCoverage=54%, HitCoverage=95%, E-value=2e-37, Identity=41%"; Hit description =Hypothetical protein precursor
  Pfam annotation: Domain name=LysM; Domain location=250-293; Score =58.2; E_value=2.8e-14; Accession=PF01476.10; Description=LysM domain
  Pfam annotation: Domain name=SNARE_assoc; Domain location=35-166; Score=-17.8; E_value=0.0068; Accession=PF09335.1; Description=SNARE associated Golgi protein
  Pfam module annotation: Pfam domain module=LysM::SNARE_assoc; Domain location=250-293::35-166
MKIFGPLYERAMKWAAHERAPTYLTVLSFFEAIIFPVMPEVMLAPMCVAQPKRGWWFATLSLAGSMVGALVGYALGHYAFEAIKPLFEALGMLPAIEQGITTVQAKMAESPWAVFTFLVLGGFMPIPMKVFTWASGIVGVPMPQYLLSMLIGRGKRVFVLAAVIRIGGARAEAALRRWIEPLGWIATALVVEVRMSPDRLSKGVRIGALALLVSTLAACGTATVVRPGGGSAAGGVTTPKTSVPKPGQTVVVRKGDTIYALARIHDITPADLIAWNRLDNPSTIYPGQVIRLYPQGATIGRAPTTVVTPPRSAGSSGGSTAPAPAPVGPVKSNIAWRWPADGAIVGRY

SEQ ID NO: 177210 - protein, 88 aa, Glycine max
  Coding DNA Sequence Number=SeqID_60432
  Gene Ontology: Mol. function=metalloendopeptidase activity; Biological process=cell wall catabolic process
  Homolog annotation: Hit_ID=Q4IXW3; Match level="QueryCoverage=49%, HitCoverage=20%, E-value=8e-10, Identity=70%"; Hit description =Peptidase M23B
MARQCPGSHLLCSARAHARAAPRRGAARKAAGRDPALPDHTVISVPADTAAGRPACRCNESRSGPCRGSHRYSPFRRSARQPSRSVLH

SEQ ID NO: 177211 - protein, 185 aa, Glycine max
  Coding DNA Sequence Number=SeqID_60433
  Homolog annotation: Hit_ID=Q5E7M4; Match level="QueryCoverage=44%, HitCoverage=84%, E-value=6e-13, Identity=43%"; Hit description =Hypothetical RNA binding protein
  Subcellular localization annotation: CTP_CleavageSite=34; ConfidenceScore=5.17e-01
MKAAATLRPLPARMLKVRAAAGLFITSRPMPRDRQAAITTAGGNTWRSPVGQLQFGGLLHRPALDQLVRGQEEAAAQHQLVDPGRAAIGGAQAVGHGDVADALHQRAFGGFDDLADHHVTGVAVFGSDLHLDQLVALQHFVQLSDEGRGHTLAAGLQQGLQVVGLAAQETGLGSGQGDGHAGKHG

SEQ ID NO: 177212 - protein, 99 aa, Glycine max
  Coding DNA Sequence Number=SeqID_60434
  Gene Ontology: Mol. function=oxidoreductase activity; Biological process=ethylene biosynthetic process
  Homolog annotation: Hit_ID=Q1S020; Match level="QueryCoverage=78%, HitCoverage=25%, E-value=5e-29, Identity=74%"; Hit description=2OG -Fe(II) oxygenase
MGFFLIENHEIDKNLMEKVKELINIHYEENLKEGFYQSEIAKTLEKKQNTSDIDWESAFFIWHRPTSNIKKITNISQELWLVNSTWVTSNVEKCWQYIF

SEQ ID NO: 177213 - protein, 123 aa, Glycine max
  Coding DNA Sequence Number=SeqID_60435
MAEEPKVPPPSDPPLPFDPSRMIGIIKRKALIKDLAAVYHAECLAYCQELLELQTKWEEWFYYALSLLKCTNALERSQPFIDLKTPEESKKETARPSKRIVEHQPKFIKGGCRFSETFMLRFP

SEQ ID NO: 177214 - protein, 218 aa, Glycine max
  Coding DNA Sequence Number=SeqID_60436
  Gene Ontology: Mol. function=protein binding; Biological process =defense response
  Homolog annotation: Hit_ID=Q1S2K5; Match level="QueryCoverage=99%, HitCoverage=45%, E-value=4e-47, Identity=39%"; Hit description =Disease resistance protein; AAA ATPase
MGNERLDTNYVVPQWMPQFKCRSEARTLIVLDDVWTLSVVDQLMCRIPGCKFLVKSIPLAANENLVKQAVTECGRLPLALKDKKIPLDVLINMWVEIHDIPETKAYAIVIELSKKKNLLTLLKKARATGTYSSCFEILVTQHDELRDLTLNLRNHESIDERRLFVMSKRENGMPKEWLIYRHKSFEAQIVSIHTGEMKEVDCSNLKFPKAEVLTITTT

SEQ ID NO: 177215 - protein, 93 aa, Glycine max
  Coding DNA Sequence Number=SeqID_60437
MEEERGRGHWMEGGTNENLVNGAHNFVLVRTKVRYSLEGVTCNQASFSIVVCGTSAAPLVSSFELHHPQCDQADTGSHGFWYSFSNIRLPIVD

SEQ ID NO: 177216 - protein, 427 aa, Glycine max
  Coding DNA Sequence Number=SeqID_60438
  Gene Ontology: Mol. function=protein dimerization activity; Cellular component=nucleus; Biological process=regulation of transcription, DNA-dependent
  Homolog annotation: Hit_ID=Q1SYN6; Match level="QueryCoverage=84%, HitCoverage=58%, E-value=2e-56, Identity=32%"; Hit description=Zinc finger, BED-type predicted
  Pfam annotation: Domain name=hATC; Domain location=370-427; Score =14.0; E_value=0.0011; Accession=PF05699.5; Description=hAT family dimerisation domain
PSNSNNPFMIPGVRYSNGKMRKIIATAIMVHEYPFSVVEDSIWMWAFQYANPSFHKKSSHQVVEYMVITGHFIDAGWNLQKRVLSFVKVPAPRHGIDVADAIFKCLKTWGIENKVFSISVDNASCNDSCIRCLKENISLSSKLFLGGSLFHVRCCAHILNLLVQDDLSTIKDIIFNISESVKYINHNDARLKAFCDVVEQKRLKERKLVIDCPTRWNSTFNMLSTALKFMTAFASYKERKSHYNYAPSLEEWNQVEKVCKLLEVFNLATHVISGSEYLTANLYLAEVWKVKQILDKEIEDEDLFMREMCKFHMVSICFPLIYSKEVAGENIKKVKSSFEELYDEYVVVTGFDEIMSMLHEKEVISPIKSELQDYLGEGIYVPKTNSFSALDWWRNNSIKHKILSKMVADTLAIPISIVTSEFIFSAG

SEQ ID NO: 177217 - protein, 464 aa, Glycine max
  Coding DNA Sequence Number=SeqID_60439
  Gene Ontology: Mol. function=oxidoreductase activity; Cellular component=integral to membrane; Biological process=electron transport
  Homolog annotation: Hit_ID=Q69F95; Match level="QueryCoverage=95%, HitCoverage=94%, E-value=0.0, Identity=91%"; Hit description =Cytochrome P450 85A
  Pfam annotation: Domain name=p450; Domain location=35-460; Score =119.4; E_value=1e-32; Accession=PF00067.12; Description=Cytochrome P450
MALFIVVLVVVALVLCFCTALLKWNEVRYRRKGLPQGTMGWPVFGETTEFLKQGPNFMKNKRARYGSFFKSHILGCPTIVSMDPELNRYILMNEAKGLVPGYPQSMLDILGTRNIAAVHGSTHKYMRGALLSIISPTLIRDLLLPKIDEFMRTHLSDWENKVINIQEKTKEMAFLSSLKQISGMESSSISQPFMTEFFKLVLGTLSLPINLPGTNYCRGLQARKSIISILSQLLEERKLSQEAHVDMLGCLMNREENRYKLTDEEIIDLIITIMYSGYETVSTTSMMALKYLHDHPKVLEEIRKEHFAIRERKKPEDPIDGNDLKSMRFTRAVIFETSRLATTVNGVLRKTTHDMELNGYLIPKGWRIYVYTREINYDPFLYHDPLAFNPWRWLGNSLESQSHFLIFGGGTRQCPGKELGIAEISTFLHYFVTRYRWEEVGGGKLMKFPRVVAPNGLHIRVSPY

SEQ ID NO: 177218 - protein, 725 aa, Glycine max
  Coding DNA Sequence Number=SeqID_60440
  Gene Ontology: Mol. function=inositol or phosphatidylinositol phosphatase activity; Biological process=vascular tissue development (sensu Tracheophyta)
  Homolog annotation: Hit_ID=Q84W55; Match level="QueryCoverage=85%, HitCoverage=55%, E-value=0.0, Identity=59%"; Hit description=Type II inositol-1,4,5-trisphosphate 5-phosphatase 12
  Pfam annotation: Domain name=WD40; Domain location=212-250; Score =5.5; E_value=8.3; Accession=PF00400.22; Description=WD domain, G -beta repeat
  Pfam annotation: Domain name=WD40; Domain location=269-306; Score =11.5; E_value=1.7; Accession=PF00400.22; Description=WD domain, G -beta repeat
  Pfam annotation: Domain name=WD40; Domain location=475-511; Score =1.1; E_value=27; Accession=PF00400.22; Description=WD domain, G-beta repeat
  Pfam module annotation: Pfam domain module=WD40::WD40::WD40; Domain location=212-250::269-306::475-511
MIVRIVVIGTGVRCLISAGILLGLSVRLCFHSLTSHTFPNFDSMDPSSSPLRQNDVASFDRQTSSRIYLHSSSSDDDVSPSHSIQSTNRRLDYMLQFLDRKLSSDHAHRRHSSGSRAAQLPEFVAKGGGAGIFRLPARGAVHPARPPSLELRPHPLRETQIGRFLRNIVSTESQLWAASECGVRFWNFKDLYASWCGVGEEEGVVARNGDEESAPFRESVWTSPTLCLVADEGNRLVWSGHKDGKIRCWKMDDDDDDNNNNNCDWSNRFTESLSWHAHRGPVLSLTFTSYGDLWSGSEGGGIKIWPLEAVEKSIHLTKEERHSAAIFVERSYVDLRSQLSTNGFSNMLTSDVKYLVSDNSRAKCLLNCRDARTRELLKVFNSDGQIENRLDVSSIQDFSVELISSSRKDKTQSSIGFFQRSRNAIMGAADAVRRVAAKGGFGDDNRRTEALVVTIDGMIWTGCTSGLLVQWDGNGNRIQDFLYHSSSIQCFCTFGMQIWVGYVSGTVQVLDLKGSLIGGWVAHGSPIVKMTVGAGYVFALANHGGIRGWNITSPGPLDSILRSELGGKEFLYTKIENIKILSGTWNVGQGKASLDSLTSWLGSVASDVSLVVVGLQEVEMGAGFLAMSAAKETVGLEGSSVGQWWLDMIDKTLDEGSTFERIGSRQLAGLVIAVWVKTNIRFHVGDVEVAAVPCGFGRAIGNKFLMITDLVIVSFGFIEQSNKDI

SEQ ID NO: 177219 - protein, 178 aa, Glycine max
  Coding DNA Sequence Number=SeqID_60441
  Gene Ontology: Mol. function=metal ion binding; Biological process =metal ion transport
  Homolog annotation: Hit_ID=Q1SEG6; Match level="QueryCoverage=78%, HitCoverage=88%, E-value=3e-21, Identity=42%"; Hit description=Heavy metal transport/detoxification protein
  Pfam annotation: Domain name=HMA; Domain location=49-109; Score=39.8; E_value=9.6e-09; Accession=PF00403.16; Description=Heavy-metal -associated domain
MASLLQKAFGSEISSFIYRLFIYQNHNKGIPRNFKMPKKGRPLSLQTVELKVRMCCTGCERVVKNAIYKLKGIDSVEVDLEMERVRVGGYVDRNKVLKAVRRAGKRAEFWPYPNPPLYFTSADHYFKDTTHEFKESYNYYRHGYNLPERHGTMHVSHRGDDNVSNMFNDDNVNACHIM

SEQ ID NO: 177220 - protein, 83 aa, Glycine max
  Coding DNA Sequence Number=SeqID_60442
MSIAILRAFISKRKQEHEAMLYKRTKAAQKVSENGISEPVMEDGAHAFLPKECDEVSMEEPCSTTEECDAVGESIDISYGKVH

SEQ ID NO: 177221 - protein, 683 aa, Glycine max
  Coding DNA Sequence Number=SeqID_60443
  Gene Ontology: Mol. function=catechol oxidase activity; Cellular component=chloroplast; Biological process=metabolic process
  Homolog annotation: Hit_ID=Q7Y249; Match level="QueryCoverage=99%, HitCoverage=93%, E-value=1e-118, Identity=45%"; Hit description =Polyphenol oxidase
  Pfam annotation: Domain name=Tyrosinase; Domain location=289-585; Score=341.9; E_value=1.1e-99; Accession=PF00264.10; Description =Common central domain of tyrosinase
IYSAGRDPIFYSHHANVDRMWNIWKTIPTGKRRDFKNRDWLETTFFFYDENKNLVSVKVKDSLDSKKMGYVYQDVDIPWLQKRTKPKRTRKAKQVAFTQQFGGIGAAIAAETGPSSKFPLTLLDSKVTLLVKRPKQLRSKKDKEEDEEVLVIDGIEFDGDDDVKFDVYITDEDVEEIGPENTEFAGSFATLGHSHSNMNMDKKIKTSLTLGITDLLEDLDAENDDSILVTLVPRSENVTITIQSIKIEFEKEERHVLLGGGIYDASTLSNTINNPLAIAAPFQPPKLENCVETDDVPGGLRNNSIVAHHNLLPSLSAAQFFNKDYLEKYEKALTRMKALPPDDPRSFIQQANIHCAYCDGGYKQVEFPKLDFKVHNSWLFFPFHLWYLYFYEKILGKLIDDPTFALRFWNWNNPDVAWDKIHQPPTLVDLNYSKNNDGSANVENNLCVVYKSVVSCGKTPSVFLGKPFHPGEEPNNSAGSVESVPHTPVHIWTGDRNQPNGEDMGRFYSAGRDPIFYSHHANVDRMLNISKTIKGGKRRDVTDPDWLETAFYFYDENKNLVRVTIKDSLDTKKLGYVYQDVDIPWLNKKPKPKKSRKAKKAAEARPSVKFPLTLNSKRSKPRSWNENEEEEKGVEEVLVIDVEYDSTDGVRFDVFINNQGDNEIGPQDSEFAGSFVTLPHSPH

SEQ ID NO: 177222 - protein, 49 aa, Glycine max
  Coding DNA Sequence Number=SeqID_60444
MSVYKVLRIFSRLGKLRELGNLVGWSRVDARVTVIVESGWGGGVGGLVG

SEQ ID NO: 177223 - protein, 532 aa, Glycine max
  Coding DNA Sequence Number=SeqID_60445
  Gene Ontology: Mol. function=GPI anchor binding; Cellular component =membrane; Biological process=root hair cell differentiation
  Homolog annotation: Hit_ID=Q69F97; Match level="QueryCoverage=80%, HitCoverage=99%, E-value=0.0, Identity=89%"; Hit description =Phytochelatin synthetase-like protein
  Pfam annotation: Domain name=Phytochel_synth; Domain location=118 -282; Score=370.9; E_value=1.9e-108; Accession=PF04833.5; Description= Phytochelatin synthetase-like conserv
MVTSQYGEAKPSETNTPSNTAFDVLCSLIYVSPAYSMVSGRCFKIWEVQKEISWALFLHYYTSNSIALRHNNIEGMRLVISAVCVIVLFSYAAAYDPLDPNGNITIKWDVVSWTPDGYVAVVTMSNFQMFRHIMNPGWTLGWTWAKKEVIWSMVGAQTTEQGDCSKFKGNVPHCCKKTPTVVDLLPGVPYNQQFSNCCKGGVVAAWGQDPSSAVSSFQVSIGLAGTSNKTVKLPKNFTLLGPGPGYTCGPAKVVPSTVFLTPDKRRKTQALMTWNVTCTYSQFLARKNPGCCVSLSSFYNETITPCPTCACGCQNKRNCVKSNSKRINMVGIHTPKKDNEPLLQCTHHMCPIRVHWHVKLNYKDYWRVKVAVTNFNYRMNYSLWTLAVQHPNLNNVTQVFSFDYKPLLPYESINDTGMFYGMKYFNDLLMEAGPTGNVQSEILLQKNQDTFTFKQGWAFPRKVYFNGEECMLPPPDSYPILPNSAPVNLLNFPAFVLTMLVMITNLTELLEKNQARLMNVCVVIHKCLSDAE

SEQ ID NO: 177224 - protein, 393 aa, Glycine max
  Coding DNA Sequence Number=SeqID_60446
  Gene Ontology: Mol. function=GPI anchor binding; Cellular component =membrane; Biological process=root hair cell differentiation
  Homolog annotation: Hit_ID=Q69F98; Match level="QueryCoverage=99%, HitCoverage=100%, E-value=0.0, Identity=80%"; Hit description =Phytochelatin synthetase-like protein
  Pfam annotation: Domain name=Phytochel_synth; Domain location=53-217; Score=326.2; E_value=5.8e-95; Accession=PF04833.5; Description =Phytochelatin synthetase-like conserv
MGFFLLPKATPCILFLALLSCTCFTSTDAYDPLDPNGNITIKWDIISWTPDGYVAVVTMNNFQQYRHIASPGWSMGWTWAKKEVIWSMMGGQTTEQGDCSKFKGGIPHCCKKDPTVVDLLPGTPYNQQIANCCKGGVLSSWVQDPTNAVSSFQVSVGRAGTTNRTVKVPKNFTLKAPGPGYTCGPAKIVAPTKFITSDKRRVTQALNTPHLASVVAGSGKNNFSPLVQCTHHMCPVSIHWHVKLNYKEYWRVKVTITNYNYRMNYSEWNMVVQHPNFDNLTQLFSFNYKSLTPYGSINDTAMLWGVKFYNDFLNQAGPNGNVQSELLFRKDKATFTFDKGWAFPRRIYFNGDNCVMPPPDAYPWLPNAGARQEVSLFALVIASLVALVFYAPA

SEQ ID NO: 177225 - protein, 79 aa, Glycine max
  Coding DNA Sequence Number=SeqID_60447
MARNVFASCPYYRNLHGRKLKGLLVIIPKVVISLLMVSLGIIPFEEHIAAVRTTSTNTLSKRKNSRLGFTVIKQVGDLA

SEQ ID NO: 177226 - protein, 138 aa, Glycine max
  Coding DNA Sequence Number=SeqID_60448
MFIIHVVQFHRGIAARASSPLRETKGKKQSDRETKEQRTENRENRERNLGRKEALIDVNGDDVGETRGEEMDEEVRGARGVDADGGACEALEAGLRVQAAEWPFLGLINCPHDISCSWKIDRNVQVRKGSIISDSRKV

SEQ ID NO: 177227 - protein, 80 aa, Glycine max
  Coding DNA Sequence Number=SeqID_60449
MNCILINKFDDKDLSDDGVVRSDDNHSEDDSDVGCKHGAEEEHETNIGDLTGSTQRFCIAAVKNMLLISILDMPDVMGLM

SEQ ID NO: 177228 - protein, 72 aa, Glycine max
  Coding DNA Sequence Number=SeqID_60450
MDIDNIFNILKPLINFGVIHARSSQERCIHHSQGNAMPFAMALGKNSVMRGGPNSAMVFNTKRCRKRQNREK

SEQ ID NO: 177229 - protein, 565 aa, Glycine max
  Coding DNA Sequence Number=SeqID_60451
  Gene Ontology: Mol. function=oxidoreductase activity; Cellular component=membrane; Biological process=electron transport
  Homolog annotation: Hit_ID=O22189; Match level="QueryCoverage=89%, HitCoverage=99%, E-value=1e-123, Identity=42%"; Hit description =Putative cytochrome P450
  Pfam annotation: Domain name=p450; Domain location=29-499; Score =85.7; E_value=1.4e-22; Accession=PF00067.12; Description=Cytochrome P450
MAVLSSGEFLGAFLVFVVIHYWRLNRHTPIAKWPILGMLPGVFLNMPTIFDYITSVLKREGGTFMFEGPCLSNMNIMFTSDPMNVQHITSTKFQNYGKGNDFREIFEILGDGIFRSDSQLWNYNRTILHSVFRKASFQLFVHQTIMNKIESCLLPFLDRGWKEGMEVDLQDVFQRLTFDNICSIVLGFDPNCLSMEFPEVACEKAFTEAEDALLYRHFRPKCLWKLMKWLHVGKEKKLEESQKIVDQMLYTEIRSKCKVQGESNNSSTPVDESQFSLLNVLINEVGKGKADDNFLRDTAINLLAAGRDTISSGLSWFFWLVATHPSVESKILEEIRKNLPAREGNWKNLGVESISRLTYLHAAISEALRLYPPIPIEHKCALKSDMLPSGHWINSNTMILYSLYTMGRAEEIWGEDCLKFIPERWISKQGGIIHIPSYKFIAFNAGPRSCLGKDISYTEMKMVAVSILSNYHVHLVEGQIISPRVSIVLHMKHGLKMVAVSILSNYHVHLVEGHTISPGVSIVLHMKHGLKVRVTKRSFCGQEIYVIVTDCVRLLHVTFIRNVEV

SEQ ID NO: 177230 - protein, 93 aa, Glycine max
  Coding DNA Sequence Number=SeqID_60452
MGTCSRQGYSVDDTVCEKYDISKEKWIQFCQSRKDPSWEDVQKKAHAIQKQNASPHEAAKFGSTDTVIDPPSPHQTTHEVEDDSPQENWSNDV

SEQ ID NO: 177231 - protein, 469 aa, Glycine max
  Coding DNA Sequence Number=SeqID_60453
  Gene Ontology: Mol. function=acyltransferase activity; Cellular component=nucleus; Biological process=regulation of transcription, DNA-dependent
  Homolog annotation: Hit_ID=Q69FA1; Match level="QueryCoverage=99%, HitCoverage=100%, E-value=0.0, Identity=82%"; Hit description =Anthocyanin acyltransferase
  Pfam annotation: Domain name=Transferase; Domain location=5-461; Score=7.2; E_value=2.7e-11; Accession=PF02458.6; Description =Transferase family
MADTVTVKVIEQCEVGPPPGTVPSTSIPLTFYDLPWLCCPPLKRIFFFNFPYSSQHFLQTLLPSLKHSLSLTLQHFFPFSSNLVFPPKPNPPHILHTQADSISFTVAESSADFTTLVSDSPKHVTLLHPFVPVLPPPRTLHDGTFLIPLMAIQVTVISHFGFTICITFRHVAADGRAFHHFMKFWASVCKSKGDLGLASLALPLHNRDIIQDPKGLKLVFLEELWNLLPENVESKGEIRDVPSDIVRHTFVLSHDHVEKLKKWVTIKCKSHGLEIPHLTTFVVTCSLIWVCKVKSEEAEVGTILPNNDESYILAFMADCRNRPECSIPLEYFGNCLVCGNAEVKRGKLVGENGVVEAALAIGSEVRHLQRETFEGAQTLMSNFTEFATVGKHMTILAGSPKLEVYQTDFGWGKPKRSEVVHVDNSGTISLSDCRDKEGRIEVGLALQKIQMNQFSTILEEHLTEIGVLD

SEQ ID NO: 177232 - protein, 286 aa, Glycine max
  Coding DNA Sequence Number=SeqID_60454
  Gene Ontology: Mol. function=acyltransferase activity
  Homolog annotation: Hit_ID=Q69FA1; Match level="QueryCoverage=84%, HitCoverage=50%, E-value=4e-50, Identity=45%"; Hit description =Anthocyanin acyltransferase
MEPSCPIYDAPCDSDMVRHRIILSCDQVEQLKKWVGIKCESIGLEALHLSTFVVTCSLIWVCKVKSKDLDSTDVTDPKDDDCYCLNFLADCRNRSELSVPSTYFGNCLTICHVELQREKLVGEKWYFGGRVLLEGKLEVWGDPLKGFEWIVSGHRRRELGRRSQNVMIIAGSPKLNAYETDFGWGRPNMSEILHADDAGAMWLSDSREQERGGIEVGLALSAFQMKKFNAILEEQLIDMDVVAPHELSILNDRNTRGSLPYSYPAECFHIICQHSCTAKSLTLESE

SEQ ID NO: 177233 - protein, 334 aa, Glycine max
  Coding DNA Sequence Number=SeqID_60455
  Gene Ontology: Mol. function=transporter activity; Cellular component= mitochondrial inner membrane; Biological process=transport
  Homolog annotation: Hit_ID=Q69FA0; Match level="QueryCoverage=97%, HitCoverage=90%, E-value=1e-129, Identity=76%"; Hit description =Mitochondrial carrier protein
  Pfam annotation: Domain name=Mito_carr; Domain location=117-209; Score=88.3; E_value=2.4e-23; Accession=PF00153.17; Description =Mitochondrial carrier protein
  Pfam annotation: Domain name=Mito_carr; Domain location=19-106; Score= 54.6; E_value=3.4e-13; Accession=PF00153.17; Description =Mitochondrial carrier protein
  Pfam annotation: Domain name=Mito_carr; Domain location=225-314; Score=81.4; E_value=2.9e-21; Accession=PF00153.17; Description =Mitochondrial carrier protein
  Pfam module annotation: Pfam domain module=Mito_carr::Mito_carr::Mito_ carr; Domain location=117-209::19-106::225-314
MAQSFGQTEINWDKLDKTRFYVVGAGLFTGVSVALYPVSVVKTRLQVATKDAVERNVFSVAKGLLKTDGIPGLYRGFGTVITGAIPARIIFLSTLETTKVTAFRMLEPFRLSETSQAAIANGVAGMTSSLFAQSVFVPIDVVSQKLMVQGYSGHSQYSGGLDVVRKVLRTDGIRGLYRGFGLSVITYAPASAVWWASYGSSQRFIWRFLDHGAKYDEVAPSMQKIMLVQATGGIIAGATSSCITTPLDTIKTRLQVMGHENRSSIKQVAKDLINEDGWRGFYRGFGPRFFSMSAWGTSMILTYEYLSENSSSLITFSLCVCALVFIFLMIYIFQ

SEQ ID NO: 177234 - protein, 84 aa, Glycine max
  Coding DNA Sequence Number=SeqID_60456
MESKYMSESKKNALQKTSFANDHLNSLEELIGRLRRLNENVGFAYLSEVNWRKVSLETQDVCNLSFKILNIGCPSNFQFCKLVP

SEQ ID NO: 177235 - protein, 70 aa, Glycine max
  Coding DNA Sequence Number=SeqID_60457
MEWFFRISHSFVTWTEETAASRHPPPPHHEEFVEPPIPKVSVATDLRTHSVVQCEGCQGMAQDLGAIAED

SEQ ID NO: 177236 - protein, 73 aa, Glycine max
  Coding DNA Sequence Number=SeqID_60458
MWMTVGSNCNLRIFRTPNSKSIILESIKNSKVRLWEQLEQQRHGSRCCNSVETSVAFASLQAGITGYYNATFK

SEQ ID NO: 177237 - protein, 46 aa, Glycine max
  Coding DNA Sequence Number=SeqID_60459
MVGGCARLLERREDPSQMENFYIEIVAIKMTGNNDGWKSKGQVYGR

SEQ ID NO: 177238 - protein, 271 aa, Glycine max
  Coding DNA Sequence Number=SeqID_60460
  Gene Ontology: Mol. function=transporter activity; Cellular component= mitochondrial inner membrane; Biological process=transport
  Homolog annotation: Hit_ID=O49875; Match level="QueryCoverage=100%, HitCoverage=74%, E-value=1e-121, Identity=77%"; Hit description =Adenine nucleotide translocator
  Pfam annotation: Domain name=Mito_carr; Domain location=173-269; Score=99.6; E_value=9.1e-27; Accession=PF00153.17; Description =Mitochondrial carrier protein
  Pfam annotation: Domain name=Mito_carr; Domain location=68-165; Score= 132.0; E_value=1.7e-36; Accession=PF00153.17; Description =Mitochondrial carrier protein
  Pfam module annotation: Pfam domain module=Mito_carr::Mito_carr; Domain location=173-269::68-165
MVDQVQHPRIIEKVAGQQHLRTGLPLYHQWRSFANYSNGALQYPVMPACRAATAASHVFVAAPSEKGHFLIDFLMGGVSAAVSKTAAAPIERVKLLIQNQDEMIKAGRLSEPYKGIGDCFKRTMQEEGVVSLWRGNTANVIRYFPTQALNFAFKDYFKRLFNFRKDRDGYWKWFAGNLGSGGAAGASSLLFVYSLDYARTRLANDAKAAKKGGERQFNGLVDVYKKTLASDGVAGLYRGFNISCVGIIVYRGLYFGMYDSLKPVLLTGSLQ

SEQ ID NO: 177239 - protein, 165 aa, Glycine max
  Coding DNA Sequence Number=SeqID_60461
TNIVSRTFCRPDPRSQVICGITSWLPAPFIKPGANEPVDAKRLTSSSTLFAIQGHQVRWQAEIPYGHRRLSSIEGNDFDGIRMMLAVRDDRVRWRREVSWLFYLVVFKTLKGMQIAIRPTWAFQDVPTEGSAYWWKQPSSPGRQPSPDENPEIGQIQAKGPSGEG

SEQ ID NO: 177240 - protein, 166 aa, Glycine max
  Coding DNA Sequence Number=SeqID_60462
  Gene Ontology: Mol. function=transporter activity; Cellular component= integral to membrane; Biological process=transport
  Homolog annotation: Hit_ID=Q0X8X8; Match level="QueryCoverage=100%, HitCoverage=38%, E-value=1e-79, Identity=86%"; Hit description =General substrate transporter:Major facilitator superfamily MFS_1
RGQGQQRQADGAQGPERFQQHQPAAAALAGQELGHHGVVHRQRAADTDAGDKAQQQQPGEVRREGRGHAGAGVDDHGHHQHRAAADAVGQSAEGEGADQHADEERGAGLQGFGHRDAEGAGDGRRAEADRQHLHGVGHPDQAEDHEQPVLELADAGGLDALFHRDE

SEQ ID NO: 177241 - protein, 73 aa, Glycine max
  Coding DNA Sequence Number=SeqID_60463
MSDMELYIEKDVAGGSMFHSANSLTSCGNKLSNNEAQPPRNVSNLHGDEDDDDDYLVSNSYIEESLDEDDSVD

SEQ ID NO: 177242 - protein, 58 aa, Glycine max
  Coding DNA Sequence Number=SeqID_60464
MGEELATQLAQASSVATSKSNRLLEEHPGMPKWAWCKMTIICVCVSLDVNEPGRQGAE

SEQ ID NO: 177243 - protein, 44 aa, Glycine max
  Coding DNA Sequence Number=SeqID_60465
MESKEPMVQFHLWEGEIELRKWMMDKETLGYSGWRGLHNVARVP

SEQ ID NO: 177244 - protein, 79 aa, Glycine max
  Coding DNA Sequence Number=SeqID_60466
  Gene Ontology: Cellular component=membrane
  Homolog annotation: Hit_ID=Q1S6K0; Match level="QueryCoverage=47%, HitCoverage=12%, E-value=1e-10, Identity=86%"; Hit description=SOUL heme-binding protein; Bacterial regulatory factor, effector
  Subcellular localization annotation: CTP_CleavageSite=59; ConfidenceScore=5.09e-01
MSFVMPSKYGANLPLPKDSSVRIKKVPRKIVAIVSFSGLKRSLGQIMAYVGIDLSSPTLASATLNLIPAFTFILALIFR

SEQ ID NO: 177245 - protein, 65 aa, Glycine max
  Coding DNA Sequence Number=SeqID_60467
MGILFSQTCGCTPQEAHHNINDQRSQFFTLSTALGTEVVRDQGVDAGGIRRLKLGDEGGFRGTRG

SEQ ID NO: 177246 - protein, 79 aa, Glycine max
  Coding DNA Sequence Number=SeqID_60468
MENKESKKAWMEKKTERRRRQHEGDETYLGIMAKEKKQRLVTMLECNEDDARVRRTRCSDADRDGFARRRLEEEESAKA

SEQ ID NO: 177247 - protein, 89 aa, Glycine max
  Coding DNA Sequence Number=SeqID_60469
  Subcellular localization annotation: CTP_CleavageSite=42; ConfidenceScore=5.51e-01
GGDPQAPDTPPPPPQADPAGRPTTGRTCRPMTASTSSASACRARVAWPGDWPEAQAGEAPAEAPSEADQARMDEEMTDLLDFLGGSGAT

SEQ ID NO: 177248 - protein, 423 aa, Glycine max
  Coding DNA Sequence Number=SeqID_60470
  Gene Ontology: Mol. function=transcription factor activity; Biological process=regulation of transcription, DNA-dependent
  Homolog annotation: Hit_ID=Q8ZRI7; Match level="QueryCoverage=49%, HitCoverage=68%, E-value=2e-82, Identity=69%"; Hit description =Putative hydrolase or acyltransferase
  Pfam annotation: Domain name=Abhydrolase_1; Domain location=1-205; Score=34.4; E_value=3.8e-07; Accession=PF00561.10; Description =alphabeta hydrolase fold
  Pfam annotation: Domain name=HTH_1; Domain location=214-273; Score =62.4; E_value=1.5e-15; Accession=PF00126.17; Description=Bacterial regulatory helix-turn-helix protein, lysR family
  Pfam annotation: Domain name=LysR_substrate; Domain location=267-423; Score=10.8; E_value=0.00016; Accession=PF03466.10; Description=LysR substrate binding domain
  Pfam module annotation: Pfam domain module=Abhydrolase_1::HTH_1::LysR_ substrate; Domain location=1-205::214-273::267-423
MAQDISQLIDALGLQRVAFVGHDRGGRVGHRLALDHPEKVSCCVFVDIAPTATMYALTDQAFATRYFWWFFLIQPHPLPETMIGHDPAFFLRKHIDGQLKTPGATEAAVFEDYLRCYRDPAMIHAVCEDYRAAASIDLQHDAADSDRRIACPLLLLWGEKGTVGQLYDVVHTWQDKALQVQGEALPCGHSPQEEVPERFLYSLQRFLGSGWPSIEDLYVFISVARHDGFGRAAIELGQSPSYISKRIAILEKQLETRLFFRTNRVMRLTPEGEKALEGALQDYLSDAVSAFIHQHPSLNIKLMLSDRAFDLLQSGTDVEICVGDDLNPSYIARRLIANRRILCAAPAYLSRAGMPASLDALIHHSCLIINERDISFGNWALTNGEQQGHGIALRSAWDVAPYLATGELVAVLPQWYQEANIWA

SEQ ID NO: 177249 - protein, 203 aa, Glycine max
  Coding DNA Sequence Number=SeqID_60471
  Gene Ontology: Mol. function=potassium ion transporter activity; Cellular component=integral to membrane; Biological process =potassium ion transport
  Homolog annotation: Hit_ID=Q8ZJT0; Match level="QueryCoverage=99%, HitCoverage=34%, E-value=1e-55, Identity=54%"; Hit description=Low affinity potassium transport system protein kup
MQNLGHRRHFTPAVSGSDLPERRRQLRNADALLVIDARRVGGADMQQHHAAVQHAVMLEVVQQRLGNFKLLAREEDGGALDAVRRIALQRFHQRQRLRSLLQISINPIMVSASSTGTQPPDSSFIRLAMNSGTSTTSIHSRNNSASGSGQRQLRSATTPARQAVITMVPVTTMPYAEDNADDWRKASTISITAVNSSQFTTGM

SEQ ID NO: 177250 - protein, 117 aa, Glycine max
  Coding DNA Sequence Number=SeqID_60472
  Homolog annotation: Hit_ID=UPI0000E69459; Match level="QueryCoverage =40%, HitCoverage=7%, E-value=1e-08, Identity=60%"; Hit description =potassium uptake protein
MASVNSSIDVAQLTEVTPAGWIEDNSRCVKSARIKTGLTFCGVKMEITSLINAFMLNPAIRGLRLKTRAGRPVRSPGWAEYEIAHGRAARCAGRSEKSRRAPAPDRGVFSSPAYRAR

SEQ ID NO: 177251 - protein, 234 aa, Glycine max
  Coding DNA Sequence Number=SeqID_60473
  Gene Ontology: Mol. function=hydrolase activity
  Homolog annotation: Hit_ID=Q0MM35; Match level="QueryCoverage=97%, HitCoverage=90%, E-value=2e-65, Identity=54%"; Hit description =Hydrolase
  Pfam annotation: Domain name=Lactamase_B; Domain location=72-209; Score=16.9; E_value=0.0071; Accession=PF00753.17; Description =Metallo-beta-lactamase superfamily
MITICTACGTSYQQQQPALTQCRICQDERQFVPPGGQQWIDQSALRASHQNQWQQLAPGLLSLQTVPDFAINQRAFVLQTPHGNILWDCIAHLDDATVTLLRALGGLHAIAISHPHYYSTMQDWADAFDAPVYLHASDSEWIMRASPRLQPWHGDSCDLLPGVRLLRLGGHFAGGTVLHWAHDGGVLLSGDILQLSQYVTAGRRHGGGHAATVAGREVYAPVRRVCRPRNSRAC

SEQ ID NO: 177252 - protein, 812 aa, Glycine max
  Coding DNA Sequence Number=SeqID_60474
  Homolog annotation: Hit_ID=Q8XQU6; Match level="QueryCoverage=37%, HitCoverage=84%, E-value=7e-87, Identity=51%"; Hit description =Putative zn-dependent hydrolase of the beta-lactamase fold protein
  Pfam annotation: Domain name=Lactamase_B; Domain location=356-562; Score=4.4; E_value=0.068; Accession=PF00753.17; Description=Metallo -beta-lactamase superfamily
MGDGDGVQAAERTQQRDGGVIQMRDAIPQDIAVRRLQHKGALVNGKIWYGLQAEQPGRQLLPLVLMRGAQRRLIDPLLPAGRHKLAFILTNATLRKGRLLLLIRRAAGGTNGDHGFSSQSGEDQFRQGTRLARGVLLWLQLINPRRPLLTVGRGDLNRHPVVAIFKLIQHRPVQRQPVRDKQITRHARAVLIKYDAGKIGGRAPAVGIVSAGDRPCQPLTADVFQDMRIALARLQRAGKATPAAKFCVTGCAMARNMFTAADSQLSLFRGIRAMLKGSSLCRGAIREYPHSAQFDGKKFRNVQPRQSLSFGDYRKMLWDFLFNKPKDTQPPAALPVQPITAAALAQAAPNSVFRLGHSSLLLKLNGQFWLTDPVFAERASPFKRLGPKRFQPAPIAVADLPPIEGIILSHDHYDHLDYHTIMQLKDRVKHFLTPLGVGDLLIKWGVAPEKVIQLDWWQSRDIGGIHFVATPSQHFSGRGLFDSNKRLWCSWTLISDQFRLFFGGDSGYFDGFKAIGRKYGPFDAAFLENGAYDARWADIHMLPQDTLRAFQDLNARWLFPIHNAAFDLAFHRWDDPFTQIVQLAAEHQVALPPRPGGKARNPMAIWLSGRAGQAVSSSYRLRSRRLHAVAAFGGQILIAEAEQLGLFKYLALRSRQFRERIVQLFPQQRFQILILRRLRHAKQRFGNFIFGKILVSGGVEQREFAFFSRSIGDLVARGAKQPGADVLHRLFHLQQFPADLLQDIFGLIVPLAAAANKGAEFRAAGGEGRQQPRILRHAVYSASGDLAGASSAGGRGSSRWLRRSCQSQRPPW

SEQ ID NO: 177253 - protein, 177 aa, Glycine max
  Coding DNA Sequence Number=SeqID_60475
  Gene Ontology: Mol. function=two-component response regulator activity; Cellular component=intracellular; Biological process=two -component signal transduction system (phosphorelay)
  Homolog annotation: Hit_ID=UPI00005F7EC6; Match level="QueryCoverage =100%, HitCoverage=85%, E-value=6e-23, Identity=33%"; Hit description= COG2197: Response regulator containing a CheY-like receiver domain and an HTH DNA-binding domain
  Pfam annotation: Domain name=Response_reg; Domain location=2-115; Score=110.7; E_value=4.1e-30; Accession=PF00072.14; Description =Response regulator receiver domain
MANFVIVDDHPIVRVAIRLVLENAGHRVSAEAGDGDNIFSLVKEKGADAAIIDIDLPGIGGIEAVKNLRTAGSLIPVIVMSGKNAEFYAYESKKAGANGFISKKNNLNDLTHAVDAVLSGYGFFPLRLSHQAEGDQLVQDSDKLLLLSHREYEVLRYLGEGTEIVKIANRMKLSNKT

SEQ ID NO: 177254 - protein, 48 aa, Glycine max
  Coding DNA Sequence Number=SeqID_60476
MYEAKSGMQFCMYTGRNKNSSHDSVHASVNPASSNTEDHYNQPKDTTA

SEQ ID NO: 177255 - protein, 206 aa, Glycine max
  Coding DNA Sequence Number=SeqID_60477
  Homolog annotation: Hit_ID=Q47522; Match level="QueryCoverage=25%, HitCoverage=64%, E-value=8e-24, Identity=100%"; Hit description=LacZ protein
MDAFTETIDPHTNYFNPVNAEKFNEDMARSFFGIGATLRMENDILKIESIVAGGPAFKSKLVSAGDRIIGIAQGSGDFEDITSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 177256 - protein, 43 aa, Glycine max
  Coding DNA Sequence Number=SeqID_60478
MAIKLPRQILVPKSQTGYMQTPLFYRREYRSARVASDGFDLSS

SEQ ID NO: 177257 - protein, 54 aa, Glycine max
  Coding DNA Sequence Number=SeqID_60479
MHMTQMQFTNTGARETVSFLDTTSRGSKVPQQGIKTEPMCDAYAKGATRECTIV

SEQ ID NO: 177258 - protein, 181 aa, Glycine max
  Coding DNA Sequence Number=SeqID_60480
IEACDQRVDMLKNTNQDEVNNIIFMQYMHGSRQLNFMLNISQSQIIPTPAEPLVLNDNNGRVLNFANSTNQVGGASSHGINMLRNIQQDDANCSSYMPSMAQSKLNCLQNNSQSQLITLQTLRSLKAKNKMVDFTNQVVVPQDSINQLGESLDWTNHHGEFEWANGLIGVEDWSNPLRVLL

SEQ ID NO: 177259 - protein, 104 aa, Glycine max
  Coding DNA Sequence Number=SeqID_60481
MRLPGKESLLMKSPITINEILDVSISFLNDHLEETLGSTKIEEIHSKCINLAQCGAKKKSLAHGILVDIVRSKDLSAHFFCFPSIPDQELSFLLLLPFLLSPIL

SEQ ID NO: 177260 - protein, 98 aa, Glycine max
  Coding DNA Sequence Number=SeqID_60482
MATMMEAMMSIKEIMEVNAAYRTRARARVMGEVEEVQEQIKADMEEKMATMVEAMMSMKKIMEANTVAVAATSAVAKVNPMPSSDLNQMNHLTSDMVG

SEQ ID NO: 177261 - protein, 95 aa, Glycine max
  Coding DNA Sequence Number=SeqID_60483
  Gene Ontology: Mol. function=drug transporter activity; Cellular component=membrane; Biological process=multidrug transport
  Homolog annotation: Hit_ID=Q1T5H1; Match level="QueryCoverage=52%, HitCoverage=9%, E-value=5e-13, Identity=74%"; Hit description=Multi antimicrobial extrusion protein MatE
MSRNLMDYAIIPSLASGMLRNFTDCTLTLPFNSRHVAELHGLPNNWPILIKCTTKTLLEKILAPKYNPTPTAKDSPTPKTKLIWRVRVAATSTFS

SEQ ID NO: 177262 - protein, 62 aa, Glycine max
  Coding DNA Sequence Number=SeqID_60484
MTGDASKFIHIYPKNSKHVTYGDNNKESTNRMNNKEQMKNEQRTAKNVHGIDHGSITEAPQP

SEQ ID NO: 177263 - protein, 68 aa, Glycine max
  Coding DNA Sequence Number=SeqID_60485
MGFRGLRDTPVLGGKNCFREENPSRGASVTLPRCFRERIREGFPSFFTVLHSSMVFFSSVFNALLPFI

SEQ ID NO: 177264 - protein, 99 aa, Glycine max
  Coding DNA Sequence Number=SeqID_60486
MSHPIRAWFPVSSSMRFFIVIHLFICSPEHKVQDHHRIQTQTANRESLSLSKIIGRPVRVTMFYENAPTIWDQHRLKGALKPGDPQGLHSEESFRASSS

SEQ ID NO: 177265 - protein, 137 aa, Glycine max
  Coding DNA Sequence Number=SeqID_60487
MILDDHEGEEHCFGKGTNARSVSFLPRSQEKIRDLAKVVIKQDMKGGEHKYGFNNNKREKPEKVRVVDDETGDKHELYEVLRMPSRTKNRCLAFFTEGRRGIINIVFYIYQTPNPMHVKYTQYFDYPSPLEYRLKEN

SEQ ID NO: 177266 - protein, 416 aa, Glycine max
  Coding DNA Sequence Number=SeqID_60488
MCWPGTFSHERNVKLYITEFDDFRRELIRRNWHKQLTNLTEGSIDVAIVKEFYANLYVPEDKSAKQVRVRGHLIKFDVDSLNTFLETPVVVEQGESLPFYSCFARLRPDPQELAARLSIPRRGFVLNVEGLPWKLLRKDLTTLAQTWSVLSYSNLAPTSYTSDLNLDRTKLVYGIVMKMNMNLGSLISSQISLIAQSNSSQLGFSTLITTLFKAGGVTSDSLTFESLNSATNLAYIKKNCWNLDEPSVTFPGTQKSRARRSEAPSTLAAPAPPTLAPSTSAVPSPSAAPVLPGPSTQSSEPFMSMLQSLHQGQLLIMQSLQDMEPQPDQEDDILEASEPTPLEPFIFETDPVAATPQVTPEPSTIVLDMSSSQPESSAPVPDLPLSQDSPSGTTALDLNEHAMDSAQDHDFYFHAF

SEQ ID NO: 177267 - protein, 73 aa, Glycine max
  Coding DNA Sequence Number=SeqID_60489
MTGPLDEPISCFLIKVDPWVLVPITFRGLYVLAIRGLTSSPAEGCTPSPLEGYTSSPLEGYASSFSVCSISTP

SEQ ID NO: 177268 - protein, 134 aa, Glycine max
  Coding DNA Sequence Number=SeqID_60490
MMVRWRTDSFKVDGEQREQESLDGEEDREKEKTTRRRRNIPRYCGEGEEAETCDDARVRRRRCSSLDKTMVRWRTDSFKVHGEQREQESLDGEEDIEKEKTTQGDETYLGMVAKEKKQRLVTMLECDKHDARCR

SEQ ID NO: 177269 - protein, 140 aa, Glycine max
  Coding DNA Sequence Number=SeqID_60491
DLEAATILEEEPQSSKASSSFPIAGHFHLDPIKDHIMAKDPRRVTLEDYSSNSLKTWDEVVEKFLKKYFPESKIVEGKAAISSFHQFPDESLSEALERFCGGKIKLKTPEEAMDLIENMAARCTICGGAQESGCCIPIEE

SEQ ID NO: 177270 - protein, 206 aa, Glycine max
  Coding DNA Sequence Number=SeqID_60492
  Homolog annotation: Hit_ID=Q1SBR5; Match level="QueryCoverage=84%, HitCoverage=21%, E-value=2e-07, Identity=25%"; Hit description =Glutamic acid-rich protein cNBL1500
MEFFSNENFECFQAFENSNLIPFMSLKLLVYSELVKAFYSNLEIHEGALMSEVYGIKMVIDQSLFFDLTKLPSEGVPFEGALIDEWKFDFSVHDARRLVCTNQADMTGRLLAGSLAFESRILHYLIVRILLPRSSNLAQVYEQDLIVMWAFHKGLQTDWAHLVRYRMHKALRLNAPFPYPHLVTLFLQHFNIPLDSEPYVPIKRSF

SEQ ID NO: 177271 - protein, 166 aa, Glycine max
  Coding DNA Sequence Number=SeqID_60493
  Gene Ontology: Mol. function=catalytic activity
MAAKTSSETEKECSSSQSLKISKDLNFRRVSETLDLFRAMGTNIIAPENSNTHGFFDGFLRSFIKLDHIQRGRIACTLLVKGPICNGFGTLHGGAIGSFFVILSTACARTVTAENKELFLGEISMSYLSGTLIDIINRGGNELSSLSRTFGSAYVSLKLKLSKKSL

SEQ ID NO: 177272 - protein, 89 aa, Glycine max
  Coding DNA Sequence Number=SeqID_60494
MAGWEGIGEREVSRPWRWRDRREGVAVPPLAVAGQGERGSHLSSWRDRLALFLKKSLHLVHVNEGFHGSMRIHKHTREENRALYWIEKS

SEQ ID NO: 177273 - protein, 212 aa, Glycine max
  Coding DNA Sequence Number=SeqID_60495
  Gene Ontology: Mol. function=oxidoreductase activity, acting on single donors with incorporation of molecular oxygen, incorporation of two atoms of oxygen; Biological process=flavonoid biosynthetic process
  Homolog annotation: Hit_ID=Q9LY48; Match level="QueryCoverage=85%, HitCoverage=46%, E-value=3e-53, Identity=53%"; Hit description =Leucoanthocyanidin dioxygenase-like protein
MTACQDWPEPVIRVQALAASGLATIPERFIKPKSQRPTNSNNYAPKTNFSQIGHHKNNTTNSNIPVIDMKHIYSGDEGKRAETLRLVSEACQEWGFFQVVNHGVSHELMKGAREVWREFFHQPLDVKEVYANTPLTYEGYGSRLGVKKGAILDWSDYFFLHYMPCSLRDQAKWPALPTSLRECEKHATNQIQPLLIQEKKNQFHMVEESALF

SEQ ID NO: 177274 - protein, 106 aa, Glycine max
  Coding DNA Sequence Number=SeqID_60496
  Gene Ontology: Mol. function=catalytic activity; Biological process =cellular metabolic process
  Homolog annotation: Hit_ID=Q6K7R8; Match level="QueryCoverage=75%, HitCoverage=23%, E-value=2e-14, Identity=50%"; Hit description =Putative dTDP-4-dehydrorhamnose reductase
MQYKLTRRDHNSTPSKERHQRQKQRRMSKVKILVVGGTGYLGQHLLQAYVHANANNGTPFAFDLAFTHHSSPPPQPLLDAIPFSLPFQVDLKTGFGFEAISNTFGQ

SEQ ID NO: 177275 - protein, 260 aa, Glycine max
  Coding DNA Sequence Number=SeqID_60497
  Gene Ontology: Mol. function=catalytic activity; Cellular component =intracellular; Biological process=cellular metabolic process
  Homolog annotation: Hit_ID=Q6K7R8; Match level="QueryCoverage=92%, HitCoverage=76%, E-value=1e-95, Identity=71%"; Hit description =Putative dTDP-4-dehydrorhamnose reductase
  Pfam annotation: Domain name=Epimerase; Domain location=2-185; Score=- 27.0; E_value=0.0002; Accession=PF01370.11; Description=NAD dependent epimerasedehydratase family
  Pfam annotation: Domain name=RmlD_sub_bind; Domain location=4-259; Score=3.8; E_value=2.9e-13; Accession=PF04321.7; Description=RmlD substrate binding domain
  Pfam module annotation: Pfam domain module=Epimerase::RmlD_sub_bind; Domain location=2-185::4-259
MSYKILSLLSIKCILKPDVVVNCAAISVPRACEIDPATAHAINVPSSLVKWLQSFEKRSTLLIHLSTDQVYEGEKSFYKEEDIAVPVNVYGKTKVAAEQFISENYPNFAILRSSIIYGPQTVSPVPKSLPIQWIDGALAKGEKVEFFHDEFRCPIYVKDLVTIILTLTSQWISEGKQMQLLLNVGGADRVSRLQMAEAVAEFRGYDASLIKSVSASSVDRGVKSPADISMDITRLVQTLRIHPVSFKDGVRLTLTTEARQ

SEQ ID NO: 177276 - protein, 78 aa, Glycine max
  Coding DNA Sequence Number=SeqID_60498
MFLVSCNLRKRLGSENSVTNLFGKRWQKSVMHRKRKMKETLQYNLHNAAWALGVGPKSLARSRWVQRNNGLCAWMPNQ

SEQ ID NO: 177277 - protein, 417 aa, Glycine max
  Coding DNA Sequence Number=SeqID_60499
  Gene Ontology: Mol. function=ATP-dependent helicase activity; Cellular component=cytoplasm; Biological process=RNA metabolic process
  Homolog annotation: Hit_ID=Q1S896; Match level="QueryCoverage=98%, HitCoverage=100%, E-value=1e-175, Identity=74%"; Hit description =Helicase, C-terminal
  Pfam annotation: Domain name=DEAD; Domain location=19-181; Score =169.8; E_value=6.7e-48; Accession=PF00270.19; Description=DEADDEAH box helicase
  Pfam annotation: Domain name=Helicase_C; Domain location=248-324; Score=120.4; E_value=5.2e-33; Accession=PF00271.21; Description =Helicase conserved C-terminal domain
  Pfam annotation: Domain name=ResIII; Domain location=13-176; Score= -38.7; E_value=0.082; Accession=PF04851.6; Description=Type III restriction enzyme, res subunit
  Pfam module annotation: Pfam domain module=DEAD::Helicase_C::ResIII; Domain location=19-181::248-324::13-176
MGEENEGIKTFRDLGFSESLVEACEKLGWKRKDVTGLAQTGYGKTGAFALPILHALLEAPRPKHFFDCVLSPTRELAIQIAEQFEALGSELLVGGIDMVQQSIKIAKQPHIIVGTPRRVLDHLKHTKGFSLGRLKYLVLDEADRLLNEDFEESLNEILQMIPRERKTFLFSATMTKKVQKLQRVCLRNPVKIEASSKYSTVDTLKQQYLFLPAKHKDCYFVYILTEMSGSTSMVFTCTCDATRLLALILRNLGLKAIPINGHMSQSKRLGASNKFKSGECNILLCTDVASRGLDIPTVDMVINYDIPTNSKDYIHRVGRTARAGRFGVAISLVNQYELGWYIQIEKLIGNKLPEYPAQEEEVLLLEERVSEAKRLAVMKMKETGGKKKRRGEEDYDGEDIDKYLGLKEGKSSKKFRR

SEQ ID NO: 177278 - protein, 822 aa, Glycine max
  Coding DNA Sequence Number=SeqID_60500
  Gene Ontology: Mol. function=ATP-dependent helicase activity; Cellular component=nucleus; Biological process=rRNA processing
  Homolog annotation: Hit_ID=Q1S897; Match level="QueryCoverage=93%, HitCoverage=94%, E-value=0.0, Identity=78%"; Hit description =Helicase, C-terminal
  Pfam annotation: Domain name=DEAD; Domain location=199-424; Score =176.6; E_value=6e-50; Accession=PF00270.19; Description=DEADDEAH box helicase
  Pfam annotation: Domain name=Helicase_C; Domain location=518-594; Score=118.9; E_value=1.4e-32; Accession=PF00271.21; Description =Helicase conserved C-terminal domain
  Pfam module annotation: Pfam domain module=DEAD::Helicase_C; Domain location=199-424::518-594
MEAAAATANSSQRKPKRKRASAKSDPELDRLDSLPWNSALPQNDDDDAFSLFIGSNELEGGFLSLEEIDEAEYGLSIPEPEVDKRKTKKKKSEQNENVKKQQQDGVDSACSDDTVVEAELDESLKSKEKKKKKKKTKNKKKDAREDQTVEPSDAGLDTNVKDDIGEEDVDETEFYAWNELRLHPLLLKAICKLGFKEPTPIQKACIPAAAHQGKVCLKLFFKALCGDVVGAAETGSGKTLAFGLPILQRLLEEREKAGNMVGERGEEPEKYASTGLLRALIIAPTRELALQVTDHLKAVAKHINVRVTPIVGGILAEKQERLLKAKPEIVVGTPGRLWELMSAGEKHLVELHSLSFFVLDEADRMVQNGHFKELQSIIDMLPMSNNSAEDNSQHVQSCVTVSSYQRKKRQTLVFSATVALSSDFRKKLKRGSIKQKQSLTDGLNSIETLSERAGMRSNAAIIDLTNPSILATKLEESFIECREEDKDAYLYYILTVHGQGRTIVFCTSIAALRHISSILRILGINVWTLHAQMQQRARLKAMDRFRENENGILVATDVAARGLDIPGVRTVVHYQLPHSAEVYVHRSGRTARASAEGCSIALISSRDTSKFASLCKSFSKDNFQRFPLENSYMPEVLKRLSLARQIDKITRKDSQEKAEKNWFDRNSSSVELVTESYDSEEEQVNKHKQMKASSRQLKKLQEDLKILISRPLQSKTFSHRYLAGAGVTPLMQEQLQQLARQKLSDHQGSGLGKKGKLVVIGQDCVDALQALRSAGEEVRMDAKDLAGKQRNMQNLKRKRKEEKKRLRDQRRKQKKKLKYGDE

SEQ ID NO: 177279 - protein, 119 aa, Glycine max
  Coding DNA Sequence Number=SeqID_60501
MYIGIAIQQGTPTTFGTKDLAPRHYIKQEGWDMQWLRLPLTMLEASIRNGDIQGFQLFRNVADQLSSNNRKKCHLNLHQELFEEGIKKEKKKNLPHAQEQSRDIGGWEHSLSLYNPVST

SEQ ID NO: 177280 - protein, 124 aa, Glycine max
  Coding DNA Sequence Number=SeqID_60502
  Gene Ontology: Mol. function=oxidoreductase activity; Cellular component=cytosol; Biological process=metabolic process
  Homolog annotation: Hit_ID=Q2HVK7; Match level="QueryCoverage=71%, HitCoverage=30%, E-value=4e-23, Identity=65%"; Hit description=Short- chain dehydrogenase/reductase SDR
  Pfam annotation: Domain name=adh_short; Domain location=7-121; Score=- 57.2; E_value=0.032; Accession=PF00106.15; Description=short chain dehydrogenase
MGEATERYAVVTGANKGIGLEIVRQLASAGIKVVLTARNEERGLKALETVKDSGLSHLVLFHQVDVADATSVASLADFIKSKFGKLDILKALLNMMNYRNEKHMLYLYDSCWKVTLIAVTPSPP

SEQ ID NO: 177281 - protein, 196 aa, Glycine max
  Coding DNA Sequence Number=SeqID_60503
  Homolog annotation: Hit_ID=Q1T1F7; Match level="QueryCoverage=51%, HitCoverage=20%, E-value=3e-13, Identity=39%"; Hit description=IMP dehydrogenase/GMP reductase
MERHAPEIEDLVAARGLSPLITCSLDTGDRRLISAFVERWHKKTSNFHLPRQCGIVATSADYMGLPQLRGSSCGRSHLASGSYAWGGATLVHMYDNLNDASKGTVKQLVEYITLLQCWIYEHFPSVASSIVVQDYHERKSRVCRWKSGKALPVSTYRKRLNRLTCDAVCWISYGDHRAFKEFELISLFVGHIRWSP

SEQ ID NO: 177282 - protein, 265 aa, Glycine max
  Coding DNA Sequence Number=SeqID_60504
  Gene Ontology: Mol. function=oxidoreductase activity; Cellular component=cytosol; Biological process=metabolic process
  Homolog annotation: Hit_ID=Q2HVK6; Match level="QueryCoverage=57%, HitCoverage=53%, E-value=3e-52, Identity=62%"; Hit description=Short- chain dehydrogenase/reductase SDR
  Pfam annotation: Domain name=Myb_DNA-binding; Domain location=203 -248; Score=35.3; E_value=2.1e-07; Accession=PF00249.21; Description =Myb-like DNA-binding domain
AKPEYDGTKGVTHTYELAEECLQINYYGAKKTTESLMPLLQLSDSPRIVNVSSSLGQLESLPKGSWARGVFNDVDNLTAEIVDEILNKFLRDFKEGSLESKGWPKYLSAYIVSKAAMNAYTRILAKKYPSFCINSVCPGYVKTDITANTGILTVEEGAASPVRLLHSTANQVALMSPAEVELPGSQINHSLPQKGMSSKSNRCKRWSQEHRLFLLGLEKHGSGDWKNISRIIETRTPLQVASHAQKYFLRQALGDKAKRRSINDI

SEQ ID NO: 177283 - protein, 371 aa, Glycine max
  Coding DNA Sequence Number=SeqID_60505
  Gene Ontology: Mol. function=protein transporter activity; Cellular component=nuclear pore; Biological process=protein import into nucleus, docking
  Homolog annotation: Hit_ID=Q2QZ88; Match level="QueryCoverage=99%, HitCoverage=33%, E-value=1e-101, Identity=53%"; Hit description =Expressed protein
  Pfam annotation: Domain name=IBN_N; Domain location=34-103; Score =27.2; E_value=5.8e-05; Accession=PF03810.9; Description=Importin -beta N-terminal domain
MQPTAALTMAEDLTQIAHLLDQTLSPDAIAVPAATDALDRLSLTPHFPFYLLSISTGAGNQGQKIAAATYLKNLIRRTVDSTGVKPSNVSKEFKDQLMQALLQVELSVLKILVEVFRTIAVADFVKQNLWPELVPNLQSAIQNSHLISGSNTKWNTVNALLVLHALLRPFQYFLNPKVAKEPVPPQLELISKEILVPLLAVFHQFVEKALATHGIAEKKTEKVLLTICKCLHFAVKSYMPSTLAPLLLSFCRDLMSILGSLSFDCVVNQEDEYLTRLKTGKRSLLIFSALVTRHRKHSDKWMPEIINCVLNIVKFTKNTSKLPFLSERLLSLGFDVISNILETGPGWRLVSPHFTTLLESAIFPALVMNDK

SEQ ID NO: 177284 - protein, 293 aa, Glycine max
  Coding DNA Sequence Number=SeqID_60506
  Homolog annotation: Hit_ID=Q9FGR6; Match level="QueryCoverage=80%, HitCoverage=74%, E-value=2e-38, Identity=36%"; Hit description =Arabidopsis thaliana genomic DNA, chromosome 5, TAC clone:K6A12
MQMQLLSSPFTIFKLLILTLLLQVIPTLTLSPCKTTCGSIPINYPFGLEDGCGAPQFRHMLNCSTDLFFQTPSGSYKVQSIDYDKKTMVIYDPSMSTCSILQPHHDFQMTDVQSAIIPPSQDTVFVLLNCSIDSPVLNHYKYLCFNFAGHTCDELYGSCNAFRVFHLLTNSSPPCCFTSYSTVKFMSMNILDCTHYTSMFNTDNLKGVGPLDWVYGIKLSFSVPDTGCESCRKSGGTCGFDTDTEGLLCLCSSFANSTRECAAGSIISKGQNNAPWTHYLLVLLFVAYFFSLG

SEQ ID NO: 177285 - protein, 274 aa, Glycine max
  Coding DNA Sequence Number=SeqID_60507
  Gene Ontology: Mol. function=oxidoreductase activity; Cellular component=cytosol; Biological process=metabolic process
  Homolog annotation: Hit_ID=Q2HVK6; Match level="QueryCoverage=97%, HitCoverage=97%, E-value=3e-81, Identity=54%"; Hit description=Short- chain dehydrogenase/reductase SDR
  Pfam annotation: Domain name=KR; Domain location=10-158; Score=-85.3; E_value=0.021; Accession=PF08659.1; Description=KR domain
  Pfam annotation: Domain name=adh_short; Domain location=7-160; Score =17.5; E_value=3.9e-07; Accession=PF00106.15; Description=short chain dehydrogenase
  Pfam module annotation: Pfam domain module=KR::adh_short; Domain location=10-158::7-160
MGETTERYAVVTGANKGIGLEIVRQLASAGIKVVLTARNEERGIQALQTLKDSGLSHLVLFHQVDVADATSVASLADFIKSKFGKLDILAAPEEDVTKAITQSYELAEECLQINYYGAKTTVESLLPLLQLSDSPRIVNVSSTMGQLESLPKGSWAREVFSDANIITEEKVDEILKKFLRDFQEGSLESNGWPRHLGAYIVSKAAMNAYTRILAKKYPSFCINSVCPGYVKTDITANTGLLTVEEGAASPVRLALLPNGSPSGLFYYRSDVASF

SEQ ID NO: 177286 - protein, 251 aa, Glycine max
  Coding DNA Sequence Number=SeqID_60508
  Gene Ontology: Mol. function=DNA binding; Cellular component=nucleus; Biological process=regulation of transcription, DNA-dependent
  Homolog annotation: Hit_ID=Q0PJL5; Match level="QueryCoverage=42%, HitCoverage=33%, E-value=8e-19, Identity=50%"; Hit description=MYB transcription factor MYB57
  Pfam annotation: Domain name=Myb_DNA-binding; Domain location=23-70; Score=37.3; E_value=5.3e-08; Accession=PF00249.21; Description=Myb -like DNA-binding domain
MSGVNNRSELSPLDQGNKTLTRRGRWSQEEHMLFLLGLEIYSRGDWINIATNVVKTRSPTQVASHAQKYFYRQASNNTGKRRSIHDITIQHPIPLLNFPASPNTNLAMHHSFPHHINQQNQGFSSNLPMHHLSVPYHFNHQTQVFCSNLAMQQFHGIPHSVPQHINQQNQVGSSNLAMQELLGRHLYVPDHINHQNQAVSPNLAMQQLHGVQHSVPGHINQQNQVSSPNLAMQQLHGVQHSVPDHINQKNQ

SEQ ID NO: 177287 - protein, 154 aa, Glycine max
  Coding DNA Sequence Number=SeqID_60509
  Homolog annotation: Hit_ID=UPI00006A2918; Match level="QueryCoverage =98%, HitCoverage=54%, E-value=2e-07, Identity=29%"; Hit description =UPI00006A2918 related cluster
  Subcellular localization annotation: CTP_CleavageSite=70; ConfidenceScore=5.13e-01
MQQLHGVQHSVPGHINQQNQVSSPNLAMQQLHGVQHSVPDHTNQKNQVSSPNLAMQQLHGVQHSVPGHINQQNQVASPNLAMQQLHGVQHSVPGHINQQNQVYSPNLAMQQLHGVQHSVPDHINQQNQVSSPNLAMQQLHGIHHSVPDHTNQQH

SEQ ID NO: 177288 - protein, 119 aa, Glycine max
  Coding DNA Sequence Number=SeqID_60510
  Homolog annotation: Hit_ID=Q0GFB2; Match level="QueryCoverage=56%, HitCoverage=10%, E-value=3e-13, Identity=60%"; Hit description=PqqF
LHALAQRYGSRLPAGQRLTARELTAADRCGRLHPDAARHAAAETGVCPAALPFARLAAAAGAPAAGRSPRRAAGPAARSGVVRCGAAGADTGPACALRAAGKSRFPPFGAARPAASQSV

SEQ ID NO: 177289 - protein, 148 aa, Glycine max
  Coding DNA Sequence Number=SeqID_60511
  Homolog annotation: Hit_ID=O04892; Match level="QueryCoverage=42%, HitCoverage=11%, E-value=7e-19, Identity=73%"; Hit description =Cytochrome P450 like_TBP
MSRRARRSLQNPGREPGRSGRRCRSWCLPTLETAQPEVGSSGWKSTARRVVSGAPPAALENPEDRVPPTPGRTHNRIRSPRQGKSAKWIRNLGKRIGSEGWARGSQSRTRRLSVDCSSCFRGESGSSRAGRGTDWERALRGLFPGRRT

SEQ ID NO: 177290 - protein, 99 aa, Glycine max
  Coding DNA Sequence Number=SeqID_60512
MSPHVMHDGGSSQYCIIIVILQRILVGEREFYAMMLVFPPEFSPLKTILFGNPSQDTVEPLMEALEEDYKDGNEINESRQFIGGVLDLEKRINRLDTLT

SEQ ID NO: 177291 - protein, 86 aa, Glycine max
  Coding DNA Sequence Number=SeqID_60513
  Gene Ontology: Mol. function=transition metal ion binding; Biological process=DNA integration
RYMKILKGYTMNLHRPKAFIVERYIPKEAIEFCSEYIEKEKPVGLPESHHDERVGGKGSRGLYVITPSVEDLQQARLNILNNSNEV

SEQ ID NO: 177292 - protein, 91 aa, Glycine max
  Coding DNA Sequence Number=SeqID_60514
  Subcellular localization annotation: CTP_CleavageSite=72; ConfidenceScore=5.17e-01
ERDEGVPPLASAGHVQASPAIGAGGIGSAPRVHALTFAPPAPRVHALTSTRSRLKGLQCLVFSSEKPMLVVVAVVLSSFKCPYPYLGHKFL

SEQ ID NO: 177293 - protein, 135 aa, Glycine max
  Coding DNA Sequence Number=SeqID_60515
MTIGISREHPYLNFERLDILCTRIGHPCERPTYNNKPQETQHKDAHAKVEYVKRLYDQVKVQIAKKNESYVKQAHKKRKELVLKTGDDPGHLRANVFQEGGNDENHETGQIQAKGPSGEGRRPKWRRTKPPSGEG

SEQ ID NO: 177294 - protein, 246 aa, Glycine max
  Coding DNA Sequence Number=SeqID_60516
  Gene Ontology: Mol. function=oxidoreductase activity, acting on NADH or NADPH, quinone or similar compound as acceptor; Cellular component=photosystem II; Biological process=electron transport
  Homolog annotation: Hit_ID=Q9M3I5; Match level="QueryCoverage=93%, HitCoverage=66%, E-value=1e-105, Identity=71%"; Hit description =NAD(P)H-quinone oxidoreductase chain H, chloroplast (EC 1.6.5.-) (NAD(P)H dehydrogenase, chain H)
  Pfam annotation: Domain name=Complex1_49kDa; Domain location=45-246; Score=258.2; E_value=1.7e-74; Accession=PF00346.9; Description =Respiratory-chain NADH dehydrogenase,
MEKIAENRTIIQYLPYVTRWDYLATMFTEAITVNGPEQLGNIQIIGAQTPFFYIFRERELIYDLFEAATGMRMMHNFFRIGGVATDLPYGWVDKCYDFCDYFLTRIVEYQKLITRNPIFLERVEGVGVVDIKEVINWGLSGPMLRASGIQWDLRKVDNYECYEEFDWEVQWQKEGDSLARYLVRIGEMMESIKIIQQALEEFPADHMKFRIRCFDREKEPEWNELSIDLLVKNRLRLLNCQNKNFM

SEQ ID NO: 177295 - protein, 128 aa, Glycine max
  Coding DNA Sequence Number=SeqID_60517
MAHHLLSLTSLLLHDKAPWYLVLFVSSPLALLISCFDALVIDILTSLSLLHSFLTLITTPFNSSFVPMDFYNSAFNSLTSSVSIGEGDDAILPRKGPVTRAMSKRLQEDWARAAEEGPRVLMNLRVDL

SEQ ID NO: 177296 - protein, 125 aa, Glycine max
  Coding DNA Sequence Number=SeqID_60518
  Gene Ontology: Mol. function=RNA-directed DNA polymerase activity; Biological process=RNA-dependent DNA replication
MRAIKGIGDYLFADMAKLCLVPNVVIPPKFKVPDFDKYKGTTWPKNYLKMYYRMMGAYSRDEKLLMHFLQEILVGVAITWQYQYNTDMAPNRTQLQNMCKKEHESFKEYAQRWRDLAAQVSTPMM

SEQ ID NO: 177297 - protein, 50 aa, Glycine max
  Coding DNA Sequence Number=SeqID_60519
MRENETYLDAMDLYCGNANGVAASITGGTNGGNGERVGLVPKAKPHILWL

SEQ ID NO: 177298 - protein, 227 aa, Glycine max
  Coding DNA Sequence Number=SeqID_60520
  Homolog annotation: Hit_ID=UPI00003CC8DF; Match level="QueryCoverage =98%, HitCoverage=80%, E-value=2e-35, Identity=37%"; Hit description =COG1721: Uncharacterized conserved protein (some members contain a von Willebrand ...
  Homolog annotation: Hit description=factor type A (vWA) domain)
MQTIKEFSYHTGWRSRSRRPGRHKSNQRGMGMEFRGHTTLLSYPDPRRIDIRQTIRDPMEQVYVRIFNQKSATPVFVMCDMSGSMQYGTPHTKLVTAAEITRSVAQSACRNTDPVGFIGFDDALHDEWLCTLSSRPHSMFDLADRLEDHLPNEVGAGALLESATLLPRERSLIFMVSDFHMPLEQLEAALLLMLRHHIVPVVLWNSTEYKQLPEFGITSINDPETGE

SEQ ID NO: 177299 - protein, 92 aa, Glycine max
  Coding DNA Sequence Number=SeqID_60521
  Gene Ontology: Mol. function=structural constituent of ribosome; Cellular component=intracellular; Biological process=translation
  Homolog annotation: Hit_ID=Q2HVB5; Match level="QueryCoverage=70%, HitCoverage=26%, E-value=2e-14, Identity=58%"; Hit description =Ribosomal protein L25
TRRRINEVLLAAVLVVFLLEHDAPKPPGATFLGGDVLVGGGAGDGKDHLIVVGIRAGEVIQVGEGLRPRRMTTAEWVSGCGTSLARSLTSLA

SEQ ID NO: 177300 - protein, 209 aa, Glycine max
  Coding DNA Sequence Number=SeqID_60522
MTSESAQEIADKIDSLEEQVTQGSFVPHGRQDILNTAIGRPDHGGRIRAAGSGVTITQYYGRASRTCSSSSTSISQQQLDEVVARLREDMTGQIREELRTQLEEENKMSLEIMTNALKEAIKKELSNKGSPESLQIQLDIQQLGARVSTKGSNVVINVQPSQEHHADAIPLMGLYVQRKDGTLRLVAMGKIMEGDSIIHTVAYADDVVR

SEQ ID NO: 177301 - protein, 285 aa, Glycine max
  Coding DNA Sequence Number=SeqID_60523
  Homolog annotation: Hit_ID=Q47522; Match level="QueryCoverage=15%, HitCoverage=53%, E-value=8e-19, Identity=100%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDPEPTLLTFHYAASGSLRNTIMCEEPNMALSTQLGHNTRQVVLVLLTIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 177302 - protein, 80 aa, Glycine max
  Coding DNA Sequence Number=SeqID_60524
MCRGKDNAKCSEGVPKIGKHQYSRQYAFDFVLCQNRSRRKRYWRHPTFSSSKIIIPTWQHWITSELDRDIFLPTYDGKMA

SEQ ID NO: 177303 - protein, 204 aa, Glycine max
  Coding DNA Sequence Number=SeqID_60525
MSCLVIITLTFLCRSVSWCMPPTRHTLDPDMSNRALGFPALITGLCQSFGVPVTPSKVIQPPITRAFIEKYCMPRQAQGDAPQAADAPPPPHQADPAGSLGMERYLQHLVRQQAANHRGQVQIHECLYQLSLSSRPRASFPLCVSQPTLRREGDARLAGCVFHERNTRGVATNVYLRKTSEKPEKTRSTNFLVKGSGVVFTHGE

SEQ ID NO: 177304 - protein, 231 aa, Glycine max
  Coding DNA Sequence Number=SeqID_60526
  Gene Ontology: Mol. function=nucleoside-triphosphatase activity; Cellular component=membrane; Biological process=ion transport
  Homolog annotation: Hit_ID=UPI00005FA35D; Match level="QueryCoverage =48%, HitCoverage=50%, E-value=3e-25, Identity=49%"; Hit description =COG4559: ABC-type hemin transport system, ATPase component
  Subcellular localization annotation: CTP_CleavageSite=61; ConfidenceScore=5.08e-01
MVALIGPNGAGGDAVNRQRAAGAARLSLAVGRGAAARAAGPAVHSAPVAPADAQWPLQRLRGAARFKSGLTVVGSGVVVTPRPAGGAGRAARGDDRTDPDALVSGRPAGGYAASAGSAADTAAAITAPCTGSGRLAAIDNQPTTHLARQQLFCACARLAQWNHFGHLLQQRAVNQFRQTLPRLLTQWFGAHHAVHAGQRNAAQNKRRNAGGQIEALRHAAGGDHAVALDPG

SEQ ID NO: 177305 - protein, 87 aa, Glycine max
  Coding DNA Sequence Number=SeqID_60527
  Homolog annotation: Hit_ID=Q2NSR1; Match level="QueryCoverage=39%, HitCoverage=10%, E-value=2e-10, Identity=85%"; Hit description=Hemin ABC transporter permease component
MRRGGWRAVVAEQRPAAASAVAVGHGQPDGCPVAEPAGVCAADCSGAAAAPAVGAECAAGGHGGGGQRHYRFCRAGGAARDAFLSRQ

SEQ ID NO: 177306 - protein, 74 aa, Glycine max
  Coding DNA Sequence Number=SeqID_60528
MATNSEPPRNSQIGFEDVTLNLMSSLSHVLMLSLEDNKEGSSTSIAVISISFATSIAQIELKWPEVPTQTTKDG

SEQ ID NO: 177307 - protein, 59 aa, Glycine max
  Coding DNA Sequence Number=SeqID_60529
MVHDDDHWIHGNYLGQHFPPTALPWLFQQLNSNNNDGQAAPWNQSLLMPCVQVILCDNI

SEQ ID NO: 177308 - protein, 70 aa, Glycine max
  Coding DNA Sequence Number=SeqID_60530
MWVRLIKEEKSITGRETRGTGTRETARKPRQDFSVSKVRFFSLFVAEYGSQSKEKVGPFCSTQMETCGIA

SEQ ID NO: 177309 - protein, 51 aa, Glycine max
  Coding DNA Sequence Number=SeqID_60531
MFVLNNALKGLDDTSQSKSKAATRWIVVKACNRLHEDCNRLPAAQNIYNSH

SEQ ID NO: 177310 - protein, 91 aa, Glycine max
  Coding DNA Sequence Number=SeqID_60532
  Subcellular localization annotation: CTP_CleavageSite=16; ConfidenceScore=5.07e-01
MAVAAAAAAAYRGRARGMRRKGKVTAPLRRGGYWVLLAAQRWWWPPRASPPVRSAVQHGAAVKRSAATHPQQQQQQQQQQQQQQQQQQQQQ

SEQ ID NO: 177311 - protein, 79 aa, Glycine max
  Coding DNA Sequence Number=SeqID_60533
  Subcellular localization annotation: CTP_CleavageSite=39; ConfidenceScore=5.34e-01
MHHSHASASFSIKWRPKRPHTGCQQVPSWWGGGGAGVATASGRTAIAALRRLRYIVSLAQRRPAIAARSLRRSRDVITI

SEQ ID NO: 177312 - protein, 204 aa, Glycine max
  Coding DNA Sequence Number=SeqID_60534
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=8e-16, Identity=30%"; Hit description= UPI00006A17C9 related cluster
GLHALTLRGLHVLANVGLHALTFRGLHVLANRGLHALTSRGLHVLALRGLHALTLRTTRPHHQRVARPHLQRTTCPRLERATRPHLGGLHVLAFRGLHILAIRGLHALTFRGPHVLALRGLHALTLGLHVLTIRGLHALTSGGLHVLALRGLHALTLGTSYPHRQRATRPHLERTTRPCQQRAVLPHLQRTTPPRLERAARPHL

SEQ ID NO: 177313 - protein, 216 aa, Glycine max
  Coding DNA Sequence Number=SeqID_60535
ADTVVSDGKQRPSLVILHPRYAEIPYGYLHPFARQTQLCPMASRDQVWSFCTQDTRRYLTRPSLVILHPRYAEIPYGYLHPFARQTQLCPMASRDQVWSFCTQDTRRYLTRPSLVILHPRYAEIPYGYLHPFARQTQLCPMASRDQVWSFCTQDTRRYLTRPSLVILHPRYAEIPYGYLHPFARQTQLCPMASRDQVWSFCTQDTRRYLTVICTPC

SEQ ID NO: 177314 - protein, 223 aa, Glycine max
  Coding DNA Sequence Number=SeqID_60536
  Gene Ontology: Mol. function=oxidoreductase activity, acting on the CH-OH group of donors, NAD or NADP as acceptor; Biological process =electron transport
  Homolog annotation: Hit_ID=Q9PCZ8; Match level="QueryCoverage=71%, HitCoverage=35%, E-value=1e-61, Identity=74%"; Hit description=UDP -glucose dehydrogenase
  Pfam annotation: Domain name=SlyX; Domain location=155-223; Score =91.8; E_value=2.1e-24; Accession=PF04102.3; Description=SlyX
  Pfam annotation: Domain name=UDPG_MGDP_dh_C; Domain location=48-152; Score=120.9; E_value=3.5e-33; Accession=PF03720.5; Description=UDP -glucoseGDP-mannose dehydrogenase family, UDP binding domain
  Pfam module annotation: Pfam domain module=SlyX::UDPG_MGDP_dh_C; Domain location=155-223::48-152
TAQQYGLEPKLLNAVEAVNDAQKGHLFALIQRHYDKGEDEGVRGKTFAVWGLAFKPNTDDMREASSRRLLAQLWEGGATVRAYDPEAMHESQRIFGERDDLTFCSTAGEALQGADALVVVTEWKQFRSPDFQKLREQLKDAVVFDGRNLYEPGEALEARLVELEMRVSFQEQALAELSDALADARMQGMRNADVLRVLLEDLGKVRNALNSSDPASEPPPPHY

SEQ ID NO: 177315 - protein, 71 aa, Glycine max
  Coding DNA Sequence Number=SeqID_60537
MKMLSQLMAEVTITKLNEERHRNTQEKDLLKKELEVLKRQINTKGSQAGFPFLFVCMVALISVAVGYYIHP

SEQ ID NO: 177316 - protein, 104 aa, Glycine max
  Coding DNA Sequence Number=SeqID_60538
MSISPCGRIVLTRHLVDPEKFNRVLGFPALITSLWIAPTRHPVGPEKSSRALGFLALITGLCQFYEAPVAPNKAIRPPINRAFIKKYCAPRQAQDETPQQPGDG

SEQ ID NO: 177317 - protein, 168 aa, Glycine max
  Coding DNA Sequence Number=SeqID_60539
MLVYDGLTSRWGMGFASLLINFSNIVFIVILAQLVLWDKRRADSMPGPINALNLFCYCLLAALVCAAVGALGSVDVERATFIPQLADWFSEQFSTAVLILPFILTLTLPSVLGRFRFSQLLPVIALVLSMALGVAVGGAGSLTFPLPALIWCAIRYPLPLTCLLTFIT

SEQ ID NO: 177318 - protein, 119 aa, Glycine max
  Coding DNA Sequence Number=SeqID_60540
  Homolog annotation: Hit_ID=Q5PN85; Match level="QueryCoverage=95%, HitCoverage=95%, E-value=2e-48, Identity=76%"; Hit description =Hypothetical protein yneG
MENLFARLGRSTFRSRFHLGVKERQYCYDKGPEIIDSHAADFIAKRLAPAQIANDGKQTPMRGHPVFIAQHATATCCRGCLEKWHAIPRGRELSGEEQRYVVQVIHHWLVMEMNAITNR

SEQ ID NO: 177319 - protein, 38 aa, Glycine max
  Coding DNA Sequence Number=SeqID_60541
MSLLHFLENVMNSLIEHAALNEIISTHSFKELSAYPCG

SEQ ID NO: 177320 - protein, 256 aa, Glycine max
  Coding DNA Sequence Number=SeqID_60542
  Gene Ontology: Mol. function=aspartate-tRNA ligase activity; Cellular component=cytoplasm; Biological process=tRNA aminoacylation for protein translation
  Homolog annotation: Hit_ID=Q6AHD6; Match level="QueryCoverage=40%, HitCoverage=24%, E-value=3e-29, Identity=60%"; Hit description =Aspartyl-tRNA synthetase
  Pfam annotation: Domain name=tRNA-synt_2; Domain location=58-255; Score=-88.7; E_value=2.1e-09; Accession=PF00152.11; Description=tRNA synthetases class II (D, K and N)
VPPVQLLTGWCVTAKAPPDISAGKCSGHAARRVPFAIQAAQLLGRAIGAGLFAITPAGERGMCCKAIKLGNARVFPEFDGAEVFSVKYFDTTAFLAQSPQFYKQMAIAGGMEKVFEIGPVFRAEPSFTSRHETEFTSIDMEISWIKDHHELMDFEQRWLAHSIRVVAEIHGPEIEAHFGVKLLFPLVRVNFELGVIMVIAVSFGKPVVPAALMNRPTRGERRFAYWALAECILAYYVGTDEGVSEVLHVAEKKGCT

SEQ ID NO: 177321 - protein, 86 aa, Glycine max
  Coding DNA Sequence Number=SeqID_60543
  Homolog annotation: Hit_ID=Q6VR11; Match level="QueryCoverage=33%, HitCoverage=14%, E-value=2e-09, Identity=96%"; Hit description=WRKY 12
  Pfam annotation: Domain name=WRKY; Domain location=52-82; Score=6.0; E_value=0.00013; Accession=PF03106.6; Description=WRKY DNA -binding domain
MAITFALTKLILLYRQLSCIIYMLISLSWIIDIYAALEVARFGCTLSEVDILDDGYCWRKYGQKVVRGNPNPRDTEMGIWVKADDI

SEQ ID NO: 177322 - protein, 55 aa, Glycine max
  Coding DNA Sequence Number=SeqID_60544
MEVAGSKKGIFVSQSKYILDLLKDTRMMGCRTAKTPIDPNKKLGTSTQTTKMEAN

SEQ ID NO: 177323 - protein, 100 aa, Glycine max
  Coding DNA Sequence Number=SeqID_60545
MEVGSWKLEVGSWNENYWKLKVENGGWKLEVGRGKESNKVASKDKHGFKINTRLLQQKKPCFKINSRSSLALKQSVFKTCKALVIDYQQCNRLPEDRVEK

SEQ ID NO: 177324 - protein, 72 aa, Glycine max
  Coding DNA Sequence Number=SeqID_60546
MLGYSVYKVGLAGKEPAKPKRTGPLSSADAARNFAWRRRSWLSGRPINKKLLLSYPGLANQPRLATGTVPGG

SEQ ID NO: 177325 - protein, 533 aa, Glycine max
  Coding DNA Sequence Number=SeqID_60547
MRLSPRIGPNMSVRSSLSTPAIAGYEWVKLANPEDSCKLAVQTCRSDDLPFLRIVSGPLPFFTLYRCLFEVLGVILPLIAFKCALLEHLNVAPSKLHPNSWAMVRAFEILCPFFNVRPSVSVILFFFQIKLLGKIGWVSLNNVSKKLFEFESNVFHHIKDHLFKVLATNVVADGMPLMFNRDGEPRFPFYWQSYPTRFKSYDEDLLTLVERVNKAILEQLPASLDVWVIQSLPSVIDPLATLDGITNDFSWRRLVMQVEPVVGTMPLSVATPSIGEGGQTAGEVGPVVVVAEVAPSALSSALVKRKMDDVVQPLGRKKSKDPMSLRSLRQAAIEAPIAAIVVANPAPSPPPMAFVQEAKSVMVLSSTIAAPLLSAGEATTGALPMLPPSSSTLVALPDVVLASMASPSSSPHLPRSFEFGNYEGEWTATPIGGAKVYILGGGGRQVEGYCSDFVAEKMDLDGKVKSMVAEKDELTKRITNLEAQIRESESKLKESELRAVKEREASKELEEELILYKKKIMEQYEKGFLKVIR

SEQ ID NO: 177326 - protein, 76 aa, Glycine max
  Coding DNA Sequence Number=SeqID_60548
MKSHTETRTHIAYTTIPNHSIQSMTQGMTQILHAGEHLHRMIGSESATAPLIDRCSPTCPPTPALDRCSTSSDGVS

SEQ ID NO: 177327 - protein, 73 aa, Glycine max
  Coding DNA Sequence Number=SeqID_60549
  Homolog annotation: Hit_ID=Q9LKZ6; Match level="QueryCoverage=64%, HitCoverage=4%, E-value=2e-17, Identity=85%"; Hit description =Receptor-like protein kinase 1
MATPSPVPSPSSLTPNSVQIQTKVVAGELVPGEGEVREVLPGAILGRDLTREEVAAEVKVADEGHGSDGERNF

SEQ ID NO: 177328 - protein, 82 aa, Glycine max
  Coding DNA Sequence Number=SeqID_60550
  Gene Ontology: Mol. function=protein binding
  Homolog annotation: Hit_ID=Q10DM3; Match level="QueryCoverage=71%, HitCoverage=27%, E-value=7e-14, Identity=61%"; Hit description =Expressed protein
MVTELINVNPIIYEKKERRAPSTPHDEYDVEPIDQQEGYIYSNSGTLQYGNSYRSMLTCQAHEKLAFMIQGGYQSGTWISCN

SEQ ID NO: 177329 - protein, 55 aa, Glycine max
  Coding DNA Sequence Number=SeqID_60551
MVQAGKHRIAYLLACGKTKGNKYLSPKRKQSRLITQVIQSLCTAEHNIIEFHNLF

SEQ ID NO: 177330 - protein, 139 aa, Glycine max
  Coding DNA Sequence Number=SeqID_60552
  Gene Ontology: Mol. function=oxidoreductase activity, acting on single donors with incorporation of molecular oxygen, incorporation of two atoms of oxygen; Cellular component=chloroplast; Biological process=abscisic ...
  Gene Ontology: Biological process=acid biosynthetic process
  Homolog annotation: Hit_ID=Q3KRR4; Match level="QueryCoverage=39%, HitCoverage=9%, E-value=7e-14, Identity=67%"; Hit description=9-cis -epoxycarotenoid dioxygenase 2
  Subcellular localization annotation: CTP_CleavageSite=61; ConfidenceScore=5.07e-01
QSGKSGIDSVATSQKLKGDLRAIFNVLSKDMQQLMLSNPERASLLQPSPESPKLPGRPLIQVAVGSSTSPRGISTSGDFSPLMRDRKIELVVEAVTTNCFEVVGSGDLELVGKVVLRHDEKFSVEEHEASVGGANAVAM

SEQ ID NO: 177331 - protein, 631 aa, Glycine max
  Coding DNA Sequence Number=SeqID_60553
  Gene Ontology: Mol. function=protein binding
  Homolog annotation: Hit_ID=Q10NT2; Match level="QueryCoverage=91%, HitCoverage=89%, E-value=0.0, Identity=55%"; Hit description =Expressed protein
  Pfam annotation: Domain name=DUF1630; Domain location=12-604; Score =932.6; E_value=1.7e-277; Accession=PF07792.3; Description=Protein of unknown function (DUF1630)
MSRFPSFSVRTEVSPSVDSESLQRWVVAFCAIRFDLEQGQLVEECYPQGCFSHDEELEIAYSSFPDSVSQHQNQNRSSIHDCIFFYRIHRHLKKSLDEKGVADSSNASKFLYGYVFNRQRHDERLKRGGEQKSVVILSYSPYSSVFRPLLQIVGPLFFDIGKKALEHIAAYVSKWPAPLPGKVMDLPIGNATLKVNLPPAHGLPVEGELSFEEGASSVAPFVPNSQPVPQGLFHDSDIFGSFRGILLQLWLLWELLLIGEPMLIIAPTPPQCCEAVASLVSLVAPLLCSVDFRPYFTIHDPVFARLNSIQEGQAFPPMILGVTNVFFLKALRNIPHIVSVGSPPLNSNRLALTTRSSTGRGSGRPEGLGFQQLSLKKFSPSSLLSAVRLRRDGPLCLMTEHKEAIWSIYSATTKPDTSILNRLIDAGVSPRVEESMSVVNNEILRRHFLELTTNFLAPFSPYFRTSTPLEGSSPYVDPPSLPPFNADEFLASLSARGPGKFILKRMKSNWLDLYRRFLNGPNFLPWFQRRRAVAEQEQDRLWRQARMKTDIQQLISRLSELEIVDSFNVIERLLLREIQGPAWARVRRCFELAVHVDGVTVFDDDNGYCSPVKKAQRSKWDALSRRERRSM

SEQ ID NO: 177332 - protein, 91 aa, Glycine max
  Coding DNA Sequence Number=SeqID_60554
MQSQGLVQAPESKVGLFAARVNTKGSCVNPSRPDPDKGELDKYGLYVDDNPPHLVTLGRVYEGPTTIHNVPLGNDQVKDKQRAEGSMNTYR

SEQ ID NO: 177333 - protein, 101 aa, Glycine max
  Coding DNA Sequence Number=SeqID_60555
  Homolog annotation: Hit_ID=Q1S6S9; Match level="QueryCoverage=40%, HitCoverage=7%, E-value=6e-10, Identity=73%"; Hit description =BTB/POZ; NPH3
MKFFKREGLRKRIKVLTASEFLRIVSPLSMKRGERRTTLCKGERNHHVVVLFSRNRVGSIGSGSETRLSSRGIDSRLLPEASVVWIWDWNRWDHVDRPQCR

SEQ ID NO: 177334 - protein, 80 aa, Glycine max
  Coding DNA Sequence Number=SeqID_60556
MPCFVIFGSVIVLAYIGVFGAGLLAGFLFQFFVQDTSFPTLKQSNPARALDRRLHEDWARDAREGPRVLMSLRVDFRPMG

SEQ ID NO: 177335 - protein, 218 aa, Glycine max
  Coding DNA Sequence Number=SeqID_60557
  Homolog annotation: Hit_ID=Q1S1X7; Match level="QueryCoverage=31%, HitCoverage=6%, E-value=9e-11, Identity=43%"; Hit description =Integrase, catalytic region; Zinc finger, CCHC-type; Peptidase aspartic, catalytic
MSDDVLYEVSEELIVVGLWLKLEKLFMTKSISYKKGMPLKEHLDELNSIPMELCDIDVKMEDEDLALILKQHWMKFPNVVHTTKAMLDYVHFNCWGPSRVPSLGGARGGYLVGSFMWIDTHYEQKGKEWTNTCGEGMLKLKRRLCWELGDGPKGSKEPRGMLSFDNPTRAPLELVGLGSSSSMDSFASYKMNGIGMEKEEREETPLQGEDESRRSSPP

SEQ ID NO: 177336 - protein, 340 aa, Glycine max
  Coding DNA Sequence Number=SeqID_60558
  Gene Ontology: Mol. function=RNA-directed DNA polymerase activity; Biological process=RNA-dependent DNA replication
MSEIEEVQEQMKADMEAMKEQMATMMEAMMSMKKIMEVNAAAVAATSAIAEVDPIPPSGLNQINHPPSDRSQQPQSNHAHVSQPMGEMHEIPYHNLADFEPRLRYATEGQAVDVGRVPPAMAKKGKLDHIEERLKVIEGGGDHAFADMAELYLVPNIVIPLKFKVPNFDKYKGTNCPKNHLKMYCRKMGAYAKDEKLLMHFFQESLTGAADLVVAFVRRYQYNSDMAPDRMQLQNMGEKGHESFKEYVQRWRDLAAQVAPPMMEKEMITMIVDTLPVFYYEKMVGYRPSSFADLVFTGERIEVGLEKGKFDYPALMHEKLGANREDEKEEGTHAMTTIPT

SEQ ID NO: 177337 - protein, 498 aa, Glycine max
  Coding DNA Sequence Number=SeqID_60559
  Gene Ontology: Mol. function=DNA binding; Cellular component=beta -galactosidase complex; Biological process=DNA integration
  Homolog annotation: Hit_ID=Q2HRM8; Match level="QueryCoverage=96%, HitCoverage=46%, E-value=1e-151, Identity=51%"; Hit description =Polynucleotidyl transferase, Ribonuclease H fold
METTPPQPTIQEPKDHTHTVKSTSSQPRRSTRMKHAPTYLQDYHRDLSSHNASASTIIRYPLSLVLSYSRLSPTHKHFIMSISSTVEPSSYAEASQHDCWIKAMKAELQALQSSDTWRLTPLPPHKTAIGCRWIYKIKHRADGSIERYKARLVAKGYTQMEGLDYLDTFSPVAKLTTVRLFLALVALNQWHLRQLDVNNAFLRGELDEEVYMQVPPGLSVPNSQLVCRLQRSLYGLKQASRQWFTKLSGLLTSHDDIILTGNSSSEIQDVTMLLDQTFKIKDLGNLKYFLGLEIARSSAGIHLLIGRLIYLTNTRPDIAYAVQQLSQYMSSPTNAHLQAAYRVLRYLKGTPGSGLFLSATGTPQLRAFSDSDWAGCQDSRKSTTDFVVYFGSSLISWQSKKQSTVSRNSSEAEYRALASTTSIQIATNPVFHERTKHIEIDCHIVRQKVTMGLLKLLPVSSSLQLADIFTKALPPTAFQNLCNKLGMMNIHSQLEGGF

SEQ ID NO: 177338 - protein, 70 aa, Glycine max
  Coding DNA Sequence Number=SeqID_60560
MKSFPICYSSCYFVNNITPPENLANDLYPPTIFFSIQPEPETMILQTATLPPIPTSTPQLPEFKEFQLET

SEQ ID NO: 177339 - protein, 229 aa, Glycine max
  Coding DNA Sequence Number=SeqID_60561
  Gene Ontology: Mol. function=oxidoreductase activity; Biological process=lignin catabolic process
  Homolog annotation: Hit_ID=Q38757; Match level="QueryCoverage=47%, HitCoverage=19%, E-value=3e-32, Identity=57%"; Hit description =Laccase
  Pfam annotation: Domain name=Cu-oxidase_2; Domain location=55-212; Score=116.0; E_value=1.1e-31; Accession=PF07731.4; Description =Multicopper oxidase
MVKRINWMTCSLLKSVRRRLGRTLREVVKNDLVSNNLMILLPFVFVNTRMSLLILRASNVIGLISTDSLALPGMWAQNTLNTLYRRAWTATEHNNCIYCPEHGLLLNKKQYSNPKYRNQGTSALTAENHGMHLHGFSFFVVGVGTGNFNNVTDPKSYNLIDPPEVNTIGLPKDGWLAMRFVANNPGVWFMHCHLERHASWGMHTVLIVRDGGTMQTSMVPPPKYMPPSS

SEQ ID NO: 177340 - protein, 417 aa, Glycine max
  Coding DNA Sequence Number=SeqID_60562
  Gene Ontology: Mol. function=DNA binding; Cellular component =membrane; Biological process=DNA integration
  Homolog annotation: Hit_ID=Q1SS72; Match level="QueryCoverage=80%, HitCoverage=23%, E-value=7e-77, Identity=41%"; Hit description =Integrase, catalytic region
  Pfam annotation: Domain name=zf-CCHC; Domain location=246-263; Score =9.6; E_value=0.026; Accession=PF00098.13; Description=Zinc knuckle
  Pfam annotation: Domain name=zf-CCHC; Domain location=282-299; Score =12.8; E_value=0.0078; Accession=PF00098.13; Description=Zinc knuckle
  Pfam module annotation: Pfam domain module=Retrotrans_gag::zf -CCHC::zf-CCHC; Domain location=77-192::246-263::282-299
MNEATFNNTESYLYLHPSENPATTLVSPVLDSTNYHSWTRSMITALSAKNKIEFVDGSTPEPLKTDRMYGAWCRCNNMVVSWIVHSIAASIRQSVLWMDKAEDIWRDLKSRYSQGDLLRISDLQQEASTLRQGALSVTEYFTRLRVIWDEIENFRPDPVCTCNIRCSCSAFAIIAQRKLEDRAMQFLRGLNEQYANIRSYVLLMDPIPAISKIFSYVAQQERQLLGNSSPNLNFEPKDISVNAAKTICDHCGRTGHTENVCYKKHGMPLNHEARNRSTSGRKTCTHCGKIGHTVDVCYRKHGYPPGYKPYNGRRTTVNNVMTVDNKPLDDQTQHHESQISGHRPETRHRSKPNKLPQSHPAPLINLPTQDTNNRMKIGIVEERHGLYHLIPDQTDKAICSTIIHPKCNIIPIDLWHF

SEQ ID NO: 177341 - protein, 251 aa, Glycine max
  Coding DNA Sequence Number=SeqID_60563
  Gene Ontology: Mol. function=diacylglycerol kinase activity; Cellular component=integral to membrane of membrane fraction; Biological process=protein kinase C activation
  Homolog annotation: Hit_ID=Q6USK2; Match level="QueryCoverage=88%, HitCoverage=34%, E-value=9e-50, Identity=49%"; Hit description =Ceramide kinase
MEREGNDCVVGDTSLTASPFDGEASILSSTLLLDHVGEVTLTFHSDRLSWKLVEPLDNNSLNNPVYRIHRTMCQDVSTCLGIKYFSKVATGIKLSDIYAFELNDHGSIHISSLPPATECLLLGQDIKMYSFTVHGFIRNKNQPSQCILVEYTFGHKNLPTCQMWVNQLNASLKHEVGRPKNLLVFVHPRSGKGNGCRTWEAVAPIFSRAKVETKVIVTERAGEAFDVMSSLTNVELNSYDGVVAVNWTGNS

SEQ ID NO: 177342 - protein, 157 aa, Glycine max
  Coding DNA Sequence Number=SeqID_60564
  Gene Ontology: Mol. function=diacylglycerol kinase activity; Biological process=protein kinase C activation
  Homolog annotation: Hit_ID=Q6USK2; Match level="QueryCoverage=99%, HitCoverage=25%, E-value=4e-37, Identity=50%"; Hit description =Ceramide kinase
GGDGFFNEILNGFLSPRFKAPYPPTPSDFVHLVKDNDDSLVLDEDEIVDETSSRNEDQFPLISSPKQSGSRISNSNSEDKAAEFPLPNEWFRFGIIPAGSTDAIVICTTGTRDPITSALHIVLGKRVHLDIAQVVRWKRTPKSEVEPHVRYAASFSG

SEQ ID NO: 177343 - protein, 174 aa, Glycine max
  Coding DNA Sequence Number=SeqID_60565
  Gene Ontology: Mol. function=diacylglycerol kinase activity; Biological process=protein kinase C activation
  Homolog annotation: Hit_ID=Q6USK2; Match level="QueryCoverage=99%, HitCoverage=30%, E-value=1e-48, Identity=53%"; Hit description =Ceramide kinase
SYEAEITYLDVESDETNLTSRRDHEGNLLQAIRSPQKSERCICRINCKVCNEKPNHASVGVCSLTPHLNSEETRWARSKGRFLSVGAAVISCRNEKAPDGLVADAHLHLTQLTRRGGSPLNFKFVEHHKTPAFTFTSSGNESVWNVDGEIFQAHQLSAQVFRGLVCMFASGPEV

SEQ ID NO: 177344 - protein, 462 aa, Glycine max
  Coding DNA Sequence Number=SeqID_60566
  Gene Ontology: Mol. function=protein serine/threonine kinase activity; Cellular component=ubiquitin ligase complex; Biological process=protein amino acid phosphorylation
  Homolog annotation: Hit_ID=UPI000034F113; Match level="QueryCoverage =99%, HitCoverage=53%, E-value=7e-62, Identity=37%"; Hit description =ATP binding / kinase/ protein kinase/ protein serine/threonine kinase/ ...
  Homolog annotation: Hit description=protein-tyrosine kinase/ ubiquitin-protein ligase
MCEQRKVHVDVIVIESDDVATAIADEVAKGAITKLVVGASSRGLFKSKQKGMSTRISVSTPRFCTIYAISKGKLSIRPSDMPIDGNIIDDASESETSLSTSSSSNYTSTSQTESASVSSYAALQSSSLTTQRFQALSSINSALLSTNPSFADTNHSRGQSLDLGRENTASSSARNSDIDHALSRVSSCKSFISDTESWMYDQNSCKDVQLATTLPSPNRQAKYNLELEKLRIELRHAQGLHAVAQTEKIEASRKLNDLSKRRSEETMRMKEIISKEEKAKELAKLEREKYQDASREAEYLKECAEREAAEKKEMELRAIRAAKEKEKLEDALSGSTPQYRKFTWDEIILATSSFSEDLKIGMGAYGVVYKCNLYHTTVAVKVLTLNTNVNSKRKQFQQECSWIISVQEVESLITMSITLELNQTTGLIYIFSFIPVRDFEQNSSSKLASSSWCMSGSWMPCV

SEQ ID NO: 177345 - protein, 87 aa, Glycine max
  Coding DNA Sequence Number=SeqID_60567
  Gene Ontology: Mol. function=protein binding
MSVVQKPISNPNVVSTLLANPSLSVVCEAGAPGFGGSPGNAAIVDEEQVVGVSVGGGVDLNEFNGGNEKRISGEVVEAVIEGGGRGG

SEQ ID NO: 177346 - protein, 70 aa, Glycine max
  Coding DNA Sequence Number=SeqID_60568
MDKILEADANNMSQHSSSSVVALAIKGNKKSKYVVQWALNKFVPEGMIIFKLIHVHGGGGYELAEDYSLG

SEQ ID NO: 177347 - protein, 88 aa, Glycine max
  Coding DNA Sequence Number=SeqID_60569
MGSEIYLEGHENPSAFFSSSSLILLEPLAHGSNEEKVYQKDTSSEEDPSMYEEDSFMKEDSSMDEEDPMMALEKMEEDSSQDFSKGDC

SEQ ID NO: 177348 - protein, 165 aa, Glycine max
  Coding DNA Sequence Number=SeqID_60570
  Homolog annotation: Hit_ID=Q5UDR1; Match level="QueryCoverage=45%, HitCoverage=11%, E-value=5e-17, Identity=53%"; Hit description =Transposase
  Pfam annotation: Domain name=hATC; Domain location=1-76; Score=83.6; E_value=6e-22; Accession=PF05699.5; Description=hAT family dimerisation domain
MEESLETKALDILHWWRLKFGQFLVLANIARDVLAIPVTIVTSNSTFSTGGRVLDPYCNSLTPKIVETLICTQDWLKEAPLLMLTNKEFEKFKEESKNEFKIESRTLQGSKGNLISRIKNQDSRFKFQDSSSKNQDQDSRLKIQESREDSIKISIKKFFQKLSST

SEQ ID NO: 177349 - protein, 55 aa, Glycine max
  Coding DNA Sequence Number=SeqID_60571
MGALIGQLEKEKVIHIFHSRCGPRGVVQGDGIKIVRCRHAHGRSLEHGVVCVEED

SEQ ID NO: 177350 - protein, 297 aa, Glycine max
  Coding DNA Sequence Number=SeqID_60572
MASPMTCGGGTRGYLMVIRTFCQPEASEPVDTQRLTSSSAPFVNQRQASPLTRKDLRHLLHLVSSRDGKSDDMQGYLMVICTFLLILTREVRWQAEIPKWLSASEHVDTQRLTSSFAPFVNQRQGYLMVIRTFLLILTSEVRWQAEIPEWLSVQRQLLLILTREVKWHARGYLMVICTFLLILTREVRWQAEIPKWLSVQRQLPLILTREASEPVDTQRLTSSFAPFVNQRQGYLMVIRTFLLILTREVRWQAERPEWLSVQRQLLLILTREVKWHAGAGKPIDTQRLTSSSAPFVI

SEQ ID NO: 177351 - protein, 193 aa, Glycine max
  Coding DNA Sequence Number=SeqID_60573
  Pfam annotation: Domain name=Bclx_interact; Domain location=13-52; Score=14.0; E_value=0.066; Accession=PF08945.1; Description=Bcl-x interacting
MAKFDPEIVIEFYANAWPTEEEVRDMRSWEAIAQLLCIPGQDFARTATGRRVRIMRTSMTTLTQIWMMLLLSNVLPSDHNYNLPLPKCQRPLDPEKSNRALGFPALITGLCQFYRVFVAPCKPAGAKLHSLCMPYPEQFRAEVAWPGDWPTEDGAGLVGSHGDAEEAHMDEDMTDLLDCLGGSRATRSRSPDL

SEQ ID NO: 177352 - protein, 77 aa, Glycine max
  Coding DNA Sequence Number=SeqID_60574
MSSFTFQSVTTYLLAGGRHEGSSMRLPREEGARSCHQRLFEENIRKTRKVWSMNINRERCFPCSYVFLNCDEEIRPM

SEQ ID NO: 177353 - protein, 243 aa, Glycine max
  Coding DNA Sequence Number=SeqID_60575
  Gene Ontology: Mol. function=hydrolase activity; Cellular component =mitochondrial outer membrane; Biological process=aromatic compound metabolic process
  Homolog annotation: Hit_ID=Q9LYG5; Match level="QueryCoverage=98%, HitCoverage=56%, E-value=1e-105, Identity=79%"; Hit description =Lysophospholipase-like protein
  Pfam annotation: Domain name=Abhydrolase_1; Domain location=1-234; Score=22.9; E_value=0.00013; Accession=PF00561.10; Description =alphabeta hydrolase fold
MDWIGHGGSDGLHGYVPSLDHVVADTGAFLEKIRSENPGIPCFLFGHSTGGAVVLKAASHPHIEVMVEGIILTSPALRVKPAHPIVGSLAMLGTLGLLKLAVKTCCKAVAPIFSLVAPRFQFKGANKRGIPVSRDPAALLAKYSDPLVYTGPIRVRTGHEILRISSYLMRNFNSVTVPFFVLHGTADKVTDPLASQDLYDKAASKFKDIKLYDGFLHDLLFEPEREEIAQDIINWMEKRLFTI

SEQ ID NO: 177354 - protein, 180 aa, Glycine max
  Coding DNA Sequence Number=SeqID_60576
  Gene Ontology: Cellular component=vacuole; Biological process =response to biotic stimulus
  Homolog annotation: Hit_ID=Q8H937; Match level="QueryCoverage=82%, HitCoverage=85%, E-value=6e-13, Identity=29%"; Hit description =Lachrymatory factor synthase
MEEESKSKWEGKAMVEVVGTGAEVAWAVLEDFCNIHKWISLDTCYQVDGILGQPGLIRYCASTVEEGVGAEKTTTIKWAKEKILAIDPVQRCLTYEVVENNMGFKSYVATLKVLPIEGDGCKIEWGFVSDPVEGWSCQGLKSYVESTLQSMAKKIEFALIRLHQSFKTLDLVIDLASVSG

SEQ ID NO: 177355 - protein, 80 aa, Glycine max
  Coding DNA Sequence Number=SeqID_60577
MGSSQAPLLKKRFYQVKIKSLGVTSLKELGQLMGQVQRQPFRKAYGKIWDLAMEEVSTEAVASLTQYYDQPLRCLTYGDF

SEQ ID NO: 177356 - protein, 52 aa, Glycine max
  Coding DNA Sequence Number=SeqID_60578
MKPRADMHFPLPQHVADITCMDPNRPPLVAEKVFKTVRFIGFFIQNGVSKSK

SEQ ID NO: 177357 - protein, 56 aa, Glycine max
  Coding DNA Sequence Number=SeqID_60579
  Subcellular localization annotation: CTP_CleavageSite=47; ConfidenceScore=5.10e-01
MGAALLVLRNHSKLVRKIAFVKKIQDEALPRRFPKRFCGNSSSFFVRSSSFFGLQP

SEQ ID NO: 177358 - protein, 395 aa, Glycine max
  Coding DNA Sequence Number=SeqID_60580
  Homolog annotation: Hit_ID=Q1WK55; Match level="QueryCoverage=18%, HitCoverage=19%, E-value=3e-24, Identity=79%"; Hit description=CYC5
  Pfam annotation: Domain name=TCP; Domain location=137-358; Score =136.4; E_value=8e-38; Accession=PF03634.4; Description=TCP family transcription factor
MRGSIRDVMSDVMRGSIRDGRGGRKKENTFPSHNGNDPISCYDPAFYYYNSRPFSPIDSESNPTSKQDNNNNCDLVPSPTPLSFFHFPSSPFEDTQNQILLEQHHDFLLQFHHQSLPKDPVPQPAVITTMDPFVKKSDQIQRKRPGKRDRHSKINTARGLRDRRMRLSLEVAKRFFGLQDMLNFDKASKTVEWLLNQAKVEINRLVKEKKKNDHHHQSCSSASSECEEGVSSLDEVVVSRDQEQQQQQQQEKVEKVVKRRVKNSRKISAFDPLAKECRERARERARERTREKMRSRGVLAEESKQCGEETNQDLIQLGSSNPFETGDQESGAKTSHSVDVHPSSLDVIATEAKEQSYRAVKEHNDDDDDSLVVLSKWSPSLIFNNSGFSQDVSFY

SEQ ID NO: 177359 - protein, 239 aa, Glycine max
  Coding DNA Sequence Number=SeqID_60581
  Homolog annotation: Hit_ID=Q47522; Match level="QueryCoverage=24%, HitCoverage=77%, E-value=3e-19, Identity=74%"; Hit description=LacZ protein
VPPVQLLTGWCVTAKAPPDISAGKCSGHAARRVPFAIQAAQLLGRAIGAGLFAITPAGERGMCCKAIKLGNARVFPEFDHNFSIEPIVKDYLVLKNALVADNDKAAAIAGKQLFATLNKVDMKTIPANKHKEFMDIFENAKENAEHIGDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 177360 - protein, 156 aa, Glycine max
  Coding DNA Sequence Number=SeqID_60582
  Gene Ontology: Cellular component=endoplasmic reticulum
  Homolog annotation: Hit_ID=Q6PW25; Match level="QueryCoverage=98%, HitCoverage=53%, E-value=6e-28, Identity=44%"; Hit description =Putative Der1-like family protein
MGISLVFMLVYVWSREFPNARINIYGVVSLKGFYLPWALLALDLIFGDPIKPDIVVLHPLAGGKFRFKTPLWVYLFFTSHKIVAYWGEGTQINAPVQSNPSAGIVFKGRSHRLGGTQTTTRRTAEQTEGNDSASCPQPQNQGDGIAFRGKSYRLDG

SEQ ID NO: 177361 - protein, 107 aa, Glycine max
  Coding DNA Sequence Number=SeqID_60583
  Gene Ontology: Mol. function=protein binding; Cellular component =endoplasmic reticulum; Biological process=retrograde protein transport, ER to cytosol
  Homolog annotation: Hit_ID=Q06397; Match level="QueryCoverage=100%, HitCoverage=44%, E-value=1e-25, Identity=52%"; Hit description =Derlin-1
  Pfam annotation: Domain name=DER1; Domain location=11-107; Score= -7.4; E_value=1.5e-06; Accession=PF04511.5; Description=Der1-like family
MSTPAEYYRSLPPVSKAYGVACLMTTAAFYLQFYDAWNIALDYGSVFKRLQVWRLITNFFFLGPFSFPFAIRLIIIAKYGVSLERGPFDNRTADYVWMFIFGALSLL

SEQ ID NO: 177362 - protein, 154 aa, Glycine max
  Coding DNA Sequence Number=SeqID_60584
  Gene Ontology: Mol. function=methyltransferase activity; Biological process=metabolic process
  Homolog annotation: Hit_ID=Q1SW53; Match level="QueryCoverage=85%, HitCoverage=31%, E-value=7e-17, Identity=37%"; Hit description=SAM (And some other nucleotide) binding motif
DPAVVTDRGGREVGAAPRPRRRRRHRLLCRLDEAPQRDRGDHDHERGGAEQRGRRTAGASAAARAPAAAAAAVRRRRGSGAVRARREPVDSFDGDGVSAAGCGQGAEGRRVYAPLIGKLGYKKVKWATGNKTDASGVKNGEVYLTALLQKPVSR

SEQ ID NO: 177363 - protein, 129 aa, Glycine max
  Coding DNA Sequence Number=SeqID_60585
MEYSQFKWLVDIFKAKIVEISQHSVTIEGDVYPIEPPDGFTVNHVLDAHWGVLNEQDVNVEGTSTYVIVTENKRGYVSCGSVQVEGTSTWLFKENKGGCIPSRSLLVKVFTRLKEISRTGSCLGTGCRH

SEQ ID NO: 177364 - protein, 51 aa, Glycine max
  Coding DNA Sequence Number=SeqID_60586
MSCTSSLSALLHLSKCTALVHPLSEKGALSQKSLTCDLQRLELEAGSGLRA

SEQ ID NO: 177365 - protein, 95 aa, Glycine max
  Coding DNA Sequence Number=SeqID_60587
MGRFLPPRGFLRKISERTPITKFTPSFHTLQKNEDIVAFEACNDLRHCRLRNVDKDIVAFEGMQLLKILSSSKCRRGHCRLSRYAMTEDIVVFEM

SEQ ID NO: 177366 - protein, 171 aa, Glycine max
  Coding DNA Sequence Number=SeqID_60588
MNEYPKNSNVIVRDQIKLDYLERNSYVTTTIGCISFEIVKEAKLHDESRLIQRCFDDNKDDDKGDDKNLKGQSKNEFKMFKIESRTLQDSRGKLKNTSRFKRKVDFKNQESRFKDQAFKNQDQDSRLMIQESREGLIKISMKMFFQKLSSTRIFLKTCLPKSFYSLLIDYQ

SEQ ID NO: 177367 - protein, 115 aa, Glycine max
  Coding DNA Sequence Number=SeqID_60589
MHWMSTIILGSFRNNWETYFNEVRPLEAERFKALCIQWAQYYLKVKLNNLYLRLFGVVSELSSQFSHLSQRVRSSVAILPRKGPVTRAMSKRLQEDWARAAEEGPRVLMNLRVDF

SEQ ID NO: 177368 - protein, 260 aa, Glycine max
  Coding DNA Sequence Number=SeqID_60590
  Pfam annotation: Domain name=Transposase_23; Domain location=137-207; Score=1.9; E_value=0.00071; Accession=PF03017.5; Description =TNP1ENSPM transposase
MKKKLEEVAQSGSVDRAIDPPSPVRRHVKWKMARTKKTREMTTEAAKEIAAKIDSFEEQDVLTAAIGRPEHPGRPEHPGRVRAAGAVADPANQGLARGVHHRKSDATSHGILQLDAVPNTISGTCTASRASGNDPETGDSDRCGLYIEADPARLVALGRVYEGSTVVHNTHLLPNQVKVGVEEVTDADAPVPVPTDEVSLVGQTLHTFHAWPTHLVAVSPAKPPPKPNPEVDDPLYLMTLTIPKLFLRPYQVTWDAIVFG

SEQ ID NO: 177369 - protein, 123 aa, Glycine max
  Coding DNA Sequence Number=SeqID_60591
  Subcellular localization annotation: CTP_CleavageSite=29; ConfidenceScore=5.27e-01
MGPVPIFSVGVSKNYANNQGLCGGKTLAPCQTKSSKSNLAVIAGAAAGGVTLVALGLCIGLFFFVRHVSFKKKEEDPEGNKWARSLKGTKQIKASYIGALHRTYMITQLFIFLVDPFVSCSNR

SEQ ID NO: 177370 - protein, 148 aa, Glycine max
  Coding DNA Sequence Number=SeqID_60592
  Gene Ontology: Mol. function=polygalacturonase activity; Cellular component=cellulose and pectin-containing cell wall; Biological process=carbohydrate metabolic process
  Homolog annotation: Hit_ID=Q2KMJ7; Match level="QueryCoverage=95%, HitCoverage=36%, E-value=1e-31, Identity=52%"; Hit description=PGN
  Pfam annotation: Domain name=Glyco_hydro_28; Domain location=1-144; Score=-129.4; E_value=0.01; Accession=PF00295.8; Description =Glycosyl hydrolases family 28
MNELISIGSLGKKFDTVQEVYVRNCSFIRTTNGARIKTFPNGMGYAKQITFEDITLEQTRNPIIIDQEYRDLTNQAVEVSDVTYRGIHGTSLDGRAITLDCGESGCYGIVLDQINIVSCLTGKSASCFCNNAHGTATATNPNCTCLLP

SEQ ID NO: 177371 - protein, 149 aa, Glycine max
  Coding DNA Sequence Number=SeqID_60593
MCLRLHWLSRLLLLPLLLQLLLLLLLHLLQWLLLSVDVVTTGAPAVPPPSSSTQVALPAVGLAVGWVKNAIDSAKAEKIGLGGKVESMAEEKDEPPKRIIDLEARLRESESILEESELRATKEREANTELEEELLLYKKEVMEQHEKGF

SEQ ID NO: 177372 - protein, 495 aa, Glycine max
  Coding DNA Sequence Number=SeqID_60594
  Gene Ontology: Mol. function=nucleic acid binding; Cellular component= chromatin; Biological process=DNA integration
  Homolog annotation: Hit_ID=Q1SB62; Match level="QueryCoverage=53%, HitCoverage=24%, E-value=9e-55, Identity=41%"; Hit description =Integrase, catalytic region; Zinc finger, CCHC-type; Peptidase aspartic, catalytic
  Pfam annotation: Domain name=rve; Domain location=184-354; Score =79.5; E_value=1.1e-20; Accession=PF00665.16; Description=Integrase core domain
MLMENLLRSKEFWQVVVGGVATPSDDVALTETQQKEYEVMKLKDLKAKNYLFQAIDRSILETILCKDTSKDIWDSMKKKYQGSSRVKQPWVLLTTCDFMCMNKRSTMEEHALKASTNIHSNNSRGRGRGRGRGRGRGDRGNRDFNNNTKDNNDQSQGNGRGRDHDKSKEKEVETLLMDVEDAKDSEAEIWHVDTDCSNHMSGKTISNVLYVPDLKSNLLSAGQLQEKGYEIFISKGKYEALSSFKSFKARVEIESEKTIKSLRTNRGGEYCSDEFSTFCVNHGIWKELTTTYTPQQNGVSERKNRTILNMVRCLLTKSGISKEFWPKADNWSVHILNRSPTFALKNMTPEEAWSERKPTVDHFRIFGCIAYAHIPDKKRSKLDDKDNEDEELQTRELEEQQIPTITIEDERPQRARRRPAWMFDYGVTEIENPITHFALFLDCDPTTFESVVKEEKWRKMMDDEIDFIERNDTWELCDLPNGHNTIGVKWVFKTN

SEQ ID NO: 177373 - protein, 181 aa, Glycine max
  Coding DNA Sequence Number=SeqID_60595
MSSLLLARPAESGDVERVANASGDIGCRSGSRHWKWRDCTNQLVWARRCVRWQSLLNGGATMCDGGLGNLPESSETVMELVPRQRDGGGPHVRQRDGAGAHARRPKGDEFVKPPSVDEYCLVSGVATLTSVGVAGCLCQVVRDERVFDVSSKVTVHCLLASLLALALSGFQFPFLLPPTSK

SEQ ID NO: 177374 - protein, 53 aa, Glycine max
  Coding DNA Sequence Number=SeqID_60596
MAKFGTSSSVGMLATVGDGDGVDVGGDGVGATSEDLTSIDTVDEDGVDDGRLS

SEQ ID NO: 177375 - protein, 113 aa, Glycine max
  Coding DNA Sequence Number=SeqID_60597
  Subcellular localization annotation: CTP_CleavageSite=21; ConfidenceScore=5.12e-01
MGAGNPAMQNHLHQDPKNKPRGSNPDTSLRWLSNPSNNTTYKLHSTIILRRTHPEKTLKRKPKEQKTQFNTSHKPSQPCKRNPMKLSGNSALPKKNTQPLSKQQKMKSSKNCI

SEQ ID NO: 177376 - protein, 421 aa, Glycine max
  Coding DNA Sequence Number=SeqID_60598
  Homolog annotation: Hit_ID=Q8ZK48; Match level="QueryCoverage=45%, HitCoverage=70%, E-value=4e-53, Identity=56%"; Hit description =Putative cytoplasmic protein
  Pfam annotation: Domain name=AP_endonuc_2; Domain location=251-421; Score=57.9; E_value=3.4e-14; Accession=PF01261.14; Description=AP endonuclease family 2
GAGENPGGGGRRVGTGGDRRDHRRASPARQRSLRDLRTPWLRKVFLLGIGIAAIQQLTGVNTIMYYAPTMLTATGLSNDAALFATIANGVISVIMTLVGIVIIGKVGRRPLVLIGQMGCTACLFFIATVCLLMPEYHAGGRAVTGHLVAAVGNLPGAHARHLHGRCRFRLVDCQLRHFHGLPAVAGRLWPGWRFPDFRCDRDRRRPVCTARYPGNQRAQPGTGKIMTYKISSDRFCVNRKIAPHLSMAEFFALVEQLGLNKVEIRNDMKSGSVTDGAGGEEVRRLAAQHQLEIETINAVYPFNQLDDAVLEKTRALLADARATGAKALVLCPLNDGTPVSNEQTVQALQTLAPLFAEYGVAGLVEPLGFPQSSLRSAALAQQLIAQAGVPFNIVLDTFHHHLYEGAEQDFAGGVDVNHIGL

SEQ ID NO: 177377 - protein, 118 aa, Glycine max
  Coding DNA Sequence Number=SeqID_60599
MILTHSPSNLDLIKEVTVCDVSSIGACRPRIFFINGFLCFLEDKWQRNGEGRERRRHFKEKMSLEEAHHHRRPWIRVWRKKEMNEGRGREEHEILCSKRALKSEVNIQMIKVEKNAHA

SEQ ID NO: 177378 - protein, 103 aa, Glycine max
  Coding DNA Sequence Number=SeqID_60600
MGPKSTLRLMRTLGSSLASLAQSSWSLLSNALGGIRLSKYIIFHHTSTIDPGKDEQHNEELNSAFHWIMILIDPTSQNFLCRWREAKRSKEKRPLSTVIENNR

SEQ ID NO: 177379 - protein, 54 aa, Glycine max
  Coding DNA Sequence Number=SeqID_60601
MTTGYPPQQKTSQGNEKKKEDENITHGNPPQEERSLRIEIEEALKNITEGDPPK

SEQ ID NO: 177380 - protein, 143 aa, Glycine max
  Coding DNA Sequence Number=SeqID_60602
MTGRKWEQPPTEEVNGGRTPEQEQPPMEDRKRNKQQPSNTRRGRRTRANRVNGILDFSPWVLGAQSNTPDISGPYPPVKGLDIGVPDSGGKCLKACKLADKLPPLDLGALVSVVLSCLDCVECGEFLVGLRCWTSVVSWLGRW

SEQ ID NO: 177381 - protein, 390 aa, Glycine max
  Coding DNA Sequence Number=SeqID_60603
  Homolog annotation: Hit_ID=Q5XM22; Match level="QueryCoverage=22%, HitCoverage=48%, E-value=4e-19, Identity=59%"; Hit description =Resistance-like protein HAAS-2
MMHPNGEGLLHQHIDSDNNKLLSRTLLRLRRNWSTTSQKHLLKKERPELKLSFHRRKMAKFGRPAPEIEGLVVANGLSPLIVTITLGDIVSLLHLHVVGAFHNFKQLHVDDTIKMVELLEIKIEACDWIVAARAYLLHLPGCTLFANKSATHVHVVFLDALRDLTQSVGYTWGAATLVHMYDNLNDVSKSTTRQLTGYITLLQHFSSISCAVFAEDYDERRLSSCRWTFGKALPTILPHPVVSSLSVVEIDDRWMQFGDYIALVGKLCVVSGHFSPDYLDWLYMISHPFMSPAQSGNPPRVPPVQQDEEFVEPDMYQQLMAAAVPNEADIDQHHLRHVVDDFAAIADKLDKLLNRRILIERTEAYTVVEECVGIARHYIGQPTVAHRSRR

SEQ ID NO: 177382 - protein, 64 aa, Glycine max
  Coding DNA Sequence Number=SeqID_60604
MASVKIAFAVVLLVLISSNGHGFKSDTVEPPCEGNHECNIYFPNCEGEAICDNGICECPHSKES

SEQ ID NO: 177383 - protein, 129 aa, Glycine max
  Coding DNA Sequence Number=SeqID_60605
MGSYCGLCSTREGGTTIQVSADYMDWFFQISHPFVTPTQAGDQPRHPPAPHDEEYVEPHIPEVPVASNLPRDSVMLVKVVKQSQKGWSVCSTLGWSLKAQSYTRSCKIASGSLGVTPQMEVLGCDVDVA

SEQ ID NO: 177384 - protein, 58 aa, Glycine max
  Coding DNA Sequence Number=SeqID_60606
  Subcellular localization annotation: CTP_CleavageSite=29; ConfidenceScore=5.22e-01
MSFPVFLTFSSSKRWWRLRAYSFLGRRTRESRVALPPKGFTFIIQKHSSPATQKILLC

SEQ ID NO: 177385 - protein, 225 aa, Glycine max
  Coding DNA Sequence Number=SeqID_60607
  Gene Ontology: Cellular component=mitochondrion
  Homolog annotation: Hit_ID=Q8TGM6; Match level="QueryCoverage=53%, HitCoverage=97%, E-value=5e-09, Identity=42%"; Hit description =Protein TAR1
  Subcellular localization annotation: CTP_CleavageSite=79; ConfidenceScore=5.43e-01
MTSPRAYQQPGLGPPSQSASVNVPSRSADRLSPFHIRPGHIAGPHPLPSRQFQALFDSLFKVLFIFPSRYLFAIGLSPVFTLGRNLPPDWGCIPKQPDSPTAPRGATGSGHDGALTLSGAPFQGTWARSATEDASPDYNSDAEGDRFSWWAFPGRRALGLMASGATCVQRLDGSRDSAIHTKYRISLRSSSMQEPRYPLPRVIVCKCCVVTTPAGHRLRAPGSRT

SEQ ID NO: 177386 - protein, 145 aa, Glycine max
  Coding DNA Sequence Number=SeqID_60608
MLLRGVYADLPRAPASWLVEIWVHGRLRRDKMVDEPRSRPITCEPVSSGPIDDPLRARTLPTRPQGAPERVRAPSCPDPVAPRGAVGESGCLGMQPQSGGKFRPRGSGWGPAMCPGRMWNGESRSADRLGTLTDADCDGGPSPGC

SEQ ID NO: 177387 - protein, 101 aa, Glycine max
  Coding DNA Sequence Number=SeqID_60609
  Subcellular localization annotation: CTP_CleavageSite=26; ConfidenceScore=5.79e-01
MGSPPASTPPPPPPPPPPPTSDASASTSAVKRTRKASRLRSLSTRPPGVERPVVHVDPATGKADDPHKKKLRTYLGIVARDKVDITYENWKEVPTAQKDLI

SEQ ID NO: 177388 - protein, 67 aa, Glycine max
  Coding DNA Sequence Number=SeqID_60610
DILLIGKQFLGALNFCRGYPDLVKSAGHTKRKTGSLEIVNLENSTKFVKPIQIVARALADFPFPAKG

SEQ ID NO: 177389 - protein, 121 aa, Glycine max
  Coding DNA Sequence Number=SeqID_60611
  Subcellular localization annotation: CTP_CleavageSite=45; ConfidenceScore=5.23e-01
WPGTQPPPHRDDANPAAQVPHQPSNESSESSTPKPLIRKRRVVVTQEAVATPEKSPEATPEPPTPMADTTSPQQAANPSTPEVQTTPVLSLNTSPVATPVLHLIDDEEVQTQDTQDQSQDF

SEQ ID NO: 177390 - protein, 104 aa, Glycine max
  Coding DNA Sequence Number=SeqID_60612
MGPKSTLRPMRNPRAFSCISGPIFLESSIQCPWGGFTCPPALSGSSLNHAILGKRYALVWHCIAEDDLNNLIGTTNINKMHLPFGSPSIKNFIVKCSWLGVVIG

SEQ ID NO: 177391 - protein, 113 aa, Glycine max
  Coding DNA Sequence Number=SeqID_60613
MKFYNIPIVERKHCCAIHKVPQGSGSQKGHCCVIRKGEKGRAKMFSPSGIWDSLKISEENCFHGKNPSRGASVTLPRRFREQFREDSSPLFVVLRSSIGKFSKSNLSIHSMHP

SEQ ID NO: 177392 - protein, 114 aa, Glycine max
  Coding DNA Sequence Number=SeqID_60614
MEPFNQSIEIPRLMHGAPHCPSVGLLGINLVFCHDLVAGNLLVSPHQLDLAPYALRSYSAQWNASGLLHDKHTLRSSRILGEMEVEEPWLGLFHCKIPSFVGVLVRAKGGVRDW

SEQ ID NO: 177393 - protein, 230 aa, Glycine max
  Coding DNA Sequence Number=SeqID_60615
  Gene Ontology: Mol. function=chitin binding; Cellular component =extracellular region; Biological process=chitin metabolic process
  Homolog annotation: Hit_ID=UPI000044A8F0; Match level="QueryCoverage =75%, HitCoverage=99%, E-value=1e-28, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
ELHVLTFRGLKAVAFRGLHALAIKGLHALAFRGLHVLAIRGLHVLIFRGLHVLTFRGLHVLAFRGLHALAFRGLHVLAIRGLHALTFRGLHILTFEGLHVLAFRGLHVLAFRGLHALTFRGLHILSFRGLHTLAFKGLHVLTFRGLHALAFRGLHALAFIGRHVLDFRGLHALTFRGLCVLTFIVSLYQFLGHPTDLGGGSTVQAQPEREAIVQLLCILGQDFVLTVVGR

SEQ ID NO: 177394 - protein, 86 aa, Glycine max
  Coding DNA Sequence Number=SeqID_60616
MASSSLQAKHVSEHIWNGEEDRKLLIIQVVHMYQGFRVDGSPLIGPTNLDWVDLCEKLLGVRPQEGELQGSVVKLSWLAHHFFTIK

SEQ ID NO: 177395 - protein, 108 aa, Glycine max
  Coding DNA Sequence Number=SeqID_60617
  Subcellular localization annotation: CTP_CleavageSite=53; ConfidenceScore=5.63e-01
MPLGGRIASSSLSICRSCLLLKNRLVSRPCNSGSKLLGSRPRVRARFLEMLVQCVMPNGACMCASGAPSSTSGLRWTPRMVADVEMVVVHLLLADVADLALAAVASLA

SEQ ID NO: 177396 - protein, 61 aa, Glycine max
  Coding DNA Sequence Number=SeqID_60618
MTGHFKLQPNLVRLGTSFYWSSIDDRVSAAVVASVGQFAVVGAQAEGEIRNNRVLARGGMK

SEQ ID NO: 177397 - protein, 79 aa, Glycine max
  Coding DNA Sequence Number=SeqID_60619
MGRLREIFLQPPQRAIFQTNTQAPSPVEISKSTASSKLKKVVHDPPPKRYARRVSLYYRNNAAKPWKEKEKEKDEDGKT

SEQ ID NO: 177398 - protein, 423 aa, Glycine max
  Coding DNA Sequence Number=SeqID_60620
  Gene Ontology: Mol. function=nucleic acid binding; Cellular component= chromatin; Biological process=DNA integration
  Homolog annotation: Hit_ID=Q1T010; Match level="QueryCoverage=88%, HitCoverage=31%, E-value=1e-116, Identity=50%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MVEKPTKVVIEAPIDEPSDSSAVVIDDSDQGGDYELIHDSTIGEEGELVQLALFSESELVSLEEAMNDTKWIDAMKEELKAIEKNNTWQLVPLPAKKKPIAVKWVYKVKKNPKGEISKYKVRLVAKGFLQKASTNFNEVFAPVARMETMRIITAIASQKGWYMHHMDVKSAFLNGLLEEVYVSQPPGFEIKGSEEKVYKLNKALYDLKQAPRAWNRRIDGFLMKLGFLKCTTEPWYDLLVTGNNETEIANFKGEMMREFEITDLDLISYFLGIEFKRTDEGLIMHQGRYARDVKKFKMVDCNFVDTPTTTGVNLVKDPNEKEVDVTLYRQMVGSLRYMENPKLSHFCAAKRIMRYVKGTLDYGILGYSDSDWCGDKSDRKSTTGYVFFYGDASILWSSKKEQVVALSSCEAEYIAAAMAACQA

SEQ ID NO: 177399 - protein, 620 aa, Glycine max
  Coding DNA Sequence Number=SeqID_60621
  Gene Ontology: Mol. function=cellulose synthase (UDP-forming) activity; Cellular component=membrane; Biological process=cellulose biosynthetic process
  Homolog annotation: Hit_ID=Q45KQ0; Match level="QueryCoverage=99%, HitCoverage=82%, E-value=0.0, Identity=59%"; Hit description =Cellulose synthase-like protein CslE
  Pfam annotation: Domain name=Cellulose_synt; Domain location=1-619; Score=58.1; E_value=2.9e-14; Accession=PF03552.5; Description =Cellulose synthase
MTINTVLSAMAYNYPANKLSVYLSDDGGSELTFYALLKASIFSKHWLPFCRRFNVEPMSPEAFFAAPNSSNNSTEYGQAWLSIKKLYEDMKNEIESAVARGRVPDNVRNQHKGFSEWNPKTTKQDHQPIVKIIIDGRDTNAVDEDRFQLPRVVYMAREKRPNYPHHFKAGAVNALIRVSSEISNAPFILNLDCDMYPNTANTIQEILCFFLDETKGHDIAYVQFPQSYNNITKNDHYANSYLVSSKFELAGICGYGAALFCGTGCLHRRESLSGAYLKDYKAKWDSKPKRNDNRTIDELNEASKVLATCTYEESTQWGKEKGLVYGIPVEDIATGLVISCRGWKSIYYNPERKAFMGIAPTTLDVACLQHMRWSEGMFQVFFSRYCPFIYGHGKIHFGVQMGYCTYLLWAPMSLPTLCYVIVSPICLLHGIPLFPQLSSIWVLPFAYAFLATYGFSLCEYLICGSTAKGWWNLQRIKFIHRTTSYLFGFIDTMKKQLGLSQTNFVITNKVVTEDVQKRYEQEIIEFGGSSIMLTMLATVALLNLVGLVGGIKRIMMDLNLEFSSSQLMMQITLSSLVVMISLPVYEALFIRSDKGCIPSSVMLKSIVLASLACCLAPFIC

SEQ ID NO: 177400 - protein, 118 aa, Glycine max
  Coding DNA Sequence Number=SeqID_60622
MKANKTRNELKVSNSNTYRLTTEERTKNGEKRRKIFTDLLMETSWKSYGSTSTWIFFTETREMGRCLPPRGFLRKISERTPITKFTPFSYFTEKLWKPYGSVLNLIFLFYLFPFTNIK

SEQ ID NO: 177401 - protein, 137 aa, Glycine max
  Coding DNA Sequence Number=SeqID_60623
MCHPTAYVCVYYNGQICNTNESTAFIRNNTKTFMVNKNNPILLFVELFAIICNNNDPLNNQRDGSTSNLEDLSHEYESFWVKNHGSCRNLPFGGRATRGSRVRLSRKEGTWSRHQRLFEENVRKTGTCGLRTLIVKG

SEQ ID NO: 177402 - protein, 51 aa, Glycine max
  Coding DNA Sequence Number=SeqID_60624
MQFPMGESKEVLFWEDHWIGEETLGRKYRRLYTISEQKQCSVIEVGGSDFE

SEQ ID NO: 177403 - protein, 109 aa, Glycine max
  Coding DNA Sequence Number=SeqID_60625
  Subcellular localization annotation: CTP_CleavageSite=19; ConfidenceScore=5.27e-01
MAIARSTPNTTNHPGKITSSSNSVSIFLLSSGNNGIIKGRCRSLDIVPRKRDCEGGGVDHHGHSMSAYKSGFWFNLLHPRSKRMKEKYYREDTKQLVRSMSIEIRETMA

SEQ ID NO: 177404 - protein, 514 aa, Glycine max
  Coding DNA Sequence Number=SeqID_60626
  Gene Ontology: Mol. function=nucleotide binding
  Homolog annotation: Hit_ID=Q67X84; Match level="QueryCoverage=88%, HitCoverage=84%, E-value=0.0, Identity=68%"; Hit description =Putative auxin-independent growth promoter
  Pfam annotation: Domain name=DUF246; Domain location=118-462; Score =685.0; E_value=5.7e-203; Accession=PF03138.5; Description=Plant protein family
MQKRKWIPLAVLRKLLIAAICSIAFVALFSVRVHIIPSSKDHRFNDKISTTQDPQSWTRELAPPHLSKAPLPTPKLSGSRGNFDYQKLWKTPSNHGFLPCTNPTPNYTTPAESRGYLLVHTNGGLNQMRSGICDMVAVARIINATLVIPELDKRSFWQDTSNFSDIFDEEHFMNSLANDVKIIKKLPKELVNATRVVKQFISWSGMDYYENEIASLWEDYQVIRASKSDSRLANNNLPPDIQKLRCRACYEALHFSPLIEQMGKLLVERMRSFGLYIALHLRYEKDMLAFSGCTHDLSLVEAEELRLIRENISYWKIKDIDPIEQRSKGLCSLTPKEVGIFLTALGYPSTTPIYIAAGEIYGGESHMAELHSRYPLLMSKEKLASIEELEPFSNHASQMAALDYIVSIESDVFIPSYSGNMAKAVEGHRRFLRRGRTVSPDKKALVHLFDKLDQGIITEGKKLSNRIIDLHRRRLGSPRKRKGPISGTKHMDRFRSEEAFYANPLPDCLCQTET

SEQ ID NO: 177405 - protein, 44 aa, Glycine max
  Coding DNA Sequence Number=SeqID_60627
MGVSFLSTCPSLLPLVAYDTPPSARYQPRSLQIMQVHGCCYVAL

SEQ ID NO: 177406 - protein, 264 aa, Glycine max
  Coding DNA Sequence Number=SeqID_60628
  Gene Ontology: Mol. function=L-ascorbate peroxidase activity; Cellular component=chloroplast; Biological process=hydrogen peroxide catabolic process
  Homolog annotation: Hit_ID=Q9THX6; Match level="QueryCoverage=100%, HitCoverage=71%, E-value=1e-105, Identity=73%"; Hit description =Putative L-ascorbate peroxidase, chloroplast precursor
  Pfam annotation: Domain name=peroxidase; Domain location=31-254; Score=44.7; E_value=8.7e-12; Accession=PF00141.13; Description =Peroxidase
ELIGSSGSLVEMANAADLIQRRQRSEFQSKIKETLFTAIKGNPDLIPSLLTLALNDALTYDKATKSGGPNGSIRFSSEIGRPENTGLSAALNLLEEAKKEIDSDSKGGSISYADLIHIAEVVEVCSNSPDFIDLIFVAQSAAKATFLAAAIRKCGGKEEKGKTLYNAYGSNGQWGLFDRQFGRADAQDPDPEGRVPLWEKASVQEMKDKFVAVGFGPRQLAVLSAFLGPDQNATETLLASDPDVAPWVQKYQRSRETVSQTDYE

SEQ ID NO: 177407 - protein, 157 aa, Glycine max
  Coding DNA Sequence Number=SeqID_60629
  Gene Ontology: Mol. function=protein serine/threonine kinase activity; Cellular component=membrane; Biological process=protein amino acid phosphorylation
  Homolog annotation: Hit_ID=Q1STT3; Match level="QueryCoverage=65%, HitCoverage=12%, E-value=8e-25, Identity=43%"; Hit description =Protein kinase; S-locus glycoprotein; Curculin-like (Mannose -binding) lectin; Apple-like
  Pfam annotation: Domain name=PAN_2; Domain location=15-83; Score =103.5; E_value=6.1e-28; Accession=PF08276.2; Description=PAN-like domain
MGWSHGCICNKELSCENKNKDKFNKLTLLKTPDTTHSWLDQTIGLEECKAKCLDNCSCMAYVNLDISGQGSGCAMWFGDLIDIRQFAIGGQDVYVQIDASKLERNHVAVSKFCLDNVLEKVNQNERLIDYLKINFVKTETLFPVYSFYLEVLALLFP

SEQ ID NO: 177408 - protein, 79 aa, Glycine max
  Coding DNA Sequence Number=SeqID_60630
MHKRGEKKRKPYEKVCVREKMKLQGLGGSRSTVQAQHEDALVALTVRWPWSLSLGTLEGNESENESKNRERQRIAGARY

SEQ ID NO: 177409 - protein, 212 aa, Glycine max
  Coding DNA Sequence Number=SeqID_60631
  Pfam annotation: Domain name=VQ; Domain location=71-101; Score=37.8; E_value=3.9e-08; Accession=PF05678.4; Description=VQ motif
  Subcellular localization annotation: CTP_CleavageSite=89; ConfidenceScore=5.34e-01
MDHKHCQTPLDSSSSFPTTTSTTNRDQYLKQLNKLSHNISKPNNIKKPTFFESSQSLTHNNTFNKQYALPSESQPQVYNISKNDFRDMVQKLTGSPGHTPQPKPVATSRLHRLRPPPLPQVVSHRPPPPNSGKVAVAPPSPLPPFPTVHAESPVSAYMRSFLRNSVPSSSSESEFQLPFSPVTFGCFNSLGGGSPIPLSPTVPVSSPRWRDL

SEQ ID NO: 177410 - protein, 132 aa, Glycine max
  Coding DNA Sequence Number=SeqID_60632
MVWRACANILLVGRFPRFRRHAIVDLICGWCGEVVETVTHALLTYPESRKVWFASPMVIQANITNRPKTPTGFVEAQYLSEVVEALTLCGALMMARDFCLFHAIFLLDQWQSKDARTRRYFMVVLEDCKNYS

SEQ ID NO: 177411 - protein, 900 aa, Glycine max
  Coding DNA Sequence Number=SeqID_60633
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=86%, HitCoverage=74%, E-value=1e-133, Identity=39%"; Hit description =Chromo
MAENTRLKELQTEIRTHTNDICRIGTTMDLCYQEQNDKMLHMQTSMDQIQLTMNQLLKTISQPHGSLVNNDTPIVMSISVALPTKEISLGFSHFDGTTPEVETIEPDDHYSSLNALKGGVGVGTIRFMAYIDKLSVTVLIDRGSSNNFLQPRVAKFLKLLVEPGNVVPLPVFLLPISGADLILGASWLKTIGPHIADYDALQLKFLMNGKFTTQGDHNLILKQTQLHHIRRMITTNSIAEVYNMHLLKENVTPKSFVNLPANMEPELALLLHTYSVVFATPISLPPQRSHDHSIPLLEGSQPVKVKPYRCPHSHKEEIEKLVSALNAITIKDSFPIPMMDELIDELFGATFFSKLDLRTHHGHYEWLGMPFGLTNAPATFQSLMNDILVGLLRKFVLVFFDDILVYSANWKDHLYHLEVVLNILPKHQLFARFSKCCFRVQQIDYLGHTLSGSGIAMDANKLEASCATIAAPLTDLLKNDSFKWIQATAQAFQQLKIAMTSALVLAIPNFNEIFILETDASGSGVGVVLSQNKHPIAYFSKSCLLPKFLGYDFTIQYKPGKENIPADALPRSFMMAISSPIHSWINQVIDRTQTDPQLGFSIILVVVDRLSKFGYFIPLKVDYNAKVVAESQGTIMSMSSSYHPQSDGQIENLNKTLKIYLSLGMTLFQAVFGRAPPSVSHYEADPIDPNQLKESLQQRDQLLSKLKADKKRRDLQFKEGDLVLVKLQPYRQHFVTLRKYQKLGMHFFGPFPMLEKIGNVTYKLKLPESTMIHLVFHVALLKPFHGMVSQPYVPLPLNSSDMATKAKDATWEDLQDIVNSYPQFNLEDKLIFDEKDNVTYVKSEEVLAQNSIEKEGHVSDDLHHMGVRKSTRGALVTCSDLNDRIYEILYHEEAEVMITL

SEQ ID NO: 177412 - protein, 78 aa, Glycine max
  Coding DNA Sequence Number=SeqID_60634
MVCLIFDGVSSEADKLESNYQSTFIVFMPKSSLPMLPQDYQSVCFSMGFAAFTLKRQGRRIRFWASGSARNQQKRVKN

SEQ ID NO: 177413 - protein, 252 aa, Glycine max
  Coding DNA Sequence Number=SeqID_60635
  Gene Ontology: Mol. function=hydrolase activity
  Homolog annotation: Hit_ID=Q5FAL6; Match level="QueryCoverage=91%, HitCoverage=87%, E-value=5e-38, Identity=38%"; Hit description =Putative Expressed protein
  Pfam annotation: Domain name=DUF1637; Domain location=5-235; Score =326.8; E_value=3.7e-95; Accession=PF07847.3; Description=Protein of unknown function (DUF1637)
MERSKIQVLYDASHAVFSQEGLPTFQQIHYLKTLLDKIEAIDVGVDESGLCDSPTSDATVDSSSSSSNSKGLLCGHGFSEITYIHIHECDYFSMGVFCLPAGKVFPLHDHPGMTVLSKLLYGSTCVKAYDWIALDCAGSQTIGLAGRVVDEVIKAPQEPSILFPRSGGNIHSFTALTPCAILDVLSPPYSEEFGRPSTYFSDIPIPSLNGYAILEEKPMPSNLVVQGAPYLGPSIVTVDHYNFGQIDFDNHV

SEQ ID NO: 177414 - protein, 103 aa, Glycine max
  Coding DNA Sequence Number=SeqID_60636
  Gene Ontology: Mol. function=voltage-gated ion-selective channel activity; Cellular component=mitochondrial outer membrane; Biological process=anion transport
  Homolog annotation: Hit_ID=Q4PKP6; Match level="QueryCoverage=70%, HitCoverage=26%, E-value=5e-25, Identity=79%"; Hit description =Mitochrondrial voltage-dependent anion-selective channel
MELSWTWLAELFTTITFNEPTLGLKAIFSFKVPHQRSGKVEVHYLHDYDEISTSVRLTANPIVNFSGVIGTNVLALGAYLSKAIGASRHAANKFAIRRIRECC

SEQ ID NO: 177415 - protein, 413 aa, Glycine max
  Coding DNA Sequence Number=SeqID_60637
  Gene Ontology: Mol. function=DNA binding; Biological process =regulation of transcription, DNA-dependent
  Homolog annotation: Hit_ID=Q1S9D7; Match level="QueryCoverage=71%, HitCoverage=89%, E-value=1e-72, Identity=47%"; Hit description =Transcriptional factor B3; Cupredoxin
  Pfam annotation: Domain name=B3; Domain location=15-120; Score=44.6; E_value=3.3e-10; Accession=PF02362.12; Description=B3 DNA binding domain
  Pfam annotation: Domain name=B3; Domain location=206-309; Score=53.6; E_value=6.5e-13; Accession=PF02362.12; Description=B3 DNA binding domain
  Pfam module annotation: Pfam domain module=B3::B3; Domain location=15- 120::206-309
MAATFPQQLLVKPIHFFKIITAHNVHEGKLHVLRTILPISMMIPNKFVKKYGKRLQNTLFLKTPNGAEWKMILKKRDGKIWFQKGWKEFAEYHSLAHGHLLVFRWDIEYPTEIIKGKTASNRKGNESPGDEHLECHRSGQKRKVNSVEFLQQCQMRSRKCVKVENTMILPRQALHHTATKCKGKSKAMDNQVTALDRASSFKSCNPFFLTVMHRTHISSHGSLNLPMKFCRSHLDLHKKRRLISLQVLSGRIWPAKYQIHKQKTAIRFKLSWNAFVKDNNLKVGDVCIFELVHGTKLTFLVHIFRETDSSKLFNVSRDYLLLDDICIYESGDNFRTRSGSYHYPDSEGTQSLNYSYLDSYTHSRRLVLKEDIGPLSLANRSSLKGQGLFLYFVALSVATIGIALQCPHFCSHR

SEQ ID NO: 177416 - protein, 114 aa, Glycine max
  Coding DNA Sequence Number=SeqID_60638
MRVHITRSHRLEHFLNMLWVVLDVLIYLMTRWHASAESMRSQSFFLLYASYANTKTIIIHLKAKPTKNGGLPICDTDGGYKSDDTGERALSNANGGYRSGNTGERVMATLEREP

SEQ ID NO: 177417 - protein, 119 aa, Glycine max
  Coding DNA Sequence Number=SeqID_60639
MCVDFKFCSKIKLHVYHRYITKLKALWEELGGYKPILLALVGKSDFFLITTIPRYILLKDPIPPINKVFSLVMQGNVPLAPLPQYLMLHLLLILNVLLKSLLNTDAKPKHGIVSDSNAD

SEQ ID NO: 177418 - protein, 299 aa, Glycine max
  Coding DNA Sequence Number=SeqID_60640
  Gene Ontology: Mol. function=protein serine/threonine kinase activity; Cellular component=spindle pole body; Biological process =protein amino acid phosphorylation
  Homolog annotation: Hit_ID=Q9FVI7; Match level="QueryCoverage=92%, HitCoverage=90%, E-value=1e-137, Identity=80%"; Hit description =Putative serine/threonine kinase GDBrPK
  Pfam annotation: Domain name=Pkinase; Domain location=4-242; Score =231.9; E_value=1.4e-66; Accession=PF00069.15; Description=Protein kinase domain
  Pfam annotation: Domain name=Pkinase_Tyr; Domain location=4-246; Score=-38.0; E_value=3.9e-10; Accession=PF07714.7; Description =Protein tyrosine kinase
  Pfam module annotation: Pfam domain module=Pkinase::Pkinase_Tyr; Domain location=4-242::4-246
MERYEILKDIGSGNFAVAKLVRDNYTNELFAVKFIERGQKIDEHVQREIMNHRSLKHPNIIRFKEVLLTPTHLAIVMEYASGGELFERICNAGRFSEDEQICHRDLKLENTLLDGSTAPRVKICDFGYSKSSVLHSQPKSTVGTPAYIAPEVLTRKEYDGKIADVWSCGVTLYVMLVGAYPFEDPADPRNFKKTIGKILSVQYSVPDYVRVSMECRHLLSQIFVASPEKRITIPEIKNHPWFLRNLPMELTEGGSWQMNDVNNPSQNVEEVLSIIQEARKSLNVPKVGGLLTGGQHGPG

SEQ ID NO: 177419 - protein, 140 aa, Glycine max
  Coding DNA Sequence Number=SeqID_60641
  Gene Ontology: Mol. function=DNA binding; Cellular component =mitochondrion; Biological process=DNA integration
  Homolog annotation: Hit_ID=Q1S1B7; Match level="QueryCoverage=68%, HitCoverage=15%, E-value=1e-25, Identity=57%"; Hit description =Integrase, catalytic region
MAPTTNPSSSSPSNGEHSYPSPASPPHDDNLGWPIAYRKEALDHLGWRQAKTVEIHALEHNGTWELVTLPPGKKTIGCRWVYAIKVGPNGEVDYLKAQLVAKSYTQIYGLHYEDTFSLAQFVCFLPWRLFDILVTSLAKQ

SEQ ID NO: 177420 - protein, 159 aa, Glycine max
  Coding DNA Sequence Number=SeqID_60642
  Gene Ontology: Cellular component=cellulose and pectin-containing cell wall
  Homolog annotation: Hit_ID=O82161; Match level="QueryCoverage=99%, HitCoverage=51%, E-value=7e-43, Identity=58%"; Hit description=Phi-1 protein
  Pfam annotation: Domain name=Phi_1; Domain location=1-146; Score= -118.6; E_value=0.0021; Accession=PF04674.3; Description=Phosphate -induced protein 1 conserved region
MAVEGFYMSCCGTHDSSSADHVKNTKELQVHLFWVGNFEAQCVWPFHQPIYGPQGPSLIAPKNDEEKILDRMVINLASLLAESTTNSFRNRFFQGPAEELLKAPSACPRVFMGKGLTLAILGTCSSTLPLVLAIMHIVLMEGSTCFLCCMTLPHHRAPR

SEQ ID NO: 177421 - protein, 849 aa, Glycine max
  Coding DNA Sequence Number=SeqID_60643
  Gene Ontology: Mol. function=nucleic acid binding; Cellular component= chromatin; Biological process=DNA integration
  Homolog annotation: Hit_ID=Q1T010; Match level="QueryCoverage=99%, HitCoverage=80%, E-value=0.0, Identity=36%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=334-488; Score=4.4; E_value=0.0026; Accession=PF00665.16; Description=Integrase core domain
  Pfam annotation: Domain name=zf-CCHC; Domain location=174-191; Score =24.9; E_value=7.7e-05; Accession=PF00098.13; Description=Zinc knuckle
  Pfam module annotation: Pfam domain module=RVT_2::rve::zf-CCHC; Domain location=570-789::334-488::174-191
KTANAKSAKEAWDILNKAYAGVDKIKKVLANSITSCGDTITNLTLVEKVLRTLNPRFDHIVVAIEESKDLESLYVDELQGSLEAHEQILQERANDKATEQALQAHHQSRNGGFDNHKGKKGRGRFQNMRGRGGYSKDKGKHQPDQRSGDSCSKRSGGFGTRGRGGKKKWDKRNVECFNCGKRGHYAEECWYKEKNADDEAQLATRAVSDTEPVLLMITTKTRADAENKWYLDTGCSTHMTGHKDWFVSIDESVNHEVRFADDNTIRVEGHGKVVIKRRDGTVSYIEDVLYVPNMRCNLLSLGQLLEKKYRMVMEDKEMKIYDKDRRLIIKAPLNRNRTFKIWTLEFQGFESTAQNGSRNTSAEKQPRNAFQKFVPVKSLQKLEVIHSDVCGPFQVESLGGNSGHCIKTLRTDGGGEYTFKEFAEFCDEAGITHEFTPPYTPQHNAATTVYILNKCLTKRLKGVTPKEAWTGYHATRGYELLDPRDVIFDELKEYEWKEDPINNTTKVLVDSIIPEELSDTTDELPTRNTEGGTRRSQRVLQPSQMLKDYEVMKDSQITDEGDIVHFALYADAEPVSFKEALKNDKNPAGEVVKHKARLVAKGFLQKEGVDYGEIFAPVARIEILDVKSAFLNGPLEEEVFVKQPPGFEVVGHEGKVYKLKKALYDQKQAPRAWNKKIDSVLIQIGFSKCISEHGVYVKEEYESDLEILCLYIDDLLITGNNKIKIDKIKQLLKNQFEITDLGSLSYFLGIEFKETEAGIVMHQSKYATDLLKKFRMTNYNAAATPAETGLTLSLRDKGEPVDETQYRQIVGSLRYLCNTRPDLAFSVGLISRFMQAPKTPHMMAAKRIL

SEQ ID NO: 177422 - protein, 49 aa, Glycine max
  Coding DNA Sequence Number=SeqID_60644
MLEKYLWREKYASHEDSINEGFNPFSVSLTFGNSIGAVRGKIGGVSGNH

SEQ ID NO: 177423 - protein, 83 aa, Glycine max
  Coding DNA Sequence Number=SeqID_60645
MFNTHRYGIRKVQGCLGEKSAKNTKIGVYLANRGCVNRLLHPNFFLGSLLITSEGLTPITVESVKFREVSQGKQPKTQKQERG

SEQ ID NO: 177424 - protein, 192 aa, Glycine max
  Coding DNA Sequence Number=SeqID_60646
MGPTYSDMGCKLALEDKKRVAFRRRQRHEHVDATRHAKPCNCSSLASQQQKACVCCFIKLPCKICHQALRCARKWACYGSKNNRAGFVNSLAFAKSGEFLVAGVGHVKIFSNYVLLTVVLKVGMSCQGCAGALNRILGKMEDSSSTCTWVLSNFNSNILTPTINYGCHLHSSDTGITDIALHSSGIKSEKGM

SEQ ID NO: 177425 - protein, 49 aa, Glycine max
  Coding DNA Sequence Number=SeqID_60647
MTPLPKREDTILIKGEGEVEAVVKGRKGKEGMLEATFIRGSVGGNERMF

SEQ ID NO: 177426 - protein, 229 aa, Glycine max
  Coding DNA Sequence Number=SeqID_60648
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=2e-30, Identity=36%"; Hit description= UPI00006A17C9 related cluster
SGPLGTSTLTFGRLHALAFIGLHVLAFRGLHAIAFRGLHRGLHDLAFRGLHILAFKGLHALSFKGLHALYFKGLHALSFRRLCVLSFRGPHVLALRGGLQALNFRGLHVLAFRGLHALTFRGLHVLAFRGLHVLPFRGLHVLAIRGLHVHAFRGLQDLAFRGLHIVALRITRLHALTFRGLHPLAFRGIHVLPFRGLHVLPSEDYTSSPSKDNTSLPSEDYMPSPSEDY

SEQ ID NO: 177427 - protein, 53 aa, Glycine max
  Coding DNA Sequence Number=SeqID_60649
  Homolog annotation: Hit_ID=Q8L5Y9; Match level="QueryCoverage=57%, HitCoverage=3%, E-value=3e-07, Identity=80%"; Hit description =Pantothenate kinase 2
MEGQKEFVQIDTNDLFPYLLVNIGFGVSMIKEAEVQDPYWTPPPRWKLENSER

SEQ ID NO: 177428 - protein, 122 aa, Glycine max
  Coding DNA Sequence Number=SeqID_60650
  Homolog annotation: Hit_ID=Q9ARH4; Match level="QueryCoverage=74%, HitCoverage=46%, E-value=2e-09, Identity=35%"; Hit description =Plastid-targeted protein 2
MIGTVVAALLSFTTNKWGPLLLLKEKIETTIEQAERVADIVEEVAERVDKIAEGAAKNLPEGKLQDVAEFVENVAENVDKLAEEAGDLLEKVLTCVPKITLNFLIFIFQSQLHLMPCFIYFT

SEQ ID NO: 177429 - protein, 115 aa, Glycine max
  Coding DNA Sequence Number=SeqID_60651
  Gene Ontology: Mol. function=inorganic diphosphatase activity; Cellular component=cytoplasm; Biological process=phosphate metabolic process
  Homolog annotation: Hit_ID=Q2HTA8; Match level="QueryCoverage=87%, HitCoverage=50%, E-value=2e-45, Identity=82%"; Hit description =Inorganic pyrophosphatase
  Pfam annotation: Domain name=Pyrophosphatase; Domain location=49-113; Score=-12.4; E_value=1.7e-07; Accession=PF00719.9; Description =Inorganic pyrophosphatase
MSDNGEEAGENRLVPRLNERILSSLSRRSVAAHPWHDLEIGPEAPQIFNCVVEITKGSKVKYELDKKTGLIKVDRVLYSSVVYPHNYGFIPRTLCEDNDPIDKIHSKTKRMSTRR

SEQ ID NO: 177430 - protein, 51 aa, Glycine max
  Coding DNA Sequence Number=SeqID_60652
MFQGGVEGKRQVDKVVDKCASMQNLEFCGDKVLMERGKIFLMADKIKELPP

SEQ ID NO: 177431 - protein, 93 aa, Glycine max
  Coding DNA Sequence Number=SeqID_60653
  Gene Ontology: Mol. function=pyridoxal phosphate binding; Biological process=metabolic process
  Homolog annotation: Hit_ID=Q1SEN7; Match level="QueryCoverage=93%, HitCoverage=19%, E-value=1e-32, Identity=76%"; Hit description =Peptidase M, neutral zinc metallopeptidases, zinc-binding site
MSHRWPSRLCVMSDDDVLRLRSYLRFYHAVEVPVYYQALRNGDRYPRDKDRFITSYVRISHQVYNTVDDYERLKTAINQLVEDGKVCSGIPKE

SEQ ID NO: 177432 - protein, 146 aa, Glycine max
  Coding DNA Sequence Number=SeqID_60654
MKLSTNGGNVPAQLLVLDRKVVKNGVAAEPAEHATEAVRNAYKDSKKKDAKTIFFLHQSRQFDSMTMEENEKIVDFFAQVKYAIEESKEVSEMSLEELQSSLEARELRLLERNKQKIAEQALLAQSSNKNFGGSNRGRSGFRGRGR

SEQ ID NO: 177433 - protein, 305 aa, Glycine max
  Coding DNA Sequence Number=SeqID_60655
MDLPPEIDGYIKESIDHSVGLPVSSQTLLFKLHASLESQRQLRDQHLFLLAKLKEKDALIERARCEANMNAQAVKRFVEENQKLAAECESLVEQRVKLEQECALYDHDREALMEFGNEADERAQEAHERALELERDLCLLEQELVKHKQQNDSVDSSSGSTLDEENLLDSLLATVTTTTIDESTTYAFLNANSENEHCEKLLTMWNCLKPSTRRVLCLVAEVKSLENDKENLRVNLHRAEEEVKLLYDENSVLDEENKRLAKRCKGRYHSSSGGKLTGSASAKINVLDPTFWYQSLIEPGIGKHE

SEQ ID NO: 177434 - protein, 252 aa, Glycine max
  Coding DNA Sequence Number=SeqID_60656
  Gene Ontology: Mol. function=ubiquitin-protein ligase activity; Cellular component=intracellular; Biological process=protein modification process
  Homolog annotation: Hit_ID=Q2QTS8; Match level="QueryCoverage=76%, HitCoverage=71%, E-value=5e-40, Identity=47%"; Hit description =Regulator of chromosome condensation, putative, expressed
MARSSTKIWRDVPRNFKLFEEFERGEKGIGDGTISYGMDDADDIYMQSWTGLLLAPLVTLQGIQIIQAAVGAGRTMLVSDSSQVYAFGKGSFRETEYGVQGSKTVAAPQIVESLKNIFVVQAAIGNFFTAALSIEGRVYTFSWGSDGKLGHRTDQSDEKPHPLLGALENISIGNRHANVLSPKFVTSLKQINERVVQISLTNSIYWSAYTFALTESGKLYAFGAGDKGQLGIELVANQTERENPERVEIDLG

SEQ ID NO: 177435 - protein, 150 aa, Glycine max
  Coding DNA Sequence Number=SeqID_60657
  Gene Ontology: Mol. function=nucleic acid binding; Biological process= DNA integration
  Homolog annotation: Hit_ID=Q1T010; Match level="QueryCoverage=87%, HitCoverage=15%, E-value=3e-17, Identity=26%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=zf-CCHC; Domain location=25-42; Score =20.2; E_value=0.00045; Accession=PF00098.13; Description=Zinc knuckle
MLKINLIRGRGYYRGGRKRFDKQNIQCYNCDRWGHFADECYAKKDSQVDEANLAKGDDEENELVMLMVTTADETCTIDECKKNRIKFADGKAMLAEGVGNLMIKMSGGKNSLICDVSMSRNRTFRANLEALCHKCLIAVVSEDDWVWHHI

SEQ ID NO: 177436 - protein, 74 aa, Glycine max
  Coding DNA Sequence Number=SeqID_60658
EFVEPPIPEVSVATDLPMHSVDLGAIAEDLERVINLRMVTGGTDLHDIMTRCLRRARGDAADGSLRPRQRRRID

SEQ ID NO: 177437 - protein, 235 aa, Glycine max
  Coding DNA Sequence Number=SeqID_60659
  Gene Ontology: Mol. function=oxidoreductase activity; Biological process=electron transport
  Homolog annotation: Hit_ID=Q0K416; Match level="QueryCoverage=99%, HitCoverage=56%, E-value=5e-97, Identity=74%"; Hit description =Predicted flavoprotein involved in K+ transport
CRGAASGRPRGVLSVGEHYRPPRAYRDRDYCWWLGALGLWDEVKIKPKKQHVAFAVSGYEGGKTVDFRRLAHMGITLVGITERWDNGVLRFAPGLAENIAEGDRAYFEVLRDADAYIERNGLDLPAEPQAWELLPDPECLLNPLMQLDVQAAGISTIIWATGFKFDFSWLQVDAFDEQGLPFHKRGISAERGIYFLGLPNLVNRASSFIYGVWHDAKYIADHIALQNAYSDYVKS

SEQ ID NO: 177438 - protein, 96 aa, Glycine max
  Coding DNA Sequence Number=SeqID_60660
  Gene Ontology: Mol. function=oxidoreductase activity; Biological process=metabolic process
  Homolog annotation: Hit_ID=Q1S068; Match level="QueryCoverage=94%, HitCoverage=60%, E-value=1e-11, Identity=49%"; Hit description=Short- chain dehydrogenase/reductase SDR
MDMNVKGMTNVLHSGKEDGGDNSEHVFWMGKVGAMLVAPYCASKLAIKGLSKSGKRGVGRYASGRTQLEHNQHQHALLLLWCIYFSLSSTAAQPLS

SEQ ID NO: 177439 - protein, 70 aa, Glycine max
  Coding DNA Sequence Number=SeqID_60661
MEDTFQDQALHLQKQKQDPQARDVPNGSCDDINSKAKPVGASVTDAKKAKITKKCLPNLKIGLELLKIKH

SEQ ID NO: 177440 - protein, 93 aa, Glycine max
  Coding DNA Sequence Number=SeqID_60662
  Homolog annotation: Hit_ID=Q5DMX3; Match level="QueryCoverage=85%, HitCoverage=8%, E-value=1e-22, Identity=66%"; Hit description=DRP
MERQRREEELKNRSSKKTLDAEQSILNRATSPQTSQQSGGNLKSMKDKSSQQDRDTQEGSGLKTAGPEGEITAGLISPRSLCSVTCAVPSLKY

SEQ ID NO: 177441 - protein, 442 aa, Glycine max
  Coding DNA Sequence Number=SeqID_60663
  Gene Ontology: Mol. function=oxidoreductase activity, acting on paired donors, with incorporation or reduction of molecular oxygen; Cellular component=chloroplast; Biological process=carotenoid biosynthetic process
  Homolog annotation: Hit_ID=Q10AT7; Match level="QueryCoverage=89%, HitCoverage=72%, E-value=1e-166, Identity=68%"; Hit description=FAD dependent oxidoreductase family protein, expressed
MMMISMMGGRCYSSYGGSNGDRKSMSKSKSEADVVVIGFGCARRVSSIPEGQFLSRIGPTEFFKDLQQYAGPNAVLEWRKLLDAVLPLSTAAMALPPLSIRGDLGVLSTAAARYGPSLIKSFLQMGPGAALGATKLLRPFSEILDDLQLKDPFIRNWIDLLSFLLAGVKANAVLSAEMNGTNRDAVLSRLHGIAAIVDALVRGLEKFGGRISLQSHVENIVVENDRAIGVKLRSGQFIRAKKAVVSNASMWDTLKLLPKEVVPKSYSDRVNTTTQCDSFMHLHLGFDAEGIRSDLGIHHIVVNDWKRGVDADQNVVLISIPSVLSPNLTPHGKHVLHAYMPGTEPFELWEGLDRRSAEYRNLKAERSEVMWKAVERAIGPGFSREKCEVKLVGSPLTRKLYCCGDSTFPGIGVPAVAASGAIVANSLVSVSQHSKLLDAIAI

SEQ ID NO: 177442 - protein, 624 aa, Glycine max
  Coding DNA Sequence Number=SeqID_60664
  Gene Ontology: Mol. function=nucleic acid binding; Biological process= meristem development
  Homolog annotation: Hit_ID=Q6J732; Match level="QueryCoverage=68%, HitCoverage=44%, E-value=1e-83, Identity=44%"; Hit description=AML1
  Pfam annotation: Domain name=RRM_1; Domain location=267-333; Score =65.0; E_value=2.4e-16; Accession=PF00076.12; Description=RNA recognition motif. (a.k.a. RRM, R
  Pfam annotation: Domain name=RRM_1; Domain location=361-427; Score =38.7; E_value=2e-08; Accession=PF00076.12; Description=RNA recognition motif. (a.k.a. RRM, R
  Pfam module annotation: Pfam domain module=RRM_1::RRM_1; Domain location=267-333::361-427
MDQRGVSASSHYFDDISFRSERNVGLRKPKSINDHYPQGNNGMVASPGNILNATPPLDVNAKAGLLLPQASLPGDNIHSTESSNYRTKSLSNACLQSAPTSYGLIGNKIVTNAAPFESSLFSSSMSEIFSQKFKLMSLSVYLFANLGAVRFFGNDVRSDHPITAGSPPKEEPYKSLEEMEADTIGNLLPDEDDLFSGVVDELGCSSHARTNDDFEDFDLFSSGGGMEMEGDEHLSSGKRMSALDGDFGFFGSSKGKLPLVEQPSRTLFVRNINSNVEDSELKALFEQYGDIRTIYTASKHRGFVMISYQDLRAAQNAMQALQNRPLGSRKLDIHYSIPKMYINLKTCQVNAPEKDIGHGTLMLSGLDSPVLNDELKQIFGFYGEIKEIYEYSEMNNHKFIEFYDVRAAEAALRALNKIDIAGKQIKLEPGHPSLMHQSQKGQEERDLGQSIIDNLSLRQKATLPSGVIGSGCLENGYNQRFQSTVRQPLNAFMDNAFIHVNSGIHNTVRGAPAGKVSSVCESSNFVDAMKFASGSRFHPHSLPEYRDSLANGSPYNFSSSISNMANNIGAGATEASDGRHIQGMGSTGNLAEFNAGVRYSNVEQPLPTTGAAVVEQFSVEAIAG

SEQ ID NO: 177443 - protein, 78 aa, Glycine max
  Coding DNA Sequence Number=SeqID_60665
ALLQAILCAGLYPNVAAGEQGIVAAVLSSLKQSSSSASSGRTVWFDGRREVHIHPSSINNNSKGFQYPFLVFLEKVCE

SEQ ID NO: 177444 - protein, 289 aa, Glycine max
  Coding DNA Sequence Number=SeqID_60666
  Gene Ontology: Biological process=multicellular organismal development
  Homolog annotation: Hit_ID=Q1SMS1; Match level="QueryCoverage=83%, HitCoverage=47%, E-value=1e-92, Identity=67%"; Hit description=WD40 -like
  Pfam annotation: Domain name=WD40; Domain location=170-209; Score =11.4; E_value=1.7; Accession=PF00400.22; Description=WD domain, G -beta repeat
  Pfam annotation: Domain name=WD40; Domain location=217-255; Score =12.6; E_value=1.2; Accession=PF00400.22; Description=WD domain, G -beta repeat
  Pfam annotation: Domain name=WD40; Domain location=69-109; Score =17.1; E_value=0.064; Accession=PF00400.22; Description=WD domain, G -beta repeat
  Pfam module annotation: Pfam domain module=WD40::WD40::WD40; Domain location=170-209::217-255::69-109
MSKHPYKTAFKTEHDQNAVVNTTSREEHEEALVALVEHRTREVKNGRKELEELFPLICKSSSPGSVFCQKLSSQLPSLHKKRVRRIAVCPVNDHRFVTSALDGVVNLWEVHSSGSGASLLRTTDCASQKQRRWPEDVAWHPDVNSVFSVYNADSQDSQISVTDFSKRERVNFLEDKPHVKGVINSIVFLPWENTSFVTGGTDHAVIMWNENSENKWKPQLLHNYDHSSAVMGVAGMQQKQIVLSAGKDKKILGYDVHAGKQEFKHQVDSKCLSVLPNPCDFNLFMVQTG

SEQ ID NO: 177445 - protein, 104 aa, Glycine max
  Coding DNA Sequence Number=SeqID_60667
  Homolog annotation: Hit_ID=Q941L3; Match level="QueryCoverage=54%, HitCoverage=10%, E-value=3e-09, Identity=51%"; Hit description =BONZAI1
MTISKSKWAIDSGLIDPSIEEKLPKQRKKLNKLSETTWESGRESVMNLDLREEAVVAARPEEAIDGVVGSVGRIEVAGGGAADGRLAASDVGAAVAHRLTDWVK

SEQ ID NO: 177446 - protein, 74 aa, Glycine max
  Coding DNA Sequence Number=SeqID_60668
MSAVVSALAQVIGGNPKHKDPTTVSQLSVVGNDSNEQSQPPQHQKQSSLGFLNLPLKIIVCPCKLHDVRFIYIH

SEQ ID NO: 177447 - protein, 170 aa, Glycine max
  Coding DNA Sequence Number=SeqID_60669
  Gene Ontology: Mol. function=ATP-dependent helicase activity; Cellular component=intracellular; Biological process=protein modification process
  Homolog annotation: Hit_ID=Q00YU4; Match level="QueryCoverage=96%, HitCoverage=8%, E-value=2e-30, Identity=44%"; Hit description=[A] KOG0924 mRNA splicing factor ATP-dependent RNA helicase
  Pfam annotation: Domain name=HA2; Domain location=61-158; Score=58.8; E_value=1.8e-14; Accession=PF04408.13; Description=Helicase associated domain (HA2)
MLRMPLVELCLQIKLLSLGYIKPFLSEALEPPKVEAMDSAISLLYEKQMSPDLSSRLWKYSYVGALEGDEELTPLGHHLAKLPVDVLIGKMMLYGAMFGCLSPILSVAAFLSYKSPFVYPKDERQNVERAKLTLLNDKLDGPGNTNDIDRQSDHLLMMTAYKRWERILTE

SEQ ID NO: 177448 - protein, 89 aa, Glycine max
  Coding DNA Sequence Number=SeqID_60670
MGQRYFLLLHPPTLRQLPLQCLGETRTRQVDLLLLRDGCSCDLHWQAPVYCFGDAETLNKTSTSLLHSQDGASSHGMLIGQILHSAYAK

SEQ ID NO: 177449 - protein, 241 aa, Glycine max
  Coding DNA Sequence Number=SeqID_60671
  Gene Ontology: Mol. function=transporter activity; Cellular component= intracellular; Biological process=transport
  Homolog annotation: Hit_ID=O48940; Match level="QueryCoverage=100%, HitCoverage=97%, E-value=1e-120, Identity=89%"; Hit description =Polyphosphoinositide binding protein Ssh2p
  Pfam annotation: Domain name=CRAL_TRIO; Domain location=92-241; Score= 70.1; E_value=7.2e-18; Accession=PF00650.10; Description=CRALTRIO domain
  Pfam annotation: Domain name=CRAL_TRIO_N; Domain location=9-77; Score= 31.8; E_value=2.4e-06; Accession=PF03765.5; Description=CRALTRIO, N -terminus
  Pfam module annotation: Pfam domain module=CRAL_TRIO::CRAL_TRIO_N; Domain location=92-241::9-77
METVRTREGAIAKDTTETELTKIPLLRATVETLHPSSKEEDDFMIRRFLRARDLDVEKASAMFLKYLKWRHEFVPNGSVSVSDVPIELAQDKVFMQGRDKIGRPILIVFGRRHFQNKDGLDEFKRFVVYVLDKVCASMPPGQEKFVGIAELKGWGYSNSDVRGYLSALSILQDYYPERLGKLFIVNAPYIFMKVWKIIYPFIDNKTKKKIVFVEKNKVKSTLLEEMDESQVPEIFGGSLSL

SEQ ID NO: 177450 - protein, 583 aa, Glycine max
  Coding DNA Sequence Number=SeqID_60672
  Gene Ontology: Mol. function=transporter activity; Cellular component= mitochondrial inner membrane; Biological process=transport
  Homolog annotation: Hit_ID=Q1SMQ9; Match level="QueryCoverage=96%, HitCoverage=97%, E-value=1e-156, Identity=76%"; Hit description =Calcium-binding EF-hand; Adenine nucleotide translocator 1
  Pfam annotation: Domain name=Mito_carr; Domain location=294-381; Score=104.0; E_value=4.6e-28; Accession=PF00153.17; Description =Mitochondrial carrier protein
  Pfam annotation: Domain name=Mito_carr; Domain location=388-479; Score=105.4; E_value=1.7e-28; Accession=PF00153.17; Description =Mitochondrial carrier protein
  Pfam annotation: Domain name=Mito_carr; Domain location=486-582; Score=89.7; E_value=9e-24; Accession=PF00153.17; Description =Mitochondrial carrier protein
  Pfam annotation: Domain name=efhand; Domain location=109-137; Score =17.6; E_value=0.044; Accession=PF00036.22; Description=EF hand
  Pfam annotation: Domain name=efhand; Domain location=230-258; Score =26.6; E_value=8.7e-05; Accession=PF00036.22; Description=EF hand
  Pfam annotation: Domain name=efhand; Domain location=42-70; Score =14.2; E_value=0.36; Accession=PF00036.22; Description=EF hand
  Pfam annotation: Domain name=efhand; Domain location=78-106; Score =28.8; E_value=2e-05; Accession=PF00036.22; Description=EF hand
  Pfam module annotation: Pfam domain module=Mito_carr::Mito_carr::Mito_ carr::efhand::efhand::efhand::efhand; Domain location=294-381::388 -479::486-582::109-137::230-258::42-70::78-106
MEHVGFSKAAIADHGRGKKTGPVSMDHVLLALRETKDERDLRIRSLFNFFDAANNGYLDYAHIEAGLSALQIPPEYKYAKELFKVCDADRDGRIDYRDFRRYMDDKELELYRIFQAIDVEHNGCILPEELWDALVKAVGMAEWHGEFFANCHGQFMKGILPRRRHKVQWHVYMAEFQPAAMCCCLLSVLFILSVLIVICTAVLSIDSERERQNFGNNSMSIHGIEIDEEELARFVEHVDKDNNGIITFEEWRDFLLLYPHEATIENIYHHWERVCLVDIGEQAVIPEGISKHVHRSRYFIAGGIAGAASRTATAPLDRLKVLLQVQTGRASIMPAVMKIWRQDGLLGFFRGNGLNVVKVAPESAIKFYAYEMLKNVIGDAQDGKSDIGTAGRLFAGGMAGAVAQMAIYPMDLVKTRLQTCASDGGRVPKLGTLTKDIWVHEGPRAFYRGLVPSLLGMIPYAGIDLTAYDTLKDLSKRYILYDSDPGPLVQLGCGTVSGALGATCVYPLQVIRTSVIMILRLQAQPANSTSAYKGMSDVFWKTLKDEGFRGFYKGLIPNLLKVVPAASITYMVYESMKKSLDLE

SEQ ID NO: 177451 - protein, 314 aa, Glycine max
  Coding DNA Sequence Number=SeqID_60673
  Gene Ontology: Mol. function=oxidoreductase activity; Cellular component=cytosol; Biological process=metabolic process
  Homolog annotation: Hit_ID=Q1SMR0; Match level="QueryCoverage=95%, HitCoverage=96%, E-value=1e-130, Identity=77%"; Hit description =Short-chain dehydrogenase/reductase SDR
  Pfam annotation: Domain name=Epimerase; Domain location=39-300; Score= -55.8; E_value=0.017; Accession=PF01370.11; Description=NAD dependent epimerasedehydratase family
  Pfam annotation: Domain name=KR; Domain location=37-171; Score=-91.6; E_value=0.048; Accession=PF08659.1; Description=KR domain
  Pfam annotation: Domain name=adh_short; Domain location=37-199; Score= 15.3; E_value=5.4e-07; Accession=PF00106.15; Description=short chain dehydrogenase
  Pfam module annotation: Pfam domain module=Epimerase::KR::adh_short; Domain location=39-300::37-171::37-199
MGHKEKSKERKEKRLQEISLLRTIPYADHQRWWSKETIAVVTGGNRGIGFEISRQLADHGVTVILTSRDASVGVESIKVLQEGGIQDVACHQLDILDTSSINQFCEWLKENYGGLDILVNNAGVNFNFGSDNSVENAKLVIETNYYGTKRMIQAMIPLMKSSSAGGRIVNVSSRLGRLNGKRNRLENEALREQLSDEESLSEEVIDGMVSTFLQQVEDGSWKSGGWPPTFTDYSVSKLAVNSYTRFMAKKLSERPDGEKIYINSYCPGWVKTALTGYAGSVSVEDGADSGVWLSLLPDQAITGKFFAERREINF

SEQ ID NO: 177452 - protein, 49 aa, Glycine max
  Coding DNA Sequence Number=SeqID_60674
MEHLNFGVPKDAKFGLRSAQRLRGWFFQGGIVETESEYLRGERGASHCN

SEQ ID NO: 177453 - protein, 66 aa, Glycine max
  Coding DNA Sequence Number=SeqID_60675
  Subcellular localization annotation: CTP_CleavageSite=45; ConfidenceScore=5.13e-01
MASNENTGKYYISYISNHSLPPYLMSKPFKLTTVTRIGGKRNRTLAESPVQAQLRELNLEERLCLP

SEQ ID NO: 177454 - protein, 273 aa, Glycine max
  Coding DNA Sequence Number=SeqID_60676
  Gene Ontology: Mol. function=RNA-directed DNA polymerase activity; Cellular component=exocyst; Biological process=RNA-dependent DNA replication
  Subcellular localization annotation: CTP_CleavageSite=41; ConfidenceScore=5.09e-01
MGLYFGGLPKSKSFRFTFQHIKPSKTSVGINKGYIISVTCVGQERRPPQICINEFKGSGIFRCTYKILAKVLTNRLKKVMHLIINERQSAFIQGRHMLHSVMVANEVVEEAKRGQKPCFIFKVDYEKAYDSVSWEFLTYMMTRMGFCTKWIQWIVGCLKSASVSVLVNGSPSSEFSPQRGLRQGDPLSPLLFNIVAEGLNGLLSKAIEKRLYRGFLVGTNKVEISLLQYADDTIFFGEASMENVRTIKAILRAFELASGLKINFAKSSCGAFG

SEQ ID NO: 177455 - protein, 260 aa, Glycine max
  Coding DNA Sequence Number=SeqID_60677
  Homolog annotation: Hit_ID=Q1T555; Match level="QueryCoverage=33%, HitCoverage=67%, E-value=2e-07, Identity=34%"; Hit description=RNA -binding region RNP-1
  Pfam annotation: Domain name=RRM_1; Domain location=68-138; Score =36.9; E_value=6.8e-08; Accession=PF00076.12; Description=RNA recognition motif. (a.k.a. RRM, R
MRERERETERDSERDSGWERVRSRRERRENERTRGMEGPCLFIAREGKGGQQRRLRVNWRDHRNISSFYFTRFPEDTTEDELWKIFRRAGDVREVFIPNKRNRTGRRYGFVRFIGVDNVQQLERRLDNIVMGGLKLYVNIPKFERGRGRVQPQSTGGREHTRLVEQGRRETYQAQKHTATPGLVRGSFADVVARREPRIQQRRTSAVQNAKTNTSRSEVHLDRPMTAPKWLQDAWVGRLKNLALLDRVEEKYAMGLGIKL

SEQ ID NO: 177456 - protein, 102 aa, Glycine max
  Coding DNA Sequence Number=SeqID_60678
MVTDYKLETEALWEEDNRWVTEKVKNRLRIETGLFTFTKGNGKGDQSLSGITHIIVDEVHERSLLFTLNVILIIYTLADWMCEVLSKMSRNTMCHESTIPKA

SEQ ID NO: 177457 - protein, 160 aa, Glycine max
  Coding DNA Sequence Number=SeqID_60679
  Gene Ontology: Mol. function=ATP-dependent helicase activity; Cellular component=intracellular; Biological process=ribosomal large subunit biogenesis and assembly
  Homolog annotation: Hit_ID=Q016U8; Match level="QueryCoverage=66%, HitCoverage=8%, E-value=7e-30, Identity=62%"; Hit description=[A] KOG0924 mRNA splicing factor ATP-dependent RNA helicase
MLNIRATLPIAALKGDILKLMEEHDFLVVCGETGSGKTTQVPQFILDDMIESGHGGYCNIICTQPRRIAAVSVAERVADERCEPSPGSDGSLIGYQVRLDSARIAKSFLKVPQSSPAKEDGIIQYLIQLSFEKITRFLWFHTHQDSATHQISHLCDLIPR

SEQ ID NO: 177458 - protein, 52 aa, Glycine max
  Coding DNA Sequence Number=SeqID_60680
  Homolog annotation: Hit_ID=Q41525; Match level="QueryCoverage=73%, HitCoverage=1%, E-value=3e-10, Identity=82%"; Hit description=Acetyl- CoA carboxylase
VHNDDEVRALFKQVQGEVPGSPIFIMKVASQAIPVSVHIKGGTDEFKYERND

SEQ ID NO: 177459 - protein, 102 aa, Glycine max
  Coding DNA Sequence Number=SeqID_60681
MGLPECFLKLDCFWRKQPSSPGRAGRQPPPLIPINRLKGAVLRIPDAPENPCRGASVTLPRCFRKQIREGFPPLFTVLHPFFVLQRYSLISVKMNSDRSVVP

SEQ ID NO: 177460 - protein, 167 aa, Glycine max
  Coding DNA Sequence Number=SeqID_60682
MSLSTYDISFKITDVNITLNRAVNIGYFKTDVAQTYNSIIGFPDPNYGIKTIINQKLSSPIYILPLAPRNVVLRSLRFMSVTLSVELLSYPNFVWGLLFDGMQPLVDRFEVKEPGGPFGPATKSYPEPHELIVIHASSTIEFGALRIDCLALFVYPPPSNLIRSPMN

SEQ ID NO: 177461 - protein, 102 aa, Glycine max
  Coding DNA Sequence Number=SeqID_60683
MTIDDCHEPPLIAVRPPHGEEHCNRSGISKTQLEDSEENEAFDPAFVVYSRAVATYPLRASEARLTDSGVVFTFEEGISTSHVDKSGALAPTYPPSKRKSDL

SEQ ID NO: 177462 - protein, 332 aa, Glycine max
  Coding DNA Sequence Number=SeqID_60684
  Gene Ontology: Mol. function=protein serine/threonine kinase activity; Cellular component=membrane; Biological process=protein amino acid phosphorylation
  Homolog annotation: Hit_ID=A0F0B1; Match level="QueryCoverage=98%, HitCoverage=72%, E-value=1e-133, Identity=73%"; Hit description=Cold- induced wall associated kinase
  Pfam annotation: Domain name=Pkinase; Domain location=9-277; Score =155.0; E_value=1.9e-43; Accession=PF00069.15; Description=Protein kinase domain
  Pfam annotation: Domain name=Pkinase_Tyr; Domain location=9-277; Score=134.3; E_value=3.2e-37; Accession=PF07714.7; Description =Protein tyrosine kinase
  Pfam module annotation: Pfam domain module=Pkinase::Pkinase_Tyr; Domain location=9-277::9-277
DLDKATDHFNINRVLGKGGQGTVYKGMLVDGNIVAVKKFKVNGNVEEFINEFVILSQINHRNVVKLLGCCLETEIPLLVYEFIPNGNLYEYLLGQNDDLPMTWDMRLRIATEVAGALFYLHSAASQPIYHRDIKSRNILLDGKYKAKVADFGASRMVSIEATHLTTAVQGTFGYMDPEYFHTSQLTDKSDVYSFGVVLIELLTGKEPISSAKQQELRSLASYFLLCMEENRLFDIIDERIVKEAEKEHIVVVANLARRCLELKGKRRPTMKEVTSELESIQKSRKQSASQEQHDAGIDECQFWSVISPTSNLGETSDSKASTLEIMPTHPNH

SEQ ID NO: 177463 - protein, 250 aa, Glycine max
  Coding DNA Sequence Number=SeqID_60685
  Gene Ontology: Mol. function=nucleic acid binding; Cellular component= nucleus; Biological process=DNA integration
  Pfam annotation: Domain name=rve; Domain location=24-164; Score=74.0; E_value=4.6e-19; Accession=PF00665.16; Description=Integrase core domain
  Pfam module annotation: Pfam domain module=RVT_2::rve; Domain location=152-244::24-164
MEYVNDVYLENTTANHFQRKEQGEPRKCWNWCTQKCGPMSTLSHAQNMYFILFIDDLTRMTWVYFIRQNSEVFVMLKKFKAFVEKQSGKLIKVLRSDKGKEVSFERQLTVGYTPQQNGVSERNNQTVMEKGIPKELWPEAINTTVYLLNRCPTKAKILKKQLRKMLGGRQCKRKLVYKVKHNLDGSIQKNKARLIAKGYSQQLGVDYEETFAPVECLDTIRTTKGAEDDVSVCASTDSFPLVDERCRRRC

SEQ ID NO: 177464 - protein, 305 aa, Glycine max
  Coding DNA Sequence Number=SeqID_60686
  Gene Ontology: Mol. function=protein serine/threonine kinase activity; Cellular component=integral to membrane; Biological process=protein amino acid phosphorylation
  Homolog annotation: Hit_ID=Q1S4Z2; Match level="QueryCoverage=98%, HitCoverage=42%, E-value=2e-51, Identity=38%"; Hit description =Protein tyrosine kinase, putative
  Pfam annotation: Domain name=WAK; Domain location=183-287; Score= -45.0; E_value=0.07; Accession=PF08488.1; Description=Wall-associated kinase
MVLKFAYIKVILMIWCMYPLTSAQYLDETITSSQYENMTIARPGCDRKCGNVFIPFPFGMGRENCYASSWFEIDCRNNNTTTNSSGEQKPYLKYIDLEVKFIDLWNEALIIMNPIYQSGKNCERNKTGGINLKGGSPFVYSARYNTFLAVGCGNTASFWSNGEEVSGCASMCNGDDLIKVDNCRGRKCCEASLPRYLSEYNVSFEGQECAYGLIIAVRLGYWNLTIKDVKHLNEVPAVLKWEIPFDTFYSNISFFRDPDIVSCYDTYLKHSLNNSSQSSGRRCHCRYGAPPANPYIRGSCLGVAP

SEQ ID NO: 177465 - protein, 150 aa, Glycine max
  Coding DNA Sequence Number=SeqID_60687
  Gene Ontology: Mol. function=zinc ion binding
MNRLNLMLSFDNDSKQPHQCVVDDDDAMPPPILPPLSSGDEVFDDVINQEFCVRSVSNLLRSSFRESLDQLIQSYVERQGHASINWELQETTLSSASVEQDLEQHSRDQIVGQEEVTVSPLNLPSLPIPPPLPIWDHHHHRDNWSQSNSS

SEQ ID NO: 177466 - protein, 252 aa, Glycine max
  Coding DNA Sequence Number=SeqID_60688
  Gene Ontology: Mol. function=protein serine/threonine kinase activity; Cellular component=integral to membrane; Biological process=protein amino acid phosphorylation
  Homolog annotation: Hit_ID=Q1S4Z2; Match level="QueryCoverage=86%, HitCoverage=30%, E-value=1e-40, Identity=41%"; Hit description =Protein tyrosine kinase, putative
MVLKFAYIIVILMIWCMYPLTSAQYLDETITSSQYENMTIARPGCDRKCGNVFIPFPFGMGRENCYASSWFEIDCRNNNTTTNSSGEQKPYLKYIDLEVKFIDLWNEALIIMNPIYQSGKNCERDKTGGINLKGGSPFVYSARYNTFLAVGCGNTASFWSNGEEVRACASMCNGDDLIKVANCRGRKCCQTSLPRHLSEYNVSFDGQECAYGLIIAVRLGMTTTTTSRAVPTSGEAAKARRRQTSKVMGSGP

SEQ ID NO: 177467 - protein, 742 aa, Glycine max
  Coding DNA Sequence Number=SeqID_60689
  Gene Ontology: Mol. function=protein serine/threonine kinase activity; Cellular component=membrane; Biological process=protein amino acid phosphorylation
  Homolog annotation: Hit_ID=Q1S4Z2; Match level="QueryCoverage=99%, HitCoverage=99%, E-value=0.0, Identity=53%"; Hit description=Protein tyrosine kinase, putative
  Pfam annotation: Domain name=Pkinase; Domain location=416-684; Score =151.4; E_value=2.4e-42; Accession=PF00069.15; Description=Protein kinase domain
  Pfam annotation: Domain name=Pkinase_Tyr; Domain location=416-684; Score=133.5; E_value=5.8e-37; Accession=PF07714.7; Description =Protein tyrosine kinase
  Pfam module annotation: Pfam domain module=Pkinase::Pkinase_Tyr; Domain location=416-684::416-684
MVLKFVYIIIILMIWCMYPLTSAQYENGTITSAQYENKTIASPPGCDSKCGNVSIPFPFGMHDPKCYASNQFEIECRHNNNTSQGHQKPVPHLKYINLEVMYIDIQYGTVGIKNPIFHPGCGKTVTGINLEGSPFVYSQNYNSFVGVGCQNAAIMLSNDTILTACMSVCYEHLEKGNDIDISSCRGSYCCETSLPPYLSAYNISTETVEVKSNIKAECSNYLLIRAEYSNFKYEYDEYNSSYWVPTLGDLKKQKDVPAVLEWEIPIHTPNNSFPEFRTDAYGHGSYNCSYTNVTSSLYPQSGWRCSCSDGFEGNPYIQEGCKLSLDGRKIIIDPTKSYGKVAMIGVFSSIGTIILLFGLWRLRKVVRKKIAKKRKEKFFKQNGGLLLEQRLSTGEVNVDKTKLFSLKELGKATDHFNINRILGKGGQGTVYKGMLVDGKIVAVKKFKVNGNVEEFINEFVILSQINHRNVVKLLGCCLETEIPLLVYEFIPNGNLYEYLHGQNDELPMTWDMRLRIATEVAGALFYLHSAASQPIYHRDVKSTNILLDEKYKAKVADFGASRMVSIEATHLTTAVQGTFGYLDPEYFHTSQLTEKSDVYSFGVVLVELLTGQKPISSVNEQGLQSLASYFLLCMEENRFFDIVDARVMQEVEKEHIIVVANLARRCLQLNGRKRPTMKEVTLELESIQKLENQCNAQEQQEELELAGNEDSQFWAAYSTTSTAGQTSDSKTSTLEIMPILIK

SEQ ID NO: 177468 - protein, 271 aa, Glycine max
  Coding DNA Sequence Number=SeqID_60690
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=O04893; Match level="QueryCoverage=97%, HitCoverage=29%, E-value=8e-80, Identity=55%"; Hit description=Alpha- glucosidase precursor
  Pfam annotation: Domain name=Glyco_hydro_31; Domain location=2-125; Score=-193.9; E_value=0.00052; Accession=PF01055.16; Description =Glycosyl hydrolases family 31
LYVWDSVASSARKVLGLRYRLLPYFYTLMYEAHTKGTPIARPLFFSFPEDVTTYEINSQFLLGRGVLVSPVLQSGATTVDAYFPKGTWFDLFNVSNSVNAESGKYVTLDAPYDHINVHVGEGNILALQGEAMTTDAARKTAFQLVVVISSSRSSYGQLYLDDGEALDMAGAKDQWTLVSFYGALHNNSVSVTSKVTNGRFALDQRWILDKVTFLRIPKLAGNELSIVNGTSSMKKAIVKSQFDSSSQFVNVQVSKLSLLIGEEFQLEIEIK

SEQ ID NO: 177469 - protein, 649 aa, Glycine max
  Coding DNA Sequence Number=SeqID_60691
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=O22444; Match level="QueryCoverage=97%, HitCoverage=65%, E-value=0.0, Identity=61%"; Hit description=Alpha -glucosidase 1
  Pfam annotation: Domain name=Glyco_hydro_31; Domain location=284-649; Score=315.3; E_value=1.1e-91; Accession=PF01055.16; Description =Glycosyl hydrolases family 31
MDTTTTIAPLLFCTCACLIFFSASLSEATVVGYGYTISSANNYPIKNSLTANLNLIKSSSVSGPDIPHLSLTASFENKDRLRVRITDSNHQRWEIPQEVIPRDSSSQHYPLGFLNTKQGSHQPKDSLSLTHSDSDLVFSLHNTTPFGFTVSRKSSNDVLFHAAPDPSNPETFLVFKDQYLQLSSSLPSQRASLYGFGEHTKSSFKLRPNQTLTLWNADIASANLDLNLYGSHPFYLDVRSHSSDGKVKAGTTHGVLLLNSNGMDIVYGGDRITYKVIGGVFDLYFFAGSSPELVLEQYTQLIGRPAPMPYWSFVFGIAGKWHKCTTPKQLAMPLIELCSVATQIHTRTADSSRQRISFHQCRWGYKNVSDLEDVVANYAKAGIPLEVMWTDIDYMDAFKDFTLDPINFPLDKMRSFVDTLHKNGQKYVLILDPGISVNETYATYDRGLKADVYIKRNGNNYLGQVWPGPVYYPDFLNPRSQAFWGGEIKLFRDLLPIDGIWLDMNELSNFITSPPIPSSNLDNPPYKVNNVGDQRPINDKTVPATSLHFGNITEYNVHNLYGLLESKVTNKALKDITGKRPFILSRSTFVSSGKYAAHWTGDNAATWNDLAYSIPAILNSGIFGIPMVGADICGFEGNTTEELCGRWIQ

SEQ ID NO: 177470 - protein, 147 aa, Glycine max
  Coding DNA Sequence Number=SeqID_60692
MACPWRDDADEFGGRNHDEGEKREKRSGKMKEEPEKSYEHGYNTGYKKGYEEGYKQGCENSTRESEYGYNNDSGNYSVKSEYGYNNNSGNYTVKSEYVYNNNSGNTVNSEDAEYGHSSHNEYGCTYNSLSRYENALRDSGDRKNDCD

SEQ ID NO: 177471 - protein, 120 aa, Glycine max
  Coding DNA Sequence Number=SeqID_60693
MSTKRREDMIDVLVIRVSLCPHPINVPRAQTLFLEEEHHRREGLIPSLKMRFRKLSGRKNDKESPHLFSYRQRFLVTASKLKKKKKVTVVSEPIGFYKSRLTLELAKRLNDEIVRADSVQ

SEQ ID NO: 177472 - protein, 116 aa, Glycine max
  Coding DNA Sequence Number=SeqID_60694
MKVEGIRSVRMKLHDGAIRTFSNVRCVPSVVVNMISMREMTSQEYKYVGSKRGCKVYKGRYLVLQRQKNKGNICYLDDQVLKRNHDSKMKKKVKFSNVVEVLGDTSVGGGVCSFSN

SEQ ID NO: 177473 - protein, 83 aa, Glycine max
  Coding DNA Sequence Number=SeqID_60695
MVSHNQGLMLVSLLVQDCSLHGASFAFLGQELRKISKEAHVLPAILFVKATMKSRDVGKAYNECRQGEPAAERLLAMSRFKNK

SEQ ID NO: 177474 - protein, 115 aa, Glycine max
  Coding DNA Sequence Number=SeqID_60696
  Homolog annotation: Hit_ID=Q9LZB8; Match level="QueryCoverage=48%, HitCoverage=9%, E-value=9e-12, Identity=59%"; Hit description=ABC2 homolog 12
MSSKATSQINVIESRRGSRNIENCKTVDTDVKKSVQGNGEVGGFGGDSVRHVTGGHAFQVRELPVEDAVEDVEPEVVDGAERGLPKVGFGAVLAGVVVAVGGVMVVTVGGLEMEE

SEQ ID NO: 177475 - protein, 177 aa, Glycine max
  Coding DNA Sequence Number=SeqID_60697
  Gene Ontology: Mol. function=nucleic acid binding; Cellular component= RNA-induced silencing complex; Biological process=regulation of transcription, DNA-dependent
  Homolog annotation: Hit_ID=Q1SMQ6; Match level="QueryCoverage=98%, HitCoverage=18%, E-value=7e-69, Identity=72%"; Hit description =Tudor; Staphylococcus nuclease subtype
  Pfam annotation: Domain name=TUDOR; Domain location=60-175; Score =70.3; E_value=6.1e-18; Accession=PF00567.14; Description=Tudor domain
MAITLVKAGLAKLQTSFGNDRIPDFHLLEQAEQSAKKQKLKIWENYVEGEEVSNGVPAENKQQEVLKVLIIEVSGRGKFYVQLIEDQRIASIQQQLSFLNLQEARAFNPKKGDMVLCLFGADKSWYRAMVVNGPQGPVESSNDMFELFYIDYGNQEVVPYSHLQPIDPSVSVIPGIA

SEQ ID NO: 177476 - protein, 104 aa, Glycine max
  Coding DNA Sequence Number=SeqID_60698
MSFSVLIFVVLRLSHGNEVFADEIFLFMTLQKAMTGKDVDVHELGRLTVAWFLEDLGSMSLGAIGNQASEEPHFSLLLVFGGLELEPVGEDGSTPAHHPLGRHG

SEQ ID NO: 177477 - protein, 289 aa, Glycine max
  Coding DNA Sequence Number=SeqID_60699
  Gene Ontology: Mol. function=transporter activity; Cellular component= integral to membrane; Biological process=cell division
  Homolog annotation: Hit_ID=Q94C59; Match level="QueryCoverage=56%, HitCoverage=29%, E-value=2e-59, Identity=68%"; Hit description =Patellin-4
  Pfam annotation: Domain name=CRAL_TRIO_N; Domain location=92-176; Score=40.0; E_value=8.4e-09; Accession=PF03765.5; Description =CRALTRIO, N-terminus
MTAEVMAQEETQAAEVVVVAVAEPQKEKDAEENVEPREPSSVDETKPKTVEKSSSYKEESNYLSDLKEFERKALSELKSKLEEAILGNTLFDPKKEALPENEEKKNEGEEKEEEEEKKVEVEENDVSIWGVTLLPSKGAEGVDVVLLKFLRAREFKVNDAFEMLKKTLKWRKESKIDSVVDEDFGSDLASAAYMNGVDHEGHPVCYNIFGAFESEESYQKTFGTEEKRSEFLRWRCQLMEKGIQRLNLKPGGVSSLLQINDLKNSPGPSKLRVATKQTLAMFQDNYPEM

SEQ ID NO: 177478 - protein, 224 aa, Glycine max
  Coding DNA Sequence Number=SeqID_60700
  Gene Ontology: Mol. function=zinc ion binding; Cellular component =nucleus; Biological process=ubiquitin-dependent protein catabolic process
  Homolog annotation: Hit_ID=Q1S7F8; Match level="QueryCoverage=92%, HitCoverage=65%, E-value=1e-42, Identity=39%"; Hit description =Ubiquitin; Seven in absentia protein
  Pfam annotation: Domain name=Sina; Domain location=69-221; Score= -44.8; E_value=0.00069; Accession=PF03145.7; Description=Seven in absentia protein family
MAHPAVNGGGDNGVPMILTDPDVFVCCGCRDTLTIPIYECTKGHVILCSPCCNKHGYKCPFCSMFIGDKRCRAIEAVMESMKTVCCYAKHGCNAIVRYSEKRDHEKTCTFVPCLCPQPRCDWISNSNELGQHFKVKHFYKRIPFKYGEFFYVSLRRDTTTRVLQAVSDGKLFVISNDKREKKNSLILFHVGPNSWIPKFDYEVRATSDGAVLLPQTFVETTQGL

SEQ ID NO: 177479 - protein, 522 aa, Glycine max
  Coding DNA Sequence Number=SeqID_60701
  Gene Ontology: Mol. function=DNA helicase activity; Biological process=DNA modification
  Homolog annotation: Hit_ID=Q016M7; Match level="QueryCoverage=98%, HitCoverage=69%, E-value=1e-113, Identity=42%"; Hit description =Homology to unknown gene
  Pfam annotation: Domain name=Toprim; Domain location=204-284; Score =32.3; E_value=1.7e-06; Accession=PF01751.12; Description=Toprim domain
MELQLNILKKKLEAIGVETEMCEPGQYNHLLCPECLGGDQEERSLSLYIAPDGGSAAWNCFRGKCGWKGSTQAFAGSNSARTQLAPVKKIRKITEEELELEPLCDELVTYFSERLISKQTLERNGVKQRKYDDQFLYIKIPYDCLVSLIEKEIQKQTFEIVIAFPYHQNGGLISCKYRDINKMFWQEANTEKIFYGLDDIVGHNDIIIVEGEMDKLAMEEAGFFNCVSVPDGAPPSVSSKEELPPQDKATRVILATDGDPPGQALAEELARRIGKEKCWRVRWPRKSRSDNCKDANEVLMYLGPDALKEVIENAELYPIRGLFNFRDYFDEIDAYYHRTLGYDIGISTGWNNLNDLYNVVPGELTIVTGVPNSGKSEWIDALLCNLNEIAGWKFALCSMENKVREHARKLLEKHLKKPFFNERYGESVERMSVEEFEQGKLWLSDTFSLISSCQVDCNHCTIPTFGYTVLGYLVVDTRCEDNSLPNISWVLDLAKAAVLRHGVRGLVIDPYNELDHQRPPNQ

SEQ ID NO: 177480 - protein, 54 aa, Glycine max
  Coding DNA Sequence Number=SeqID_60702
MGLEQNTVKKGLWQGKRCRWEKRVFLRFGNGEEWKKGFMVFVSGSGREGFAVLV

SEQ ID NO: 177481 - protein, 619 aa, Glycine max
  Coding DNA Sequence Number=SeqID_60703
  Gene Ontology: Mol. function=sugar porter activity; Cellular component=membrane; Biological process=phosphoenolpyruvate-dependent sugar phosphotransferase system
  Homolog annotation: Hit_ID=Q016M7; Match level="QueryCoverage=14%, HitCoverage=12%, E-value=2e-21, Identity=56%"; Hit description =Homology to unknown gene
  Pfam annotation: Domain name=Toprim; Domain location=153-246; Score =23.6; E_value=0.00072; Accession=PF01751.12; Description=Toprim domain
  Subcellular localization annotation: CTP_CleavageSite=32; ConfidenceScore=5.34e-01
MAVSSSHSFPFLQVTSQNKTCSNSVIPKTMPRGAEQVVDSSFDAPKVKLLKQKMELLGINLEKSCLPGKFLNLVCFDMLVQRWAVKGEECFRAQCGWAGQVSADDKELYSGVCTNANLYRQLAEESLGLEPLGPEGKGADKILYGIDDISQASEIIIVEGEIDKLSLEEAGFQNCVSVPVGAPEKVSSKDLPPIEKDTAFRYLWNCKEYLDKAVRIILATDNDPPGQALAEELARRLGRERKAEPSNNDVVSSEHRNWSNIFKSLVQMVCSQQNQLHSFASRHKFLEDRLRMQHEGWVSDVRCHKDQISQMNGMLTFEEKKQSLEAAKADFALSLKHREAAMLKWILEHAEDELADFKAWFEILSCKSSNGEDQGTAFKDTDLKKKGSTDRGNMSTRNTAEKEKYSSENKDEFSRLKGEYDKLALEKYSEVTTLLAEKKFMWNQYNVMENDYADKLRTKEAEVEKANEKIKILVSSMEQLQSENYEKDSKISELQSKMAEMEAETKRLNNEISELSVELESLRKFRNSQVTPSVLNRCTEGTKAPESGVVKSNKSRRNMTLKKEICTPDAPVPAKSSEKGTKTKSMKRKEAPVIPTSETPKLFSSGFKVPKLKSSVRVT

SEQ ID NO: 177482 - protein, 333 aa, Glycine max
  Coding DNA Sequence Number=SeqID_60704
  Gene Ontology: Mol. function=5-formyltetrahydrofolate transporter activity; Cellular component=membrane
  Homolog annotation: Hit_ID=Q10ZJ4; Match level="QueryCoverage=92%, HitCoverage=65%, E-value=2e-25, Identity=26%"; Hit description =Folate/biopterin transporter
  Pfam annotation: Domain name=BT1; Domain location=2-333; Score=166.5; E_value=6.9e-47; Accession=PF03092.7; Description=BT1 family
  Pfam annotation: Domain name=MFS_1; Domain location=10-322; Score= -45.8; E_value=0.039; Accession=PF07690.6; Description=Major Facilitator Superfamily
  Pfam module annotation: Pfam domain module=BT1::MFS_1; Domain location=2-333::10-322
MSIFAISIYLLLSNLGASIAEVANDAIVAEMAKQTPSSTKHPQPSSSGNLQSFVWIASSAGGVLGNLLGGIFIGRFSPQSMFLYFGLLLALQFFITISVRESSLRLPKSPSGGIRKQLSQLLVALRKPEIAYSISWFTASYAIIPALTGTMFFYQTQYLKIDSSVLGISKVFGQATMLLWGIIYNQYFKSVSSRKLISAIQVMMAFLMVSDFLFVRGFYRQMGMPDSLYVVIFSGFLEVLFFFKILPFSVLIAQMCPPGCEGSVMAFLMSCVALAFIVSGYLGVALASCIKVTGNDFSGLPFGLLIQAACTLVPTFWSSCIPDKVESKAKRKD

SEQ ID NO: 177483 - protein, 116 aa, Glycine max
  Coding DNA Sequence Number=SeqID_60705
  Gene Ontology: Mol. function=5-formyltetrahydrofolate transporter activity; Cellular component=membrane
  Homolog annotation: Hit_ID=Q9SKZ5; Match level="QueryCoverage=73%, HitCoverage=16%, E-value=8e-10, Identity=37%"; Hit description =Expressed protein
MVASDGGGGGRLMKKVLGLGFWVQGFRCFPWLVVSFYLKDGLNVDPSTLQILQSSANLPMVGKPLYGLLSDSVYISGQHRVPYIALGVCCWFRDVGILESRIGSSFLSQMDKRIDE

SEQ ID NO: 177484 - protein, 66 aa, Glycine max
  Coding DNA Sequence Number=SeqID_60706
MEEMSIKKKREKFMKIQGKQNVGPRGVMTGQNPGDPFFALGLIQGKTDNILPVTSNHQYLTTLKNL

SEQ ID NO: 177485 - protein, 287 aa, Glycine max
  Coding DNA Sequence Number=SeqID_60707
  Homolog annotation: Hit_ID=Q1SPJ4; Match level="QueryCoverage=90%, HitCoverage=17%, E-value=2e-72, Identity=57%"; Hit description =Thiolase
MAPLRGLAPEGAEIRGWKIVIRSWKINNAGSKDTPKLYCDKEEFPYELLHPLEDCNVNSSLSFTLQICRVEDILVEGLIKGSIVHFHRARTISVESSRTISASRIGCTGGLGHGNTLSNGIGSGGGHGGTGGEAFYNDNHVEGGYSYGNATLPCELGSGSGNGNSTRTTAGGGIIVVGSLEHPLSSLSIQGYVKADGGNFEPQIRNEKFAIFDNFTGGPGGGFGGTILMFLHMLTIGKSVVLSSIGGYSSSNGSGGGGGGRIHFHWSDIPTGDVYLPIASVKGDIQI

SEQ ID NO: 177486 - protein, 111 aa, Glycine max
  Coding DNA Sequence Number=SeqID_60708
MDKDQWMYDSIISEEVDMDDQNEQECGVNEQHVDYLDAFNTSQTRSVAHENGFVAVIMRSDTNTGSRGRTSFVLISCERSGQYKCRKKDFVRRDTETRKCGCPFKLHGKPV

SEQ ID NO: 177487 - protein, 161 aa, Glycine max
  Coding DNA Sequence Number=SeqID_60709
  Gene Ontology: Mol. function=ATPase activity, coupled to transmembrane movement of substances; Cellular component=integral to membrane; Biological process=transport
  Homolog annotation: Hit_ID=Q9LZB8; Match level="QueryCoverage=98%, HitCoverage=42%, E-value=1e-17, Identity=53%"; Hit description=ABC2 homolog 12
VLPAILFVKANNEESCKNTRFKRLALVDYTARQKKKKMKALIPQIIQAIYFGVLSILKSQSRITQDVGKAYNECWQGEPAAERLLAMSRFKNKQLRSFLIASMNSLHLLTLFSGTVAANIGYRDLTTKIDMDRVKHASETAHADEFVKKLPEGYKINIGYL

SEQ ID NO: 177488 - protein, 480 aa, Glycine max
  Coding DNA Sequence Number=SeqID_60710
  Homolog annotation: Hit_ID=Q10KX9; Match level="QueryCoverage=38%, HitCoverage=46%, E-value=4e-71, Identity=69%"; Hit description =Expressed protein
  Subcellular localization annotation: CTP_CleavageSite=21; ConfidenceScore=5.05e-01
MAFHRASKAKPKSARSRILLLAAAVTAIALLLLFSSLLSTTVSKANLLQQPFEKYLYWGTRIDCPGKHCRSCEGLGHQESSLRCALEEALFLGRTFVMPSGMCINPIHNKKGILHSTNASSEELWDASSCAMDSLYDTELMSDTVPVILDNSKEWYRVLSTSMKLGARGVAHVGGVSRFELKENSRYSDLLLINRTASPLSWFMECKDRNNGSAIMLPYSFLPSMAAGKLRDAAEKDFLSLSLKHISFCGLACCNMSATAAAIAAGRSGAAPIRDVHVCSGAVSGHGWSGRYCGGAARVAERFFAPLLRSTVVLSGFGELEGLELKAVAAVFFDLVYRLVYVKSSLILVALATAPQVQENGIHPIMKLKMFFESLVILMKMKSCNLDAQNVLTYLAFLAVAQSRMLGFLLCAGFSEYVYHFGRSLSTTINFFPHSHLMSLCLGNTTGDGFATKVASNSLYIVDEEIDIEVEAMLCGVPCG

SEQ ID NO: 177489 - protein, 90 aa, Glycine max
  Coding DNA Sequence Number=SeqID_60711
MASPPQNSDLIFPAADVAGELNPGRNTHFHVDPTSSEVDASKEQAEAKQKKNERQKKDALQTIKSAIIISGIVVAVAGAAFAITKKLREK

SEQ ID NO: 177490 - protein, 217 aa, Glycine max
  Coding DNA Sequence Number=SeqID_60712
  Gene Ontology: Mol. function=calcium-dependent phospholipid binding; Cellular component=plasma membrane; Biological process=cell differentiation
  Homolog annotation: Hit_ID=Q94CK4; Match level="QueryCoverage=98%, HitCoverage=82%, E-value=1e-64, Identity=57%"; Hit description =Annexin-like protein
  Pfam annotation: Domain name=Annexin; Domain location=148-213; Score =49.7; E_value=9.9e-12; Accession=PF00191.10; Description=Annexin
  Pfam annotation: Domain name=Annexin; Domain location=3-54; Score =15.0; E_value=0.0018; Accession=PF00191.10; Description=Annexin
  Pfam annotation: Domain name=Annexin; Domain location=72-138; Score =33.3; E_value=8.5e-07; Accession=PF00191.10; Description=Annexin
  Pfam module annotation: Pfam domain module=Annexin::Annexin::Annexin; Domain location=148-213::3-54::72-138
ETPDYKVIIEIACTRTSEEFLAAKRSYQFQCKHCLEEDVASKTIGDFRRLLVVVTSAYRYDGDEFDENLAHSEANILHQVIENKAFNNDEIIRILCTRSKKQLCSTFIAFRNMYGTTITKGLSTDHPNDEYMEALRTVIRCIKNPRRYLAKVLYYALNDLIAEEHALSRVIISRAEKDLNEINDLYFQRNGITLDSSVAKKTSGNYMNFLLALLGNN

SEQ ID NO: 177491 - protein, 518 aa, Glycine max
  Coding DNA Sequence Number=SeqID_60713
  Gene Ontology: Mol. function=catalytic activity; Biological process =protein amino acid phosphorylation
  Homolog annotation: Hit_ID=Q6F3B8; Match level="QueryCoverage=66%, HitCoverage=88%, E-value=1e-80, Identity=44%"; Hit description =Expressed protein
  Pfam annotation: Domain name=DUF860; Domain location=149-481; Score =448.2; E_value=1e-131; Accession=PF05898.4; Description=Plant specific of unknown function (DUF860)
MRMIAPSIIVLLLNKHENKFSDPILLKEKGLGPNFVNFEKSARPINPGVATVSVRLRGPDLKGPYSIPNSKVKVMMELEVHENDLKAAGAELFAAGGRRGIRINGWVIETRRHSILNSSTLQEWESCLLKLYLTIDLERYSYVNVYMKWKKDSYYDSIEHIHYSVQLKPIIALKNCIVRDPNGCIPISAVSKRGLELDVPMKVARFMRQYPSIFEEFTGPEYNLPWFRLTPEVAEIDRDEKRVYEECREDLRSRLRKMILMTREHVLPLKIIQGMQWYLGLPSDLLQHPEQILDESFRFVEMEDGLKGLALESGEKIYSVMERNAMKSGFYSGGPMEAIEFPFFPSKGLRLRRKIENWLNEFQKLPYISPYDDFSNLDPNSDIADKRLVGVLHELLSLFVEHSAERKKLFCLKKYFGLPQKVHRAFERHPHMFYLSFRNKTCTVILKEAYSNKSAIEKHPLLRVRKKYIKLMKKSEVILRNRRVNNRFSNSNAKLDIDSNDIDEKGHEMASCSLEQVA

SEQ ID NO: 177492 - protein, 122 aa, Glycine max
  Coding DNA Sequence Number=SeqID_60714
  Gene Ontology: Mol. function=calcium-dependent phospholipid binding; Cellular component=cytoplasm; Biological process=negative regulation of coagulation
  Homolog annotation: Hit_ID=Q56D09; Match level="QueryCoverage=65%, HitCoverage=25%, E-value=4e-18, Identity=55%"; Hit description =Putative annexin
  Pfam annotation: Domain name=Annexin; Domain location=14-77; Score =67.0; E_value=6.1e-17; Accession=PF00191.10; Description=Annexin
MTTLIAAKDSSSIEDAENIRKACKGFGTDEAVLISILAHRNVAQKKLVRMAYEELYQEDLIQQFKSELSGSFEVKTLQFIAIVFAYLQNEITSSLSFYAHTWMGMNIFVEINFALANWLANG

SEQ ID NO: 177493 - protein, 73 aa, Glycine max
  Coding DNA Sequence Number=SeqID_60715
MTDKSVWADPGLAERRRLEGSVERKWGVDLGRQSVVRPFVRSDLDKQPCWMCEEFRQMSKNKDYRNCSIYYDF

SEQ ID NO: 177494 - protein, 194 aa, Glycine max
  Coding DNA Sequence Number=SeqID_60716
  Gene Ontology: Mol. function=oxidoreductase activity; Biological process=metabolic process
  Homolog annotation: Hit_ID=Q2CQH8; Match level="QueryCoverage=83%, HitCoverage=49%, E-value=2e-13, Identity=31%"; Hit description =Probable short chain dehydrogenase
  Subcellular localization annotation: CTP_CleavageSite=28; ConfidenceScore=5.20e-01
MALHSPRLLSLTRRAFSSSPSSFQGGVSMVQGASRGIGLEFVRFFSYLHINIAYLGTAHIVKIFIFNTAFSFFHLQVKQILEYDDKEHVIATCRNPSASTGLIHLKDKFADRLKILSLDLTVETSIEASALSIKETYGRLNLLINASGILSIPEVMHPETTLNKVEKSSLMLAYEVNAVGPILVIKRLHKNIIA

SEQ ID NO: 177495 - protein, 228 aa, Glycine max
  Coding DNA Sequence Number=SeqID_60717
MSKVEGFKYEELRMQRITENQAKIEALGLSKLAIIFKDRIQKAKKKDKKPIMMMKTMYLNMKGDLDQILSENYKNDKRDEFAATNDLKSRKRKVIKSSILNSKRVYNDSSIHHSLDKEVKESLPNNASHASELTNVEQVESNAGQHVIKKGRGHTINAKFQKKKENLMAKEKSIDIQFPPPFYKIYEKHAKYFKSETQVRIHQKAPLQVNGWSEISKDDVDEMWRHMK

SEQ ID NO: 177496 - protein, 44 aa, Glycine max
  Coding DNA Sequence Number=SeqID_60718
MVRWVIVLSLGVGAVKVMCRGLEVVDRGEFGCDNGKGVEAGGNC

SEQ ID NO: 177497 - protein, 210 aa, Glycine max
  Coding DNA Sequence Number=SeqID_60719
MAESLKKRKGSSSTTTAAGQRRHGTSVRVFYNNLKIQDRVIFSEVHQIPIIVDQSLFYSLTKLSSQGVPFEGTLVDDWKQVYSSHDARKMIDWAYLVRYRMHKALRANPPLPYPHLITLFLQHFNVPLEDEPFVKWVRKQHLPPPIPDERTLSPPPQRDTSSSLLTEVLTKLRDLRAFVGDRFDAMDSCITRLEDDMSFIQRCFDALDNS

SEQ ID NO: 177498 - protein, 69 aa, Glycine max
  Coding DNA Sequence Number=SeqID_60720
  Subcellular localization annotation: CTP_CleavageSite=46; ConfidenceScore=5.23e-01
RLFFAQPGGASGALSEFDSHSTHLYKSSSSRFFYALIQSCCTQWIMRSARGGWLSELQKSNFTKLAYFT

SEQ ID NO: 177499 - protein, 177 aa, Glycine max
  Coding DNA Sequence Number=SeqID_60721
MVAGVAVDVDIDDGQSKRLRGDDANDGENGECKKEPDRDKAIDHDCERSYGRHRKVEVACSSMRDFTSELPWEADMGSGADLGAGLGGMIMRDFITELPWEAAMGSDADLGARLGGMGAGHGIGVVIGRGVGIGASVGGGCTEEENGERWLDTMVSSFKIMASSLKIMEAWVAAKRS

SEQ ID NO: 177500 - protein, 312 aa, Glycine max
  Coding DNA Sequence Number=SeqID_60722
  Homolog annotation: Hit_ID=Q1SKA0; Match level="QueryCoverage=42%, HitCoverage=35%, E-value=9e-20, Identity=59%"; Hit description =Na+/H+ antiporter-like protein
MDSNATFGNACLLPMKATSNGVFQGDNPLDFALPLAILQICTNVGKTTLSAITINDIAAWVLLALAIALSGHDRSPLMSLWVFFVGGDFDICAILIVPPIFKWMSHRCHEGELVEEVYIYATLVVVLAVGFVSLLYDLQRRFLRVEHSIEGTWNPIWKMTTMHQTSSMSGGIVKFVERKRKGHWKYLFTVACEGSREGEGKKENRGRKEEIKHEASFSSITSSNNEWSGTFVACPVHHLMMRMTRVIKEERGSVCGCNPPLPLAAKVERVGGIVTGSGDIGGERTVSPMGMATPKLGLADRDGEIGQGQSRR

SEQ ID NO: 177501 - protein, 115 aa, Glycine max
  Coding DNA Sequence Number=SeqID_60723
  Pfam annotation: Domain name=zf-GRF; Domain location=20-65; Score =26.8; E_value=1.7e-05; Accession=PF06839.3; Description=GRF zinc finger
  Subcellular localization annotation: CTP_CleavageSite=30; ConfidenceScore=5.33e-01
MSQRSNASSSRTRVSSQVVLFCGCGRRAVRCVAGTNISRGRAFFTCSINKDEVGYCGYFIWVDQLIEALGVDDSLGTFSMEQRRQFGREEDKTMWKAQYVHFVAKLHKIQFCIRA

SEQ ID NO: 177502 - protein, 273 aa, Glycine max
  Coding DNA Sequence Number=SeqID_60724
MYTLLRILVTYFEGSIAEICYIIGAFHALSLSGLNGDPKKIVIKLKDLNYVNLDDSQELSSQTLNLTQLSAISQFSELERFLWNVKVISISEMNELKEMEFVPLLPLLATLLKGRMAGATLHAKNAIKKLKFRMSLLHVCIHGYKLEIKVEDKNNAKFIFWDDQCVKFMEKSVASQIQLMKDEGEDDLKVHLDPLDKMLECTLAMRIRMQPKGTSEAVNTLADVNQASQCDSTQSLSATADKDYHLKVSVMASYPKICFCITLVNKDLKAHQK

SEQ ID NO: 177503 - protein, 111 aa, Glycine max
  Coding DNA Sequence Number=SeqID_60725
  Homolog annotation: Hit_ID=Q1S4X4; Match level="QueryCoverage=93%, HitCoverage=73%, E-value=9e-22, Identity=73%"; Hit description=Fatty acid hydroxylase, putative
  Pfam annotation: Domain name=FA_hydroxylase; Domain location=15-111; Score=-10.7; E_value=2e-07; Accession=PF04116.3; Description=Fatty acid hydroxylase
MVVQNFVVDLNKALVFQVGHLGGAYEEWVHQPIVSNEGPRFFENEILEFWNLVKLMATPSTAPALFGGGLLGYVMYDCTHYYLHHGQPKTEVPRNLKSLEIEGHYSESEIQ

SEQ ID NO: 177504 - protein, 117 aa, Glycine max
  Coding DNA Sequence Number=SeqID_60726
MAVAECDDGVEGLDIEGDMVFGIGSESKLFNQICGFSDEGVRGGFRDESWFAFTIGVVRRVHGSQWDYPLEKFVGFQKFLVPTINILYLDQLRHKLDDGFIFGIFVGFVKFFNNIKC

SEQ ID NO: 177505 - protein, 378 aa, Glycine max
  Coding DNA Sequence Number=SeqID_60727
  Gene Ontology: Mol. function=oxidoreductase activity; Cellular component=membrane; Biological process=electron transport
  Homolog annotation: Hit_ID=Q9FI25; Match level="QueryCoverage=93%, HitCoverage=79%, E-value=4e-62, Identity=36%"; Hit description =Berberine bridge enzyme-like protein
  Pfam annotation: Domain name=FAD_binding_4; Domain location=28-158; Score=49.6; E_value=1.1e-11; Accession=PF01565.13; Description=FAD binding domain
MEKPIPLATMLPIVIVYLFSLHASCAAPTTESVHETFVDCLRNNIKTRSGGHGFEGRSYISDEPFIMLDMFNLRNITVDVQNEVAVVQAGATLGEVYYRIWEKSDVHGFPAGECHTVGVGGHFGGGGYGNMMRKYGLSIDHILDAKIVDVKSRILNKESMGEDLFWAIRGGGGATAVMTKFLGGTEELVSLLEKELPTLGLKKENCIEMSWIESAVWWDSFPNGAHPEALLGRKLNSAKFLKRKSDYVKTPISKDGLEWIWKKMIELRQTSMAFNPNDGRMNKISANATAFPHRQGNLFKIEYSVNWEEPGISAEKNFTIQIRRLHSYMTPFVSKNPRRAFLNYRDLDIGINHHDNNSSTKKGGFMVLSTSITTSTDW

SEQ ID NO: 177506 - protein, 390 aa, Glycine max
  Coding DNA Sequence Number=SeqID_60728
  Gene Ontology: Mol. function=protein serine/threonine kinase activity; Cellular component=integral to membrane; Biological process=protein amino acid phosphorylation
  Homolog annotation: Hit_ID=Q1S4Z2; Match level="QueryCoverage=97%, HitCoverage=54%, E-value=8e-66, Identity=38%"; Hit description =Protein tyrosine kinase, putative
MVLKRVYMVILLIWCIYPLESVIPPHRYRNQNQTIARHGCNPKCGNVTVFFPFGMDDPKCYASKPFEIECRHNNNTSQGHRKPVPYLKYISLEVMYIDIQDGTVGIKNPIFHLGCGKTITGINLEGSPFVYSQNYNSFVGVGCQNAAILSSNDTILTALTACVSMCYDDLEKGNDIDISSCRGSYCCETSLPPYLSAYNISTETVEVKSNIKAECSNYLLIRAEYSNFKYVYDEYNSSYWVPILGDLKKQKDVPAVLEWEIPIHTPNNSFPEFRTDGSYNCSYTNVTSSLYSQSGWRCSCRDGFEGNPYVRGGCTALPDYNKNLTKKWAIVGVSSSLGSIILLLCLWLLYKVQRMSSNEVNVDRAILFSLKDLEKATDRFNMNRFLGREP

SEQ ID NO: 177507 - protein, 112 aa, Glycine max
  Coding DNA Sequence Number=SeqID_60729
  Gene Ontology: Biological process=electron transport
  Homolog annotation: Hit_ID=Q1S4Y9; Match level="QueryCoverage=58%, HitCoverage=19%, E-value=1e-15, Identity=43%"; Hit description =Berberine and berberine like, putative
  Pfam annotation: Domain name=BBE; Domain location=41-70; Score=12.1; E_value=0.002; Accession=PF08031.2; Description=Berberine and berberine like
MAEIPHRKGKLFKIQYTVNWVDPSPCAAKNFTNQARKLYSYMAPFLFQRLVKVKTAVDPGKFFRSEQNVPRGDAEHGTATVAFTATPTGTHSMWRLLTRPSEADRHQRSSVT

SEQ ID NO: 177508 - protein, 108 aa, Glycine max
  Coding DNA Sequence Number=SeqID_60730
  Homolog annotation: Hit_ID=Q1SRT2; Match level="QueryCoverage=36%, HitCoverage=11%, E-value=1e-10, Identity=73%"; Hit description=Amino acid/polyamine transporter II
MAYNGAGPIGGSGSTLTIKQVFTWYGATIEMDGATETDYTADEEKLCSMLKDVLKSEPKLFLMASATGIYLLSNPNGTMKLYEFVVIFGYFMLILAQMPHINLVSLVM

SEQ ID NO: 177509 - protein, 424 aa, Glycine max
  Coding DNA Sequence Number=SeqID_60731
  Gene Ontology: Mol. function=protein serine/threonine kinase activity; Cellular component=integral to membrane; Biological process=protein amino acid phosphorylation
  Homolog annotation: Hit_ID=Q1S4Z2; Match level="QueryCoverage=99%, HitCoverage=61%, E-value=1e-130, Identity=56%"; Hit description =Protein tyrosine kinase, putative
MILQLIPFSIIVLIIFPLASETYQIIAKPGCNSTCGEVSIPYPFGMKDPECYADGWFEIECKDTSQGQKPYLKSLNLQVTSISDFLGLVTIMNPIYRWNCPSKRAMPAIKDLRGSPFVYSQESNKFVAVGCNNLAFLKSGGDTVGGCVSICDNNEEFKNMDFISSDGCHGRYCCETSLPNYLSEYNATLQDFNNQNSSVESHQCSSAFIVNKYWSQRYYMPHLNNMDYVDAVLEWEILNNTLSDSVLQFLSDHARCHGSNVTSSFTRVSGYTCRCIQGYQGNPYVRGGCTALPDYNKNLTKKWAIVGVWSSLGSIILLLCRWLLYKVVRKRMIKKRKQKFFKKNGGLLLQQRMSSNEVNVDRAILFSLKDLEKATDRFNMNRILGKGGQGTVYKGMLVDGKIVAVKKFKVEGNVEEFINEFVIL

SEQ ID NO: 177510 - protein, 103 aa, Glycine max
  Coding DNA Sequence Number=SeqID_60732
MHTRARFPPCRYKKTSADHAHQHDHPYVDDVAIWQHSAQRPQCQSPPADVSVGLCRHDIGKDRAHETPSGPKEVQQGPGVSSSGYGPLSVLPGARSPSEVMPS

SEQ ID NO: 177511 - protein, 70 aa, Glycine max
  Coding DNA Sequence Number=SeqID_60733
MGVQIVISNLGPSRGFWAISCLRLNLLPLFPINRLKGVVLRIPDAPGFRKQIREGFPPLFTVLRFLQSST

SEQ ID NO: 177512 - protein, 107 aa, Glycine max
  Coding DNA Sequence Number=SeqID_60734
MREKERERGRETERGRERRRVTNRDRRNERWSETDTARTSVKQRSMKVMQKSSLAGRQSQNLEIGDNNKHYRLNWRNNADITSFYFTHFPDEANEELLWRHFKNWGD

SEQ ID NO: 177513 - protein, 75 aa, Glycine max
  Coding DNA Sequence Number=SeqID_60735
  Homolog annotation: Hit_ID=Q1T1X0; Match level="QueryCoverage=80%, HitCoverage=9%, E-value=5e-08, Identity=51%"; Hit description=IMP dehydrogenase/GMP reductase
MMKTPPVQDYIGNGDLPPDRIRSALVGNDFKKLYKQGRFEEALALYDRAIAIDSKKATYHCNKSAALISLGRFLQ

SEQ ID NO: 177514 - protein, 646 aa, Glycine max
  Coding DNA Sequence Number=SeqID_60736
  Gene Ontology: Mol. function=cellulose synthase (UDP-forming) activity; Cellular component=membrane; Biological process=cellulose biosynthetic process
  Homolog annotation: Hit_ID=Q1T0J4; Match level="QueryCoverage=99%, HitCoverage=62%, E-value=0.0, Identity=69%"; Hit description=Zinc finger, RING-type; Cellulose synthase; Zinc finger, FYVE/PHD- type
  Pfam annotation: Domain name=Cellulose_synt; Domain location=213-646; Score=480.5; E_value=2.1e-141; Accession=PF03552.5; Description =Cellulose synthase
  Pfam annotation: Domain name=PHD; Domain location=8-57; Score=7.5; E _value=0.01; Accession=PF00628.19; Description=PHD-finger
  Pfam annotation: Domain name=zf-C3HC4; Domain location=9-54; Score =6.8; E_value=0.031; Accession=PF00097.15; Description=Zinc finger, C3HC4 type (RING finger)
  Pfam module annotation: Pfam domain module=Cellulose_synt::PHD::zf -C3HC4; Domain location=213-646::8-57::9-54
VTELSGQICQICGDELEVTVNGEPFVACNECAFPVCRPCYEYERREGNQVCPQCKTRYKRIKGSPRVEGDEEEDDTDDLESEFDIGSVFSARLNYGSQVNGSVIHAPSEFDAASVASEIPLLTYGQEDVGISADKHALILPPFTARGKRVYPMPFPDSSVPVSLFNVTINDGDAVQPRPMDPKKDIAVYGYGSVAWKERMEDWKKKQSEKLQVVRHEGDKDSDELDDPDLPKILHPVNDAYALWLTSVICEIWFAVSWIFDQFPKWSPILRETYLDRLSLRYEKEGKPSQLSDIDVFVSTVDPMKEPPLITANTVLSILAVDYPVDKVACYVSDDGAAMLTFEALSETSEFARKWVPFCKKFCIEPRAPEWYFAQKVDYLKDKVDATFIRERRAIKREYEEFKVRINALVALAQKVPEDGWTMQDGTPWPGNNVRDHPGMIQVFLGQNGVRDIEGNELPRLVYVSREKRPGYDHHKKAGAMNALVRVSAIITNAPYVLNVDCDHYINNSKALREAMCFMMDPTSGKKICYVQFPQRFDGIDRHDRYSNRNVVFFDINMKGLDGIQGPIYVGTGCVFRRQAFYGCDAPTSKKAPRKTCNCWPKWCCCLCCGSRKKKIKAKSSVKKKIKNKDDLKQMHALENIEEGIE

SEQ ID NO: 177515 - protein, 201 aa, Glycine max; identical to SEQ ID NO: 174394
  Coding DNA Sequence Number=SeqID_60737
  Homolog annotation: Hit_ID=Q84VH5; Match level="QueryCoverage=85%, HitCoverage=29%, E-value=1e-73, Identity=73%"; Hit description =Envelope-like protein

SEQ ID NO: 177516 - protein, 94 aa, Glycine max
  Coding DNA Sequence Number=SeqID_60738
  Gene Ontology: Cellular component=integral to membrane
  Homolog annotation: Hit_ID=UPI00005F9823; Match level="QueryCoverage =100%, HitCoverage=25%, E-value=2e-34, Identity=69%"; Hit description= COG2199: FOG: GGDEF domain
MTVVIVVGLEVIDIQQQHKVAAGMIFHDGIQPVLQPAPVIQAGERIKHAQIAKTLLLLIQLAHQPQGEGVEAAAHQMVQREADQRQRNGEQNGH

SEQ ID NO: 177517 - protein, 270 aa, Glycine max
  Coding DNA Sequence Number=SeqID_60739
  Gene Ontology: Mol. function=signal transducer activity; Cellular component=integral to membrane; Biological process=regulation of transcription, DNA-dependent
  Homolog annotation: Hit_ID=Q9X5X6; Match level="QueryCoverage=39%, HitCoverage=27%, E-value=4e-30, Identity=64%"; Hit description=HmsT
  Pfam annotation: Domain name=GGDEF; Domain location=1-106; Score =36.5; E_value=8.7e-10; Accession=PF00990.12; Description=GGDEF domain
MGDQALARVSVAIRDAVRSRDVVTRYGGEEFLVLMTNVNASIAMKLAERIRQYVVDLEIPHRFNDKVSTHVTISAGIAPIFAEDFDQAVANADRALYVAKNQGRNTILAWEDLPKLAPVSSDLVSRMAIITRQDHRFSAHPLIFMQSDRSLASALEDLMCDQRSYMRENVKLGQPAPAGTLTLAEWSTPFHYRRLTQRYSDYLYRHHPDVPQEAKPLQSLWAQWSRARSTARRSVSTLSSTKTAIRAPSGLMCRRMRMRAISIRSSVSNA

SEQ ID NO: 177518 - protein, 48 aa, Glycine max
  Coding DNA Sequence Number=SeqID_60740
MEVHVEMGCIVEAEVAQVSLDSDHGVVIEVGGCLINIVKRQRRCMPKH

SEQ ID NO: 177519 - protein, 233 aa, Glycine max
  Coding DNA Sequence Number=SeqID_60741
  Gene Ontology: Mol. function=nucleic acid binding; Cellular component= nucleus; Biological process=DNA integration
  Homolog annotation: Hit_ID=Q1T010; Match level="QueryCoverage=91%, HitCoverage=16%, E-value=3e-52, Identity=46%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MWLYLIKTKSETLKIFQRIFGSLCFSHVPNQRKRKLQDKSEPMILVGYHPTSGYRMYEPVKYIVVISRDAIVVEIDFWDWKNKSKSLPQISSSILDELGNQTDEEVITETSIIENQLQPRRVQRNSQLPLRFVDHEVFPYNAGNNECDLVHFSLFVNNKPLNLEESMKKQAWKKATVEELRSIEKNQTWELINLPPDKHPIIVKWVYKLKWNPDGLIIKHKERLVAKGFFQRK

SEQ ID NO: 177520 - protein, 61 aa, Glycine max
  Coding DNA Sequence Number=SeqID_60742
MDTHLHVIGDLMNGVQRYKKTSLNESDDNYCRGGGHKPLFEDSPSECGGGAATVRYGLISK

SEQ ID NO: 177521 - protein, 164 aa, Glycine max
  Coding DNA Sequence Number=SeqID_60743
  Subcellular localization annotation: CTP_CleavageSite=31; ConfidenceScore=5.34e-01
MNVGALVSRQITLMAQSNSSRLGFPVLIIALCMARGDPMVSFLGTRKARARGSEGPSSAAPQTSTAPAPIPSAPVPATSDPSAQSIDLMMAFTRPEVQPSSHVGGEASIAQEPQPNPKTTPAAQEDDLEATPPYTPLGSLAGTPMLHFTDDEAMDQDPPHDQSQ

SEQ ID NO: 177522 - protein, 119 aa, Glycine max
  Coding DNA Sequence Number=SeqID_60744
  Subcellular localization annotation: CTP_CleavageSite=67; ConfidenceScore=5.12e-01
MTQTVYTDNRLGISTCHPTSWVRMTKVLKTILGIFASHPTSRVRMTQTVCTDNRLGITACHLTSLVRFTKVQKMTLGISACHPTSRVRMTQTVCTDNRLGISTCHPTSWVRITKVQKMT

SEQ ID NO: 177523 - protein, 98 aa, Glycine max
  Coding DNA Sequence Number=SeqID_60745
MTISPCGNINWSVSFRHRDRAHKTPSGPGEVQQGPGVSSSGCMPLDRARKTHSGSKEFYEAPVAPNKALRPPINRVFIKKYYTPKQAQGETPQQPGDG

SEQ ID NO: 177524 - protein, 110 aa, Glycine max
  Coding DNA Sequence Number=SeqID_60746
MLRNLTNYVIIPLLPSGTLRNFTDCVLTLPFNFRHVTKLHGLCYNAFLLASGMPRNFTNCLTMGAKYLKVVERGSHPTTDGPRTKLGTFPLSPNRWPNPDRYHVQPFYKP

SEQ ID NO: 177525 - protein, 100 aa, Glycine max
  Coding DNA Sequence Number=SeqID_60747
  Subcellular localization annotation: CTP_CleavageSite=43; ConfidenceScore=5.44e-01
MHTQSFTIPQFPKIGPTHKNCPQWSCQLSQPTLLRANEARLTGASSKGGKCTESPPTFICGKRWKNRRKPAIKNIPDLGVVFTFEKGISTSHVCPKGQQP

SEQ ID NO: 177526 - protein, 143 aa, Glycine max
  Coding DNA Sequence Number=SeqID_60748
  Gene Ontology: Mol. function=sequence-specific DNA binding; Cellular component=intracellular; Biological process=regulation of transcription, DNA-dependent
  Homolog annotation: Hit_ID=Q942Y5; Match level="QueryCoverage=65%, HitCoverage=53%, E-value=2e-41, Identity=83%"; Hit description =Putative HAP3-like transcriptional-activator
  Pfam annotation: Domain name=CBFD_NFYB_HMF; Domain location=21-86; Score=125.5; E_value=1.5e-34; Accession=PF00808.13; Description =Histone-like transcription factor (CBFNF-Y) and archaeal histone
  Pfam annotation: Domain name=Histone; Domain location=18-89; Score =16.5; E_value=0.0032; Accession=PF00125.14; Description=Core histone H2AH2BH3H4
  Pfam module annotation: Pfam domain module=CBFD_NFYB_HMF::Histone; Domain location=21-86::18-89
MEDSIGGSSSNDNNIIKEQDRLLPIANVGRLMKQILPQNAKISKEAKETMQECVSEFISFVTSEASEKCRKERRKTVNGDDICWALATLGFDDYAEPMRRYLHRYREVEVDHNNKVNLQERENNSPEEKDDEVFQLSNRGVRF

SEQ ID NO: 177527 - protein, 272 aa, Glycine max
  Coding DNA Sequence Number=SeqID_60749
  Gene Ontology: Mol. function=kinase activity; Biological process =carbohydrate metabolic process
  Homolog annotation: Hit_ID=Q1SCC6; Match level="QueryCoverage=85%, HitCoverage=47%, E-value=1e-101, Identity=80%"; Hit description=CBS
ALNWRGIHLNLQRGSRSCDEVWCLEGILKVALNSRLNVWSEHGFCKGCCGWCGRDSANSHAFCVAIWRKECVSQWFFHTFWSERWLELLPMSPVEGCPTVFQVIYNLPPGYHQYKFFVDGEWRHDEHQPYVPGEYGIVNTVLLATDPNYMPVLPPDVASGNSMDVDNDAFRRMARLTDGTLSEVLPRISDTDVQISRQRISAFLSSHTAYELLPESGKVVALDVDLPVKQAFHILHEQGVFMAPLWDFCKGQFVGVLSASDFILILREIEEV

SEQ ID NO: 177528 - protein, 234 aa, Glycine max
  Coding DNA Sequence Number=SeqID_60750
  Gene Ontology: Mol. function=kinase activity; Biological process =carbohydrate metabolic process
  Homolog annotation: Hit_ID=Q1SCC6; Match level="QueryCoverage=97%, HitCoverage=40%, E-value=7e-86, Identity=72%"; Hit description=CBS
MHAGPYDNLKDIAMKILQKEVSTVPIIHSSSEDASFPQLLHLASLSGILKCMLDPYQIDFSGICRYFRHCSSSLPVLQLPICAIPVGTWVPKIGESNRRPLAMLRPTASLASALNLLVQGVNFLSDPEHSVSKRKATERKDEEIAQVSSIPIVDDNDSLLDIYCRSDITALAKNRAYTHINLDEMTVHQALQLGQDAYSPYELRSQRCQMCLRSDPLHKVMERLANPGVLVFPF

SEQ ID NO: 177529 - protein, 86 aa, Glycine max
  Coding DNA Sequence Number=SeqID_60751
  Homolog annotation: Hit_ID=Q1SCC6; Match level="QueryCoverage=33%, HitCoverage=6%, E-value=7e-07, Identity=89%"; Hit description=CBS
MLESGVRRLVIVEAGSKRVEGIVSLSDIFKFFIGDFRLRKRPVNSEYLIAQNLFISPHSYYLQMYCAPDIDTSKVGEHNFCNHSML

SEQ ID NO: 177530 - protein, 34 aa, Glycine max
  Coding DNA Sequence Number=SeqID_60752
MWDRHKLQGALKPGVFTPKTYTPKSPSGPLPPDS

SEQ ID NO: 177531 - protein, 141 aa, Glycine max
  Coding DNA Sequence Number=SeqID_60753
MDRDTLGYSGQRGSRNLRGLMSGDYSTFGAIIWRGGRLTYITNNSQHTKRAGIDEDMTKSKGKDPLEGLGGPMTRARARKAKEALQQVLSILFEYKPKFQGEKSKGPIGNLGISLLGDQMVADLLAVGGLILDDPKSALVP

SEQ ID NO: 177532 - protein, 56 aa, Glycine max
  Coding DNA Sequence Number=SeqID_60754
MSIGFNDEICAFSGESGRASGSRPRAKRKISVLSTAGVFSQAQRTTGAKLESTYPR

SEQ ID NO: 177533 - protein, 100 aa, Glycine max
  Coding DNA Sequence Number=SeqID_60755
MHRAHPVEVTKDRGVHLDMSSEEMEEWKTHPIAKKSQVLTMLSTSRHLWAQCSTQREQVTEDRGDHLDMSSKEMEEYRELLRQLESTFEEESNGSPKDAF

SEQ ID NO: 177534 - protein, 88 aa, Glycine max
  Coding DNA Sequence Number=SeqID_60756
YGKTENNKQYPPLQIHAFVKWWSQFDTSKAAPEQVKNWFQSNPEFLKPADPETSLFLNQKSQLAAFLASSKSKESLAQNLKEVLQLLQ

SEQ ID NO: 177535 - protein, 120 aa, Glycine max
  Coding DNA Sequence Number=SeqID_60757
  Homolog annotation: Hit_ID=Q00RU6; Match level="QueryCoverage=41%, HitCoverage=4%, E-value=9e-07, Identity=52%"; Hit description=[J] KOG0465 Mitochondrial elongation factor
MGLDADALDDIDKDEGVIAESGSGGDLDVEVDVVRHVKHPDYDDTVHTVSDDDTANTGNWPVVLGAVVVFEGRVLWWGWLGFFVGKGVFRDWDWWLWSGGDGGGKICGWRHLFWRGLFSV

SEQ ID NO: 177536 - protein, 175 aa, Glycine max
  Coding DNA Sequence Number=SeqID_60758
MPMTYLLVNCLPLFMKGDAFVVKILEYEYQVGLESWKNNLHGRMVLTKAQEPIKLQDPHLVYKKLSAFCDSCKVVGHSFLECQLLKKPTLESEKDTHYVPKQKGIVIGNSEKQKDFVTDNSKKAGPSHVNMNVMVANSVEVVHEKALEEVLDNYGCTDAGGRVIEMVQAIKDDSL

SEQ ID NO: 177537 - protein, 139 aa, Glycine max
  Coding DNA Sequence Number=SeqID_60759
  Homolog annotation: Hit_ID=Q1SKD7; Match level="QueryCoverage=73%, HitCoverage=26%, E-value=2e-08, Identity=30%"; Hit description =Ankyrin
AEHQQRFETIKGWSFHRERRVQLRDDEYIDFLEEIACRRWTSLVTPMAKFDPDIVLEFYVNAWPTEEGVRDMRSWVRGQWIPFDADALSQFLGYPLVLEEGQECEYREAPAEAPGDADETRMDEEMIDLLDFLGRSGAT

SEQ ID NO: 177538 - protein, 585 aa, Glycine max
  Coding DNA Sequence Number=SeqID_60760
MSSFLSNSTIDMGGSDSGDMIEQPMMNREVISIGASSSEDTHHGASDNKSFSSERLFLVTLILPPSASGGVRRGSGGGDVRVSTFVQRSHSVGSLSSQPAIASCEWVRDDVLKYKSSLTSMASVVALQRQGGIGQLPSKIGWVSFNSVSKKLFEFDSNVFRCFKDHFFKVLATDVMDLLTLVEKVDKAILEQLPASLDAPAILSLPLVSNPLIALDGIVGDFTLRPLMKGQLTGEVSSIVIVAEVTSSTPSSILAKRNEMKAARLTLGAGCPSIVQDVPLAPPVIEALAADTTTPATSVVVVIVPITLVGPIVVSPSTVTTPLLSAVVATISAPIVPPPPSSTPPVPPSTVWLDQKTPTGFVLAFDKSLIGLAGVQNTMDSTISFAEVVRSNFKSCANLSSKVEGIAAKKDELEKVVADLEAMLKELEFRLEKEASKELEEELLIYKKEAMEKYEKGFSKAIRHAGVLLDQEEIAVEKEAVDEERGAEEKQDLVNVEGFLLLCKASTLMVVRSMFDLSLVEGLANQCGGRSLDMLSFSFDGYEENDSPRVNLGFVKPWTGDVCCPGFCQAYEATSRLIGDEPWIL

SEQ ID NO: 177539 - protein, 274 aa, Glycine max
  Coding DNA Sequence Number=SeqID_60761
MDGEVPTEPRTLPEFRQGSNWRPFTYTHDLSVFSHCGIRLGRLPASGLYPLSCKAKEWTSIRMDNVGGDLKSLESFPIHDINGTALINEDLGHHEVCNNDGDNHGVVLVDRVDTLEVVAHAIIVGVSVYLGLPLYLFFCLLLGSYAAPLVVLQTSQGSQGHAMRSVSCILCIEAFNEGVEAVYGPSQEGIQVLIWICGLIIPLKVEWFLPQGYVSLHNVVDEVMPMSSPPYWTMHPLADHGQPFAFSSPPCGITPSNTVGTKCIYQNPELGHIK

SEQ ID NO: 177540 - protein, 102 aa, Glycine max
  Coding DNA Sequence Number=SeqID_60762
MAAILEALQALEKKSFERTPSMSKEEQTITLTASGATIGSTADLVQNMSQPQNNNLASQGNSLNYQDTTNTHQVAVEGRSYDIRDVVDLCLVPDKVIAPEFK

SEQ ID NO: 177541 - protein, 432 aa, Glycine max
  Coding DNA Sequence Number=SeqID_60763
  Gene Ontology: Mol. function=nucleoside-triphosphatase activity; Cellular component=integral to membrane; Biological process=protein catabolic process
  Homolog annotation: Hit_ID=Q6H6R9; Match level="QueryCoverage=78%, HitCoverage=41%, E-value=1e-145, Identity=78%"; Hit description =Putative cell division protein FtsH3
  Pfam annotation: Domain name=AAA; Domain location=1-95; Score=12.5; E_ value=2.4e-05; Accession=PF00004.19; Description=ATPase family associated with various cellular activities (AAA)
  Pfam annotation: Domain name=Peptidase_M41; Domain location=102-319; Score=118.0; E_value=2.6e-32; Accession=PF01434.8; Description =Peptidase family M41
  Pfam module annotation: Pfam domain module=AAA::Peptidase_M41; Domain location=1-95::102-319
MDGFDSNSSVIVLGATNRSDVLDPALRRPGRFDRVVMVEAPDRIGREAILKVHVSKKELPLAKDVDLSGIACMTTGFTGADLANLVNEAALLAGRQNKVVVEKLDFIQAVERSIAGIEKKTAKLRGSEKAVVARHEAGHAVVGTAVAKLLPGQPRVEKLSILPRSGGALGFTYIPPTTEDRYLLFVDELHGRLVTLLGGRAAEEVVFSGRVSTGALDDIRRATDMAYKAIAEYGLNQTIGPVSIATLSSGGIDESGGAVPWGRDQGHLVDLVQKEVQTLLQSALAVALSIIRANPTVLEGLGADLEEKEKVEGEELQKWLRLVVAPTELDAFVKGTQPPLLPSQTVPYLNPYFKLLPTNTVPHKVRFTPFHASSSWLPLTMSSLCIEKPRSTMDRCCGRGECDNNEELQEVSVPDNSSLMPPSLAIDHNDRT

SEQ ID NO: 177542 - protein, 571 aa, Glycine max
  Coding DNA Sequence Number=SeqID_60764
  Gene Ontology: Mol. function=thiamin-phosphate diphosphorylase activity; Cellular component=intracellular; Biological process =thiamin biosynthetic process
  Homolog annotation: Hit_ID=O82392; Match level="QueryCoverage=86%, HitCoverage=77%, E-value=0.0, Identity=93%"; Hit description =Putative thiamin biosynthesis protein
  Pfam annotation: Domain name=ThiC; Domain location=21-444; Score =1151.6; E_value=0; Accession=PF01964.9; Description=ThiC family
LPQLRKEWVDRREKLGYPRFTQMYYAKQGIITEEMLYCATRENLDPEFVRSEVARGRAIIPSNKKHLELEPMIVGRNFLVKVNANIGNSAVASSIEEEVYKVQWATMWGADTAMDLSTGRHIHETREWILRNSAVPVGTVPIYQALEKVNGIAEDLNWEVFRDTLIEQAEQGVDYFTIHAGVLLRYVPLTARRMTGIVSRGGSIHAKWCLAYHKENFAYEHWDEILDICNQYDVALSIGDGLRPGSIYDANDTAQFAELLTQGELTRRAWEKDVQVMNEGPGHIPMHKIPENMQKQLEWCSEAPFYTLGPLTTDIAPGYDHITSAIGAANIGALGTALLCYVTPKEHLGLPNRDDVKAGVIAYKIAAHAADLAKGHPYAQAWDDALSKARFEFRWMDQFALSLDPMTAMSFHDETLPADGAKVAHFCSMCGPKFCSMKITEDVRKYAEEHGYGTDEALQRGMDAMSAEFQAAKKTISGEQHGEAGGEIYLPEEYVSSKRDPTIEGLGRFIRLVQSSSEGKGLLLHQDLNGANQLEELGASFPTGLSGCGEALLSLRNRRDTCLLLFGLLVY

SEQ ID NO: 177543 - protein, 95 aa, Glycine max
  Coding DNA Sequence Number=SeqID_60765
MLNPTQFQAKKEKVQVVDDSLSEADSLSEWHPLSEAYNSLNRREDFEMLLNGSLSEPDWLSKAHPLSEEVSLLSESKPKRMLSRRAARLARSQPA

SEQ ID NO: 177544 - protein, 87 aa, Glycine max
  Coding DNA Sequence Number=SeqID_60766
MKIRAYSVQLNDTAGIPSMIIQLHSDQLNKICRTIVYKPLLFKTKEKLFWYFLTIYIPYTLLLIDNETLPTKKKYNSKVCKSQEPAT

SEQ ID NO: 177545 - protein, 128 aa, Glycine max
  Coding DNA Sequence Number=SeqID_60767
MESGDNVQPKKGWEKPMDVVHPHVKFTTSADFSACNMASIIMSFAPATGRVFAATAAKGAGGSKEEKGLLDWILGGLQKEDQLLETDPILKKVEEKNGGTTSNTGRNKNSVAVPQKKKGGFGGLFAKN

SEQ ID NO: 177546 - protein, 90 aa, Glycine max
  Coding DNA Sequence Number=SeqID_60768
  Gene Ontology: Mol. function=sequence-specific DNA binding; Cellular component=nucleus; Biological process=regulation of transcription, DNA-dependent
  Homolog annotation: Hit_ID=O81662; Match level="QueryCoverage=70%, HitCoverage=29%, E-value=3e-24, Identity=89%"; Hit description =Transcription activator
  Pfam annotation: Domain name=SRF-TF; Domain location=26-76; Score =116.0; E_value=1.1e-31; Accession=PF00319.9; Description=SRF-type transcription factor (DNA-binding and dimerisation domain)
MVFDLSQQQKELKEEIIMVRGKTQIKRIENATSRQVTFSKRRNGLLKKAFELSVLCDAEVALIIFSSSGKLYEFASSSCHKHENTVGDTG

SEQ ID NO: 177547 - protein, 67 aa, Glycine max
  Coding DNA Sequence Number=SeqID_60769
MEMGESALLKNALWEEQTLCLKLIRRGMKLKEEDLKCFGGKLMQKLEEKSLKKKLEELDNSLSAHPH

SEQ ID NO: 177548 - protein, 139 aa, Glycine max
  Coding DNA Sequence Number=SeqID_60770
  Gene Ontology: Mol. function=nucleic acid binding
MEQGKFMFKFFHIMDLDKTYNGGPWNFNGHMLVLNKVPTGDITLNPIVSYSPVSSRTHLGNFIGKFQEYDPKNNTGGWQTFMRIKVRVDVQEPLKQGKKVRKLGAFCPAIFDKGVDDGRRDWSIELRDDLRGREVVDNT

SEQ ID NO: 177549 - protein, 356 aa, Glycine max
  Coding DNA Sequence Number=SeqID_60771
  Gene Ontology: Mol. function=transporter activity; Cellular component= integral to membrane; Biological process=transport
  Homolog annotation: Hit_ID=Q9SDI4; Match level="QueryCoverage=64%, HitCoverage=43%, E-value=1e-118, Identity=87%"; Hit description =Putative solute carrier family 17 (Anion/sugar transporter), member 5
  Pfam annotation: Domain name=MFS_1; Domain location=42-349; Score =110.2; E_value=5.8e-30; Accession=PF07690.6; Description=Major Facilitator Superfamily
MVTRYWTIRRCLNLANFVFEMSSPLHEDSVLDMVGYPKSHELTSWGWVNMSIAILPMSAEYNWNPSTVGLIQSSFFWGYLLTQIAGGIWADTVGGKQVLGFGVVWWSVATALTPIAAKLGLPFLLVARAFMGIGEGVAMPAMNNILSKWVPVSERSRSLALVYSGMYLGSVTGLAFSPFLIHQFGWPSVFYSFGSLGTVWFSVWLSKAHSSPLEDPELRPEEKKLITTNCSSKEPVKTIPWRLILSKPPVWALIVSHFCHNWGTFILLTWMPTYYNQEKFLGNHTLKYILHRLVLGIMCYNGQRGRGKAGDITDSKVANHANDEDLGPEVGGYELVALTFVPINEIFVPFQNKNAG

SEQ ID NO: 177550 - protein, 56 aa, Glycine max
  Coding DNA Sequence Number=SeqID_60772
MGAEHGVVEGGEKQEIMALPLIVASAKEQDEDFYQHWLSFLHVDTAYRTRPLHLGD

SEQ ID NO: 177551 - protein, 142 aa, Glycine max
  Coding DNA Sequence Number=SeqID_60773
  Gene Ontology: Mol. function=RNA-directed DNA polymerase activity; Biological process=RNA-dependent DNA replication
DEEKGLWVLTCFYKILDRAHRRESWQLLKDLHSNIFLPWCIVSDFNNLFSKEDKCGRVKHPPWLFQGFREAIFERLDRAMVDSDWFQLHGQERGLEEVVSGEWNKLADEEIEGKIKNYVEKMEAWGVFPVEAKLHDESTMIQ

SEQ ID NO: 177552 - protein, 60 aa, Glycine max
  Coding DNA Sequence Number=SeqID_60774
MGCGFCLVFGSARINLLTCSEEDDNICYARSDNKIRESKVQANHSSKVDISLTDQSQLKV

SEQ ID NO: 177553 - protein, 317 aa, Glycine max
  Coding DNA Sequence Number=SeqID_60775
  Gene Ontology: Mol. function=nucleic acid binding; Cellular component= anchored to membrane; Biological process=regulation of transcription
  Homolog annotation: Hit_ID=O82389; Match level="QueryCoverage=81%, HitCoverage=71%, E-value=3e-90, Identity=62%"; Hit description =Expressed protein
  Pfam annotation: Domain name=zf-C2H2; Domain location=23-46; Score =19.4; E_value=0.013; Accession=PF00096.16; Description=Zinc finger, C2H2 type
RFVPESGISTDTNLFFPLRNDIFPCTACGEIFQKPHLLEAHQTLKHAVSDLPGSDPGHNIVQIIFKSGWPESKPFPTITRILKIHNSPKILSKFEEYREAVKSKAARHGAHTRRRDERCIADGNELMRFHCSTFLCDLGHNGDSAICSQQFCNICGIIKSGFSPKLDGIATLSTSWRAHVAIPEDIEREFRFMNVKRAMLVCRVIAGRVGSDSDEVEKEDGGFDSVMASGESGVYTRLDEEELLVFNPRAVLPCFVIVYTMRCFFLHNPGSWTLVHEIMCIKLTHYSIETECAVSDDHMLPALCSVSDEVAREVHSN

SEQ ID NO: 177554 - protein, 259 aa, Glycine max
  Coding DNA Sequence Number=SeqID_60776
  Gene Ontology: Mol. function=nucleic acid binding; Biological process= DNA integration
  Homolog annotation: Hit_ID=Q1S6N9; Match level="QueryCoverage=68%, HitCoverage=14%, E-value=2e-36, Identity=44%"; Hit description =Integrase, catalytic region; Zinc finger, CCHC-type; Peptidase aspartic, catalytic
  Pfam annotation: Domain name=zf-CCHC; Domain location=129-146; Score =16.8; E_value=0.0017; Accession=PF00098.13; Description=Zinc knuckle
MKESKTIKEYSGRLLDIVNNIRLLGFDFSNDRIVQKFLVTVPEKFEATIASMDNSRDLSSITLAEFLNALQAQEQRRLLRQEGSVERAFQAKNYKGNKYSQNNDTCVFSPCPYCKKNNHPHKCWWRPDMKCHKCGQLGHVEKICKPHHQHLEVKVAEDQLEEEQLFATSCFTTNNSKKKDASNLEVFKVHMKGKSFSLDLMKEQDEQDDNGDKKQPKKLHEIKLEDHKPQENKPTKLEMVWKINLSNDSCISKIPKSIL

SEQ ID NO: 177555 - protein, 351 aa, Glycine max
  Coding DNA Sequence Number=SeqID_60777
  Gene Ontology: Mol. function=sugar porter activity; Cellular component=integral to membrane; Biological process=transport
  Homolog annotation: Hit_ID=Q84L09; Match level="QueryCoverage=71%, HitCoverage=65%, E-value=2e-88, Identity=65%"; Hit description =GONST2 Golgi Nucleotide sugar transporter
  Pfam annotation: Domain name=DUF6; Domain location=105-232; Score= -3.4; E_value=0.1; Accession=PF00892.11; Description=Integral membrane protein DUF6
MSSDFKLDIFSQHDSEEPGLGTTITSKMFLDEKANSVQTIREQGKLSINNFATNAERRTLNDRFLKANKATIGDNVSLLDEEERHHLHGSAKKSGPLISGAAYCISSCSMIMLNKIVLSGYNFDAGISLMFYQNFIATLVVVLLSLSGRISVEKLSWRLIRAWIPVNVIFIGMLVSGMYSLKYINVAMVTILKNMTNILTAIGELYLFRKRQSPKVWTAMFMMIISAVSGGITDLSFDAVGYTWQIINCVLTASYSLTLRRVMDEAKNATKSGSLNEVSMVLLNNSLSLPFAIILIFLFGEWDYPVDCLDFPSALPQCGSYIKLALQHIGTGKDAKDFSEHTNRLNSLALN

SEQ ID NO: 177556 - protein, 506 aa, Glycine max
  Coding DNA Sequence Number=SeqID_60778
  Gene Ontology: Mol. function=RNA-directed DNA polymerase activity; Biological process=RNA-dependent DNA replication
MEVSGISFSSQIKLSIIYLIIKHTSSPLPKKMMVHSNRIEEVRMALGFYKAFMVDNQGRSGGLAMLWRSSVRGEMVTMLAAGFYGILDRAKRRDSWNLFRTLAANICFPWCVMGDFNDLLSNEDKCGRVEHPFWLMQGFQEAVGDCGLRDIVLEDYPFTWVKSKSIDSAVEERLDRGPWLIELEDVVLGGWSFNPNADVIAKLQNCASGLDSWGRILKSRFREDIDRCKKDLEYWRDKGDSYSELAKEDGYVVQTQEDLKSLAEDHFTNLFARQNCNNADEALMDMDPNKSPCPDGLNPTFFRRFWERGSMPPAVNALSALIKKAEASGDVHGIKVSRGAPIVSHFMYANDCYLFFRASLLEAGQQDRRQILGIREGLPSGILSGARREIMLKSVAQVVPNYEKGQNTHGFNLAQRGKQDWNLLTNPDTIISKFLKAKYYLRRDFLETKVGYNPSYSRRSICVSQVVVRKDFRWKIGDDSLINIWSEPWIKGECKHLNFLFLKLKI

SEQ ID NO: 177557 - protein, 374 aa, Glycine max
  Coding DNA Sequence Number=SeqID_60779
  Gene Ontology: Mol. function=DNA binding; Cellular component=nucleus; Biological process=regulation of transcription, DNA-dependent
  Homolog annotation: Hit_ID=Q9FIM4; Match level="QueryCoverage=77%, HitCoverage=63%, E-value=1e-52, Identity=42%"; Hit description =Similarity to Myb-related transcription factor
  Pfam annotation: Domain name=Myb_DNA-binding; Domain location=113 -158; Score=55.5; E_value=1.8e-13; Accession=PF00249.21; Description =Myb-like DNA-binding domain
  Pfam annotation: Domain name=Myb_DNA-binding; Domain location=61-107; Score=56.2; E_value=1.1e-13; Accession=PF00249.21; Description=Myb -like DNA-binding domain
  Pfam module annotation: Pfam domain module=Myb_DNA-binding::Myb_DNA -binding; Domain location=113-158::61-107
MWPNNNSTTQEVSYAEQIIFANNNEEALNWSQQVCFKEDGKNIAKVVGRRPKKGSSVPLIKGQWTDEEDRKLLKLVKQHGVRKWSLIAEKLDGRAGKQCRERWHNHLRPDIKKDSWSEEEERILVETHAKIGNRWAEIAKCIPGRTENAIKNHWNATKRRQNSRRKNKRAGTSNGKPQPSILQDYIKSLTLITSTTTSPVEQQIAPQLSNSVTNNENSSLMAESYDDELLFMQQLFKENNANNVESLKHSKNIINNSSAASLDCYYHQTNYNGGGQLLTDVTQCGFVVHSNPNTTNSHHNNMCLDESLFISRKSTTPHAPINYLDSDHVYLSHLLNGTAGSSFCYNNYGVHNQNNMELQLGNQDCFEERGRWIW

SEQ ID NO: 177558 - protein, 43 aa, Glycine max
  Coding DNA Sequence Number=SeqID_60780
MRALARHGPGSAIGAAKRVRFDSAMTLDLTMIEAKGDDSTGEI

SEQ ID NO: 177559 - protein, 128 aa, Glycine max
  Coding DNA Sequence Number=SeqID_60781
VFGNAEGRTKLNLDLKLGLSDIYSAQARDNHYNNHTFNQVEENFIHGSSSTHGVGINFNTNQTYEGQASKPGLDLNMATKMEDPKRLKRMREKKGTPYLSIIPLYTFERDLERERAGSKISYDIGRVK

SEQ ID NO: 177560 - protein, 62 aa, Glycine max
  Coding DNA Sequence Number=SeqID_60782
MSGSCPEEPTLGLKRQSSGAMDDDVRELLEVGPNYCLIVTSALAAQTQPGCFGRPMAVVSTF

SEQ ID NO: 177561 - protein, 118 aa, Glycine max
  Coding DNA Sequence Number=SeqID_60783
MWCLLGYVWDLTSMFVLLKGMKYLLLENSMLPPPIYIDAIETKWEHDDVFHMDHFFEFLCCRLPPGLNMVDPVSKDEGADMKEDTSYKEDLSMDEEHPAMEPKIMEEDSSQDSSKESY

SEQ ID NO: 177562 - protein, 158 aa, Glycine max
  Coding DNA Sequence Number=SeqID_60784
  Homolog annotation: Hit_ID=Q45Q24; Match level="QueryCoverage=57%, HitCoverage=32%, E-value=4e-24, Identity=80%"; Hit description=PHB1
  Subcellular localization annotation: CTP_CleavageSite=43; ConfidenceScore=5.07e-01
MVARPCLLCCTLLTPATVSPMLLVKHPPRQSVCRQCQWWLTCIANTSGGRRCISDSVRSICPKANIQNGKRPAGDGVVPDEPGPRGLWAGRFRDPIKLLPLHVDGGQLVVLFDRFRGILDETIGEGTHFLIPWVQKPYIFDIRTRPHTFSFVSGTKDL

SEQ ID NO: 177563 - protein, 249 aa, Glycine max
  Coding DNA Sequence Number=SeqID_60785
MDPSQEVEPPKVECQKKADEVEVVNIPKNWSSLFTGKKLIQDLDVYDAKTFWNQIVWNDTLKASISRYDRKDNTDHHEFIQVLSPIKTFHLGDACVCFTKDADNYDFITRLKNLIIIFHETTYNLTMMDERDFRDHGTQLHGAQKAKRAEMEEDIVVAKADKEKTDKAQAEAIAKAMDDNIVSQPSLQRRCEKGLFDGPRVCLPLKENAWSRHQHLFEENVEKNQNGKGRRSTYFENKGSGVVYAWGRY

SEQ ID NO: 177564 - protein, 242 aa, Glycine max
  Coding DNA Sequence Number=SeqID_60786
MLNEFLQTPVVLEEGESLPTYSRFYKLRTNHQEIKARLCIPRKGFVLNAEGQPWKILRKDLTTLAQTWSVFSYSNLAPTSQTSDLNIDRARLVYGLVTNMDMNIGALISGQISSIAQSNSSRLGFPALITAHAELEKLPLTLTLEGQGRQGFDQLVFPSSSTQPTPSTSTTPTPAPRGPYAQDSQRFESMLQSLHKGQILLMQSLQVIAPPGSILIVEQFLEKVSWPGTLPSFEREGGVPSA

SEQ ID NO: 177565 - protein, 135 aa, Glycine max
  Coding DNA Sequence Number=SeqID_60787
  Gene Ontology: Mol. function=transcriptional repressor activity; Cellular component=mitochondrion; Biological process=regulation of progression through cell cycle
  Homolog annotation: Hit_ID=Q45Q24; Match level="QueryCoverage=52%, HitCoverage=25%, E-value=2e-23, Identity=79%"; Hit description=PHB1
MKAEQERQAAIIRAEGESDTAKLISDATVSAEMGLIELRRIEASREAAATLAKSPNVAYLPGGKNLLMALNAVGHYRLMQFAIRNLCGCGCVKLVNPECLNVNAMFATISDLPVYAFDHLYSINHQIISDLPVYY

SEQ ID NO: 177566 - protein, 85 aa, Glycine max
  Coding DNA Sequence Number=SeqID_60788
MGDSDKCGLYIKENPSRLVALGRVYEGSTAVHNIPLLHGQVKVGVEEVKNAEAPIPIPTDEEVMSPAKPPDRPDHEIDDPLYLMT

SEQ ID NO: 177567 - protein, 68 aa, Glycine max
  Coding DNA Sequence Number=SeqID_60789
MRKTILSLRMSCGLLIPPWRKKKKMKNLFEKAVKVEVATETAQNEPDVVAGERTPIGSTKDSFFNTET

SEQ ID NO: 177568 - protein, 130 aa, Glycine max
  Coding DNA Sequence Number=SeqID_60790
SDSNFLTAYEDCQSPTNQPVINTEDISAHALKLIFIIVIIILYYDIKQFQDILILVINSCNVDIVMHKCGMIKEYQKIKIVGVQGSAYVVEMAKLNCHYYKIHPNISNNFCLMIIQLIVKIINITYEHTT

SEQ ID NO: 177569 - protein, 42 aa, Glycine max
  Coding DNA Sequence Number=SeqID_60791
MGLLHASRQLDYGVPSLHASRQYCWRNPHVLKQGYLTSGMVE

SEQ ID NO: 177570 - protein, 70 aa, Glycine max
  Coding DNA Sequence Number=SeqID_60792
QNWHKALTQFMDGHIDMALVKEFYSNLGWLIKFDAASLNAFLETPPVIQPWEQSALEAPEEGFDNLGPDL

SEQ ID NO: 177571 - protein, 98 aa, Glycine max
  Coding DNA Sequence Number=SeqID_60793
SYLAHGPEIYLKAHENPKAFSCIPGPIFLESSIQCPCGVGFHQLSSLKAALSSTNSSKISLSIESLASEARLAQQMPQLIMLGPGKLDLARGYQQKIV

SEQ ID NO: 177572 - protein, 180 aa, Glycine max
  Coding DNA Sequence Number=SeqID_60794
  Homolog annotation: Hit_ID=Q1S3K9; Match level="QueryCoverage=27%, HitCoverage=7%, E-value=1e-07, Identity=71%"; Hit description=IQ calmodulin-binding region
MEVVLHQGAIPCGRRNWVEYIGRSYYIFLNSSPTLYLCSALRNMKVAISRWSRATTRTTKVDNGLSKDYKAQKDFEFEPLLRNMKPAISRWSRATTKAAKGNDFCLYFCLSQILPIHVQSLDVTFNAPQFPNHLTCRQLQPPKGNDPSITHYLTPSNHPSFFYHLHFNSKQIILSKRLPP

SEQ ID NO: 177573 - protein, 189 aa, Glycine max
  Coding DNA Sequence Number=SeqID_60795
MTSATCSSADGLRAISTQLPFVLPRAANTSTSGSIEGNCCGLIDVVELLEPCDACPKYWLIVTPTPIAGTQPGCSDRPIVMSSAHIALCRPTSTSHVFQLEMEDQQSLLNPQSTLLPLIFSSISPPLASSQATRNPHETKNTSSSNLPSRGFAAYNKFFPTLWIQTILKTRSLVILTLPVFIYIFGGQR

SEQ ID NO: 177574 - protein, 204 aa, Glycine max
  Coding DNA Sequence Number=SeqID_60796
MESWQHHQGLLPLDQLLPSVRLGRVDKQYNSEAREKIPIVHPNWKAMPKSLKNLICDDILVRKIDIREVSNVKKKVMSSVATRWRQFKSSLTTKYVYEDREGQDDQTPCFKYGCVPAIGVGVTISQYFGHASHGSNSSTTSINPQQLPEIIRTLKVEWKREVEEDKKSRGSTKGSCVDIALNPSAEEHVADVIVYIVTTRLVAT

SEQ ID NO: 177575 - protein, 162 aa, Glycine max
  Coding DNA Sequence Number=SeqID_60797
  Gene Ontology: Mol. function=transition metal ion binding; Biological process=cytoskeleton organization and biogenesis
MGIPEQLHPISQGRQTVKVPQGYSSNIKSLLSVNDFKLVGLKSHDYHVLMQQLMAIAIRGILLDKVRVAITRLCFFFNVIDSKVTDPQKLDDLENEAAIILCQLEIASDKNPIQASMPYFGVIEEIWELDYSEFRVAYKDKPFIMAEQAKQVFYVQDPCDSR

SEQ ID NO: 177576 - protein, 203 aa, Glycine max
  Coding DNA Sequence Number=SeqID_60798
MGVGFRQEMTRLTGWIHILDSIKNGVGLPLNHVAAIEPPNNVTIATSGGSEVCFPSNATPEDLFDHFCDGALSNGSSKLSNGNKTRVLVNYSQERGAPTLNEGRDFDGEERCSKRAQLGGYNNDRPYYGRGNYQGKERERCFSNNRKRPRGDRDEIDRRDKDGGGMLEIGIVPTAISKKGLQFDVPTAISKKGDGGESWNDLV

SEQ ID NO: 177577 - protein, 530 aa, Glycine max
  Coding DNA Sequence Number=SeqID_60799
  Gene Ontology: Mol. function=DNA binding; Cellular component =membrane; Biological process=regulation of transcription, DNA -dependent
  Homolog annotation: Hit_ID=Q8W032; Match level="QueryCoverage=80%, HitCoverage=81%, E-value=1e-143, Identity=60%"; Hit description =CDC6b protein
  Pfam annotation: Domain name=AAA; Domain location=156-363; Score= -17.2; E_value=0.0042; Accession=PF00004.19; Description=ATPase family associated with various cellular activities (AAA)
  Pfam annotation: Domain name=Cdc6_C; Domain location=435-514; Score =59.2; E_value=1.3e-14; Accession=PF09079.1; Description=CDC6, C terminal
  Pfam module annotation: Pfam domain module=AAA::Cdc6_C; Domain location=156-363::435-514
METWWGDGCIEVIDGTTNSRVEAHENPIFIFFFNLENPNPISLHGSLTSKTMPVIAAKRTLRSHPSSPPRKSPRRCTAATPNSTPTKNRLGGADENQADPAAVKPKWNPKDGEQLKRAKMALHLSTAPSSVVCREEEQNMVLEFCKGCVEHQKAGSLYICGCPGTGKSLSMEKVKDKLLNWAKEEGLPLPDVLSVNCTTLTNTSDIFTKILGLNQTQGKKVSALPLQQLQNMYSQKSSVKNMTLIVADELDYLITKDRAVLHDLFMLTTFPFSRCILIGVANAIDLADRFLPRLTSLNCKPIVVNFRAYSKDQILKILEERLNEFPYSVFQQQALELCARKVAATSGDMRNALCICGSAIEMLEAEIRESACNLNTSLEEISSSRQNFATAPDFMKKREFDTVKTDHMARALSKTYRSPVVDTIQSLPHHQQIVLCSSMKHFRGAKKDAILGELYKSYVGVCKSCLIPPAGILEFSNMCRVLNDQGLIKLGQSREDKLRRVSPKIDEGDITFALQISLFGSNRCLQLFIV

SEQ ID NO: 177578 - protein, 286 aa, Glycine max
  Coding DNA Sequence Number=SeqID_60800
  Gene Ontology: Mol. function=RNA-directed DNA polymerase activity; Cellular component=extracellular region; Biological process=RNA -dependent DNA replication
MQKIINLSPWNFDKRIIILVELKSDANLEEFDLSTSLFWVQESDLPRASRSEAVAQTIGNSIGTFLTWDDIDEIMYGKVMRIRVQISHPFLANDSVIFTRATLEKASHLAFIIRQYEEAFGQMAMENSMTYLGLPTIVGRSTTFVFQFVKERGWKKLKGWKEKFLSQAGRETLIKAVEMLMRRKSTGSDRIKWQNQRIVMEWASEWFQASTKLFWVNNGGGFFLGQNRSCVKGIVEKGIIWKVGDGTQIKSWTNTWIPSNVKFKTSAQPQDDDDKSLLVFELTNHK

SEQ ID NO: 177579 - protein, 166 aa, Glycine max
  Coding DNA Sequence Number=SeqID_60801
MDRKKEAKLSTHSHKDRRNDAWRIETIRARPRHMGELRGNPEQADVPVVARFPMIGQADIPTGGPNTNPPNLFPQFEALRVTVRENPPNFAAYTSGTRTIKSSANVDHQEDILDLINEPEGDERISHKTQHQSHGHVEKDESWVPKKKGYLGRCELHEVVHDYVSS

SEQ ID NO: 177580 - protein, 134 aa, Glycine max
  Coding DNA Sequence Number=SeqID_60802
  Gene Ontology: Mol. function=protein kinase activity; Biological process=protein amino acid phosphorylation
  Homolog annotation: Hit_ID=Q2R017; Match level="QueryCoverage=93%, HitCoverage=7%, E-value=3e-38, Identity=56%"; Hit description =Helicase, putative
MTDEPKQIYHKIMQAVNNNEGGMFFLYGYGGTGKTYIWRTLASSLRAKNQIVIMVASSGIASLLLPRGRTAHSKFKIPVPIFEDSTCNILQGSQLAELLNQTNMIIWDEAPMAHKFCFQALDQSLTDIIKEKKI

SEQ ID NO: 177581 - protein, 526 aa, Glycine max
  Coding DNA Sequence Number=SeqID_60803
MQKRIEDLKGVGKDAYQETLWGSRCNYTENRYGQQSAVTLAAQLQEHGRTNWRDAPDVFIAKKKNRSGRKYGFVRFKGVEEVGMLECQLDNMVIGDLKLHANLPKHGREPVINDKSIIDMKHKVGLVMDKVAEDEQQQGKKETEHTFKNRGLLKQHPQRMQSPVSYAKGNNNMERRCFPRHVTPTRSISHSTLQPSIPIEENKWYYNAWVGRLRNLVLFDKMEDQIMWVGGEDITPKYLGDDMVLLLGLTDTRAKEMCRKGACWGIPLHAWDKENIKKNVPAVGEVVEVDDEVGELQQLDRARETCYSPNTCKWHMRSMMGSSEEISSNESKMGLPLTAANESSESKFPMNISNENGGGGKLGGVARDKQFSDGQCPTLGPKGIPYGPTQQLQSRGKDTKHTTARDHEEETGGNKEGGPSRLANFELKWRGSQALEEAESPLMGLATQNHNGTNAGEKDNLEVKSNGSAHTWQVYSRNKGRKKQMGLNKTADLKVGHSTHKNTNASRICNISSSVMRGNRLKEVAG

SEQ ID NO: 177582 - protein, 207 aa, Glycine max
  Coding DNA Sequence Number=SeqID_60804
  Gene Ontology: Mol. function=RNA-directed DNA polymerase activity; Biological process=RNA-dependent DNA replication
MVKRERIDILCLQETKKEQVDKVVCQALWGDADVSWELQPACNSAGGILCLWSQKTFRLERKHIGCNFIYLEGIWVADGEKVNIINIYSLCDLNQKRILWEQIRRLRNSNMGGLWYILGHFNSIRRSSERVGTCHRGQDERSLQEFNEWIANLQVEDVPCVGRKFTWDRNLSGFWIVDSKIKHSEKLSKSAGQPTMSEVGEALIFQC

SEQ ID NO: 177583 - protein, 538 aa, Glycine max
  Coding DNA Sequence Number=SeqID_60805
  Gene Ontology: Mol. function=calcium ion binding; Cellular component =endoplasmic reticulum; Biological process=protein folding
  Homolog annotation: Hit_ID=Q1SIV8; Match level="QueryCoverage=99%, HitCoverage=100%, E-value=0.0, Identity=78%"; Hit description =Calreticulin/calnexin
  Pfam annotation: Domain name=Calreticulin; Domain location=32-389; Score=750.8; E_value=8.5e-223; Accession=PF00262.8; Description =Calreticulin family
MGEPKRIYLRIFALLLFISASSFQLLRAFDDAIFYESFDEDFEDRWIVSQKDEYNGVWKHAKSEGHDDYGLLVSEKVRKYAIVKELDEAVGLKDETVVLQFETRLQNGLECGGAYLKYLRPQEAGWKSKEFDNESPYSIMFGPDKCGATNKVHFIFKHKNPKSGEYVEHHLKNPPSVPSDKLSHVYTAILKSDNELQILIDGEQKKKVNFLSADDFEPPLIPPKTIPDSDDKKPEDWDEREKIPDPSAVKPDDWDEDAPLEIVDEEAEKPEGWLDNEPEEIDDPEATKPEDWDDEEDGEWEAPKIENPKCEAAPGCGEWKRPMKRNPAYKGKWHAPLIENPAYKGIWKPRDIPNPDYFELKKPDFEPIAAIGIEIWTMQDGILFDNILISKDDKIAESYRETRWKPKFTVEKEKQKEEDSEAGSSGLAGFQKKVFDLLYKIADIPFLSAYKLKIYDVIEKGQEQPNLTVGIVVAVVVVILSIFLRLIFGGKKKPTRVEKTNPEPAETASSQGSGENEENKEKEESSAPARRKPTRRDN

SEQ ID NO: 177584 - protein, 540 aa, Glycine max
  Coding DNA Sequence Number=SeqID_60806
  Gene Ontology: Mol. function=diacylglycerol kinase activity; Cellular component=nucleus; Biological process=protein kinase C activation
  Homolog annotation: Hit_ID=Q9FLS9; Match level="QueryCoverage=69%, HitCoverage=76%, E-value=1e-123, Identity=54%"; Hit description =Similarity to selenium-binding protein
  Pfam annotation: Domain name=PPR; Domain location=100-134; Score =41.0; E_value=4.1e-09; Accession=PF01535.11; Description=PPR repeat
  Pfam annotation: Domain name=PPR; Domain location=135-169; Score =11.4; E_value=0.33; Accession=PF01535.11; Description=PPR repeat
  Pfam annotation: Domain name=PPR; Domain location=201-235; Score =39.9; E_value=8.6e-09; Accession=PF01535.11; Description=PPR repeat
  Pfam annotation: Domain name=PPR; Domain location=236-270; Score =11.5; E_value=0.33; Accession=PF01535.11; Description=PPR repeat
  Pfam annotation: Domain name=PPR; Domain location=272-306; Score=9.8; E_value=0.52; Accession=PF01535.11; Description=PPR repeat
  Pfam annotation: Domain name=PPR; Domain location=38-72; Score=6.5; E_ value=1.3; Accession=PF01535.11; Description=PPR repeat
  Pfam module annotation: Pfam domain module=PPR::PPR::PPR::PPR::PPR::PP R; Domain location=100-134::135-169::201-235::236-270::272-306::38-72
DFHTFPYVIKASALLHSLSLAQSLHSQALKFGLLPDLFSLNTLIGVYSIHHRVNDAHKLFYECPHGDVVSYNALIHGLVKTRQISRARELFDEMPVRDEISWGTMIAGYSHLKLCNQAIELFNEMMRLEVKPDNIALVSVLSACAQLGELEQGSIVHDYIKRNRIRVDSYLATGLVDLYAKCGCVETARDVFESCMEKYVFTWNAMLVGFAIHGEGSMVLEYFSRMVSEGVKPDGVTLLGVLVGCSHAGLVLEARRIFDEMENVYGVKREGKHYGCMADMLARAGLIEEGVEMVKAMPSGGDVFAWGGLLGGCRIHGNVEVAKKAAQQVMEIKPEDGGVYSVMANIYAHTEQWDDLVKVRRSLSANKRAKKITGRSLIRLNDEGSVALPEASMATVSTQKTDKCLLASTFSYVAPEPSFFTETHIAFCTNSNGIIFIKQYKSVEPTFRPILSRHSGNWLAVLERELEERLRTQPQQTPKMKAYAPAADYGYVHHRQHGKSDKFIKQSFFRKVAHVQDRSYPNPILRDAYAYTPRVDPSHV

SEQ ID NO: 177585 - protein, 350 aa, Glycine max
  Coding DNA Sequence Number=SeqID_60807
  Gene Ontology: Mol. function=amidase activity; Biological process =translation
  Homolog annotation: Hit_ID=Q1SIW5; Match level="QueryCoverage=94%, HitCoverage=59%, E-value=1e-135, Identity=69%"; Hit description =Amidase
  Pfam annotation: Domain name=Amidase; Domain location=1-311; Score =57.8; E_value=4.8e-15; Accession=PF01425.11; Description=Amidase
MTSGSKSFKNQVIDMEAWVYKRLKSAGAVLVAKLVSGSLAYDDIWFGGRTRNPWNIEEFSTGSSAGPAASTSAGMVPFAFGTETAGSITFPATRCGVTALHPNFGTIGRSGDKIGPFCRSATDCAIILDIVGGKDLDDPSSKHSSLDDRFLVDITKLTVGYLDDAEMEMVPYKLNYTVDSVQGILNFTMDVDMLAHFDEWQRSGEDNVYEAQDQWPTELRRAGLIPAVDYIQAQRARGKLIKEIRESFSVDAFIGSATDWEKVCLGNLVGLPVIVVPTGLKNISDPPPDGTRRTTITTGIYAPPNCDHIAPELAMTYQEVTNHHKQRPPIKDLGPNDKFPDPVTATYPPR

SEQ ID NO: 177586 - protein, 77 aa, Glycine max
  Coding DNA Sequence Number=SeqID_60808
MEGFLPLVYKAIKKRKTRRQYQCLSSGDMNVAEFYPPSTHHHGHGYINYMQEPSTSTQKVVDDDDDTENIGYMRYNS

SEQ ID NO: 177587 - protein, 102 aa, Glycine max
  Coding DNA Sequence Number=SeqID_60809
  Gene Ontology: Mol. function=catalytic activity; Cellular component =cellular_component; Biological process=metabolic process
  Homolog annotation: Hit_ID=Q9SPJ0; Match level="QueryCoverage=89%, HitCoverage=12%, E-value=2e-37, Identity=72%"; Hit description =Putative cycloartenol synthase
MLVIYLQNEDGGWGMHIEGSSIMFTSALNYVTLRLLGEDINGGEGAIQKARTWILDHGGATYIPSWGKLWLSVLGVYEWSGMKPIPPEIWLFPYFVPLSRLS

SEQ ID NO: 177588 - protein, 238 aa, Glycine max
  Coding DNA Sequence Number=SeqID_60810
  Gene Ontology: Mol. function=nucleotidyltransferase activity
  Homolog annotation: Hit_ID=Q1SIX1; Match level="QueryCoverage=91%, HitCoverage=49%, E-value=1e-88, Identity=72%"; Hit description =Cytokine, four-helical bundle
  Subcellular localization annotation: CTP_CleavageSite=24; ConfidenceScore=5.22e-01
MAVSESSCLNFQSLLQLANFYAISSSSSSHARKSVTLGDKIGLCYVFKNRLSSSDELAVAYNPVGNFNLRDFHHAVNNLPYDAFLADIDSISDLMISNVLSERVLYSWQGKDIERKVIVITSTLPEDIDSIVQKSLMKSIHLTDTRENINNFRRCISHLDNCSVQTYIPDFRVFHSLVKRWLLILKDDMEEPLLARLIFKDNLFDSVNHIFCNLFAPVNPITNIFTQCRVIVLTIHID

SEQ ID NO: 177589 - protein, 154 aa, Glycine max
  Coding DNA Sequence Number=SeqID_60811
  Gene Ontology: Mol. function=phosphoric diester hydrolase activity; Cellular component=nucleus; Biological process=DNA repair
  Homolog annotation: Hit_ID=Q1SIX7; Match level="QueryCoverage=77%, HitCoverage=11%, E-value=3e-47, Identity=74%"; Hit description =Forkhead-associated; Tyrosyl-DNA phosphodiesterase
MDERDDEKCPASHAKCACKSNTVLSDYALSLTCMTPSILKISFNRKTWQRLKTSNILHDAIPHPHERIGHPMHIKVMRRCFWSGRDAPSVGWVYSGSHNFSAAAWGRQISNPFRTKADRPKKEDPSVNYGLHICNYELGIILLFLLQKIMVVLK

SEQ ID NO: 177590 - protein, 280 aa, Glycine max
  Coding DNA Sequence Number=SeqID_60812
  Homolog annotation: Hit_ID=Q1SIX1; Match level="QueryCoverage=29%, HitCoverage=12%, E-value=3e-15, Identity=53%"; Hit description =Cytokine, four-helical bundle
MAEAPYHCYYILQPSDTGPMLMRVRTSPLSLLFIPLVLCTFTQSRIMRLAGAEEVLRVPDNQLVDSSINKEIESSVQACLLKIDLTDYDPLLHERGFHQKLNVLVKESLQFWSVFSKSEGAFSELSASQQPSSEVMGKAEPATGVIVNEETLALDITDHDDKTMACITEEWKQLVVSEDPKLYSPSSMPKAKLGQSSVSPRDGNRKLDRETSRILERLEVPRPLKAKTTSPGSNESCMKNTSVPIKKPLVPFQPTQGTEQVLVGSQLMKPNFQRQKRKHK

SEQ ID NO: 177591 - protein, 410 aa, Glycine max
  Coding DNA Sequence Number=SeqID_60813
  Gene Ontology: Mol. function=phospholipase C activity; Biological process=intracellular signaling cascade
  Homolog annotation: Hit_ID=Q53KW9; Match level="QueryCoverage=48%, HitCoverage=28%, E-value=4e-28, Identity=35%"; Hit description =Expressed protein
MAHLDVCHQVRFIGQLEEYGSRLSSSIPTVEGSKDKEEIVEVKPIFMPNFKKRKRLSLNRLREIKADMCARQSSGTPKTKCESIDRWSAKRYELAQQSMWEVLKGEGATFENPITRPALRMAARKHIGDTGLLDHLLKHIDGKVAPGGTERFRRCFNTKGIMEYWLESANLDEIRQETGVQDPYIGELKMLKIEMAQMKKDMQELIAKKQEKSEMCLMEETQKSFVNWKAMTEQRVTEIMTSLKGVQGMHENMLIWKTKVEQQLIEITNKLSDVQKLREDTTSSYPPVSWEDWLGSTNTDNIQGNELNLELLNVPKEVVLQDLNSTLPTQLQCVELTNMNSNLLELVPKIKEDQPNVTPDSSMTVNSKSDLDNSLILYQEMIMELFTSRDKMEQQLLQIANTVYGMLTMK

SEQ ID NO: 177592 - protein, 189 aa, Glycine max
  Coding DNA Sequence Number=SeqID_60814
  Homolog annotation: Hit_ID=Q1SIX7; Match level="QueryCoverage=47%, HitCoverage=7%, E-value=2e-11, Identity=46%"; Hit description =Forkhead-associated; Tyrosyl-DNA phosphodiesterase
STKLDDIILPFVVPAPKYRSSDRPATKQAMREVMVELAEREKEKHTEEEMMDELDDEEEYVELPEELEATNYVEQENEDEKAYADILWSQDLKVVATHHAIAAAVNCAITPRRYKILILWKCAIRQEAVGPAVKWIPGKNVLESLPKTEQLTQGVADANLDSGQDDGEWVVYAKKSKNRACETMESSSS

SEQ ID NO: 177593 - protein, 174 aa, Glycine max
  Coding DNA Sequence Number=SeqID_60815
  Homolog annotation: Hit_ID=Q1SIX8; Match level="QueryCoverage=98%, HitCoverage=88%, E-value=1e-27, Identity=43%"; Hit description=VQ
  Pfam annotation: Domain name=VQ; Domain location=14-44; Score=37.8; E_ value=3.8e-08; Accession=PF05678.4; Description=VQ motif
MEKPPIHGAAASDCKPLTTFVQTNSDAFREVVQRLTGPSEASAAKEGDATKVATVKRNTSKLHERKKYMKPKLEIVKPTFNYRTGASFPPSPGSGSSSLLPSPTTPSTLFSQLKINLEDEKKEESVNTAEEEEEKAIKERRFYLHPSPRAKPGYTEPELLNLFPLASRNASEKV

SEQ ID NO: 177594 - protein, 144 aa, Glycine max
  Coding DNA Sequence Number=SeqID_60816
  Gene Ontology: Mol. function=metal ion binding
MVASNFSEWLRRSKERHSAVLCPQCRAAVHFVGKNHFLRTFAESRALGFNSPSGSALNECTSITMKGEELDLIKLKYVNQDMLRADSSLRRSHDEVALLDTYALVRPNLVSHWIWKEESKGGPTHQMIKVMAHISAHSVFCCPS

SEQ ID NO: 177595 - protein, 575 aa, Glycine max
  Coding DNA Sequence Number=SeqID_60817
  Gene Ontology: Mol. function=transporter activity; Cellular component= integral to membrane; Biological process=transport
  Homolog annotation: Hit_ID=Q2Q0V7; Match level="QueryCoverage=84%, HitCoverage=86%, E-value=1e-146, Identity=52%"; Hit description =Patellin 1
  Pfam annotation: Domain name=CRAL_TRIO; Domain location=299-483; Score=72.8; E_value=1.1e-18; Accession=PF00650.10; Description =CRALTRIO domain
  Pfam annotation: Domain name=CRAL_TRIO_N; Domain location=216-287; Score=46.4; E_value=9.7e-11; Accession=PF03765.5; Description =CRALTRIO, N-terminus
  Pfam annotation: Domain name=EMP24_GP25L; Domain location=488-569; Score=61.8; E_value=2.2e-15; Accession=PF01105.14; Description =emp24gp25Lp24 family
  Pfam module annotation: Pfam domain module=CRAL_TRIO::CRAL_TRIO _N::EMP24_GP25L; Domain location=299-483::216-287::488-569
MAEETPNQTTTPPPPQESVVQVEEVVVTDVPQPDKTTTTVPVERDSQPQPYEPEKKKPVEETVTLETHLSKPNNADHTNNIPEFIEESTKLSDLPENENKALQELKKLVQDALNNHHFSSKHDNKKPPQTTAADNKEEQQPQEVVTETKPDAAPAKTEEEHVETKKEEEKEEEEKEQVTETKEEEAAVDDDGAKTVEAIEETVVAVSSTVQPQAEEKASEPEATKEESSPPLPPEEASIWGIPLLADERSDVILLKFLRAREFKVKEAFTMLKNTIQWRKEFGMEELMEEKLGDELEKVVFMHGFDKEGHPVCYNIYEEFQNKELYKKTFSDEEKREKFLRWRIQFLEKSIRKLDFNPGGICTIVHVNDLKNSPGLAKWELRQATKHALQLLQDNYPEFVAKQVFINVPWWYLAVNRMISPFLTQRTKSKFVFAGPSKSTETLLRYIAPEQLPVKYGGLGKDGEFGNTDAVTEITVRPAAKHTVEFSVTENCLLSWELRVIGWEVSYGAEFVPSSEGSYTVIVQKARKVASSEEPVLCNSFKVGEPGKVVLTIDNTSSKKKKLLYRLKTKPSLSD

SEQ ID NO: 177596 - protein, 218 aa, Glycine max
  Coding DNA Sequence Number=SeqID_60818
  Gene Ontology: Mol. function=DNA binding; Cellular component=nucleus; Biological process=regulation of transcription
  Homolog annotation: Hit_ID=Q8S402; Match level="QueryCoverage=58%, HitCoverage=61%, E-value=4e-53, Identity=69%"; Hit description =Typical P-type R2R3 Myb protein
  Pfam annotation: Domain name=Myb_DNA-binding; Domain location=15-62; Score=54.6; E_value=3.3e-13; Accession=PF00249.21; Description=Myb -like DNA-binding domain
  Pfam annotation: Domain name=Myb_DNA-binding; Domain location=68-113; Score=47.0; E_value=6.3e-11; Accession=PF00249.21; Description=Myb -like DNA-binding domain
  Pfam module annotation: Pfam domain module=Myb_DNA-binding::Myb_DNA -binding; Domain location=15-62::68-113
MGRTPCSDKEQINKKGPWSKEEDELLINYINLHGQGNWKSIPKAAGLLRCGKSCRLRWTNYLRPDLKKGNFTEEESNLIIHLHSLLGNKWSQIATSLPGRTDNEIKNYWKSHLKRYLYALGIDPVTHKPFKEDTNTTSTPPNNSMATTTSTIPRIYYFNVFLNSKVHISADDDYSADGGADSNSSSGVTIEEASPQVNLELSIAPPSQPHEDAASVKP

SEQ ID NO: 177597 - protein, 214 aa, Glycine max
  Coding DNA Sequence Number=SeqID_60819
  Gene Ontology: Mol. function=ferrochelatase activity; Cellular component=chloroplast; Biological process=heme biosynthetic process
  Homolog annotation: Hit_ID=Q9FEK8; Match level="QueryCoverage=82%, HitCoverage=31%, E-value=2e-57, Identity=64%"; Hit description =Ferrochelatase
  Pfam annotation: Domain name=Ferrochelatase; Domain location=70-214; Score=-88.5; E_value=1.1e-06; Accession=PF00762.10; Description =Ferrochelatase
MYRCSGGHVESSTNINPLKNCVVGRSTLGWFETQPLVSEQLLNRRLLSVEALVTPTVQDFSDTPLIGDDKIGVLLLNLGGPETLEDVQPFLFNLFADPDIIRLPRLFSFLQKPLAQFVSVLRAPKSKEGYASIGGGSPLRRITDAQARHFPITYFPYITTAEELRKSLWSKNVPAKVYVGMRYWHPFTEEAIEQHFLKIMPGTAFFYKFQWVLI

SEQ ID NO: 177598 - protein, 361 aa, Glycine max
  Coding DNA Sequence Number=SeqID_60820
  Gene Ontology: Mol. function=protein serine/threonine kinase activity; Cellular component=spindle pole body; Biological process =protein amino acid phosphorylation
  Homolog annotation: Hit_ID=Q43466; Match level="QueryCoverage=99%, HitCoverage=100%, E-value=1e-166, Identity=79%"; Hit description =Protein kinase 3
  Pfam annotation: Domain name=Pkinase; Domain location=4-270; Score =187.1; E_value=4.4e-53; Accession=PF00069.15; Description=Protein kinase domain
  Pfam annotation: Domain name=Pkinase_Tyr; Domain location=4-271; Score=-67.7; E_value=2.6e-08; Accession=PF07714.7; Description =Protein tyrosine kinase
  Pfam module annotation: Pfam domain module=Pkinase::Pkinase_Tyr; Domain location=4-270::4-271
MDKYEAVKDLGAGNFGVARLMRNKETKELVAMKYIERGQKVVLTPTHLAIVMEYAAGGELFERICNAGRFSEDEVDNLLSVFSALFHTLAFSTITIVAISHLFFHLIVQARYFFQQLISGVHYCHAMQICHRDLKLENTLLDGSPAPRLKICDFGYSKSSLLHSRPKSTVGTPAYIAPEVLSRREYDGKLADVWSCGVTLYVMLVGAYPFEDQDDPRNFRKTIQRIMAVQYKIPDYVHISQDCRHLLSRIFVANPLRRISLKEIKSHPWFLKNLPRELTESAQAVYYQRGNPSFSIQSVEEIMKIVGEARDPPPVSRPVKGFGWDGEEDEGEEDVEEEEDEEDEYDKRVKEVHASGEFQIS

SEQ ID NO: 177599 - protein, 744 aa, Glycine max
  Coding DNA Sequence Number=SeqID_60821
  Homolog annotation: Hit_ID=Q1S1T0; Match level="QueryCoverage=62%, HitCoverage=98%, E-value=1e-170, Identity=66%"; Hit description=DDT
  Pfam annotation: Domain name=DDT; Domain location=277-337; Score =44.1; E_value=4.6e-10; Accession=PF02791.7; Description=DDT domain
MRDNGSLTWSSDYLKQLNLYRQRVWMCKVTGKTGLTYEEALVSEQLATEKVQQFPKELMTVALSIIQYSMLPLKDLADSIAEKLQECLFVGAELHGKKDDGVHPCKILKVIQKGVDTVSYEVAWLDKNKNIREQAEVSAEDLVHKKPLFSRNILKSFIRESTYRNAPWVLHDELAKNHGISTDIPEDLQGRVFYKYGLLVCSKKRKNEESLEDTDNCKRKKLDGAQVDDSSQEKENGQHNDEAIKYPIDDLLVTPSPDDPVFTDRPSPAKDFNIPMSCVGELLMVWDFLSSFGRLLQLSPYSLEDFEFAICHKDSNVALLMESHAALFRLLIKDKDEYSLVVKNRKLKSKITTNNWTEYLCHFLEMINIPELRQHKTTIKRGHYGLVDASAKLKILGELVNRALETAIFREKLDEIIEQRQALGATRREEALENGRRRREEKERMKAESESNGFVDGHLNGANVLANNIHGIQNGDVGEKRIIEIEPSGQNDPLGRSGIKHLNPAPKKTLKKLNSELKEPTENGKELSRKESPKQLKADKDSSEKNSKEQRKEYFEREMEKRFIRRSPLGKDRDHNRYWWFCRYGRIFVESCDSKNWGYYSSKEELDTLMSSLNCKGERERALQKHLEKYYNTICSELQKTSKDLMHRFVDESVLRRSTRVRAQPRQNPSDACLRYRNNKDKLFQYCQGTCMYPLGFSYMNTTHFYLLGIRESLWKGMTIERDRACQTEKILSSSILKIEPKIQ

SEQ ID NO: 177600 - protein, 99 aa, Glycine max
  Coding DNA Sequence Number=SeqID_60822
MGTIHRNLGIWWQKVTLMEVMHQLVQFQEILKVKTVPECSNLIWRASFKWSIQVVAHMCFSHTFLKLIAKCYMNFGSAKVHMTSLMLPDFSTSVELCLT

SEQ ID NO: 177601 - protein, 342 aa, Glycine max
  Coding DNA Sequence Number=SeqID_60823
  Gene Ontology: Mol. function=ferrochelatase activity; Cellular component=chloroplast; Biological process=heme biosynthetic process
  Homolog annotation: Hit_ID=Q9FEK8; Match level="QueryCoverage=86%, HitCoverage=57%, E-value=1e-148, Identity=87%"; Hit description =Ferrochelatase
  Pfam annotation: Domain name=Ferrochelatase; Domain location=1-208; Score=210.6; E_value=3.6e-60; Accession=PF00762.10; Description =Ferrochelatase
DGITKLVVLPLYPQFSISTSGSSLRLLESIFRDDEYLVNMQHTVIPSWYQREGYIKAMTNLIEKELKGFDCPEEVMIFFSAHGVPLAYVEEAGDPYKAEMEECVDLIMEELEKRKITNAYTLAYQSRVGPVEWLKPYTDETIIELGKKGVKSLLAVPISEHIETLEEIDVEYKELALNSGIEKWGRVPALGTETTFISDLADAVIESLPYVGAMAVSNLEARQSLVPLGSVEELLTAYDSQRRELPPPVIVWEWGWTKSAETWNGRAAMLAVLLLLFLEVTTGEGFLHQWGILPLFSGELEKERDFYDIKLDLLTMTVGRVELEKEELEKGSRLVSREEEKK

SEQ ID NO: 177602 - protein, 213 aa, Glycine max
  Coding DNA Sequence Number=SeqID_60824
  Gene Ontology: Mol. function=DNA binding; Biological process=DNA integration
  Homolog annotation: Hit_ID=Q1S3H4; Match level="QueryCoverage=94%, HitCoverage=67%, E-value=4e-25, Identity=56%"; Hit description =Integrase, catalytic region
MVNYKVASIIPNDFNWNQLKKFLHDACFYVWDDLYLFKIGADNILRRCVTMEEAGSILRHCHNSPCGGHYNGDKTIAKVLQARFFWPSSIFKDAHDHVLHCDHDHVLYCKTSRKVTEGEKQKRKLQQLELEEIRLNAYESSQIYKQKMKVYHDRKLIKKNFQLEQQVLLFNSRLKLFLGKLKSKCSGPFTIKEVKPYGAVKLIDLALSEPEQS

SEQ ID NO: 177603 - protein, 54 aa, Glycine max
  Coding DNA Sequence Number=SeqID_60825
MWKETGGSVAPAAGAPPVVPDPWALPKAPASGALPPCATCHVHSGGAWVGGALQ

SEQ ID NO: 177604 - protein, 549 aa, Glycine max
  Coding DNA Sequence Number=SeqID_60826
  Gene Ontology: Mol. function=RNA-directed DNA polymerase activity; Biological process=RNA-dependent DNA replication
MAQDDAKEAKAGDPVLGITSTKINGPSIRPPNQGLNLYERTTKLEDTSTQLMQEGQLAKQLDERSTGSFVANTEKNPKEECKAEMIKNESKESCGEVLTTKTKSQLAREARKEITLDLVKEVPYPLVPSKKERGQYFARFLDIFKKLEITIPFGEALQQMPLYTKFLKDLLTKKRKYINNGSIMVEGNCSVVIQRILPKKFKDPGSVTILCSIGDVSMDQYGVVEDVLIKVHQFTFPMDFVIMDIEEDSDIPLILKVTFNLLEAIKHPGDSKACFKVEAIEQEANLAMQHMTTHSLLEKELINAFEELKKDSPTKKPKVELKALPTHLKHKAAIGWHISYLKGIGPSYCMHKIMMEDDYRLVRQSQRRLNPSMKEKVWKQVLKLLEAELIYPISDSAWVSPIQVVPKKGRMIMVRIEKNDLISTWIITGWRMCIDYHKLNDATRKNHFPLPFVDQMLERCMLAIFPYMVEKCIEVFMDDFSIFGPSFDCYLTNLELVLRCCVKDFSNIARPLSNFLNKDAVFKLDEECLTAFQTLKNKLASTPIIVALD

SEQ ID NO: 177605 - protein, 67 aa, Glycine max
  Coding DNA Sequence Number=SeqID_60827
MGEVCRREMYAGGEEFKARCYGLSTSFISGYPCLAQDGALSAYRLIEKDIDTSLIHFTSTSYTPIKS

SEQ ID NO: 177606 - protein, 168 aa, Glycine max
  Coding DNA Sequence Number=SeqID_60828
MASSLPIPEVSPPLQKEARLLARKPEIGMPLVSSLATGEITSEDSTSRDTGHGGGFAAWGKATPTETKKKAGRGKMRWLEEEWLVVVLVEHPEWLGEAEPGRTGLGNLGNLQRDHVVHIHVHLHNESVYHTGLVHVEVRGVGGRSEVEVGKHTPCLGKGSEVLSHNLP

SEQ ID NO: 177607 - protein, 55 aa, Glycine max
  Coding DNA Sequence Number=SeqID_60829
MHGATRRRKRCNEGFHGFTAETNSEEGTVKRTVKKRISEEGEDSVKRVWLIFVSL

SEQ ID NO: 177608 - protein, 247 aa, Glycine max
  Coding DNA Sequence Number=SeqID_60830
  Homolog annotation: Hit_ID=Q47522; Match level="QueryCoverage=21%, HitCoverage=64%, E-value=1e-23, Identity=100%"; Hit description=LacZ protein
MDDDARIWKFALNGNWKKIWALKVPPKVKHLIRRIQRDCLPSRVRLHAKGVQCPSTCAFCHNNLESLDVNMQNEKVWEDVETAPVMAMLLAYQHLFKWKQARYNPSSMAATQNHHVPWKPPLPRDEWGRFVIANTATMFGVPEPIEVEAWSLLHPLCPGDPLVLERPPPRWSSNSPYSESYYNSLAVVLQRRDWENPGVTQLNRLAAHPPFASWRNSEEARTDRPSQQLRSLNGEWDAPCSGALSAA

SEQ ID NO: 177609 - protein, 90 aa, Glycine max
  Coding DNA Sequence Number=SeqID_60831
  Subcellular localization annotation: CTP_CleavageSite=60; ConfidenceScore=5.55e-01
MTPSPSFLFSAHHGCHSSLSAIDHQLNASQTRHGTRVGLGRIVLPRSPSPNLTLLPVPVSAPRGGGIFCPVPVPQLPAGTLFYIKFLLQK

SEQ ID NO: 177610 - protein, 408 aa, Glycine max
  Coding DNA Sequence Number=SeqID_60832
  Homolog annotation: Hit_ID=Q10NM2; Match level="QueryCoverage=25%, HitCoverage=29%, E-value=1e-33, Identity=67%"; Hit description=RNA recognition motif family protein, expressed
  Pfam annotation: Domain name=RRM_1; Domain location=96-167; Score =80.4; E_value=5.4e-21; Accession=PF00076.12; Description=RNA recognition motif. (a.k.a. RRM, R
MKPPKNHNLTLLPLYKPLHPRHVCFPLTQTVILSFTEKVVLIPLHLSLKRVLFVLDLLVTMSYSRRSRYSPSPSPSPYKRYGRSLSRDAENPGNNLYVTGLSPRITKRELEKHFAAEGKVIDVHLVVDPWTRESRGFGFVTMETLEEAERCVKYLNRSVLEGRVITVEKAKRRRGRTPTPGRYLGLRTIRELLLLLFVYLANPYYVLHYIQLDVALQVTLLVALLAILPSEEATVALPILQTEVGVVLTLLTIRGGGLTLHITPGGGLTLHSIAGTGPILDMIDTGHILDLALRIAGHLSACMTDHTLPMKYDMTRRMRTPTEGTVTDLFHEVPRLMILIMEGTVTGLFLGVPHPGQGEGQGGATHGVLHLFQREATHEMCPPGQGGAIQEALRGVANVRNATQEARV

SEQ ID NO: 177611 - protein, 57 aa, Glycine max
  Coding DNA Sequence Number=SeqID_60833
MVILDYDEVFTVANLNTRTDPQEQDACKGNSRQYHAGECGAAPHHNETGRECSNHER

SEQ ID NO: 177612 - protein, 833 aa, Glycine max
  Coding DNA Sequence Number=SeqID_60834
  Gene Ontology: Mol. function=ATP-dependent helicase activity; Cellular component=intracellular; Biological process=peptidoglycan metabolic process
  Homolog annotation: Hit_ID=Q9SD77; Match level="QueryCoverage=93%, HitCoverage=55%, E-value=0.0, Identity=61%"; Hit description =Putative helicase
  Pfam annotation: Domain name=DEAD; Domain location=366-518; Score =92.9; E_value=1e-24; Accession=PF00270.19; Description=DEADDEAH box helicase
  Pfam annotation: Domain name=ResIII; Domain location=362-512; Score= -29.7; E_value=0.014; Accession=PF04851.6; Description=Type III restriction enzyme, res subunit
  Pfam module annotation: Pfam domain module=DEAD::ResIII; Domain location=366-518::362-512
MDPIQAANELAFRVGFSGHSGHLRLEPLSTEERRNPLRSIPDFIPWVFHTIVYRVVKPPAFPSETPESIKKYIEETYLQPRLDPDDFSPEKVGRQWEFDWFDRAKVPLEPSLPRTMVVPVWEPPFRRSNNGSVKGIWEPKFEEVDVADLTSGAVESGPLPRTSGKDFVRGSINNRPFRPGGLDDSRSLDRILPEGASNGEWVHEILNGGPAQTIPPSLKQGLDFGMLKPYPCSWNVCKEANSLKSSSDEKLSGLSVQFDDLFKKAWDEDAVGDQEDGHLSEVETITLEAEVGTTEVSSRAHESEMSLDDILSADSEGSKLHLDGFNDEIGQQKKEAWAIHETSEQIVDSFHELVPDMALEFPFELDAFQKEAIYYLEKGESVFVAAHTSAGKTVVAEYAFALASKHCTRAVYTAPIKTISNQKYRDLCGKFDVGLLTGDVSLRPEASCLIMTTEILRSMLYRGADIIRDIEWVIFDEVHYVNDVERGVVWEEVIIMLPRHINIVLLSATKRDNNNKSLIPPGKVPNTIEFADWIGRTKQKEIRVTGTTKRPVPLEHCLFYSGELYKICESEKFLPQGLKAAKKEASRKKNLTAGGGSGPKPGISPGHDKARVQKRENTSHTKHHGANFYGTGRGYQNNGNGQSNWELRRADASMLLMLINKLSKKSLLPVVIFCFSKNRCDKSADSLTGTDLTSSSEKSEIRLFCDKAFSRLKGSDKNLPQVVRVQNLLRRGIGVHHAGLLPIVKEVVEMLFCRGVIKVLFSTETFAMGVNAPARTAPYFAKVWRRVIVCTRSLPLSYAKMLHPDLSPCPTDHQGTTFPLCPGSPSTLSFARI

SEQ ID NO: 177613 - protein, 144 aa, Glycine max
  Coding DNA Sequence Number=SeqID_60835
  Gene Ontology: Mol. function=monooxygenase activity; Biological process=electron transport
  Homolog annotation: Hit_ID=Q1T1B4; Match level="QueryCoverage=55%, HitCoverage=18%, E-value=9e-09, Identity=38%"; Hit description =Cytochrome P450
MGLCIRDEWGRLEIAKTATMFGVLEPAKAEAWSLPLALSWIKEQNLYYVDIEMDEKGLHNKSYGDSAFQILINSCKSLVSSFPNSVMSFVQDEWGTFVIAKTTTMYEVNQQKLGDLEFPTCVVVDKRANLYFVDIEMDAKGVAQ

SEQ ID NO: 177614 - protein, 159 aa, Glycine max
  Coding DNA Sequence Number=SeqID_60836
MKNGRRMIEERSKNNVEINCSRDSSASQRLAWVSQGSEKVQNVLIALPFEYFLHSFPKCQKTLQIARQLALSSSIRLARIKMLAKMMTKAQDNEFKIESRTLQESRGNLISRFKNQVSRFKFSRIKNNQDQDSRLKIQESRKGSIKISTKKFFKTLSST

SEQ ID NO: 177615 - protein, 114 aa, Glycine max
  Coding DNA Sequence Number=SeqID_60837
MAPTPRTHIEILVPTPRSMKERALWCPYQTRTLGCPYQTPLHFVVGRVPPVMVERGKLDHIEVRLKTIEGGGDYAFADMVELCLVLDTVIPPKFKVPDFDKYKGTTCPKNHLKM

SEQ ID NO: 177616 - protein, 37 aa, Glycine max
  Coding DNA Sequence Number=SeqID_60838
MPSAPSNTQKPADSSSSFCEARNQTSFVLASPWTKQV

SEQ ID NO: 177617 - protein, 457 aa, Glycine max
  Coding DNA Sequence Number=SeqID_60839
  Gene Ontology: Mol. function=peroxidase activity; Biological process =protein folding
  Homolog annotation: Hit_ID=Q338Y6; Match level="QueryCoverage=83%, HitCoverage=87%, E-value=5e-36, Identity=38%"; Hit description =Expressed protein
  Pfam annotation: Domain name=DUF1678; Domain location=104-298; Score=- 99.6; E_value=0.084; Accession=PF07913.2; Description=Protein of unknown function (DUF1678)
  Pfam annotation: Domain name=DUF641; Domain location=52-203; Score =131.2; E_value=2.9e-36; Accession=PF04859.3; Description=Plant protein of unknown function (DUF641)
  Pfam module annotation: Pfam domain module=DUF1678::DUF641; Domain location=104-298::52-203
MTRKVSNFSDLIQRVTASCLLHPLATAAAKEDDNSPYESEEEVENDEEYEEEENEEYEEEERMLGPLKAFKVKQMEVLMEEVFDTVSSMKRAYVRLQEAHSPWDPERMRAADVAVVAELRKLAVLRERFRRSGGGGGRKKGRRRGGGGRDGVASVREVVAPYEAVVEELKKEVKVKDLEVKNLREKLDSAVALTTNGSAEKKPGRSLSKRKLGIQAMAAVPTPELFEATMMQVRESSKSFTSLLLSLMHNAHWDITAAVRSIEAATASTDKFHNTSSTTSIVSAYHAKYALESYISRKIFQGFDHETFYMDGSLSSLLNPDQFRRDCFTQYRDMKSMDPTELLGILPTCHFGKFCSKKYLAIVHPKMEESLFGNLEQHSHVQAGNHPRSEFYNEFLGVAKTVWLLHLLAFSLNPAPSQFEASRGAEFHPQYMDSVVKFSGGRVPAGQVVGFPVSPGF

SEQ ID NO: 177618 - protein, 297 aa, Glycine max
  Coding DNA Sequence Number=SeqID_60840
  Gene Ontology: Mol. function=transporter activity; Cellular component= mitochondrial inner membrane; Biological process=mitochondrial transport
  Homolog annotation: Hit_ID=Q65YS1; Match level="QueryCoverage=89%, HitCoverage=87%, E-value=1e-100, Identity=67%"; Hit description =Uncoupling protein a
  Pfam annotation: Domain name=Mito_carr; Domain location=112-207; Score=114.5; E_value=3e-31; Accession=PF00153.17; Description =Mitochondrial carrier protein
  Pfam annotation: Domain name=Mito_carr; Domain location=212-297; Score=103.2; E_value=7.5e-28; Accession=PF00153.17; Description =Mitochondrial carrier protein
  Pfam annotation: Domain name=Mito_carr; Domain location=8-106; Score =97.2; E_value=5.1e-26; Accession=PF00153.17; Description =Mitochondrial carrier protein
  Pfam module annotation: Pfam domain module=Mito_carr::Mito_carr::Mito_ carr; Domain location=112-207::212-297::8-106
MSDPNQISFAQAFFCSAFAACFAEFCTIPLDTAKVRLQLQKKVGVDEGVGLPKYKGLLGTVKTIAREEGISALWKGIVPGLHRQCLYGGLRIGLYDPVKTFLVGSAFVGEVPLYHMILAALLTGALAITIANPTDLVKVRLQAEGQLPSGVPRRYSGAIDAYLTILRQEGIGALWTGLGPNIARNAIINAAELASYDKVKRTILKIPGFMDNVYTHLLAGLGAGLFAVFIGSPVDVVKSRMMGDSTYKSTFDCFLKTLLNEGFLAFYKGFLPNFGRVGIWNVILFLTLEQAKRAVRG

SEQ ID NO: 177619 - protein, 125 aa, Glycine max
  Coding DNA Sequence Number=SeqID_60841
  Gene Ontology: Mol. function=sugar porter activity; Cellular component=membrane
  Homolog annotation: Hit_ID=Q59IV5; Match level="QueryCoverage=80%, HitCoverage=33%, E-value=2e-39, Identity=78%"; Hit description =Plastidic phosphate translocator-like protein2
  Subcellular localization annotation: CTP_CleavageSite=66; ConfidenceScore=5.24e-01
MKVSVSGKLFTVGLISFCYVAIAWLKMVPMQTVRSRVQFVKISSLGLIFCLSVVGGNISLRYLPVSFNQAVGATTPFFTAVFAYLMTLRREGWLTYVTLLPVVAGVIIASGVSLLSYLFELKNYR

SEQ ID NO: 177620 - protein, 59 aa, Glycine max
  Coding DNA Sequence Number=SeqID_60842
MVFEDSLSQSAPSSELFRIASSSSSAESHFRELDDAFLQGLSFLQCGIWGGNVGANFRF

SEQ ID NO: 177621 - protein, 97 aa, Glycine max
  Coding DNA Sequence Number=SeqID_60843
  Homolog annotation: Hit_ID=Q1S1T5; Match level="QueryCoverage=52%, HitCoverage=5%, E-value=7e-12, Identity=72%"; Hit description =Calponin-like actin-binding
MERNGATKVRNGATENNQHRKHLDTTAVENRCHDGARSPEITGVTAVPDFDIVICMVAMPKDLVGCRRRSIELSHNILADSSGSYYLQKHARRKSRQ

SEQ ID NO: 177622 - protein, 637 aa, Glycine max
  Coding DNA Sequence Number=SeqID_60844
  Homolog annotation: Hit_ID=Q1S1T5; Match level="QueryCoverage=99%, HitCoverage=76%, E-value=1e-138, Identity=47%"; Hit description =Calponin-like actin-binding
GYPVTDSTKDYETYSDQSVDTENKHLVLQFDDLHTDDLYDYTSDINYNIASPMVERDYLPEDLHQLDIQNQQRNGIFNDDFELLCSKESLQYHCSEDIKHDCELTWSSSSSSPSGDLHTDLIDMTSHLDTKKEQVQESRRIMDLDYFENLSLSSNSSVIVTPKNDKTPGKRDASLLTKDRKGTDLFHEDNSTPNVYQSASSHGSNPTPQTAENGKLFEIGDDKEVLLVACVNCYSREVLNLGDQVDAENNFKNIEPFKVHNDKNGQLDTIKKEHESQGIVKCKDMPYQIISSTGYSYSVKKFEETEPLLYSPDCYFCNTNSLDTVVLHSNDTSSTSLKKFLAYEERDSQLDLDNASCYQSQESLSCQSYYLPESCKWDQKGKCAITSYKDEKISHFLEDGSHEEITPCKQKAPEVLMSTVVKLDTDGEKLNIDSLALASNALAADDCEKCSTLGDGPNDFFKGDTIQDIGEQGQRVLDMLTNEVVVPANCDDDISSPESCISSKLELNGDHQACQYEKDPVYRSEPTRVVHLKEEIKAEDERAHFLENFAGTEEGDKEITKAKPQKRLLLRSVLGGAAAVGLLFMIMHLRRNGGEKAPEPSMASSHKGKEKIKKKSTWKVKTSTTKGVYPAERIKLK

SEQ ID NO: 177623 - protein, 630 aa, Glycine max
  Coding DNA Sequence Number=SeqID_60845
  Homolog annotation: Hit_ID=Q1S1U2; Match level="QueryCoverage=98%, HitCoverage=98%, E-value=0.0, Identity=77%"; Hit description =Membrane attack complex component/perforin/complement C9
  Pfam annotation: Domain name=MACPF; Domain location=119-347; Score =31.7; E_value=5.3e-08; Accession=PF01823.10; Description=MACPerforin domain
MAGKKGVAAEDAIRAIGLGYDLTNDLKLKFCKNHSRLIAIDDDNLRTVELPPRISIPNVPKSIKCDKGDRMRLCSDVLSFQQMSEQFNQDLSLSGKIPTGHFNTAFGFTGVWQKDAANTKTLAFDGVSITLYDIAFEKTQVVLHDHVKQAVPSSWDPAALTRFIEKYGTHVIVGVKMGGTDIIYAKQQYSSTVPPAEVQKKLKDMADEFFIDKAGQYNSIGGRFNAKEKGEPMEDQGRYQQLVGTLNYLTVTIPNITFVVSVFMKDNVLNFMDIQARSYYESEAQDIKFMCRRKGGNGKRFLSHSEWCQTVLSQPDVISMSFVPITSLLGGINGSGYLTHAMNLYLRYKPGIEELHQFLEFQLPRQWAPVFGELALGPERKPQNTASLQFSFMGPKLYVNTTPVDVGKKPVTGLRLYLEGKRSNCLAIHLQHLSSLPKTFQLQDEPNGNASNDSSERKYYEKVQWKSFSHVCTAPVDSDDDNAVVTGAHFEVGDTGLKKVLFLRLHFCKVVGATRVKVPEWEGSPGLTQKSGIISTLISTTFSGPQKPPPPRPSDVNINSALYPGGPPVPTQSPKLLRFVDTTEMTRGPQDSPGYWVVSGARLLVEKAKISLKVKYSLLTVIPDEEGASF

SEQ ID NO: 177624 - protein, 375 aa, Glycine max
  Coding DNA Sequence Number=SeqID_60846
  Gene Ontology: Mol. function=oxidoreductase activity; Cellular component=cytoplasm; Biological process=gibberellic acid mediated signaling
  Homolog annotation: Hit_ID=O22377; Match level="QueryCoverage=99%, HitCoverage=100%, E-value=1e-147, Identity=69%"; Hit description =Gibberellin 3 beta-hydroxylase
  Pfam annotation: Domain name=2OG-FeII_Oxy; Domain location=208-308; Score=142.9; E_value=8.8e-40; Accession=PF03171.10; Description=2OG -Fe(II) oxygenase superfamily
MPSLSEAFRGHPVYLHQKHHDFNSLQELPDSYAWTQPDDDDHRLTNYPSNNKTKTVVPIIDLNDPNAPNLIGHACKTWGVFQVVNHGIPTSLFSDIQRASLALFSLPLHQKLKAARSPDGVSGYGRARISSFFPKLMWSECFTILDSPLDLFLKLWPQDYAKYCDIVVEYEAAMKKLAAKLMCLMLASLGIPKEDIKWAGPKGEFNGACAALHWNSYPSCPDPDRAMGLAAHTDSTLLTILHQNNVNGLQVLKEGEGWVAVPPLPGGLVINVGDLLHILSNGLYPSVLHRVRVNRTRQRFSVAYLYGPPTNVQISPQVKLVGPTRPVLYRSVTWNEYLGTKAKLFNKALSAVRLSSSINGLFDVNEDKSNDFQVG

SEQ ID NO: 177625 - protein, 78 aa, Glycine max
  Coding DNA Sequence Number=SeqID_60847
MSLPVLISYWDGDKRKSSERYIDRTDKKEALTNMKEALLACTIMLLNYIPSIIRYKLVKVVEKFEYVGYKGLLMNMVI

SEQ ID NO: 177626 - protein, 385 aa, Glycine max
  Coding DNA Sequence Number=SeqID_60848
  Gene Ontology: Mol. function=catalytic activity; Cellular component =small ribosomal subunit; Biological process=metabolic process
  Homolog annotation: Hit_ID=Q1RW27; Match level="QueryCoverage=96%, HitCoverage=84%, E-value=1e-176, Identity=70%"; Hit description =Octicosapeptide/Phox/Bem1p; CBS
  Pfam annotation: Domain name=CBS; Domain location=106-226; Score =81.9; E_value=2e-21; Accession=PF00571.18; Description=CBS domain
  Pfam annotation: Domain name=PB1; Domain location=290-370; Score =42.8; E_value=1.2e-09; Accession=PF00564.15; Description=PB1 domain
  Pfam module annotation: Pfam domain module=CBS::PB1; Domain location =106-226::290-370
MVSKVMTRSPIFVTSDMLALEALQKMVQGKFRHLPVVENGEVIAILDITRCLYDAITRMERAAEQGSAIAAAVEGVERHRGSNVSASALIETLKERMFKPSLSTLMGENTKVAIASPADPVYVAAKKMRDLRVNSAVIVSLSGTKIQGILTSKDILMRVVAQNLSPELTLVEKVMTPNPDCASIDTTILDALHMMHDGKFLHLPVVDKDGYVVACMDVLQITHAAISMVESSSGAVNDVANTIMQKFWDSAFNLEPPEDSDTHSELSGLVMSDGADTSKSGYQSVGFGNSFAFKFKDLSGRVHRFNCGTEHLDELVSTIMQRLDVNDGERPIILYEDDEGDKIVLATNSDLVSAVSYARSAGVKVKIFASTGFFMTLQFAPYILI

SEQ ID NO: 177627 - protein, 51 aa, Glycine max
  Coding DNA Sequence Number=SeqID_60849
MSLPASIIMTNSDCNVFMELLKLLKMQKPTQEKLGSAISASYATFSWSHSM

SEQ ID NO: 177628 - protein, 166 aa, Glycine max
  Coding DNA Sequence Number=SeqID_60850
  Homolog annotation: Hit_ID=Q1SKN3; Match level="QueryCoverage=38%, HitCoverage=22%, E-value=5e-17, Identity=75%"; Hit description =Glutaredoxin; Glutaredoxin-related protein
MAVSFLARDVSDLCLGKPPLRSLSASATVADALAALKSSDHETHVTLWSFCENKNERGQSLVSNTLDPPFPYLLLLGDTEAVAVSPENDGPTIELPSGAVYAVYDTNGDVQFIGLSRIIAASVAAHWKSVPELCGSVKVLQRPQMLVGGEVERQRTRVVRWHTEVW

SEQ ID NO: 177629 - protein, 359 aa, Glycine max
  Coding DNA Sequence Number=SeqID_60851
  Homolog annotation: Hit_ID=Q1RW07; Match level="QueryCoverage=44%, HitCoverage=22%, E-value=2e-68, Identity=74%"; Hit description =Diacylglycerol kinase accessory region; Diacylglycerol kinase, catalytic region; Protein ...
  Homolog annotation: Hit description=kinase C, phorbol ester/diacylglyc erol binding
  Pfam annotation: Domain name=C1_1; Domain location=273-336; Score =1.4; E_value=0.018; Accession=PF00130.12; Description=Phorbol estersdiacylglycerol binding
MEPPLPQEYFGNSVHVVSAETTTGELLENGIGWAAWKLHMAVANHNNGVVLQSLKVWLESPFVIQMGSSPRFNVYGMGKAVAARSGYANKFEGKVTSYPGHEGGGSIDLEVCLSPDEEFLNAVSKSNPFIEKDDGKCFTTLLSQKNDPLMLWLTDGPGYSSFSGPAFQIERENFDTKSETLLHLNQVLCLTEEFNQMSLTMIDLGNSFLRLVTSPDASSASIFGWLITGSFGLMALIYAVLKWQRRSSLNWIKAAAREKKKVWKKFKVPLSEHLWVEDFTYREQPSTCCFCLTSLWPFQNLGTTASPHAPLHRCSVCGVAAYFLCSQFAAKDCKCVAQAGFGHIRHHWSERWVNVEEGA

SEQ ID NO: 177630 - protein, 1054 aa, Glycine max
  Coding DNA Sequence Number=SeqID_60852
  Gene Ontology: Cellular component=mitochondrion
  Homolog annotation: Hit_ID=Q1RW25; Match level="QueryCoverage=58%, HitCoverage=86%, E-value=0.0, Identity=70%"; Hit description =Streptomyces cyclase/dehydrase
  Pfam annotation: Domain name=CorA; Domain location=12-390; Score =255.9; E_value=8.3e-74; Accession=PF01544.9; Description=CorA-like Mg2+ transporter protein
  Pfam annotation: Domain name=Polyketide_cyc; Domain location=454-589; Score=69.8; E_value=8.9e-18; Accession=PF03364.10; Description =Streptomyces cyclasedehydrase
  Pfam annotation: Domain name=Polyketide_cyc; Domain location=643-793; Score=27.7; E_value=4.2e-05; Accession=PF03364.10; Description =Streptomyces cyclasedehydrase
  Pfam module annotation: Pfam domain module=CorA::Polyketide _cyc::Polyketide_cyc; Domain location=12-390::454-589::643-793
MVRRKTSVGITTGVKTWMVVSSETGEQRLEDVGKHSLMRRTGLPARDLRVLDPMLSHPSSILVRERAILVNLEHLKGIITSTEVLMINSSNPFFLLFLQDLLTRLTHQPPSPMSNDMNPGYEAKPPAMCGSEDSSQNVSHVKISEEVKADSPKMAPIAPKQLPFEFRALETFIESACRLEEEAYPALDELTSQLCTLNLERVRHIKSRLVALSGRVQKVADELEHLLDDDKDLAEMYLTEKLNASLLDQASLKEEYNSESEDTDQSDESNSEKYDKFPGLKLNVEELEMLLEAYFAQTNGILQRLFSLSEYVDDTEDYINMMLDDKRNELLQATIIFNTLNMILNAGIVVVGLFGMNIQIELFNGKPRQFWATTGGTFGGSPFLSLSFFFPYHSANNGIAVSSTQCKPRIRCDKEVGNGNNNGIEEDEEAEREVQCEVQVVSWRERRVKAEIPVNADIESVWNALTDYDHLADFIPNLVWSGKIPCPYPGRIWLEQRGFQRSMYWHIEARVVLDLQELINSAWDRELHFSMVDGDFKKFEGKWSVKSGTRSSSTNLSYEVNVIPRFNFPAIFLERIIKSDLPVNLQALAYRVERNISGNQKLSLPENHLDKTSSDINESSAQKINSALCENKEDLVNSIPGTLPMPSSEVNINNWGAFGKSCRLDRPCMVDEIHLRRFDGLLENGGVHRCVFASITVKAPVRDEGCKGLLYMVLHARVVLDLCEYLEQEISFEQVEGDFDSFQGKWTFEQLGNHHTLLKYSLESKMRKDTFLSEAIMEEVIYEDLPSNLCAIRDYIENKTASNILEACKQNTNSGQQTVPSGFEDDDSYCSAEDLSDCNAQSSSQQRPRVPGLQRDIEVLKSELLKFIAEHGQEGFMPMRKQLRLHGRVDIEKAINRKGGFRKIATIMNLSLAYKHRKPKGYWDNLENLHYEQQTIGLLTFKSSKERWIKLMAVASSHFQFEVSIQWNFPAGRFDIARALEKWGGLRQVSRLLSLKVRRQRSRQGKLAKDKKVDDDVASPDVDREIKTPSRPTVSQDPQKWLTELKQLDINWVE

SEQ ID NO: 177631 - protein, 200 aa, Glycine max
  Coding DNA Sequence Number=SeqID_60853
MAEIMHSKSNINRIKEVIAKLTSTQFHLMATQNSMATKLDNLLLKMAQLETSQHSPTSSTVNQHIVSPSPNPHRMKLEVTGLTRLQEEKFCDFRRSPRDKPTSLPLSAPHYALAVNQHPSSLLLPSPPKPPSILFKHLSPEKLATRRKKGLFFNCDEKYHRGHKCASKVFLLIAEEADKSQVDHVLLDPSPDKSYLSPRG

SEQ ID NO: 177632 - protein, 1055 aa, Glycine max
  Coding DNA Sequence Number=SeqID_60854
MKFPFSAIVALWFVCDLVLANSRYPGGMYSFDRNTHVTYKYDRMSEVQKQCASVLSASSELRYQYSVTGMKGELSFVNGDWKQDGGKFPIMPFDANKSPGPGTLSEDRAPLNLVSFWVSDVDHDHRLKKLIPINGFMVMGITRDGNFVDSSYDGNAEFQLWPSHSQLSIPFQGIYTESKKNGGERVLCLLGNTMLPTREADPVNPWEGMKNPGDIPLSEDDQIMLVLHYPMTFTLTNRVISGELRSLNRESNSKYFDVVHISSQLSKSAKFTFGSQQIVSKACNPYPFKDNLMDDGISVYKGVRFCEILEEITRDRPLSIVPNWRCNGTDDFCSKLGPFLTDKGIKSTDGGFQDVKLYMQDVVCERATSKSDTGSARVSTVFRAVSPSENQYTAAKRSGPSNTSLAAEGIWKPSSGQLCMVGCLGFVDAEGSSCNTRICMYIPTTFSLKQHSIILGTLSPINNSSAFFPLSFEQLVLPSELWNYFKLTNPNYSYSKINLAGTVLEKNEPFSFTTVIKKSLLTFPKLEDNEAYRDSLSVLSEDLTFHVSGFPDPVPNVLAPRIDIQMEILSIGSLFGHYWNAKNTSESEQETPDLAKAAEYTEKQLLINVSAQLSLTGKGYSFSVLFLEGLYDPHVGKLYLIGCRDVRASWKVLYQSYDLEAGMDCLIQVVVAYPPTTTRWLVDPRASISIESQRTDDDPLRFDPIKLKTFPIIYRKQREDVLSRRGVEGILRILTLSFAIGCILSQLFYIQKNVDSLPYISLVVLGVQALGYSIPLVTGAEALFKKMVSESYDVSSSELESSEWLHVIDYTVKLLLIVSLLVTLRLFQKVWKSRIRLQKLTSLEPHGVPSDKLVFLCTFTIHVIGYVIVLIIHGTKTSQKALIAKTYLVDGGNSHSLPGWETELEEYVGLVEDFFLLPQIIGNLIWHINCKPLRKLYFIGITLVRLLPHIYDYIRAPVSNPYFYEESEFVNPNLDFYSKFGDIAIPVTAIVLAIVVYIQQRWGYEKLSQFLTFGRYKILPTFRYQRLSSRAGESELVPGINGAAAAKENEQVDVE

SEQ ID NO: 177633 - protein, 103 aa, Glycine max
  Coding DNA Sequence Number=SeqID_60855
MVQGKFVPNFGEPLGMEAKCLKKKGKYGEGTNAKVKVILWMNALLEPKLLNPRKTMNCWQPNPITSLESPSDSFLCVHCCMIGDEMQRLELVLVVYDGISLNT

SEQ ID NO: 177634 - protein, 141 aa, Glycine max
  Coding DNA Sequence Number=SeqID_60856
MLGAPCNIAEEPSSGEAIGRSSSDNFSGRRFFQMNNLFYRKNLLPVVSSKEGFSGNFPKEGSSVRTQIVLPEEGSSEKLSEEVNLYWKYGVSQTNPMGVKILRPDSALGAASSGGSVEWSWVLWQLFTCHFFMYQISKFKH

SEQ ID NO: 177635 - protein, 37 aa, Glycine max
  Coding DNA Sequence Number=SeqID_60857
MDFMGPIWYKSPQALSSMRKKELEINGDMARMIMLDE

SEQ ID NO: 177636 - protein, 93 aa, Glycine max
  Coding DNA Sequence Number=SeqID_60858
MSMVASRWRQFKSSLTSKFVYANNYDQQIFDPTLKYGLDPATWAEFAKSRQTLNWGIRKKAQEIQKYNNCPHLLSHGGYELLENKLMDEKRKH

SEQ ID NO: 177637 - protein, 54 aa, Glycine max
  Coding DNA Sequence Number=SeqID_60859
MTLNSIPVSDPDVLEIRQTKGVKILRPDSALGAASSGGSAELGAVAAIYALITC

SEQ ID NO: 177638 - protein, 83 aa, Glycine max
  Coding DNA Sequence Number=SeqID_60860
MSEVTSDCPPRILPSPHQLDFAPYVSGSYNAQWNAPELLHDKHMLHSSCVHRKMEVGFMADLGVAFVDNWVFLDDRVVDNEKG

SEQ ID NO: 177639 - protein, 124 aa, Glycine max
  Coding DNA Sequence Number=SeqID_60861
MRQGTLEKRCLRTKDICKGSEKPSHLKFKKKEFYVDPFGCILLVFFCEQGSGNSQGTSSSLSDEVRQVEWEFFSTLILYLDLNLMQMDKESVLSEALAELAGKIISTCLPDAGFALLSINPKGA

SEQ ID NO: 177640 - protein, 152 aa, Glycine max
  Coding DNA Sequence Number=SeqID_60862
  Homolog annotation: Hit_ID=Q00M75; Match level="QueryCoverage=23%, HitCoverage=5%, E-value=1e-10, Identity=86%"; Hit description=PPR -repeat containing protein
MACGKIYLYIARPVQLLVGVMKFCRGIQCINSRASPGAAVKLCLGDLLVMGSNPETASLHMQGVFRIKILLAILKDVEKVCKTKQKNQKIQQVQVEEYQEHEEEKLFVTNCYVLYAAESNIDAWQINKGSSSIIASHANNSKKPEKTYSPKS

SEQ ID NO: 177641 - protein, 197 aa, Glycine max
  Coding DNA Sequence Number=SeqID_60863
MAKVNEEGVQLLSGGVDDNPSSLMMDLYVRNILRFRLWYDPGGGTSGFMLLCSFLLEVNRIGCEIAETEVPNVRKVLVRVVLSWNSLSSGRLPPYNEYCTSTPTLTVSARYKINVAVDFSDTCKGEKWRGKSILPTPSTMIATIPQPRINLESLFDSNGNNNHSGSAISVATGKETGNINLTVLNNFNSRDLSGIKW

SEQ ID NO: 177642 - protein, 71 aa, Glycine max
  Coding DNA Sequence Number=SeqID_60864
MGDVDEVQEQMKVDMSTLKDQMASMMEAMLSMRRLIESNTVATAAPSTAAETDPALPTSTNQAHQLTPDMR

SEQ ID NO: 177643 - protein, 108 aa, Glycine max
  Coding DNA Sequence Number=SeqID_60865
MGTIINQYKEKLSLAATHEQRLEDEYAKVLVLQAEREARERVIDSLHKEAMMWMDRFTFTLNGSQDLPRLLAKPKAMADVYSAPKEVHRLLNYCQHMIDLMAHIIRSR

SEQ ID NO: 177644 - protein, 89 aa, Glycine max
  Coding DNA Sequence Number=SeqID_60866
MFLVFFKAPPPVSLLGFPNVREKEKELKPPFHGPTCDASFFLHRDYFANLNVLSRQLWVFAGKEKLQFEGYFSQIQHVLIIPNGGKATN

SEQ ID NO: 177645 - protein, 692 aa, Glycine max
  Coding DNA Sequence Number=SeqID_60867
  Gene Ontology: Mol. function=protein transporter activity; Cellular component=soluble fraction; Biological process=ER to Golgi vesicle -mediated transport
  Homolog annotation: Hit_ID=Q8LLE5; Match level="QueryCoverage=76%, HitCoverage=83%, E-value=1e-103, Identity=43%"; Hit description =Coiled-coil protein
  Pfam annotation: Domain name=DUF869; Domain location=129-657; Score =442.7; E_value=5e-130; Accession=PF05911.2; Description=Plant protein of unknown function (DUF869)
  Pfam annotation: Domain name=Strep_SA_rep; Domain location=216-240; Score=8.3; E_value=4.6; Accession=PF06696.2; Description =Streptococcal surface antigen repeat
  Pfam annotation: Domain name=Strep_SA_rep; Domain location=451-475; Score=9.3; E_value=3.1; Accession=PF06696.2; Description =Streptococcal surface antigen repeat
  Pfam annotation: Domain name=Strep_SA_rep; Domain location=507-531; Score=8.4; E_value=4.3; Accession=PF06696.2; Description =Streptococcal surface antigen repeat
  Pfam annotation: Domain name=Strep_SA_rep; Domain location=611-634; Score=1.2; E_value=65; Accession=PF06696.2; Description =Streptococcal surface antigen repeat
  Pfam module annotation: Pfam domain module=DUF869::Strep_SA _rep::Strep_SA_rep::Strep_SA_rep::Strep_SA_rep; Domain location=129 -657::216-240::451-475::507-531::611-634
MMHVEECNVTGSCHQQIFLFSQCWIQWSQFEKSLMDRRSWLWRRKSSEKSPGETESSGSISSLSERFSDEQVGIGIEVVYPTQAAFSPEVTSKAAPNEEVSNPKKSKEDTGLKILTDKLAAALLTISAKEDLVKQHSKVAEEAVSGWEKAENEVSSLKQQLDAARQKNSILEDRVGHLDGALKECMRQLRQARELQEQKMVEAVVNSSRDWESKKSELERKVAEFEAQLQTAKADAAASIHFDLHQRLEAVQNENSSLKHELQSRLEELEFRIVERDLSSQAAETASKQHLESVKKVAKLEAECRRLKAMTRKTFSVNDHRSVTASSVYVESFTDSMSDSGDRLLAVESDMRKLGGWEMNECELRRFDSCSSSFVMELDQFKNEKANGKNHVVSSTEINLMDDFLEMERLATLPDSESGSNFVRKEVASDQSNVGQATIKAEIEAMIEKNAELEKKLGKMEAEMEGMIQKNVELEKKLKKMEAGKVEVDMVLTKYQMQLETSESQIREAELKVAEFQTQLALAKKSNQEACEELKATKAKKEIVESTLKHTETEVEELISKIRSLEEEIHKERALSTENSIKCGNLEVELSKMKHKVQVQQDTEIKHTEGVNLDLKLKQEKDLALAASRFAECQKTIASLGQQLKSLATLEDFLLDSDNPMESTCEVTKEAKEELTEGNCGEARKDKVEVEL

SEQ ID NO: 177646 - protein, 73 aa, Glycine max
  Coding DNA Sequence Number=SeqID_60868
MKTAGNNEAKGMWRSGIDNGSGDLEAAKCFFWSSIKPINFKKAVKLVVFTARSWFLFYFPALPCARYLKILTK

SEQ ID NO: 177647 - protein, 78 aa, Glycine max
  Coding DNA Sequence Number=SeqID_60869
  Subcellular localization annotation: CTP_CleavageSite=34; ConfidenceScore=5.24e-01
MSGHITRRNSAPHKRPPSLSKKLQNGSLSEPPSKASSPPPQEYLLLLYLISSLHSFSLSSAFNHTPIRTNPTKPFYLI

SEQ ID NO: 177648 - protein, 130 aa, Glycine max
  Coding DNA Sequence Number=SeqID_60870
  Gene Ontology: Mol. function=protein serine/threonine kinase activity; Cellular component=nucleus; Biological process=protein amino acid phosphorylation
  Homolog annotation: Hit_ID=P93322; Match level="QueryCoverage=99%, HitCoverage=27%, E-value=5e-46, Identity=70%"; Hit description =Cdc2MsE protein
MWAVGCIFAELLTLKPLFQGAEVKATSNPFQSFSFSLLVDIHSVDEYSRAISQDIVTVPGHPTLEKWPSLASLPHWQQDVQHIQGHKYDNAGLYNVVHLSPKSPAYDLLSKMLEYDPRKRLTAAQALEHE

SEQ ID NO: 177649 - protein, 185 aa, Glycine max
  Coding DNA Sequence Number=SeqID_60871
  Subcellular localization annotation: CTP_CleavageSite=58; ConfidenceScore=5.50e-01
MPTAPPCPMPMQQSQAPMPAPHLAANSKHHMPHTPSSVFNQLGQARAVVSLDNLLSVVVHYGRAAAPHDKLLENRDMALFEMGVESYGSAMVARKRQPAAFALWTAAKPNEFRRDRPWDPGITFGSHGLKPQHLEDKVFLMGQGMLGIRNQALNVPLRTCTNNPNAGANHPSTWWITSNRVCLKC

SEQ ID NO: 177650 - protein, 166 aa, Glycine max
  Coding DNA Sequence Number=SeqID_60872
  Gene Ontology: Mol. function=oxidoreductase activity; Biological process=electron transport
  Homolog annotation: Hit_ID=Q1RW32; Match level="QueryCoverage=98%, HitCoverage=28%, E-value=1e-66, Identity=79%"; Hit description =Pyridine nucleotide-disulphide oxidoreductase, class I
MEQIVLVDQSECFVFKPMLYELLSGEVDKWEIAPPFSDLLANTSVQFFKDRVKVLNPSDHWGMNGSKASSCGGTVHLESGLLVEYDWYNMHCLTRLVLALGAESKLDVVPGAVEFAIPFSMLEDAPKVNDKLTKLERKTFGKDFQISVAVIGCGYSGVELAATLAE

SEQ ID NO: 177651 - protein, 169 aa, Glycine max
  Coding DNA Sequence Number=SeqID_60873
  Gene Ontology: Mol. function=oxidoreductase activity
  Homolog annotation: Hit_ID=Q1RW32; Match level="QueryCoverage=85%, HitCoverage=21%, E-value=4e-37, Identity=59%"; Hit description =Pyridine nucleotide-disulphide oxidoreductase, class I
MVEAEQQQSLQLSAFQITMLHIALAAPVSPTVVDFHSSSHPHTTTCLESEKTEGKLSCGAKQWSALFPSFRRSRGAGSSLFASSLRKRLQLRFFASGENGGTGGAVEEISEAEKEPTNFAWPDNKNYLIAEPRVCILGGGFGGLYTALRLESLEWPDDKKTQLAGFYGC

SEQ ID NO: 177652 - protein, 188 aa, Glycine max
  Coding DNA Sequence Number=SeqID_60874
  Gene Ontology: Mol. function=oxidoreductase activity; Biological process=electron transport
  Homolog annotation: Hit_ID=Q1RW32; Match level="QueryCoverage=99%, HitCoverage=45%, E-value=1e-72, Identity=62%"; Hit description =Pyridine nucleotide-disulphide oxidoreductase, class I
MICPNAQPGNREVALKRLSELESSDTLTGADENSTEVVPDFEKYILELQPAERGMQSKIVEADLVLWTAGTKPPLPQLEPSDVAFQQADFTGWNLWAAINGRPLLPFRFQNLGEMMTLGRNDAAISPSFIDGLTLEGSVGHTARKIAYLIRLPTDEHRLKVGISWLTKSAIDSVSSLQSTLYKVVSGS

SEQ ID NO: 177653 - protein, 431 aa, Glycine max
  Coding DNA Sequence Number=SeqID_60875
  Gene Ontology: Mol. function=pepsin A activity; Cellular component =cellulose and pectin-containing cell wall; Biological process =proteolysis
  Homolog annotation: Hit_ID=Q1SJD1; Match level="QueryCoverage=82%, HitCoverage=90%, E-value=1e-158, Identity=70%"; Hit description =Peptidase aspartic, active site; Immunoglobulin/major histocompatibil ity complex
  Pfam annotation: Domain name=Asp; Domain location=70-418; Score= -107.5; E_value=2.9e-07; Accession=PF00026.14; Description=Eukaryotic aspartyl protease
  Subcellular localization annotation: CTP_CleavageSite=39; ConfidenceScore=5.47e-01
MKMGKVVMVVAVMVLFNMSSCSAWFGGNKHKSGRNSILPSEATSSRSRLLNPAGSSIVLPLYGNVYPVGFYNVTLNIGQPARPYFLDVDTGSDLTWLQCDAPCTHCSETPHPLYRPSNDFVPCRDPLCASLQPTEDYNCEHPDQCDYEINYADQYSTFGVLLNDVYLLNFTNGVQLKVRMALGCGYDQVFSPSSYHPLDGLLGLGRGKASLISQLNSQGLVRNVIGHCLSAQGGGYIFFGNAYDSARVTWTPISSVDSKHYSAGPAELVFGGRKTGVGSLTAVFDTGSSYTYFNSHAYQALLSWLKKELSGKPLKVAPDDQTLPLCWHGKRPFTSLREVRKYFKPVALGFTNGGRTKAQFEILPEAYLIISNLGNVCLGILNGSEVGLEELNLIGDISMQDKVMVFENEKQLIGWGPADCSRIPKSGDVSI

SEQ ID NO: 177654 - protein, 74 aa, Glycine max
  Coding DNA Sequence Number=SeqID_60876
EVEVAHGSGGVEVDGREVCAVTRLIGAVCAVTRLIGAACAVMGLVGAVLAPEEVVQAVTRRRGDGMLIVMAVRW

SEQ ID NO: 177655 - protein, 740 aa, Glycine max
  Coding DNA Sequence Number=SeqID_60877
  Gene Ontology: Mol. function=heat shock protein binding; Cellular component=integral to membrane; Biological process=protein folding
  Homolog annotation: Hit_ID=Q1SJE9; Match level="QueryCoverage=98%, HitCoverage=80%, E-value=2e-79, Identity=59%"; Hit description=Heat shock protein DnaJ, N-terminal
  Pfam annotation: Domain name=TolA; Domain location=279-657; Score= -116.0; E_value=0.002; Accession=PF06519.2; Description=TolA protein
MRAKRDKLHTPDIGLSSEPTASASKTTPTSAEDPFKVFESASAPVDSSAGHFMDPLEEISKFSSSRSTKNDSSSTSNGKVYEDIDPFDGLGKSAPAFSSERNSRKGSSSPRLNTSTSWTGDKEPVDKISGRSPERHTQNKIPVENDREFPHVPFHMPTYSSDSDKPVGPRPTSPPYDNVDFRQTNVQADMSPKYEDNLEPSEDIWLTVSEIPLFTQPTTAPPPSRPPPPRPVHIPKSGTSSPASANARKKTNEFSSFPGSTRFAQGPKSAPAAERVPPSSQFDELDDFAMGRSRGNDNESANGFLPDEELEMNSAAAAMKEAMDRAEAKFRHAKEVREREYSKAARSKEAVQMEKDERTVLEERENQERLDRERQQKEREEKEQRRLMKEREEKEREQQRLERERARQAVERATREARERAAAEARQRAERAAVEKVNAEARGRAERAAVQRAQAEARERAAAEAKERAEKAAAEAKERETRERATAARAEAEARVKAERASVERAAAEARERAAAAARMNQQKNENDLESFFGMGARASSVPRPPRANSSDNVFESQFQSDVTRKSTSASTSMKKASSSTNIVDDLSSIFGAAPTSGEFQEVEGETEERRRARLERHHRTKERAAKALAEKNQRDLQTQREQAERHRLAETLDFEIKRWAAGKEGNLRALLSTLQYVLWPECGWQPVSLTDLITAAAVKKAYRKATLCIHPDKVQQKGANLQQKYVAEKVFDLLKGLIS

SEQ ID NO: 177656 - protein, 411 aa, Glycine max
  Coding DNA Sequence Number=SeqID_60878
  Gene Ontology: Cellular component=integral to membrane; Biological process=peroxisome organization and biogenesis
  Homolog annotation: Hit_ID=Q8LFS8; Match level="QueryCoverage=81%, HitCoverage=68%, E-value=1e-134, Identity=67%"; Hit description =Amino acid transport protein AAP2
  Pfam annotation: Domain name=Aa_trans; Domain location=39-399; Score =280.6; E_value=2.9e-81; Accession=PF01490.8; Description =Transmembrane amino acid transporter protein
MPENPAATTNLQVFGIEDDLPSHSQNNSKCYDDDGRLKRTGNVWTASSSDRIRGAWAIAQLGWIAGPTVVFLFSLVTSWAIKRSNCFHKSGGKNPCHMPSNLYMIIFGATEMFLSQIPDFDQIWWLSTVAAIMSFTYSIIGLSLGIAKVAETGPFKGGLTGVSIGPVSETQKIWRTSQALGDIAFAYSYAVVLIEIQDTIKSPPSEAETMKKATLISIAVTTTFYMLCGCMGYAAFGDAAPGNLLTGFGFYNPYWLIDIANAAIVIHLVGAYQVFSQPIFAFVEKEVTQRWPNFNREFKIPIPGFSPYKLKVFRLVLRTVFVVLTTVISMLLPFFNDIVGVIGALGFWPLTVYFPVEMYISQKKIPKWSNRWISLKIFSMACLIVSVVAAVGSVAGVLLDLKKYKPFHSNY

SEQ ID NO: 177657 - protein, 706 aa, Glycine max
  Coding DNA Sequence Number=SeqID_60879
  Gene Ontology: Mol. function=beta-galactosidase activity; Cellular component=beta-galactosidase complex; Biological process =carbohydrate metabolic process
  Homolog annotation: Hit_ID=Q1SJD5; Match level="QueryCoverage=98%, HitCoverage=98%, E-value=0.0, Identity=74%"; Hit description =Galactose-binding like
  Pfam annotation: Domain name=Glyco_hydro_35; Domain location=33-341; Score=586.7; E_value=2.2e-173; Accession=PF01301.10; Description =Glycosyl hydrolases family 35
  Pfam annotation: Domain name=Glyco_hydro_42; Domain location=54-361; Score=-230.9; E_value=0.0042; Accession=PF02449.6; Description=Beta -galactosidase
  Pfam module annotation: Pfam domain module=Glyco_hydro_35::Glyco _hydro_42; Domain location=33-341::54-361
MTSSEKENWVALVILLLGSWTLAMAEVTYDGRSLIIDGQRKILFSGSIHYPRSTPQMWPALISKAKEGGLDVIQTYVFWNLHEPQFGQYDFSGRYDLVRFIKEIQVQGLYVCLRIGPYIESEWTYGGFPFWLHDVPAIVYRTDNQPFKLYMQNFTTKIVSMMQSEGLYASQGGPIILSQIENEYQNVEKAFGEDGSRYVQWAAEMAVGLKTGVPWLMCKQTDAPDPLINTCNGMRCGETFTGPNSPNKPAFWTENWTSFYQVYGGEPYIRSAEDIAFHVTLFIARKNGSYVNYYMYHGGTNLGRTSSSYVITSYYDQAPLDEYGLLRQPKWGHLKELHAAIKSCSTTLLEGKQSNFSLGQLQEGYVFEEEGKCVAFLVNNDHVKMFTVQFRNRSYELPSKSISILPDCQNVTFNTATVNTKSNRRMTSTIQTFSSADKWEQFQDVIPNFDQTTLISNSLLEQMNVTKDKSDYLWYTLSESKLTAQSAAHVTHAFADGTYLGGAHGSHDVKSFTTQVPLKLNEGTNNISILSVMVGLPEKLIFFSNQKDAGAFLERRFAGLTAVEIQCSEESYDLTNSTWGYQVGLLGEQLEIYEEKSNSSIQWSPLGNTCNQTLTWYKTAFDSPKGDEPVALNLESMGKGQAWVNGESIGRYWISFHDSKGQPSQTLYHVPRSFLKDIGNSLVLFEEEGGNPLHISLDTISSTNIS

SEQ ID NO: 177658 - protein, 75 aa, Glycine max
  Coding DNA Sequence Number=SeqID_60880
MANVAEPIHKRRTWVGNALIVTSILFKYSLRKHTRQNEMKVKRWGQRISTSYKVWEQLLVHEKDALMGCGMSMSL

SEQ ID NO: 177659 - protein, 66 aa, Glycine max
  Coding DNA Sequence Number=SeqID_60881
  Homolog annotation: Hit_ID=Q9XHD7; Match level="QueryCoverage=88%, HitCoverage=13%, E-value=7e-20, Identity=71%"; Hit description=UVB -resistance protein UVR8
MGDKMAMVACGWRHTRCVSSSGGLYTTGWGKYGQLGHGNFEDHLVPRKVQALSDKFISQVVLQIHA

SEQ ID NO: 177660 - protein, 58 aa, Glycine max
  Coding DNA Sequence Number=SeqID_60882
MARSESGRDVYSWGCDKEPKAAAGNIFMKLEARVQADVQEVNKPKRRITKPSYLKDFV

SEQ ID NO: 177661 - protein, 139 aa, Glycine max
  Coding DNA Sequence Number=SeqID_60883
  Homolog annotation: Hit_ID=Q1SJF0; Match level="QueryCoverage=28%, HitCoverage=9%, E-value=1e-15, Identity=90%"; Hit description =Regulator of chromosome condensation/beta-lactamase-inhibitor protein II
MVNLDLEPQRTLFCHKKFKNLSLRNFRNHEVSKIIFYFFEKEKVGNTFKKVELNAMVIFLLANSSSKVFSSGDWCSTVKGREYWYVPVFGHGNWLNTNIQGIPIKMVAAGAEHSVAITEDGNLYGWGWGRYGNLGLGDK

SEQ ID NO: 177662 - protein, 191 aa, Glycine max
  Coding DNA Sequence Number=SeqID_60884
  Gene Ontology: Mol. function=oxidoreductase activity; Cellular component=mitochondrial outer membrane translocase complex; Biological process=electron transport
  Homolog annotation: Hit_ID=Q1SZE5; Match level="QueryCoverage=92%, HitCoverage=41%, E-value=8e-81, Identity=81%"; Hit description =Pyridine nucleotide-disulphide oxidoreductase, class I; FAD -dependent pyridine ...
  Homolog annotation: Hit description=nucleotide-disulphide oxidoreductase
MLGKSTFGLSMWLLKWLPMRLVDRFLLMVSWLLLGDTSHLGLDRPRLGPLELKNLSGKTPVLDVGTLAKIKGGDIKVRPAIKRLKRHTVEFVDGRTENYDAIILATGYKSNVPYWLKEEDMFSKKDGYPRRPFPNGRKGRNGLYAVGFTKKGLLGASMDAKRIAEDIEQCWETGANHRTTLAPSHLPQPNS

SEQ ID NO: 177663 - protein, 515 aa, Glycine max
  Coding DNA Sequence Number=SeqID_60885
  Gene Ontology: Mol. function=triacylglycerol lipase activity; Biological process=lipid metabolic process
  Homolog annotation: Hit_ID=Q2TNK2; Match level="QueryCoverage=95%, HitCoverage=79%, E-value=1e-122, Identity=47%"; Hit description =Phytoalexin-deficient 4-2 protein
  Pfam annotation: Domain name=Lipase_3; Domain location=1-91; Score =3.1; E_value=0.00029; Accession=PF01764.16; Description=Lipase (class 3)
MLEIVGNKDTKSVVITGHSIGGATASLCTLWLLSYLQSISSSVSILCITYGAPLIGNESFSQTIFKERWGGNFCHVVSKHDIMPRLLFAPITSLSTQLNSLLQFWHLSMTSPDFGKLANQISEKEKDKLFTAVMDYLEAATQDGEKSAPILFHPFGSYFFVSEEGAVCVDSPSAIIKMMHLMLATSSPASSIEDHLKYGDYVNKMSAQTLYQSNSMQKNIPDSSYEAGLELAIQSSGIANQEPAITSAKECLKTTRRMGPSPTLNAASLAVSLSKVVPYRAQIEWYKTWCDEQDDQMGYYDSFKSRDSSSSKRDMKININRCKLARFWNNVIDMLERGELPHDFDKRAKWVNTSHFYKLLVEPLDIAEYYGKGMHRTKGHYMQHGRERRYEIFDRWWKDKTVTTGREENKERSKFASLTQDSCFWARVEEARDWLNCVRSERDTNKLALLWDKIENFEKYAIDLIENKEVSGDVLFKNSSYSIWVEDLRELKQLKAKVQRFPRQFTGFLDGEVVP

SEQ ID NO: 177664 - protein, 94 aa, Glycine max
  Coding DNA Sequence Number=SeqID_60886
MQRDERVQWVKDQKGKRNVCIFQQGMVDWLVLVDEIKFTAWSWLYNNHPEFNISFVQWSSNIAACRWVWHMHVGNHVFCCGLHAKREPTFMFGT

SEQ ID NO: 177665 - protein, 69 aa, Glycine max
  Coding DNA Sequence Number=SeqID_60887
MKNERRMMKNDEERRRIFTKLLTEEIKGRWLSPSSPRRAGLLPPEGTAFCLNPLEGPSGPGCYLHTYFY

SEQ ID NO: 177666 - protein, 179 aa, Glycine max
  Coding DNA Sequence Number=SeqID_60888
  Gene Ontology: Mol. function=sequence-specific DNA binding; Cellular component=nucleus; Biological process=regulation of transcription, DNA-dependent
  Homolog annotation: Hit_ID=O22300; Match level="QueryCoverage=68%, HitCoverage=29%, E-value=4e-25, Identity=50%"; Hit description =Homeobox protein knotted-1-like LET12
  Pfam annotation: Domain name=KNOX1; Domain location=94-138; Score =72.6; E_value=1.2e-18; Accession=PF03790.4; Description=KNOX1 domain
MAFHEHLPHEITFQPFAEEQQQQQLGQSRDMQRLLPLSGGAPTWLNNSNAATLRQQNFLHLQPESAATAAQQNDDVRAMDRNRTESNSEADDLAEYKADILGHPLYDQLLSAHVSCLRIATPVDQLPRIDAQLQQSQRVVDKYSGLGNGNGVVDDKELDQFMVCTCFLSHNLLITIMVL

SEQ ID NO: 177667 - protein, 98 aa, Glycine max
  Coding DNA Sequence Number=SeqID_60889
MATSPLTTSESGRTPEASLQEDSSPDWNSCQDWKCQRDKVVCPLLDRCRVGRVSDVGRKAWLMLGILVEAKVIAWASPSFFFAPVAPNLLLLILAGAT

SEQ ID NO: 177668 - protein, 127 aa, Glycine max
  Coding DNA Sequence Number=SeqID_60890
MRLTRDLALSAQGQPRDDSLGALSDHMRAKRASHKFLGSFQNSPTPQLPPRGYDERAKPTRITAEARSTRLAGTSALSALMNLSERAKLVPQELSACICHQPSRFTLCTPTSTLHIPLLATFCTLLY

SEQ ID NO: 177669 - protein, 251 aa, Glycine max
  Coding DNA Sequence Number=SeqID_60891
  Homolog annotation: Hit_ID=Q1SKD7; Match level="QueryCoverage=85%, HitCoverage=54%, E-value=9e-08, Identity=25%"; Hit description =Ankyrin
MASRKHQAVPTPGEASNWDSSHFTSKIAWHRYQDNIQLRNILPERNAELGPVMFDEFLQELRRCRWDQVLTRLSEKRIDVALVKEFYSNLYDLEDHNPRFCRVRGQVVRFDADTINDFLDTPVILEDGEEYPVYTRYLNTHPDPNTIPATLCTPGGRFVLNADGLPWKLLRKDMTTLAQTWSVLSYYDLAPTSHTYDVNLDKARLIYSLVSRMDMDVGNFISQQISQIAQSSTSRLGFPTLITALCDIQGV

SEQ ID NO: 177670 - protein, 46 aa, Glycine max
  Coding DNA Sequence Number=SeqID_60892
MALGSGLWKSHPPKPRALGLWRPHPLQKEKARLLARPPAHQTHPCS

SEQ ID NO: 177671 - protein, 168 aa, Glycine max
  Coding DNA Sequence Number=SeqID_60893
  Homolog annotation: Hit_ID=Q1SKD7; Match level="QueryCoverage=97%, HitCoverage=41%, E-value=8e-11, Identity=27%"; Hit description =Ankyrin
MEIAPKKLLSKRARKDTTEEGSSAASQADMEFDKHRFQSEKHQCRFEAIKSWSFLKERRVKLRGGEYVEFQEEISRRQWTQLAGPMAKYDPEIVMEFYANAWPTEEGVRDKRSWVWGQWIPFDEDTINQFLGLLLVLEEGQRCKFSQRRSQASGFDEEAISQQLCVPG

SEQ ID NO: 177672 - protein, 459 aa, Glycine max
  Coding DNA Sequence Number=SeqID_60894
  Gene Ontology: Mol. function=ATP-dependent peptidase activity; Cellular component=integral to membrane; Biological process=ATP -dependent proteolysis
  Homolog annotation: Hit_ID=Q6EQH5; Match level="QueryCoverage=90%, HitCoverage=90%, E-value=1e-141, Identity=59%"; Hit description =Membrane protein-like
  Pfam annotation: Domain name=DUF81; Domain location=81-427; Score =5.4; E_value=7.2e-06; Accession=PF01925.9; Description=Domain of unknown function DUF81
  Subcellular localization annotation: CTP_CleavageSite=25; ConfidenceScore=5.00e-01
MAEFGTRTGSIWTVLFCFASVVAIVASERSIMKMEVARFNVTTSREPQQSFLTKALNFLWQSGESGYQHVWPDMEFGWQIVVGTFVGFCGAAFGSVGGVGGGGIFVPMLSLIVGFDQKSSTAISKCMIMGAAVSTVYYNLKLRHPTLNMPIIDYDLALLIQPMLMLGISIGVVFNVVFPDWIVTILLIVLFLGTSTKAFFKGIETWKKETIMKKEAAKRQESNGSGAEVEYKPLPSGPNGANEKDTKEQEVTIIENVYWKEFGLLVFVWVSFLALQIAKVPVSVGVTAYEAAALFSGRRVIASTGEQGKDFTVLQLIIYCVFGVLAGVVGGMLGLGGGFVMGPLFLELGVPPQVSSATATFAMTFSSSMSVIEYYLLKRFPIPYALYFVLVATIAAFVGQHIVRKLIILFGRASLIIFILASTIFVSAVSLGGVGIVNMVHKIDNHEYMGFEDLCKYGS

SEQ ID NO: 177673 - protein, 408 aa, Glycine max
  Coding DNA Sequence Number=SeqID_60895
  Gene Ontology: Mol. function=GTP binding; Cellular component =intracellular
  Homolog annotation: Hit_ID=Q8LBI3; Match level="QueryCoverage=69%, HitCoverage=100%, E-value=2e-85, Identity=59%"; Hit description =Putative GTP-binding protein
  Pfam annotation: Domain name=MMR_HSR1; Domain location=111-237; Score= 53.5; E_value=7.3e-13; Accession=PF01926.13; Description=GTPase of unknown function
  Pfam annotation: Domain name=Miro; Domain location=112-237; Score= -4.6; E_value=0.015; Accession=PF08477.3; Description=Miro-like protein
  Pfam module annotation: Pfam domain module=MMR_HSR1::Miro; Domain location=111-237::112-237
  Subcellular localization annotation: CTP_CleavageSite=65; ConfidenceScore=5.57e-01
MVLLYLPRFPLYLVTLSHSLPRRTYSKTTLLRPPKSTLTTSQPLTVNPSPTELSLEKLFVPPETTVSLESSRVLNGSNILLSNYANDAQVLQAEFVKSSVKTEDCPSDGIPEFALVGRSNVGKSSLLNSLVRRKKLALTSKKPGMEFYELVDWNSMQTKPMTFICHYVLVIRYASAPHELRMDWEKFTKDYFLNRSTLVSVFLLIDASIPAKQIDLDYASWLGQNQIPMTLIFTKCDKRKKKKNGGKRPEDNVNDFQDLIRALLIRVVMRYSSIWPSYGTTGSSTSSEKHDIVRAGVNLNGLHPPWKNRSQALIQIQNRHRRGDKFLHEITAEVEKDRRRERNERLRLGLDTADIDAESEQDYMGVGPLIAKLEKEMLKESAELNRYEEPTDSEDDSDEETMDDADKK

SEQ ID NO: 177674 - protein, 297 aa, Glycine max
  Coding DNA Sequence Number=SeqID_60896
  Homolog annotation: Hit_ID=Q86WR0; Match level="QueryCoverage=66%, HitCoverage=95%, E-value=8e-54, Identity=54%"; Hit description =Coiled-coil domain-containing protein 25
  Pfam annotation: Domain name=DUF814; Domain location=74-166; Score =112.2; E_value=1.5e-30; Accession=PF05670.3; Description=Domain of unknown function (DUF814)
MANVIIPVAATKAYSWALVKGEREGSVILIYAAIRITKAILICVEERTGLRTLLFFLVCVKTKQRHTMVFYFKARPEAGDFTIFMGLDKFENEELIKYGFPEDIWFHVDKMSSAHVYVRLHKGQTLDDLSEALLEDCAQLVKANSIQGNKVNNVDVVYTPWSNLKKTASMDVGQVGFHNSKMVRTVRVEKRINEIVNRLNKTKVERKPDLKGEREAVGAAERAERKQQLREKKRREELERLEKEKQTELRSYKGLMVAENMTSNKQIASGSKSLQELEEDFMQMTGGQLTTWQIYVD

SEQ ID NO: 177675 - protein, 644 aa, Glycine max
  Coding DNA Sequence Number=SeqID_60897
  Gene Ontology: Mol. function=protein serine/threonine kinase activity; Cellular component=membrane; Biological process=protein amino acid phosphorylation
  Homolog annotation: Hit_ID=Q8GX23; Match level="QueryCoverage=75%, HitCoverage=82%, E-value=1e-107, Identity=43%"; Hit description =Putative serine/threonine protein kinase
  Pfam annotation: Domain name=Extensin_2; Domain location=1-302; Score= -137.9; E_value=0.065; Accession=PF04554.4; Description=Extensin-like region
  Pfam annotation: Domain name=Pkinase; Domain location=315-514; Score =68.6; E_value=1.9e-17; Accession=PF00069.15; Description=Protein kinase domain
  Pfam annotation: Domain name=Pkinase_Tyr; Domain location=315-561; Score=56.6; E_value=6.1e-16; Accession=PF07714.7; Description =Protein tyrosine kinase
  Pfam module annotation: Pfam domain module=Extensin_2::Pkinase::Pkinas e_Tyr; Domain location=1-302::315-514::315-561
  Subcellular localization annotation: CTP_CleavageSite=26; ConfidenceScore=5.38e-01
MLAVAPYSPAAPPPLSLLFDITPPPSPSMYPTPPAPPVTPPPETLLVQDSPPPSSVTPLPLTEPLLPSPSPESLPPPLPSSTVTPSPPTPTAESQPPPFPFATAPAPTTFPPFAVAPSPPTPTATFPPALPEMPPATAATVTVPSPPQHPPFMTEPTLATPWFPALPASAPEVNFPSTARGGSLPVAVDVQKPSTFHVSSGLIFGLVIAAIVFVFVFTVGSVLRWNRKKNKHNNLSTPHYKESSPSLGSKGSHVIRVSPNPTLPPPPPLTEGGGASGSFNSVSVKAIPNHAPRGAFGPANGIFTYDELLVATKCFSESNLLGEGGFGYVYKGVLPCGKEIAVKQLKSGSQQGEREFQAEVETISRVHHKHLVEFVGYCVTRAERLLVYEFVPNNTLEFHLHGNPAIIHRDIKASNILLDFKFEPKVSDFGLAKIFPNNDSCISHLTTRVMGTFGYLAPEYASSGKLTDKSDVYSYGIMLLELITGHPPITTAGSRNESLVDWARPLLAQALQDGDFDNLVDPRLQKSYEADEMERMITCAAACVRHSARLRPRMSQIVGALEGVVSLTDLVGDVTTGLTTDTVYNWSNILDYDAGHYQQDMRNFNLALSCHKYSSSGYSETTSAYGLHSSGSSSEAQQSFRDIV

SEQ ID NO: 177676 - protein, 103 aa, Glycine max
  Coding DNA Sequence Number=SeqID_60898
METQDATMAGPWLETRPCASLLTPAKVTRDYHGQRWRREVKVRPGEGVAVVAGGVNECSHGGKEENREKEMKKIERRRGGSLWRKEEKTCWRERTKLSRKEEK

SEQ ID NO: 177677 - protein, 184 aa, Glycine max
  Coding DNA Sequence Number=SeqID_60899
  Gene Ontology: Mol. function=metal ion binding
  Homolog annotation: Hit_ID=Q5JMT9; Match level="QueryCoverage=95%, HitCoverage=59%, E-value=8e-32, Identity=42%"; Hit description =Copine I-like
  Pfam annotation: Domain name=Copine; Domain location=1-76; Score= -18.6; E_value=3.1e-05; Accession=PF07002.6; Description=Copine
MTVISLSIGPTSFAPVIDAAVGIVERSNGQYHVLVIIADGQVTRNSDTPHGKFSPQEKATINFIIAASYSDYQPLSPQLFWLELEMDHGMMQHFDDNITQRLFDNFQSFALAALMEIPIQYRITQNLQIANENPTSYQHKRPLPSSCSRISMLLTESTCKECGVTLSSCPMCRQEITTRLRLYT

SEQ ID NO: 177678 - protein, 977 aa, Glycine max
  Coding DNA Sequence Number=SeqID_60900
  Gene Ontology: Mol. function=DNA binding; Cellular component=nucleus; Biological process=regulation of transcription, DNA-dependent
  Homolog annotation: Hit_ID=Q948S5; Match level="QueryCoverage=99%, HitCoverage=100%, E-value=0.0, Identity=45%"; Hit description=Myb
  Pfam annotation: Domain name=Myb_DNA-binding; Domain location=150 -195; Score=53.2; E_value=8.4e-13; Accession=PF00249.21; Description =Myb-like DNA-binding domain
  Pfam annotation: Domain name=Myb_DNA-binding; Domain location=37-83; Score=61.5; E_value=2.8e-15; Accession=PF00249.21; Description=Myb -like DNA-binding domain
  Pfam annotation: Domain name=Myb_DNA-binding; Domain location=89-144; Score=39.0; E_value=1.6e-08; Accession=PF00249.21; Description=Myb -like DNA-binding domain
  Pfam module annotation: Pfam domain module=Myb_DNA-binding::Myb_DNA -binding::Myb_DNA-binding; Domain location=150-195::37-83::89-144
MEGDQTIPAASDVVIEGVQKIRALNGRTTGPTRRSTKGQWTPEEDEILRKAVQRFKGKNWKKIAECFKDRTDVQCLHRWQKVLNPELVKGPWSKESSIESECKQEDEIIIDLVNRYGPKKWSTIAQHLPGRIGKQCRERWHNHLNPTINKEAWTQEEELALIRAHQIYGNRWAELAKLLPGRTDNSIKNHWNSSVKKKLDSYLASGLLTQLQNVPLVGNPNQPIASISSRLQQSGDDNGPRGTEGEEVSQCSQESANAGHFSSARDMSSVVLQTGEEYRPSEEPSQASCSEPYYVSLDEVTASLQDMAGQEICTSQFIEQKYSHKPRNSSNGDCQLDLLDLTNISSLDFGQESSQMQNDCVAPSENHNIVNVPFQTSMGLGVATTMGPTSVKPEHMLMSDDECCRILFSEAISDECFSSGDYSKGVNMVNLSGCTSFLCQSSLPSVPSVVSSAGDRLTYTYTAEANQLVGSEDQQFVSRTQDNIIYANDLSSSPCIHRIDSTEMQEPSDVVKGDSKLVPVNSFGCGSDAKQTSYPTDEKPNMLTEQEDKGALCYEPPRFPSLDIPFLSCDLIQSGGDMQQEFSPLGIRQFMMSSMNMDLTPFRLWDSPSRDDSPDALLKSAAKTFTGTPSILKKRNRDLLSPLSDKRIDKRLEIEMTSTLIKNFSRLDVMFDDNETQGADLLPASSMQKRDSGTSVEGDKQNCGQAVKVEQVEDKNKSAILNDKKSEDDSGDNNSLDKIKQQPLDVDSEIKNDASAAAEIVQQPSGILVEHDRNDLLLYSPDQSISSSGPGENSGDHIGNDGGLETCNIFGGTPFRKSIESPSAWKSPWFMNTFLSSPRIDTEITIEILIHHNKNRAFLQDFGYFMSPGDRSYDAIGLMKQISEQTAAQYASAQEILGNETPKALPKDASRNDRDEDQEHIDAHNQHGNHCQLASSALVERRVLDFSECGTPVRGDSSKSSAKNFSSPSSYLLKGCR

SEQ ID NO: 177679 - protein, 110 aa, Glycine max
  Coding DNA Sequence Number=SeqID_60901
  Subcellular localization annotation: CTP_CleavageSite=33; ConfidenceScore=5.49e-01
AHITPHSLGGTHKTLSQSLTRQKRSVDGLHTVGASSTAATCGGGQGSLRSWSSHRAEKLLCIALGRKTLAAISTTAQPHTSETPPQSGLDFEFGGGIDELLCIPLISCSL

SEQ ID NO: 177680 - protein, 218 aa, Glycine max
  Coding DNA Sequence Number=SeqID_60902
  Gene Ontology: Mol. function=sequence-specific DNA binding; Cellular component=intracellular; Biological process=regulation of transcription, DNA-dependent
  Homolog annotation: Hit_ID=Q9SIT9; Match level="QueryCoverage=78%, HitCoverage=83%, E-value=5e-51, Identity=62%"; Hit description =Nuclear transcription factor Y subunit B-7
  Pfam annotation: Domain name=CBFD_NFYB_HMF; Domain location=49-114; Score=127.0; E_value=5.2e-35; Accession=PF00808.13; Description =Histone-like transcription factor (CBFNF-Y) and archaeal histone
  Pfam annotation: Domain name=Histone; Domain location=43-117; Score =2.9; E_value=0.063; Accession=PF00125.14; Description=Core histone H2AH2BH3H4
  Pfam module annotation: Pfam domain module=CBFD_NFYB_HMF::Histone; Domain location=49-114::43-117
MEDESHNNILPNGFNTGSTESPCLKTSTMTTQHNNNNNHQNHSNKEQDRFLPIANVGRIMKKVIPPNGKISKDAKETVQECVSEFISFVTGEASDKCQREKRKTINGDDVIWAITTLGFEDYVEPLKTYLQKYKEIEGEKLNIPKQLRSEQRLHQHQQNHNNNHDENNNQPFNGAYASSNLISQPPYVPTDQKFSLPFSPNSIQNQLRQQEQIDSVGH

SEQ ID NO: 177681 - protein, 102 aa, Glycine max
  Coding DNA Sequence Number=SeqID_60903
MPTIELDFPNGKKFPGNGTKNLFHPYTTCYYGCEILLASVPSRASSNKTGMEPSEECLDCGMRGQFPVFETIGETGTRSTCPGLIHCPDEFDQVVIMEELHT

SEQ ID NO: 177682 - protein, 137 aa, Glycine max
  Coding DNA Sequence Number=SeqID_60904
MTSMDGLEKEVAVEGKQNAGVARVGVVEHEGETTDGRPRVSPLGGEPDWPLAPSKARYTTTQEKGRQKANDLIGEVFELRQGLKKNGPGGELAITGTDGSGGTYMVEEGDDERIGVMRWSSSSILRVKDCMDSPRDI

SEQ ID NO: 177683 - protein, 518 aa, Glycine max
  Coding DNA Sequence Number=SeqID_60905
  Gene Ontology: Mol. function=methyltransferase activity
  Homolog annotation: Hit_ID=Q9FMJ2; Match level="QueryCoverage=99%, HitCoverage=58%, E-value=1e-127, Identity=70%"; Hit description =Ankyrin-like protein
  Pfam annotation: Domain name=DUF248; Domain location=321-518; Score =81.2; E_value=1.1e-30; Accession=PF03141.7; Description=Putative methyltransferase
  Pfam annotation: Domain name=TolA; Domain location=13-358; Score= -125.3; E_value=0.0048; Accession=PF06519.2; Description=TolA protein
  Pfam module annotation: Pfam domain module=DUF248::TolA; Domain location=321-518::13-358
  Subcellular localization annotation: CTP_CleavageSite=61; ConfidenceScore=5.19e-01
MAQAKYTRIDNNNKRPSSYCSTVTIVVFVALCLFGIWMMTSSSVTPVQNVDVSQENNNEVKEQSEAKEQPTDPSNNNSQQFEDNRGDLSEDATKGDGSVTPATNYDVTEKQDEKSDEKSQEKPSEDTKTENQDSSVSEKRSDSDESEKRSDSDESEKKSDSDESEKKSDSDESEKKSDSDESEKKSDSDESEKKSEYNETEKNSESNDSSERENKSDSDENEKKSDDASETTDKTEEKVEQSSNQESDENSNEKKTDDNANSQGSNEVYPSVAQSELLNESTTQNGSFTTQAAESKNEKESQVSSKQSANWKLCNVTAGPDYIPCLDNLKAIKSLPSTKHYEHRERQCPKESPTCLVPLPEGYKRPIEWPKSREKIWYSNVPHTKLAEYKGHQNWVKVTGEYLTFPGGGTQFKHGALHYIDTIQQSVPDIAWGNRSRVILDVGCGVASFGGFLFERDVLTMSLAPKDEHEAQVQFALERGIPAISAVMGTKRLPYPGRVFDVVHCARCRVPWHIEGIQ

SEQ ID NO: 177684 - protein, 41 aa, Glycine max
  Coding DNA Sequence Number=SeqID_60906
MGRNKDGTPKTKKPSALFSFKGRAPQVLSAYQYESRGTRVH

SEQ ID NO: 177685 - protein, 116 aa, Glycine max
  Coding DNA Sequence Number=SeqID_60907
  Gene Ontology: Mol. function=catalytic activity; Cellular component =chromatin; Biological process=auxin mediated signaling pathway
  Homolog annotation: Hit_ID=P33079; Match level="QueryCoverage=79%, HitCoverage=100%, E-value=5e-45, Identity=96%"; Hit description =Auxin-induced protein 10A5
  Pfam annotation: Domain name=Auxin_inducible; Domain location=24-114; Score=170.8; E_value=3.4e-48; Accession=PF02519.5; Description=Auxin responsive protein
MPEQTLGCQVGNLVATNSEGEKIMGFRIVGIVRRTSFSTTQAASKRVDVPKGYAAVYVGDKMRRFTIPVSYLNEPSFQELLSQAEEEFGYDHPMGGLTIPYKEEEFLNVTAHLNEL

SEQ ID NO: 177686 - protein, 183 aa, Glycine max
  Coding DNA Sequence Number=SeqID_60908
MKGGNSYSFRGRHISLALVILVILTMLLWTWERNPIIAMTLRSAQEWYRLPSEFPVEAPIESVGTSTLEKGVEKSISPITENGTKLQLDTQGVEAVDSTPTESPETQYNQNVMPSSRSKVTPTPKKGVEKSTTPITENGTKLQFDTKDVAAVDSIPAESPETLYHQTVMSSSRSKGRFFLFCS

SEQ ID NO: 177687 - protein, 343 aa, Glycine max
  Coding DNA Sequence Number=SeqID_60909
  Gene Ontology: Mol. function=cysteine-type endopeptidase activity; Cellular component=endoplasmic reticulum; Biological process =proteolysis
  Homolog annotation: Hit_ID=Q6Y1E6; Match level="QueryCoverage=99%, HitCoverage=100%, E-value=1e-148, Identity=72%"; Hit description =Cysteine protease 8
  Pfam annotation: Domain name=Inhibitor_I29; Domain location=39-96; Score=109.4; E_value=1e-29; Accession=PF08246.2; Description =Cathepsin propeptide inhibitor domain (
  Pfam annotation: Domain name=Peptidase_C1; Domain location=125-342; Score=454.6; E_value=1.2e-133; Accession=PF00112.13; Description =Papain family cysteine protease
  Pfam module annotation: Pfam domain module=Inhibitor_I29::Peptidase _C1; Domain location=39-96::125-342
MATKIQFHHISLALFFCLGFLAFQVASRTLQDASMYERHEQWMARYGKVYKDPEEKEKRFRVFKENVNYIEAFNNAANKPYKLGINQFADLTSEEFIVPRNRFNGHMRSSNTRTTTFKYENVTVLPDSIDWRQKGAVTPIKNQGSCGCCWAFSAIAATEGIHKKSTGKLVSLSEQEVVDCDTKGTDHGCEGGYMDGAFKFIIQNHGINTEASYPYKGVDGKSNIKEEAVHAATITGYEDVPINNEKALQKAVANQPVSVAIDASGADFQFYKSGIFTGSCGTELDHGVTAVGYGENNEGTKYWLVKNSWGTEWGEEGYIMMQRGVKAVEGICGIAMMASYPTA

SEQ ID NO: 177688 - protein, 200 aa, Glycine max
  Coding DNA Sequence Number=SeqID_60910
  Homolog annotation: Hit_ID=P33080; Match level="QueryCoverage=17%, HitCoverage=38%, E-value=4e-11, Identity=97%"; Hit description=Auxin- induced protein X10A
MAEELSTAIPQSQASSTKKRASKNKKRCLEDYLHLVHSRQTLHLTMNQLNQFSFSKKLRSFSLNTRDSFSSFLLSQVIRIHGFKKIHHAPKHQRESPPRPSICPCLPVGPIQPVLSYSPPTSVIHAFRTTEVIHILKHLKFKSLHLIHKFFLTIFSSQVSTHTTTMGFRLPGIRKTSIAANQASSKAVEVPKGYLVVYVG

SEQ ID NO: 177689 - protein, 654 aa, Glycine max
  Coding DNA Sequence Number=SeqID_60911
  Gene Ontology: Mol. function=nucleoside-triphosphatase activity; Cellular component=integral to membrane; Biological process=transport
  Homolog annotation: Hit_ID=Q9SIT6; Match level="QueryCoverage=98%, HitCoverage=98%, E-value=0.0, Identity=68%"; Hit description=White -brown complex homolog protein 5
  Pfam annotation: Domain name=ABC2_membrane; Domain location=374-584; Score=194.7; E_value=2.2e-55; Accession=PF01061.14; Description=ABC -2 type transporter
  Pfam annotation: Domain name=ABC_tran; Domain location=76-262; Score =171.4; E_value=2.3e-48; Accession=PF00005.17; Description=ABC transporter
  Pfam module annotation: Pfam domain module=ABC2_membrane::ABC_tran; Domain location=374-584::76-262
MMQGCEVEAIGISYTIHTHKSENPFKILSKSAQEQLDTEQDGKKEAAEEEAQVEQSCSGGVRHVLKNVSFQAKPWEILAIVGPSGAGKSSLLEILAGKHSPQSGTVFLNHKPVDKAQFRKLSGYVTQKDTLFPLLTVEETLMFSAKLRLKLSQEQLCSRVKSLIKELGLDHVAATRIGDDRLRGISGGERRRVSIGVEVIHDPKVLILDEPTSGLDSTSALQIIDMLKVMADTRGRTIILSIHQPGFRIVKLFNSLLLLANGSVLHHGTADLLGVNLRLMGLELPLHVNVVEFAIESIDTIQQQQKCVPVQVETPRQLPGTMQQQKRGGDGEAGEGRNGKFTLQQLFQQSKVIDEETMYAGMDFTCEFANSRLRETMILSHRFSKNIFRTKELFTCRTVQMLVSGLVVGSIFCNLKDDIVGAYERVGLFAFILTFLLSSSIEALPIFLQEREILMKETSCGSYRVSSYAIANGLVYLPFLLILAILFSMPLYWLVGLNRNFLAFLHFLLLIWLILYTANSVVVCFSALVPNFIVGNSVIAGVIGSFFLFSGYFISKQEIPKYWIFMHYISLFKYPFEGLLINEFSNSGKCLEYMFGACVKSGEDVLKEEGYGGESNRWKNVGVTVCFILVYRFISYVILRYRCSQMGFGRVVTN

SEQ ID NO: 177690 - protein, 352 aa, Glycine max
  Coding DNA Sequence Number=SeqID_60912
  Gene Ontology: Mol. function=cysteine-type endopeptidase activity; Cellular component=endoplasmic reticulum; Biological process =proteolysis
  Homolog annotation: Hit_ID=Q6Y1E6; Match level="QueryCoverage=93%, HitCoverage=96%, E-value=1e-155, Identity=79%"; Hit description =Cysteine protease 8
  Pfam annotation: Domain name=Inhibitor_I29; Domain location=39-96; Score=102.1; E_value=1.7e-27; Accession=PF08246.2; Description =Cathepsin propeptide inhibitor domain (
  Pfam annotation: Domain name=Peptidase_C1; Domain location=125-339; Score=410.0; E_value=3.4e-120; Accession=PF00112.13; Description =Papain family cysteine protease
  Pfam module annotation: Pfam domain module=Inhibitor_I29::Peptidase _C1; Domain location=39-96::125-339
MFAKNQFYQISLALLFCSGFLTFQVTCRTLQDASMYERHEEWMGRYAKVYKDPQERERRFKIFKENVNYIEAFNNAANKPYTLGINQFADLTNEEFIAPRNRFKGHMCSSITRTTTFKYENVTAIPSTVDWRQKGAVTPIKDQGQCGCCWAFSAVAATEGIHALSAGKLISLSEQEVVDCDTKGEDQGCAGGFMDGAFKFIIQNHGLNNEPNYPYKAVDGKCNAKAAANHVATITGYEDVPVNNEKALQKAVANQPVSVAIDASGSDFQFYQSGVFTGSCGTELDHGVTAVGYGVSADGTEYWLVKNSWGTEWGEEGYIRMQRGVKAEEGLWHSYDGILPYCIIIKFGHHYS

SEQ ID NO: 177691 - protein, 260 aa, Glycine max
  Coding DNA Sequence Number=SeqID_60913
  Homolog annotation: Hit_ID=Q9LVN4; Match level="QueryCoverage=64%, HitCoverage=85%, E-value=3e-10, Identity=30%"; Hit description =Arabidopsis thaliana genomic DNA, chromosome 5, P1 clone:MBM17
MAFEDFDPIFSKPKVEVEWASQSSRPFFFHAYSPDSSHLRDIVRIGGSWSEFAGYFVTSLKSQDLKLLLELDSSSYGVVSHAKLVAQKSKGMPLITIPLIKLVDSAAAMEVKSNFCSSLSEAFEIKSMECSLEKEMKPYNWNSDKSFKISNSENGVSTDGLQNSPDKQAAWDTGATKVKNRKIGKCDGRLRAGKRRGNADRVSVSLQLFTAKDERHHQKKKMYLLVSVHRKDKIVAGYVALDDKTYGVLAAEPGMKSSVG

SEQ ID NO: 177692 - protein, 148 aa, Glycine max
  Coding DNA Sequence Number=SeqID_60914
  Pfam annotation: Domain name=zf-CCHC; Domain location=132-148; Score =7.3; E_value=0.062; Accession=PF00098.13; Description=Zinc knuckle
MKKKGKFQHSSKRKCRSKLHDDEPSNFDNAKSPTYILCGTSRAYIYLGCNTKNKRGYISCGSVQVERTSTWLFKENKGGYIPCGSLLVKDFTRLKEISRTGGCLGIGRRHGFWPNHKDSRSKKKNKEESNEIIYFKCRKLGHMKTECP

SEQ ID NO: 177693 - protein, 121 aa, Glycine max
  Coding DNA Sequence Number=SeqID_60915
MDGQWLKKDAQPPQDERAPSPPPQQDDSLALMHEVLSKLRGLRTYVGERFNSLGGRIDAIDACFAGMDTYITQLEEDISYELNYHHQKEGDCRSKDFDVLMIPKDHALLKFNSRGSYASQG

SEQ ID NO: 177694 - protein, 238 aa, Glycine max
  Coding DNA Sequence Number=SeqID_60916
  Gene Ontology: Mol. function=RNA-directed DNA polymerase activity; Cellular component=nucleus; Biological process=RNA-dependent DNA replication
  Pfam annotation: Domain name=Transposase_21; Domain location=100-224; Score=-72.9; E_value=2.2e-08; Accession=PF02992.5; Description =Transposase family tnp2
MLLSAVLSLVNVKARYEWSDKSFSLLLEVVHNMLPEQNMQPKSYYQAKKILWPMGMEYQKIHACPNDCILCKHELKEIHNCPRCGVSRFKCLFANGDNAKDLTWHANGRNYDGMLCHHADSSQWKKIDRLYPNFSKETRNLRLGLATDGMLCHHANTVNWSAEKIVCDNVIGMFLNIQGKTKDGLNTRQDLAEMGIQAQLHPRYDVPQGYSSNIKSLVQLKDLKLTSLKSHDCHILMQ

SEQ ID NO: 177695 - protein, 120 aa, Glycine max
  Coding DNA Sequence Number=SeqID_60917
MVRGIVKILISKLGVSLDDSKINLGAHSRCRTPLGLRNHYIVYIHGKGDWDSLQNGSCKTKRGPNHVEMRKCENDEQEATCSHTKGSANDNVTRGTHNRLGSITTLEKLREIVIWRWCYE

SEQ ID NO: 177696 - protein, 150 aa, Glycine max
  Coding DNA Sequence Number=SeqID_60918
  Gene Ontology: Mol. function=strictosidine synthase activity; Biological process=biosynthetic process
  Homolog annotation: Hit_ID=Q1RTN5; Match level="QueryCoverage=59%, HitCoverage=26%, E-value=8e-29, Identity=65%"; Hit description =Soluble quinoprotein glucose dehydrogenase
MASNLIKVSTSLVLVVLVALTVQILYFSPIDPVLLDIKPVTLQNIIKLGEGLLKEPEDVGVDKEQILYTATRDGWIKRLRRNNGKWENWKHIDSHTLLVIATAKEGGLIVCDTSKIKGEGRYEILTSTADATNAPKKLEQRATMAEGREG

SEQ ID NO: 177697 - protein, 401 aa, Glycine max
  Coding DNA Sequence Number=SeqID_60919
  Gene Ontology: Mol. function=ATP-dependent helicase activity; Cellular component=nucleus; Biological process=RNA-mediated posttranscriptional gene silencing
  Homolog annotation: Hit_ID=Q6YUI7; Match level="QueryCoverage=99%, HitCoverage=78%, E-value=1e-105, Identity=66%"; Hit description=RNA helicase-like
  Pfam annotation: Domain name=Helicase_C; Domain location=221-315; Score=58.4; E_value=2.3e-14; Accession=PF00271.21; Description =Helicase conserved C-terminal domain
  Pfam annotation: Domain name=PWI; Domain location=4-77; Score=7.8; E _value=0.0014; Accession=PF01480.8; Description=PWI domain
  Pfam module annotation: Pfam domain module=Helicase_C::PWI; Domain location=221-315::4-77
MGSDDSLKTWVSDKLMSILGYSQPTVVQFMIGLSKQATSPAHLVGKLVEFGISSMDTHAFAEEIYSRVPHRSSGINADDDSDDDYVDKSSVTTASSRRKEKERQVKRRTSPDEVSDSESEEERLKDQREKEELEQHMRERDAAGTRKVLVNVQIDLDIARFRPDLKLLISSATLDAEKFTIVTSLQIHVTQPPGDILVFLTGQEEIETAEEILKHRTRGLGTKISELIICPIYANLPTELQAKIFEPTPEGARKVVLATNIAETSLTIDGIKYVIDPGFCKMKSYNPRTGMESLLVTPISKASANQRAGRSGRMGPGKCFRLYTAYNDLDDNTRTNLANVVLTLKSLGIHDLLNFDFMDHPPAEALLKALELLFALSALNKLGELTKVGRQMAEFPLDPML

SEQ ID NO: 177698 - protein, 76 aa, Glycine max
  Coding DNA Sequence Number=SeqID_60920
MNRCLAAGNLREQSAQSEKQAYAASRCKNKGEVVAICCSRGWAMQFPCVYEKKAANPKMPHCMDGYRTPKILLTSK

SEQ ID NO: 177699 - protein, 95 aa, Glycine max
  Coding DNA Sequence Number=SeqID_60921
  Homolog annotation: Hit_ID=Q1S326; Match level="QueryCoverage=46%, HitCoverage=12%, E-value=3e-10, Identity=68%"; Hit description =Putative receptor kinase-related
MASVRFLLSMAAMQQWPLYHIKNTILHGVLAEEVYMKPPPGFVAQENCQPFLSPHHCISRQTRIRVQTFFQGSYWVIQESFRLTLTQISDTTRMA

SEQ ID NO: 177700 - protein, 114 aa, Glycine max
  Coding DNA Sequence Number=SeqID_60922
  Gene Ontology: Mol. function=nucleic acid binding; Cellular component= mitochondrion; Biological process=DNA integration
  Homolog annotation: Hit_ID=Q1SRN1; Match level="QueryCoverage=96%, HitCoverage=8%, E-value=5e-35, Identity=65%"; Hit description =Integrase, catalytic region
MAYCEYDALLRNGTWTLVDLPPSRKAIGCKWVFRIKENPDGTVNKYIDRLVAKGFHQQLGYDYNETSPPVIKPVTLDVKNDFLNGTLQEEVYMTQPLNPPTSSLWVDCTKPFMA

SEQ ID NO: 177701 - protein, 157 aa, Glycine max
  Coding DNA Sequence Number=SeqID_60923
  Gene Ontology: Mol. function=nucleic acid binding
  Homolog annotation: Hit_ID=P93486; Match level="QueryCoverage=63%, HitCoverage=69%, E-value=7e-15, Identity=41%"; Hit description =Glycine-rich RNA-binding protein PsGRBP
  Pfam annotation: Domain name=RRM_1; Domain location=60-132; Score =64.4; E_value=3.7e-16; Accession=PF00076.12; Description=RNA recognition motif. (a.k.a. RRM, R
MYVKTACCFTPSLRKMLYCVSDINLKFTVMRIASALVNGSALHFHLPRFLYVRHHSSIKLFVTGLSYDTNEPVLRDAFGQHGEIIEVKVICDHVTGKSRGYGFVRFLSETIAAATHKEMNGQVDLLAKNLASISPNIIICGPCSLSSHRYWMEDAFE

SEQ ID NO: 177702 - protein, 49 aa, Glycine max
  Coding DNA Sequence Number=SeqID_60924
MSIMVNASPSGLALTRCTLVHVSQLNNFNCKLNIHIRLRKMGSLTYALI

SEQ ID NO: 177703 - protein, 88 aa, Glycine max
  Coding DNA Sequence Number=SeqID_60925
  Subcellular localization annotation: CTP_CleavageSite=49; ConfidenceScore=5.06e-01
MLQLFFTVAFSAVPLTLYVPPIRSLNLFVETMEYVVRESRTHRNRVYPRLRVAWSRMLDIMLCNTRELDIKLSLIIEFTALLVNVKEK

SEQ ID NO: 177704 - protein, 193 aa, Glycine max
  Coding DNA Sequence Number=SeqID_60926
MQEEIEGNKEKIDDSDQHVQRDVVKGVGKVGTTGKEMPKKEYVADVGLVAKTMETKRDLKTTPSKEKYTIAQNVKDEKPRIQEEKIKADVEKVDKKGYQAKVVEEGMSKGEHGAEVVPEIKRERPKVAKSEETKEASKLPLKREMGKTTQSAEDRKPKMGEITNEFEKTSGSKQAVEKMLESLNREHQKDSKE

SEQ ID NO: 177705 - protein, 138 aa, Glycine max
  Coding DNA Sequence Number=SeqID_60927
  Gene Ontology: Mol. function=RNA-directed DNA polymerase activity; Biological process=RNA-dependent DNA replication
  Pfam annotation: Domain name=zf-CCHC; Domain location=112-129; Score =15.6; E_value=0.0026; Accession=PF00098.13; Description=Zinc knuckle
MVAEYATRFENLVRYFPHYQGEVGERSKCVKFINGLLPEVKMMDQLEKVTFYRNANVSHGKEKNLVTHNRAKPYSVPPGQYGNHFGGQKTSEGLHPAGGGGGGAPAIVSTPLRCGKCGRLGHIACECTDREVTFFNCL

SEQ ID NO: 177706 - protein, 79 aa, Glycine max
  Coding DNA Sequence Number=SeqID_60928
  Subcellular localization annotation: CTP_CleavageSite=48; ConfidenceScore=5.17e-01
MWPLDGMLLSSNVIHICVRVVILVRMIRTRLFAVAWVKSCPGMRSSCVIASFSGCARTVGRPPISGGGPRTDKRKLLAP

SEQ ID NO: 177707 - protein, 182 aa, Glycine max
  Coding DNA Sequence Number=SeqID_60929
SKSNGRNRGGARVDEGRHGGHERANGHNVGGHDEHGEDNEGKELGSTGGPHFMQVQNKHTFPPYGLPLNYIPPNVAHTPDENVNNSTPILIEIQQPQSNHAHVSQPMGETHEVPHHNLADFKPCLEYTSEGQTVGDEPLPNTLEGPQFLPTTTTIAFHNGKNPSCYGGKRKVGSFRGKAQGH

SEQ ID NO: 177708 - protein, 152 aa, Glycine max
  Coding DNA Sequence Number=SeqID_60930
  Gene Ontology: Cellular component=membrane
  Homolog annotation: Hit_ID=Q0K4H1; Match level="QueryCoverage=90%, HitCoverage=44%, E-value=4e-35, Identity=51%"; Hit description =Permease of drug/metabolite transporter
  Pfam annotation: Domain name=DUF6; Domain location=15-136; Score =38.2; E_value=2.9e-08; Accession=PF00892.11; Description=Integral membrane protein DUF6
  Subcellular localization annotation: CTP_CleavageSite=22; ConfidenceScore=5.24e-01
MDNPLSYGLAFGGAMIWAVYCVVTKKSAKGSNGITLFFMLTALTLWLKSLLSPQPPVVFSLQACISLALAAMAMGLGYAAWNVGILHGNVTLLAAASYFIPIISSLIAAFILNSSLTFSFWQGTAMVCLGSLLCWWSTRGTATHKLESNTLE

SEQ ID NO: 177709 - protein, 280 aa, Glycine max
  Coding DNA Sequence Number=SeqID_60931
  Gene Ontology: Mol. function=sequence-specific DNA binding; Cellular component=intracellular; Biological process=regulation of transcription, DNA-dependent
  Homolog annotation: Hit_ID=Q7MZI9; Match level="QueryCoverage=98%, HitCoverage=83%, E-value=5e-95, Identity=64%"; Hit description =Similar to AraC family transcriptional regulator
  Pfam annotation: Domain name=DJ-1_PfpI; Domain location=1-137; Score =46.5; E_value=9e-11; Accession=PF01965.14; Description=DJ-1PfpI family
  Pfam annotation: Domain name=HTH_AraC; Domain location=180-224; Score= 27.0; E_value=6.9e-05; Accession=PF00165.13; Description=Bacterial regulatory helix-turn-helix proteins, araC family
  Pfam annotation: Domain name=HTH_AraC; Domain location=230-274; Score= 35.5; E_value=1.8e-07; Accession=PF00165.13; Description=Bacterial regulatory helix-turn-helix proteins, araC family
  Pfam module annotation: Pfam domain module=DJ-1_PfpI::HTH_AraC::HTH _AraC; Domain location=1-137::180-224::230-274
MSLQHTSIRCSSGVRLEADVALTAATQHRADTFLVAGAPDASQMQLSASERQQIIALCQRSQRYGSVCTGALLLAQTGLLNGRKVTTHWACAERLALLLPDAQVEADALYVADGALRTAAGVTSGLDLALRLVEEDLGRELAQEVAASLVMFFQRPVTQGHFVRKQQMSLAGRSAFQEMQRWAIAHLAQIRGLEDLAAHMHLSTRHLARLFQQEMQIQPGAWLEQARISHARALLDAGELPLKAIPAACGYHSADVMRRAFVKVTGMTPSLYRKMFPPPR

SEQ ID NO: 177710 - protein, 52 aa, Glycine max
  Coding DNA Sequence Number=SeqID_60932
  Subcellular localization annotation: CTP_CleavageSite=49; ConfidenceScore=5.38e-01
MAYSLVDGASSHLFSFVFHCISMVLLSSSGNIQARRRARFFSGGQGRSSAMA

SEQ ID NO: 177711 - protein, 84 aa, Glycine max
  Coding DNA Sequence Number=SeqID_60933
MVRAFAKRDTQWISARKNPEEDEFSGSLSAPLQVIKRAASAHPLSERSALSQKSLTCAKRSIRPLSARARTRQLIEAVTESNKH

SEQ ID NO: 177712 - protein, 289 aa, Glycine max
  Coding DNA Sequence Number=SeqID_60934
  Gene Ontology: Mol. function=chitin binding; Cellular component =extracellular region; Biological process=chitin metabolic process
  Homolog annotation: Hit_ID=UPI000044A8F0; Match level="QueryCoverage =74%, HitCoverage=100%, E-value=1e-29, Identity=29%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=40; ConfidenceScore=5.64e-01
TCSPLKAMACSPLKVRTCSPLKAMACSPLKARARSPQKVRCSPLLARMCSPLMARTCSPLKARPCSPLKVRTCSPLKAMTYSPLKVRTCSPLLARKCSPLMARMCSPLKARACSPLKVRTRSPLKVRTYSSLKAKACSLLKVRACSPTKAKARACSPLKERACSPLKVRMHSPLKARTCSPLKARTCSPLKVRTCGPLKVWTCSPLMARTCSPLMSRNFTDYTTIPPLTSGMLRNFMDCAIMLPFDSRHVVELHGLANNGCQVPQSGQAKVAYHQTDGPQTKLGSDSRA

SEQ ID NO: 177713 - protein, 225 aa, Glycine max
  Coding DNA Sequence Number=SeqID_60935
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=9e-25, Identity=22%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLTFRGLHALVFRGLYVLTFRRLHDITFRGLRVLTFRGLHVLAIRGLHALTFRELHVLTFRGLHALVFRGLYVLTFRRLHILTFRGLRVLTFRGLHVFAIRGLHALTIRGLHVLTFRGLHALVFRGLYVLTFRRLHVLTFRGLRVLTFRGLHVFAIRGLHALTIRGLHVLTFRGLHALVFIGLHVLTIRGLHAFAFRGLCVLAFRGLNAIAFRGLHVVVFNG

SEQ ID NO: 177714 - protein, 173 aa, Glycine max
  Coding DNA Sequence Number=SeqID_60936
  Homolog annotation: Hit_ID=UPI0000612705; Match level="QueryCoverage =44%, HitCoverage=93%, E-value=3e-07, Identity=31%"; Hit description =UPI0000612705 related cluster
MVGPLNELISCFLIRVKPWVLVPSPSEDYMSSPPEDYMSSPLEDYASSPSEDYTSSLSEDCTSSPSKGCTPSPSKGDTSSTLEGCTPSPLEGYASSFSVCFISAPSENSRASSFLLSVPGPPPNIERRPTMQAQPEREAITQLLCIPGQDFTRAAAKRRVWVMRTNMTTLTQI

SEQ ID NO: 177715 - protein, 64 aa, Glycine max
  Coding DNA Sequence Number=SeqID_60937
MTSLLSNILPSDRNADLPMWKVLVAPSKVIRPPTNRPFIKKYYAPLGRCRVRHHNSLGMTGSEQ

SEQ ID NO: 177716 - protein, 109 aa, Glycine max
  Coding DNA Sequence Number=SeqID_60938
  Subcellular localization annotation: CTP_CleavageSite=19; ConfidenceScore=5.39e-01
ARLAEVPSTSAAPHPTSTSAAPPPARMTATPSTLPPADFQHSIPTVEQFNEWVVWPGTQPPLHREDEDPTAQEAAATSEKSLEATPEPSTLVADTTSPQQAADPSMHED

SEQ ID NO: 177717 - protein, 441 aa, Glycine max
  Coding DNA Sequence Number=SeqID_60939
  Gene Ontology: Mol. function=thiamin pyrophosphate binding; Cellular component=membrane; Biological process=electron transport
  Homolog annotation: Hit_ID=Q3KCN2; Match level="QueryCoverage=100%, HitCoverage=73%, E-value=1e-152, Identity=61%"; Hit description =Thiamine pyrophosphate enzyme
  Pfam annotation: Domain name=TPP_enzyme_M; Domain location=200-330; Score=148.6; E_value=1.6e-41; Accession=PF00205.12; Description =Thiamine pyrophosphate enzyme, centra
  Pfam annotation: Domain name=TPP_enzyme_N; Domain location=3-176; Score=156.0; E_value=9.6e-44; Accession=PF02776.8; Description =Thiamine pyrophosphate enzyme, N-term
  Pfam module annotation: Pfam domain module=TPP_enzyme_M::TPP_enzyme _N; Domain location=200-330::3-176
MSKKTSDFFVERLQAWGVTRIYGYPGDGINGVLGAIQRANKAGAGIEFIQVRHEEMAAFMAAGHAKFTGELGVCLSTGGPGATHLLTGLYDAKMDHAPVLAIAGQAETTARGASYQQEMNLDRIFADVANFVQEAAAPAQVQHLVDRGVRIAKAQNGVAVIILPKDLQDENWQPPQHAHGFTHSGPGYQRPKIVPYDEDLRRAAEVLNAGKKVAVLIGAGARGAAVEVVQIANLLGAGVAKALLGKDVLPDDAPFVTGSIGLLGTKPSWELMQNCDTLLMIGSGFPWTEFLPPEGKVRAVQIDIDPAMLGLRYPCEVNLHGDAAETLRALLPLLTHKADRHWQEEIAVQVRDWWTLMEQRAMAPANPVNPQRVVWEMSPQLPEDAIVTSDSGSCANWFARDYRVKQGQLATLSGGLACMGAAVPFAIATKFAFPTHPVVAL

SEQ ID NO: 177718 - protein, 99 aa, Glycine max
  Coding DNA Sequence Number=SeqID_60940
MGSKIYPKIHENPKPSLSTLAQSSWSLLLMALVTGPFLGRIASKWQPKEHEMELMRLNQHEENDKKKKGITLKALSSVQEESDKEDLNEVEEMMISVSS

SEQ ID NO: 177719 - protein, 70 aa, Glycine max
  Coding DNA Sequence Number=SeqID_60941
MKETVQRKKTFKNDKMRSHECLYFLFLIWKHSQSNVYSTLLVAYGTPTKCVERAISDWADLEINLAAQVS

SEQ ID NO: 177720 - protein, 86 aa, Glycine max
  Coding DNA Sequence Number=SeqID_60942
MAIRDILPNKVKHTEFDIPKAFDLRTKKKILQTVREQWRQFKSDLTSKWALADGKEGTDDEVCEKYNINKKKWNQFYQSRREPSWE

SEQ ID NO: 177721 - protein, 177 aa, Glycine max
  Coding DNA Sequence Number=SeqID_60943
  Gene Ontology: Mol. function=cysteine-type peptidase activity; Cellular component=cytoplasm; Biological process=proteolysis
  Pfam annotation: Domain name=Transposase_21; Domain location=55-175; Score=25.0; E_value=9.6e-17; Accession=PF02992.5; Description =Transposase family tnp2
MHKCPRCGVSRYKVKDDDECSSDESTMKVPPAKVLWYLPIIPRFKHFFANADDAKDLTWHADGRNCDGMLCHPVDSFQWKKINRLYPNFGKKTRNLRLGLALDGMNPYGSLSTQHSSWLVFPRQPRNDIDVYISLLIEDLTNLWDKVVAVHDGHRNETVKLCAILFVPSMTSQHMEI

SEQ ID NO: 177722 - protein, 155 aa, Glycine max
  Coding DNA Sequence Number=SeqID_60944
MGLCQSYRVPVPPARSLHHDIRIAPTRHPVDPEKSNRVLGFLALITGLFQFYRVHAAPIKVIRPSINRAFIKKYCAPQASTGGDTTAAWGWPATDNRRTTATSRAPQLIYKGWSVAYDPWPTSRQPSPKPKVSKSTRSVTDKSSRVQLKTLKKRY

SEQ ID NO: 177723 - protein, 82 aa, Glycine max
  Coding DNA Sequence Number=SeqID_60945
EPRLKGSSRCGVSMENNDGLWWLMVVVGDGESSWDFRNDFGRKKEEEMTFFLSYTKAKAETKFREDPMANEGWAVFLPRQLH

SEQ ID NO: 177724 - protein, 60 aa, Glycine max
  Coding DNA Sequence Number=SeqID_60946
  Homolog annotation: Hit_ID=Q8TGM5; Match level="QueryCoverage=67%, HitCoverage=61%, E-value=4e-08, Identity=70%"; Hit description =Uncharacterized protein ART3
MASGATCVQRLDGSRDSAIHTKYRISLRSSSMQEPRYPLPRVIDEEAGRTGRRGHPLPPD

SEQ ID NO: 177725 - protein, 163 aa, Glycine max
  Coding DNA Sequence Number=SeqID_60947
  Homolog annotation: Hit_ID=Q5CEG7; Match level="QueryCoverage=64%, HitCoverage=99%, E-value=1e-44, Identity=84%"; Hit description =Senescence-associated protein
  Subcellular localization annotation: CTP_CleavageSite=52; ConfidenceScore=5.26e-01
MIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAV

SEQ ID NO: 177726 - protein, 77 aa, Glycine max
  Coding DNA Sequence Number=SeqID_60948
MRSNEATHPRPMPVSADAPFPGVDPSSPQHVADSSIPVLEIPEGQTIPVLTLDTSPPATPVLHLIDEEDVQTQDTQD

SEQ ID NO: 177727 - protein, 92 aa, Glycine max
  Coding DNA Sequence Number=SeqID_60949
MVDENLNLIQQDDQLSSTDDDDGLENSSAKPTTIQDLQTEINNLKREVKELRQQQEIHQIILSQLEEDSDSESVNNSEENQPDNLEDDMFMA

SEQ ID NO: 177728 - protein, 827 aa, Glycine max
  Coding DNA Sequence Number=SeqID_60950
  Gene Ontology: Mol. function=protein serine/threonine kinase activity; Cellular component=cellulose and pectin-containing cell wall; Biological process=protein amino acid phosphorylation
  Homolog annotation: Hit_ID=Q9ZU46; Match level="QueryCoverage=85%, HitCoverage=99%, E-value=0.0, Identity=63%"; Hit description =Putative receptor-like protein kinase
  Pfam annotation: Domain name=LRRNT_2; Domain location=139-180; Score =57.4; E_value=4.6e-14; Accession=PF08263.3; Description=Leucine rich repeat N-terminal domain
  Pfam annotation: Domain name=LRR_1; Domain location=207-230; Score =16.2; E_value=0.12; Accession=PF00560.23; Description=Leucine Rich Repeat
  Pfam annotation: Domain name=LRR_1; Domain location=231-253; Score =14.5; E_value=0.4; Accession=PF00560.23; Description=Leucine Rich Repeat
  Pfam annotation: Domain name=LRR_1; Domain location=255-277; Score =6.4; E_value=18; Accession=PF00560.23; Description=Leucine Rich Repeat
  Pfam annotation: Domain name=LRR_1; Domain location=279-302; Score =16.3; E_value=0.11; Accession=PF00560.23; Description=Leucine Rich Repeat
  Pfam annotation: Domain name=LRR_1; Domain location=304-326; Score =15.0; E_value=0.27; Accession=PF00560.23; Description=Leucine Rich Repeat
  Pfam annotation: Domain name=LRR_1; Domain location=328-351; Score =4.1; E_value=50; Accession=PF00560.23; Description=Leucine Rich Repeat
  Pfam annotation: Domain name=Pkinase; Domain location=527-815; Score =61.1; E_value=3.7e-15; Accession=PF00069.15; Description=Protein kinase domain
  Pfam annotation: Domain name=Pkinase_Tyr; Domain location=516-819; Score=-7.9; E_value=5.5e-12; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::Pkinase::Pkinase_Tyr; Domain location=139 -180::207-230::231-253::255-277::279-302::304-326::328-351::527 -815::516-819
  Subcellular localization annotation: CTP_CleavageSite=41; ConfidenceScore=5.19e-01
MARGGHQWSWVVEKEISLSELVSLSRSSLFMLSTTSFALSLAQQANSRSVQFPLREEFMACELTIDSELTTRKDCSIAEVRLWSGRQRSCSAVEGKVLFNSFSLYLFFTPTVSNKLEMFPLVVLLFLACNFHVAPVSSLTVEGSVLLALKKSIITDPEGSLSNWNSSDDTPCSWNGITCKDQSVVSISIPKRKLHGVLPSELGSLSHLRHLNLRNNNLFGDLPVGLFEAQGLQSLVLYGNSLSGSVPNEIGKLRYLQALDLSQNFYNGSLPAAIVQCKRLRTLVLSHNNFTGPLPDGFGGGLSSLEKLDLSFNEFNGLIPSDMGKLSSLQGTVDLSHNHFSGSIPASLGNLPEKVYIDLTYNNLSGPIPQTGALMNRGPTAFIGNSGLCGPPLKNLCAPDTHGASSPSSFPVLPDNYPPQDSDDGFVKSGKSKRLSKGAVVGIVVGDIVGICLLGLLFSYCYSRVWGFTQDQEEKGFDKGRRLRKECLCFRKDESETLSDHDEQYDLVPLDAQVAFDLDELLKASAFVLGKSEIGIVYKVVLEEGLNLAVRRLGEGGSQRFKEFQTEVEAIGKLRHPNIVTLRAYYWSVDEKLLIYDYVPNGSLATAIHGKAGLATFTPLSWSVRVKIMKGVAKGLVYLHEFSPKKYVHGDLKPGNILLGHSQEPCISDFGLGRLANIAGGSPTLQSNRVAAEKSQERQRSLSTEVTTSILGNGYQAPETLKVVKPSQKWDVYSYGVILLELITGRLPIVQVGNSEMDLVQWIQCCIDEKKPLSDVLDLYLAEDADKEEEIIAVLKIAIACVHSSPEKRPIMRHVLDVLDRLSIPSD

SEQ ID NO: 177729 - protein, 131 aa, Glycine max
  Coding DNA Sequence Number=SeqID_60951
  Homolog annotation: Hit_ID=Q9AVH2; Match level="QueryCoverage=35%, HitCoverage=16%, E-value=3e-20, Identity=97%"; Hit description =Putative senescence-associated protein
GLLVIGGEGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 177730 - protein, 165 aa, Glycine max
  Coding DNA Sequence Number=SeqID_60952
  Homolog annotation: Hit_ID=Q41689; Match level="QueryCoverage=25%, HitCoverage=40%, E-value=4e-09, Identity=76%"; Hit description =Serine carboxypeptidase
  Subcellular localization annotation: CTP_CleavageSite=54; ConfidenceScore=5.03e-01
MKEILTLASKPCYPETSQSCVVVVSPLFCHVAPPLSCSCVIVNVEGVNTDSRFRLSHTATSKASNLIFVYQPIIGTRFTYTYNESDIRHDEEGVSSDLYDSLQDDIVLNEELMHIMANPNFQQVAQHDKIEPFLATPSCASNDSDIEITENFPTRNETRSSYEDE

SEQ ID NO: 177731 - protein, 326 aa, Glycine max
  Coding DNA Sequence Number=SeqID_60953
  Gene Ontology: Mol. function=hydrolase activity, acting on glycosyl bonds; Cellular component=integral to membrane; Biological process =polysaccharide catabolic process
  Homolog annotation: Hit_ID=P10538; Match level="QueryCoverage=52%, HitCoverage=34%, E-value=4e-70, Identity=71%"; Hit description=Beta -amylase
  Pfam annotation: Domain name=Glyco_hydro_14; Domain location=57-326; Score=-110.5; E_value=1.4e-10; Accession=PF01373.8; Description =Glycosyl hydrolase family 14
  Pfam annotation: Domain name=Pkinase; Domain location=3-201; Score= -72.3; E_value=0.0003; Accession=PF00069.15; Description=Protein kinase domain
  Pfam module annotation: Pfam domain module=Glyco_hydro_14::Pkinase; Domain location=57-326::3-201
MCCISNEDSMFLVYKYLENHNLDKWLHKKIKSSSVSKVVLDWPKRLKIAIGIVQGLSYMHLDCSPPVVHRDIKTSNILLDTQFNAKVADFGAKMLIKPGELNTMSAVIGSFGYIAPDRARKPRTKHCFFKLDCGQLKKERVVRVTLKAETSKFKLYTDYMRSFRDNMKDFLESELTIDIEVGLGPAGELRYPSCTQNLGWVFPGIREFQCYDKYIKDDFKGAATRAGHPEREMPDNVGELNDAPESTKNFKSRGTYPTKKGKFFLTWYSNKLLIHGNEVLDRANNVFLGCKVKLAAKVAGIHWLYKSKSHASELTPGYQNLNHRDG

SEQ ID NO: 177732 - protein, 221 aa, Glycine max
  Coding DNA Sequence Number=SeqID_60954
MDMNVGYLISHQISLTAQHDTSRLGFPALITALCKARGVQSDSRSLESLSPAINLAYIKKNCWNLDEPTVTFRGPRKARDKRFEAFSTTPSEIGGPSSSTLPTSSYTEIPVIPPAPTQIPLPAPLSIGPTDFIFTPQMLHSMLQSIHRGQSIIMQSLQGLGLPSIMSMEEFDTRVAWPGDQPSSSGGGGASTAQEPVSEEPPAPAPSPTAAEEETTPAQTP

SEQ ID NO: 177733 - protein, 61 aa, Glycine max
  Coding DNA Sequence Number=SeqID_60955
  Gene Ontology: Mol. function=hydroxymethylglutaryl-CoA synthase activity; Cellular component=soluble fraction; Biological process =steroid biosynthetic process
  Homolog annotation: Hit_ID=P54873; Match level="QueryCoverage=93%, HitCoverage=12%, E-value=9e-25, Identity=89%"; Hit description =Hydroxymethylglutaryl-CoA synthase
MAKNVGILAIDIYFPPTCIQQELLEAHDGASKGKYTIGLGQDCMAFCTEVEDVISMRFQYY

SEQ ID NO: 177734 - protein, 107 aa, Glycine max
  Coding DNA Sequence Number=SeqID_60956
  Gene Ontology: Mol. function=hydroxymethylglutaryl-CoA synthase activity; Biological process=acetyl-CoA metabolic process
  Homolog annotation: Hit_ID=Q6QLW8; Match level="QueryCoverage=71%, HitCoverage=16%, E-value=1e-30, Identity=84%"; Hit description=HMG -CoA synthase 2
  Pfam annotation: Domain name=HMG_CoA_synt_C; Domain location=2-105; Score=-111.0; E_value=2.9e-06; Accession=PF08540.1; Description =Hydroxymethylglutaryl-coenzyme A synth
MYWRLKVRYDYSFVDEAAKEKLEPFATLSGDESYQSRDLEKASQQVAKPQYDAKVQPTTLIPKQVGNMYTASLYAAFISLIHNKHSTLVNILNTLLVKYKPLLNKGW

SEQ ID NO: 177735 - protein, 128 aa, Glycine max
  Coding DNA Sequence Number=SeqID_60957
  Gene Ontology: Mol. function=protein serine/threonine kinase activity; Cellular component=chloroplast thylakoid membrane; Biological process=protein amino acid phosphorylation
  Homolog annotation: Hit_ID=Q6ZH91; Match level="QueryCoverage=86%, HitCoverage=17%, E-value=4e-16, Identity=40%"; Hit description =Putative pentatricopeptide (PPR) repeat-containing protein
  Pfam annotation: Domain name=PPR; Domain location=20-54; Score=7.8; E_ value=0.89; Accession=PF01535.11; Description=PPR repeat
  Pfam annotation: Domain name=PPR; Domain location=64-98; Score=48.9; E_value=1.7e-11; Accession=PF01535.11; Description=PPR repeat
  Pfam module annotation: Pfam domain module=PPR::PPR; Domain location =20-54::64-98
MAKEVYDEMLGTYGVSPDTCTYNVLIRGFCKNSMVDEGAGKVRIARNLVNGMGKKCEGLNPNVVTYTTLIRGYCMKQEVEEALVVLEEMTSRGLKPNMITYNTLVKGLCEAHKLDKMKDVLERMKSDG

SEQ ID NO: 177736 - protein, 109 aa, Glycine max
  Coding DNA Sequence Number=SeqID_60958
  Gene Ontology: Mol. function=transporter activity; Cellular component= membrane; Biological process=oligopeptide transport
  Homolog annotation: Hit_ID=Q9CAS0; Match level="QueryCoverage=84%, HitCoverage=14%, E-value=8e-19, Identity=44%"; Hit description =Putative peptide transporter; 37139-33250
MMFTLVGHIQFYNNESLDKMKSIGNSLQYLVVAFSIYIGTLLVNVVHQLTRKHGGIDWLNDDINAGRLDYYYFLMAGLALINLIYILFCVKHYHYKVNVEEKVVEKLEP

SEQ ID NO: 177737 - protein, 112 aa, Glycine max
  Coding DNA Sequence Number=SeqID_60959
MKLMSSSRCVMRESIALKRSPAKARRYLISVRTSFNKEDEESRCGGGEGVGRLCLSPKIPKLMWSSGIGDGRLRLRTSTSFRYPKEATTLAPIANKCLTLTKGSSSKGTLKC

SEQ ID NO: 177738 - protein, 94 aa, Glycine max
  Coding DNA Sequence Number=SeqID_60960
MSGFPQIKIGGVYFNHGGGVELPAIVETWSQGGLIATTVGLAVVREDKQGGSDDRYRGGGTQIQTPGFHMAEPCGERFFAAHCSFDVSSCGEGT

SEQ ID NO: 177739 - protein, 274 aa, Glycine max
  Coding DNA Sequence Number=SeqID_60961
  Gene Ontology: Mol. function=transferase activity
  Homolog annotation: Hit_ID=Q9FJ75; Match level="QueryCoverage=98%, HitCoverage=88%, E-value=3e-43, Identity=40%"; Hit description=Wax synthase-like protein
MDGEVERFIKVWLTTISCLSYCYYIASRIPKGFMRLLSLLPILYLFLSLPFNLSSFHLGGPTTFFLVWLDNFKLILFSFNQGPLALSPPNILHFISIASLPINPKQHSPTKNNHTNNTQKPKWLLLLKVLIFAMIIRAYDYREKLHPHFILVLYCYHMYLGIELLLALSAIPIRTLLGFEIEPQFNEPCLFTSLQDFGVLGGISWLPFFYSPLPHTCYSHVGSHVLFCASRCVHRGGDDDKEGDAPPWVTAASRCVRTARGGVLGSHRKVPHTS

SEQ ID NO: 177740 - protein, 180 aa, Glycine max
  Coding DNA Sequence Number=SeqID_60962
MGGIRAAYSGTQNWPSVANPLYDSGITDVGEHHSSLPRDIANSVGYRPYVREDENYLRELETRQQTRHYGIQNPNSVMSNYLSVHDPANSHHMGPSYPALALASEPYVMNTPAMQRYAPRLDELNHARMDPLGSEHAIVGRNGAFERSALPPGYGSRMPGFAAGSHHMYSRQNSADRFNG

SEQ ID NO: 177741 - protein, 79 aa, Glycine max
  Coding DNA Sequence Number=SeqID_60963
MQLRTRCKLSRFIVTLATEKRMQGMSNYMARACEPNGKDPKARYLVTTPKAEGIISPKRAGCLRMKAFHGPGEPDAGLG

SEQ ID NO: 177742 - protein, 191 aa, Glycine max
  Coding DNA Sequence Number=SeqID_60964
  Gene Ontology: Mol. function=microtubule motor activity; Cellular component=microtubule associated complex; Biological process =microtubule-based movement
  Homolog annotation: Hit_ID=Q8GZU1; Match level="QueryCoverage=98%, HitCoverage=20%, E-value=2e-18, Identity=58%"; Hit description =Kinesin related protein
  Pfam annotation: Domain name=Kinesin-related; Domain location=1-150; Score=-307.3; E_value=0.018; Accession=PF06548.2; Description =Kinesin-related
MESEWICLTDELRADFESYRQRTERLEMELKLEKKSSVEMDDSLKRAVMGHARMVEHYADLQEKYDDLVTKHDATMEGIAEVKKAAAKASIKAVQAAGELLVRLREAEHAAAVAENFANENLKMQIEKPERKHKTEINTMKQYSTKSKLPESALQPLYREDFDVPHNATSSYTYDDQASRADFGAIYQEHY

SEQ ID NO: 177743 - protein, 46 aa, Glycine max
  Coding DNA Sequence Number=SeqID_60965
MDLDTKEDLSLSALSAMHRLNVQHTHSVRHSLTAITTILAKHGKRA

SEQ ID NO: 177744 - protein, 177 aa, Glycine max
  Coding DNA Sequence Number=SeqID_60966
  Gene Ontology: Mol. function=aspartate-tRNA ligase activity; Cellular component=cytoplasm; Biological process=tRNA aminoacylation for protein translation
  Homolog annotation: Hit_ID=Q1SI14; Match level="QueryCoverage=50%, HitCoverage=17%, E-value=8e-28, Identity=76%"; Hit description =Aspartyl-tRNA synthetase, class IIb; tRNA synthetase, class II
MPLEVGEWACVEALDGMLENNLVLIRGRAQAIRPIGKKMVFLVIKENGFTVQCLVQVQPDTVSSQMVKFAVNPSSMSKALFRSPPLPSKAPVAATLSSIDPVLTLSVAGNGGGSAILRAAFDQYRGIVFKNITGVGFSFIRKLGERLVSSILARNLPKSLLSGGSVMADGEEVKTTD

SEQ ID NO: 177745 - protein, 174 aa, Glycine max
  Coding DNA Sequence Number=SeqID_60967
MLQPYGINIGLKEHSNPVTPKAYTPKTPSGPLPPDLGPTPKIILHADIAHELYNTHDLTLRHLWRFPKIPPIFPPTVPIEFSNVRETEKGLKPPFVLSSCDFFCYLHEHYLNNPNDSYGFLRERKRLQCEGYFSQLKHDIEIPNGENAWNWVAVFKFHDHPMVNESEIVIFLRQ

SEQ ID NO: 177746 - protein, 170 aa, Glycine max
  Coding DNA Sequence Number=SeqID_60968
  Gene Ontology: Mol. function=nucleic acid binding; Biological process= DNA integration
MDTLKRKFMFPNLQALRIINIQIMHTSLRKLFMDLNKLQDKDFVHKMQGEFEMSMIGELNYFVGFQVKKMDHGTFLRQTNCKKLLKKFEMDKSKESATPMATNYYLSADEKGKTIDLSSLLYLLASRSDIMFSVYMYACYQSGPMESNIYVVKKDYEIPKRHFRCWPMVL

SEQ ID NO: 177747 - protein, 86 aa, Glycine max
  Coding DNA Sequence Number=SeqID_60969
MLELHCPEVATRQVLRWVSNLKPFLHCHDLRGFSHYGISDGEAPGELPMAEGGHQVHVASDLDSLACKAEEWSTREWRVLGETSNF

SEQ ID NO: 177748 - protein, 113 aa, Glycine max
  Coding DNA Sequence Number=SeqID_60970
  Gene Ontology: Biological process=response to other organism
  Homolog annotation: Hit_ID=Q1S3D5; Match level="QueryCoverage=71%, HitCoverage=77%, E-value=3e-32, Identity=77%"; Hit description=Plant lipid transfer/seed storage/trypsin-alpha amylase inhibitor
  Pfam annotation: Domain name=Tryp_alpha_amyl; Domain location=30-102; Score=41.2; E_value=3.6e-09; Accession=PF00234.12; Description =Protease inhibitorseed storageLTP f
MEQKKFVALLMVVVVMASSMWKGSKGLSLCNMDEDGLEACKPSVTQPNPVDPSPDCCKALDGADLKCLCSYKNSSELPLLGIDLTLAASLPAKCNLTPPDNCYVSSTFGQKVL

SEQ ID NO: 177749 - protein, 170 aa, Glycine max
  Coding DNA Sequence Number=SeqID_60971
  Gene Ontology: Mol. function=protein dimerization activity
  Homolog annotation: Hit_ID=Q1SYN6; Match level="QueryCoverage=66%, HitCoverage=15%, E-value=3e-10, Identity=37%"; Hit description=Zinc finger, BED-type predicted
  Pfam annotation: Domain name=zf-BED; Domain location=56-104; Score =51.8; E_value=2.3e-12; Accession=PF02892.5; Description=BED zinc finger
MKYETIHQRKTSFNASSGNDGGDECIENEEPMENDPLEDGCDEHENTSKKVRICTSEVWKFFTKIGVKDYKEKAKCNVCRKEYVIGGSKIGTSTLICHLKRRSSAFAKNQDVDCMIIDNLGELRARELNNKHVRELIVRATIEHDLPFQFVEYTWIRELLSFKSRCQACV

SEQ ID NO: 177750 - protein, 235 aa, Glycine max
  Coding DNA Sequence Number=SeqID_60972
  Gene Ontology: Mol. function=DNA binding; Biological process=DNA integration
  Homolog annotation: Hit_ID=Q1SKC8; Match level="QueryCoverage=75%, HitCoverage=49%, E-value=5e-55, Identity=53%"; Hit description =Integrase, catalytic region
MATPYHPQTNGQVEIYNRELKRILEKTVASSRKDWALKLDDTLWAYRTTFKTPIGLSLFQLVYGKSCHLPVELEHKAYWALKLLNFDEAAYGERRKLQLLELKEMRLNAYESSRIYKLRLFPGKLKSKWSRPFVIKEVRPHGAIELMDPIGDNLKRRWIVNGQFLKIYNGGQLERLTSVDYLKEGTTPLGMYPQLMTQRPSSSRLFGQESNPLLMGGEPSEVGDTTEVGTKDETI

SEQ ID NO: 177751 - protein, 75 aa, Glycine max
  Coding DNA Sequence Number=SeqID_60973
MSIQAHDFSYRTDRDQDTLRVCYSKGVEGFKFWDLISKKMVISNGAVFDEQSMLPEIVETTMLVSTRAFPNSIEL

SEQ ID NO: 177752 - protein, 322 aa, Glycine max
  Coding DNA Sequence Number=SeqID_60974
  Pfam annotation: Domain name=DUF827; Domain location=122-264; Score= -114.1; E_value=0.061; Accession=PF05701.2; Description=Plant protein of unknown function (DUF827)
MFGLSASFWLAIEDLAQAMRPQAELEFYFEPSVMTLCNPSVAEVGRNNLKTSIESSQEAAKKSLEKAAERVRCLEDDLAKSRYLHAFCIACNVWVLNLKFCVFRSEIIKTEAKGILERNVEFSQLVVDYQRKLRESSESLIAAEELSRKLTLELSVLKQEKEVISNSEKRASNEVRSLSERVQRLQASLSTIQSTEEVRGEARAAERVKQEEYIKKLEREWAEAKQELNEERENVRRFTSDRDQTLKNSLRQVEDMSKELANALRAVASAESRAAVAEVKLSGLQRKMGSTDDKLVEIGGVSGPSTLSSDEVGIHFYISISL

SEQ ID NO: 177753 - protein, 89 aa, Glycine max
  Coding DNA Sequence Number=SeqID_60975
MVRIRDNKCCYASRETSWWITLGKEVENGEHLTFINASIRKLPHPTFFSPRMHRLVDTAVRNNSFDEMFLMVGLVLYKVFKIQACTDSA

SEQ ID NO: 177754 - protein, 877 aa, Glycine max
  Coding DNA Sequence Number=SeqID_60976
  Gene Ontology: Mol. function=structural molecule activity; Cellular component=intermediate filament
  Homolog annotation: Hit_ID=Q5EE04; Match level="QueryCoverage=85%, HitCoverage=39%, E-value=2e-12, Identity=19%"; Hit description=TPR
MFCTSTGRNRSSLLKQEKLRLQSQHESALKAAESAHASLETERAKSRSFLFTEEEFKALQLQVRELNLLRESNMQLREENKHNFEECQKLRELAQKVRAETENLENLLREREIELQRHKKEIGTLKMEKDNLNKKVSELLERSKNVDVEDYDRVKKLAREIQDKLRERDARIEELGKSLSEKQDSVSCLEKDLSNCRLELAEREKRINDILHNEANLKLDSEKHRKLLAQFKKRIDVLSREKEDLGKENQQLSRQLDEIKQGKRSTCDTTGEQAMKEEKDTRIQILEKHLERQRDELKKEKEESRLERSRRLKTEKAIKDSYNNVEQEKIKLIIEIERYKESLKRLSDEVEKLKIVIGNLPEGSNVVQLLSGSNVDDFAAPYISAVESFEKEAQSVFRELGGRGNLGDAATITDGSAAATGSLVHPQSQGIASLAAPGVSGLPPKATGESEKRLALPKASVETRRTGRRLVRPKLLEKSEKRPEELQGGDTEMSDAEGPGGKPGQSSDTDTSNVVQSSQQLARKRVAPTSTSELREESVAPGEKSSDVLKKSKGSESLEENTEEQPAAILEFTGSHPVTEELFDSSDMPQCQNEEVGEAQNEDGEIAVGNDEESKDPRHLDGTGQEELQADKTGTLEENQDQSAETKVLSDEMQRNQTDPDNQQSTLAPSGEREEGELMPDTGDLEGASDLSNIAENQESREGQSESAATPERSPARVDDDALEAGEINSPELSSDDKNDEGDLVEEAADGSDKLIDVNEPISAESDQVAEPVASETATSTSTVAESSSSKVNLPVPRQGTPSAPAETEETKQASPVGSTSTTINLSERARERAQMRQAGLVSSTLRGRGRGGAPRGRVGRGRGVVRRPPPPPGSDQ

SEQ ID NO: 177755 - protein, 58 aa, Glycine max
  Coding DNA Sequence Number=SeqID_60977
MEKKGKRRRKGLNGVRACVRKAEEEIVSLNTRLPSYSGGGALENTRNITTDNEERLSD

SEQ ID NO: 177756 - protein, 87 aa, Glycine max
  Coding DNA Sequence Number=SeqID_60978
MYLANLLSMTIKRIIYFDFYLIIINWCIYAIKCHGDEDDEISMNLTTTFLSLLNVGGSSPETLVSRKYALTLHFLQFHESPYAQATA

SEQ ID NO: 177757 - protein, 125 aa, Glycine max
  Coding DNA Sequence Number=SeqID_60979
MTQGHNKQRPSIIKNTNEQQQTSPTPPTIINNKGSNAKIEHDAANNTRSTPQKQTNNAHFLALNIKKSIETNESERKPRSSRGVSLSVKSRVVNLSSIVELSNETPPNLSTDQRSSSTTRGRSTT

SEQ ID NO: 177758 - protein, 1266 aa, Glycine max
  Coding DNA Sequence Number=SeqID_60980
  Gene Ontology: Mol. function=protein binding; Cellular component =membrane; Biological process=defense response
  Homolog annotation: Hit_ID=Q6R270; Match level="QueryCoverage=97%, HitCoverage=100%, E-value=0.0, Identity=69%"; Hit description =Disease resistance protein
  Pfam annotation: Domain name=LRR_1; Domain location=1033-1056; Score =6.1; E_value=20; Accession=PF00560.23; Description=Leucine Rich Repeat
  Pfam annotation: Domain name=LRR_1; Domain location=1100-1122; Score =11.1; E_value=2.4; Accession=PF00560.23; Description=Leucine Rich Repeat
  Pfam annotation: Domain name=LRR_1; Domain location=1125-1148; Score =3.4; E_value=65; Accession=PF00560.23; Description=Leucine Rich Repeat
  Pfam annotation: Domain name=LRR_1; Domain location=1173-1193; Score =1.5; E_value=1.5e+02; Accession=PF00560.23; Description=Leucine Rich Repeat
  Pfam annotation: Domain name=LRR_1; Domain location=1196-1219; Score =9.6; E_value=4.5; Accession=PF00560.23; Description=Leucine Rich Repeat
  Pfam annotation: Domain name=LRR_1; Domain location=1221-1244; Score =10.0; E_value=3.9; Accession=PF00560.23; Description=Leucine Rich Repeat
  Pfam annotation: Domain name=LRR_1; Domain location=592-614; Score =5.4; E_value=28; Accession=PF00560.23; Description=Leucine Rich Repeat
  Pfam annotation: Domain name=LRR_1; Domain location=616-637; Score =10.6; E_value=3; Accession=PF00560.23; Description=Leucine Rich Repeat
  Pfam annotation: Domain name=LRR_1; Domain location=639-661; Score =14.5; E_value=0.38; Accession=PF00560.23; Description=Leucine Rich Repeat
  Pfam annotation: Domain name=LRR_1; Domain location=663-684; Score =5.3; E_value=30; Accession=PF00560.23; Description=Leucine Rich Repeat
  Pfam annotation: Domain name=LRR_1; Domain location=799-820; Score =6.9; E_value=15; Accession=PF00560.23; Description=Leucine Rich Repeat
  Pfam annotation: Domain name=LRR_1; Domain location=822-845; Score =2.8; E_value=87; Accession=PF00560.23; Description=Leucine Rich Repeat
  Pfam annotation: Domain name=LRR_1; Domain location=877-898; Score =11.2; E_value=2.3; Accession=PF00560.23; Description=Leucine Rich Repeat
  Pfam annotation: Domain name=LRR_1; Domain location=900-923; Score =2.8; E_value=87; Accession=PF00560.23; Description=Leucine Rich Repeat
  Pfam annotation: Domain name=LRR_1; Domain location=955-976; Score =11.6; E_value=1.9; Accession=PF00560.23; Description=Leucine Rich Repeat
  Pfam annotation: Domain name=LRR_1; Domain location=978-1001; Score =1.8; E_value=1.3e+02; Accession=PF00560.23; Description=Leucine Rich Repeat
  Pfam annotation: Domain name=NB-ARC; Domain location=165-469; Score =340.6; E_value=2.7e-99; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::NB-ARC; Domain location=1033-1056::1100 -1122::1125-1148::...
  Pfam module annotation: Domain location=1173-1193::1196-1219::1221 -1244::592-614::616-637::639-661::663-684::799-820::822-845::877 -898::900-923::955-976::978-1001::165-469
MALELVGGALLSAFLQAAFQKLASHQIRDFFRGRKLDQKLLNNLEIKLNSIQALADDAELKQFRDPRVRNWLLKVKDAVFDAEDLLDEIQHEISKCQVDAEAEAESQTCTCKVPNFFKSSPVSSFYKEIKSRMEQVLEDLENLASQSGYLGLKNASGVGSGFGGAVSQQSQSTSLLVERVIYGRDDDKEMIFNWLTSDIDNCNKPSIFSIVGMGGLGKTTLAQHVFNDPRIENKFDIKAWVCVSDEFDVFNVTRTILEAVTKSTDDSRNREMVQGRLKEKLTGKRFFLVLDDVWNRNQKEWEALQTPLNDGAPGSKIVVTTRDKKVASIVGSNKTHCLELLQDDHCWQLLAKHAFQDDSHQPNADFKEIGTKIVAKCKGLPLALTTIGSLLHQKSSISEWEGILKSEIWEFSEEDSSIVPALALSYHHLPSRLKRCFAYCALFPKDYRFGKEGLIQLWMAENFLQCHQQSRSPEEVGEQYFNDLLSRSFFQQSSNIEGKPFVMHDLLNDLAKYVCGDFCFRLEDDQPKHIPKTTRHFSVASNHVKCFDGFGTLYNAERLRTFMSLSEETSFHNYSRWYCKMSTRELFSKFKFLRVLSVSDYSNLTELPDSVGNLKYLHSLDLSNTGIEKLPESTCSLYNLQILKLNGCKHLKELPSNLHKLTDLHRLELMYTGVRKVPAHLGKLEYLQVLMSSFNVGKSREFSIQQLGELNLHGSLSIENLQNVENPSDALAVDLKNKTHLVELELEWDSDWNPDDSTKERDEIVIENLQPSKHLEKLTMRNYGGKQFPSWLSDNSSLNVVSLSLRNCQSCQRLPPLGLLPFLKELSIEGLDGIVSINADFFGSSSCSFTSLESLRFSNMKEWEEWECKGVTGAFPRLQRLSIGYCPKLKGLPPLGLLPFLKELSIEGLDGIVSINADFFGSSSCSFTSLESLKFSDMKEWEEWECKGVTGAFPRLQRLSIRYCPKLKGLPPLGLLPFLKELSIQRLDGIVSINADFFGSSSCSFTSLESLDFYDMKEWEEWECKGVTGAFPRLQRLSIYNCPKLKWHLPEQLSHLNRLGISGWDSLTTIPLDIFPILRELDIRECLNLQGISQGQTHNHLQRLSMRECPQLESLPEGMHVLLPSLDYLGIIRCPKVEMFPEGGLPSNLKNMHLYGSYKLMSSLKSALGGNHSLETLRIGGVDVECLPEEGVLPHSLVTLDISHCEDLKRLDYKGLCHLSSLKELTLWNCRRLQCLPEEGVGFSNNVAGNPKAKTGQRLLTLKTWI

SEQ ID NO: 177759 - protein, 103 aa, Glycine max
  Coding DNA Sequence Number=SeqID_60981
MAISVMKQGNMIGRMERDEDLTLFRELRKHQNERVSSLFYCVNSEEFECGTNTHSGRSKSLHHAWAKKVENTTSNFSLEVEPSPQLVLQKELPIPQAISRVRH

SEQ ID NO: 177760 - protein, 43 aa, Glycine max
  Coding DNA Sequence Number=SeqID_60982
MDGNAEALVSGSSIVDRWWRQHGAVACGGDMVNRGSRKYDGIK

SEQ ID NO: 177761 - protein, 154 aa, Glycine max
  Coding DNA Sequence Number=SeqID_60983
  Gene Ontology: Mol. function=serine-type peptidase activity; Cellular component=integral to membrane; Biological process=proteolysis
  Homolog annotation: Hit_ID=Q2R135; Match level="QueryCoverage=67%, HitCoverage=50%, E-value=4e-18, Identity=44%"; Hit description =Signal peptidase I family protein, expressed
RKTAVMILRNLEAFEPIIKAGWRFSKFYCFIHVTKTYLIAPDVISPRFGKVACGDIVVLLNPQHPRHFMTKRVVGLEGDSVTYISNPETYEYEGDSFTRISSPDNGDKSKTIVGDNKYNRNDSRKFGPVPYDLIDGKMFWRVTPLKKFGPFWNK

SEQ ID NO: 177762 - protein, 1213 aa, Glycine max
  Coding DNA Sequence Number=SeqID_60984
  Gene Ontology: Mol. function=protein binding; Cellular component =membrane; Biological process=defense response
  Homolog annotation: Hit_ID=Q6R270; Match level="QueryCoverage=99%, HitCoverage=97%, E-value=0.0, Identity=75%"; Hit description=Disease resistance protein
  Pfam annotation: Domain name=LRR_1; Domain location=592-614; Score =1.8; E_value=1.3e+02; Accession=PF00560.23; Description=Leucine Rich Repeat
  Pfam annotation: Domain name=LRR_1; Domain location=616-637; Score =9.4; E_value=5; Accession=PF00560.23; Description=Leucine Rich Repeat
  Pfam annotation: Domain name=LRR_1; Domain location=639-661; Score =15.6; E_value=0.18; Accession=PF00560.23; Description=Leucine Rich Repeat
  Pfam annotation: Domain name=LRR_1; Domain location=663-684; Score =5.3; E_value=29; Accession=PF00560.23; Description=Leucine Rich Repeat
  Pfam annotation: Domain name=LRR_1; Domain location=799-820; Score =5.9; E_value=23; Accession=PF00560.23; Description=Leucine Rich Repeat
  Pfam annotation: Domain name=LRR_1; Domain location=822-845; Score =3.1; E_value=75; Accession=PF00560.23; Description=Leucine Rich Repeat
  Pfam annotation: Domain name=LRR_1; Domain location=877-898; Score =7.4; E_value=12; Accession=PF00560.23; Description=Leucine Rich Repeat
  Pfam annotation: Domain name=LRR_1; Domain location=900-923; Score =2.7; E_value=88; Accession=PF00560.23; Description=Leucine Rich Repeat
  Pfam annotation: Domain name=LRR_1; Domain location=955-978; Score =10.8; E_value=2.8; Accession=PF00560.23; Description=Leucine Rich Repeat
  Pfam annotation: Domain name=NB-ARC; Domain location=165-469; Score =353.7; E_value=3e-103; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::NB-ARC; Domain location=592 -614::616-637::639-661::663-684::799-820::822-845::877-898::900 -923::955-978::165-469
MALELVGGALLSAFLQVAFEKLASPQVRDFFRGRKLDEKLLNNLEIKLNSIQALADDAELKQFRDPRVRNWLLKVKDAVFDAEDLLDEIQHEISKCQVEAEAEAESQTCTCKVPNFFKSSPVGSFNKEIKSRMEQVLEDLENLASQSGYLGLQNASGVGSGFGGAVSQQSQSTSLLVESVIYGRDDDKEMIFNWLTSDIDNCNKLSILSIVGMGGLGKTTLAQHVFNDPRIENKFDIKAWVCVSDEFDVFNVTRTILEAVTKSTDDSRNREMVQGRLREKLTGKRFFLVLDDVWNRKQKEWKDLQTPLNDGASGSKIVVTTRDKKVASIVGSNKIHSLELLQDDHCWRLFTKHAFQDDSHQPNPDFKEIGVKIVKKCKGLPLALTTIGSLLHQKSSISEWEGILKSEIWEFSEEDISIVPALALSYHHLPSHLKRCFAYCALFPKDYRFHKEGLIQLWMAENFLQCHQQSRSPEEVGEQYFNDLLSRSFFQQSSNIKGTPFVMHDLLNDLAKYVCGDICFRLEDDQVTNIPKTTRHFSVASNHVKCFDGFRTLYNAERLRTFMPSSEEMSFHNYNWWHCMMSTDELFSKFKFLRVLSLSGYSNLTEALDSVGNLKYLHSLDLSNTDIKKLPESTCSLYNLQILKLNGCRHLKELPSNLHKLTDLHRLELINTGVRKVPAHLGKLKYLQVLMSSFNVGKSREFSIQQLGELNLHGSLSIRQLQNVENPSDALAVDLKNKTHLVEVELEWDSDRNPDDSTKERDEIVIENLQPSKHLEKLRMRNYGGTQFPSWLSDNSSCNVVSLTLDNCQSCQRLPPLGLLPFLKELSIGGLDGIVSINDDFFGSSSSSFTSLESLKFFDMKEWEEWECKGVTGAFPRLQRLSILHCPKLKGLPPLGLLPFLKELSIGGLDGIVSINADFFGSSSSSFASLEILEFSRMKEWEEWECKGVTGAFPRLQRLSIKDCPKLKGHLPEQLCHLNDLKISGCEQLVPSALSAPDIHELVGGSLLSAFLQVAFEKLASLQVRGFFRGRKLDEKLLNNLEIKLNSIQALADDAELKQFRDPLVRNWLLKVKDAVFDAEDILDEIQHEISKCQVEVEAEAESQTCTCNVPNFFKSSPASSFNREIKSRIEQVLENLENLARQSGYLGLKNASGVGSGFGGAVSQQSQSTSLLVESVIYGRDDDKEMIVNWLTSDIDNCSELSILSIVGMGGL

SEQ ID NO: 177763 - protein, 121 aa, Glycine max
  Coding DNA Sequence Number=SeqID_60985
MSSLHFKLLVVDAFKLLDEFFTSPKHLYLSLKKVVDGGDQGVDDSDEVELTEGEFGQGSLEAVLASGRKFKLKLVWQPWALNESTKMLRVEYGKAGFEGPSPPEEEEEEKKIALGIRGPTS

SEQ ID NO: 177764 - protein, 90 aa, Glycine max
  Coding DNA Sequence Number=SeqID_60986
MWSQQGCGEWLHGCRTWRRSQNGRRRWHRRWSRHGRQSSEVELTEGEFGQGGLEAVLASGRKFKMVWRMLWTAVVWAGMAAMEGSHGSSV

SEQ ID NO: 177765 - protein, 405 aa, Glycine max
  Coding DNA Sequence Number=SeqID_60987
  Gene Ontology: Mol. function=chromatin binding; Cellular component =chromatin; Biological process=chromatin assembly or disassembly
  Homolog annotation: Hit_ID=Q1SAV4; Match level="QueryCoverage=86%, HitCoverage=89%, E-value=1e-103, Identity=52%"; Hit description =Integrase, catalytic region
  Pfam annotation: Domain name=Chromo; Domain location=300-350; Score =30.1; E_value=7.9e-06; Accession=PF00385.14; Description='chromo' (CHRromatin Organisation MOdifier
  Pfam annotation: Domain name=rve; Domain location=2-151; Score=65.6; E_value=1.6e-16; Accession=PF00665.16; Description=Integrase core domain
  Pfam module annotation: Pfam domain module=Chromo::rve; Domain location=300-350::2-151
MDLSLDFITGLPPFRGNTVILVVVDHFFKGVHLGMLPTAHTAHAVASLFLELVVKIHGVPRSLVSDRDPLFVSKFWQKLFHLSGTQLKMSLAYHPQSDGQTEVLNHVIDQYLRSFIHHQPSNWGRFLAWAEYSHNTSWNAATGTTPYEVTFGRKPFNFPTYIAGTSNLDAVDTFMTNRDEVFQFIRKKLLKAQATMKDQADTHRREVTYNPGEWVLLKLRPHRQSTAKGSQVFSGKLAKMFYGPFQIIERIGKVSYRLQLPPEAKIHSVFHCSMLKPFKGDPEVTALTLPGQIIDHQPIVAPLAILDYRKADSPNETWQVLVQWQGLSPDDTSWEDWSQLCHDFHLGDKVLFQGPWSDKEAESAEGKIEANAKGAENRATATEQVQRAKKPKRVVTRPSYLRDFV

SEQ ID NO: 177766 - protein, 117 aa, Glycine max
  Coding DNA Sequence Number=SeqID_60988
  Homolog annotation: Hit_ID=Q10KF1; Match level="QueryCoverage=59%, HitCoverage=4%, E-value=1e-12, Identity=54%"; Hit description =Expressed protein
MSYSIEICRDQISLKLDDHLYKKDGVEDDLGSNLWQVTYTDNQVPPQDHGPYPQALIIETYTPPDPGPYPQDQPKQNSVRFTPTQVEAIISGIQPGLIMVVGPPSTGKTDQQSVIKN

SEQ ID NO: 177767 - protein, 79 aa, Glycine max
  Coding DNA Sequence Number=SeqID_60989
  Subcellular localization annotation: CTP_CleavageSite=39; ConfidenceScore=5.44e-01
MPAAASRSLKIRKFQKSSASGIFESMFPPPPKVLGRGSLCSEVSGKSSSEGWNSKFDYISMGNHGETQNTAQKDMSSIY

SEQ ID NO: 177768 - protein, 59 aa, Glycine max
  Coding DNA Sequence Number=SeqID_60990
MASTLLASSEWCRDRREMASSSLSVVVLRVLWSAMEGQVGPNVMNGARPCFEDKQVGYS

SEQ ID NO: 177769 - protein, 416 aa, Glycine max
  Coding DNA Sequence Number=SeqID_60991
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=26%, E-value=1e-123, Identity=53%"; Hit description =Chromo
MKFHHLGQPVELHVDADHGPHPISATQIKRMIQTNATSALFHLCVLPASDTTIPQHPPSSTPSSIPAIDALIHKYQSLFQTPTALPPSRSIDHHIHLRPNTEPINVRPYRYPHFQKAEIEKQVADLLSAGLIQVSRSPFSSPVLLVKKKDDSWRMCVDYRALNAVTIRDRFPMPTVDELLDDLGHASWYSKLDLQQGFHQILMAPEDTPKTAFRTHQGHYEYRVMPFGLCNAPSTFQAAMNTLLQPFLRRFTAVFFDDILVFSDSLQAHLHHLELVFQALLQGQFYLKHTKCSFAQRRLEYLGHIISERGVEPDPSKIRAMIDWPTPKTPKDLRAFLGLTGFYRKFVQGYAALASPLTALLCKNAFDWTPESQLAFETLKTAMTRAPVLALPNFEHPFVLETDASGTAMGAVLLQQ

SEQ ID NO: 177770 - protein, 121 aa, Glycine max
  Coding DNA Sequence Number=SeqID_60992
  Gene Ontology: Mol. function=structural molecule activity; Cellular component=protein complex; Biological process=microtubule-based movement
  Homolog annotation: Hit_ID=Q53M52; Match level="QueryCoverage=53%, HitCoverage=14%, E-value=2e-28, Identity=93%"; Hit description =Tubulin alpha-2 chain
  Pfam annotation: Domain name=Tubulin_C; Domain location=1-117; Score =18.8; E_value=8.3e-05; Accession=PF03953.7; Description=TubulinFtsZ family, C-terminal domain
MEKLTQTSFGGDHLTLNAPVISAEKAYHEQLSVAEITNSAFEPSSIMAKCDPRHGKYMACCLMYRGDVVPKDVNAAVARWHGGAVACEFICAPRGPSPIQSDPAHCPVIGGKSFCCEAASS

SEQ ID NO: 177771 - protein, 295 aa, Glycine max
  Coding DNA Sequence Number=SeqID_60993
  Gene Ontology: Mol. function=DNA binding
  Homolog annotation: Hit_ID=Q8LAV4; Match level="QueryCoverage=95%, HitCoverage=100%, E-value=1e-58, Identity=45%"; Hit description =Putative DNA-binding protein
  Pfam annotation: Domain name=DUF296; Domain location=101-218; Score =194.3; E_value=2.9e-55; Accession=PF03479.5; Description=Domain of unknown function (DUF296)
MGPSKHHMLATVANPWWTGQGGLSGVDHPGTHSPGLGKRPSDLGISENSGGHNREEDEDNRDEPKEGAVEVGTRRPRGRPPGSKNKPKPPIFVTRDSPNTLRSHVMEVTGGADVAESVAQFARRRQRGVCVLSGSGSVANVTLRQPSAPGAVVALHGRFEILSLTGTFLPGPAPPGSTGLTVYLTGGQGQIVGGSVVGSLVAAGPVMVIAATFANATYERLPLDEDDEGPSSAAGAQGGGSSPPPPLGIGSSGGGQLQGGMPDPSSMPLYNLPPNGGVGQVGHEALAWAHGRAPF

SEQ ID NO: 177772 - protein, 336 aa, Glycine max
  Coding DNA Sequence Number=SeqID_60994
  Homolog annotation: Hit_ID=Q2QXR0; Match level="QueryCoverage=40%, HitCoverage=25%, E-value=5e-31, Identity=50%"; Hit description =Expressed protein
  Pfam annotation: Domain name=DUF668; Domain location=167-256; Score =189.6; E_value=7.5e-54; Accession=PF05003.3; Description=Protein of unknown function (DUF668)
LGLSGVSPSPTLQNECGLVSGQINVPMSSEKLKNIHCKRNRRTAVETRETISKPMRRGELAYLQLEDFGFPCGTSPGRLFMECLSLSSSVVKLDDDDDDYVVDREDLHGHISSSHSIDVGNKAKKRDHLYNSGGPNHVQSGVPFTEDLSCSTFGPQSRLAVYAPPSTLGGCALALHYANVIIVMEKLLRYPHLVGEEARNNLYQMLPTSLRLSLKGKLKTYIKNLAIYDAPLAHDWKVTLDGILKWLAPLAHNMIRWQSERNFEQHQIVNRTNVLLFQTLYFADKDRTEEAICQLLMGLNYICRYEQQQNVLLGCASSFDFEDCMEWQLQCGAFPS

SEQ ID NO: 177773 - protein, 125 aa, Glycine max
  Coding DNA Sequence Number=SeqID_60995
TLFLQHFNIPLDSEPYVPIKRSFLIDAVVVSSFGYHKERDGSWVKKGAQPNDDEGQLPVEEDSSLFQSILDRFDGLQTYVGERFDALEQQVDMRFNTMDSRITKVEEDATIIRDYLDLPPPPPSI

SEQ ID NO: 177774 - protein, 64 aa, Glycine max
  Coding DNA Sequence Number=SeqID_60996
MGKQNSNDNIVHDATIKENRVDDHGDDKEGGSGAVGTPDGPWCRWATAAEEVDEPFRFFNDSAI

SEQ ID NO: 177775 - protein, 141 aa, Glycine max
  Coding DNA Sequence Number=SeqID_60997
MGEVEEVQKQMKADMEAMKEQMARMIEAMMSMKKIMETNAVAVAATSAVAKSQQPQSDHAHVFQTVGETHEIPHHNLADFKPCLGYATEGQVVGGILLQNTLEGPQFHPQPQPLHSTVAKIPPIMEGMGKVGSSRGKAQGR

SEQ ID NO: 177776 - protein, 129 aa, Glycine max
  Coding DNA Sequence Number=SeqID_60998
MILDASTGGTMMSKSPEEAIVIIDSIAASDYQSHHDRAPTQRKEEKAHYLQNQARPQQNFQGSYQGYRGGSGSNQPYGRRPQNSSPTNTSCAGPSNNSYGGSSSRGPQQHQAQPDRMSKMEDTLTQFMQ

SEQ ID NO: 177777 - protein, 63 aa, Glycine max
  Coding DNA Sequence Number=SeqID_60999
MSQTLLRNNIIIQKQHYVELWKDLWQIELEGPVTKSMNKRLQEDWARAVEEGPRVLMNLRIDL

SEQ ID NO: 177778 - protein, 156 aa, Glycine max
  Coding DNA Sequence Number=SeqID_61000
MATNCASTTRGGGYRAATVHTNEDRAHKTPSGPGGVQQGPRVSSSSYGPLDRAHKTPSGPGEVQQGPGVSSSSYGPLSVLQGARSPRQGIAPARHPVDSKKSNRVLGFPALIMGLYQFYGVPVAPSKVIRPPINWTFIEKYCAPGRRRARHHSSGQ

SEQ ID NO: 177779 - protein, 581 aa, Glycine max
  Coding DNA Sequence Number=SeqID_61001
  Gene Ontology: Mol. function=transcription regulator activity; Cellular component=nucleus; Biological process=regulation of transcription
  Homolog annotation: Hit_ID=Q5N802; Match level="QueryCoverage=73%, HitCoverage=83%, E-value=1e-66, Identity=40%"; Hit description =Putative bHLH transcription factor
  Pfam annotation: Domain name=HLH; Domain location=393-443; Score =34.6; E_value=3.4e-07; Accession=PF00010.16; Description=Helix-loop -helix DNA-binding domain
MENQFFLNAGVPPQLHFEPSPHHHHHHLCPPPSWQSSLSSAMDVQVTVLNCSTEQNPDCFYNNTPTWDKSTDHHGLQFDSALSSMVSSPAASNSNMSSENFVIRELIGKLGNIGAGSDEIEISPHSQPLVGASSYINCNNNSTNTSCYSTPLSSSPKVNMNKIPTMVKHLVKEGMPLSLGTSTSLNSTVAEFSADPGFAERAAKLSCFGSRSFNGRTTQLCLNIAELAQRSSPLVENGKKQLPRVSSSPSLKVLGSQMGTQENKNSPLQDLMEVANSQEESAISEQTPNGDTGEKPSPYVNSRKRKGPSKGKAKETSTSTNPPMAAEASDDSNAKRSKPNEGEGNENGQVKAEEESKGGNNSNANDEKQNKSNSKPPEPPKDYIHVRARRGQATDSHSLAERVRREKISERMKLLQDLVPGCNKVTGKALMLDEIINYVQSLQRQVEFLSMKLASVNTRLDFSIESLISKDIFQSNNSLAQPIFPIDSSAPPFYGQQTQPNPAIHNNIPNGTMTHNSVDPLDTGMCQNLGMHLPHLNGFNEGGFQYPITFSEDDLHTIVQMGFGQTANRKTPIQSQSFNGK

SEQ ID NO: 177780 - protein, 445 aa, Glycine max
  Coding DNA Sequence Number=SeqID_61002
  Gene Ontology: Mol. function=lyase activity; Cellular component =anchored to membrane; Biological process=pathogenesis
  Homolog annotation: Hit_ID=Q52PJ2; Match level="QueryCoverage=89%, HitCoverage=91%, E-value=1e-177, Identity=74%"; Hit description =Ripening-related pectate lyase
  Pfam annotation: Domain name=Pec_lyase_C; Domain location=183-366; Score=315.1; E_value=1.2e-91; Accession=PF00544.9; Description =Pectate lyase
MKLLSPKLFTLAILLAAALVLASADAVSDNEMQKHEATESRDVVEEKLRVQSLKNSSMAERSGGALNEHAVDNPEEIASMVDESIRNYTARRNLNFFSCGTGNPIDDCWRCDKRWYARRKRLANCGIGFGRNAIGGRDGRYYVVSDPNDDDPVNPKPGTLRHAVIQDRPLWIVFKRDMVITLKQELIMNSFKTIDGRGVNVHIAYGACITIQFVTNVIIHGLHIHDCKVTGNAMVRSSPSHYGWRTLADGDGISIFGSSHIWIDHNSLSSCADGLVDAVMGSTAITISNNYFTHHNEVMLLGHSDSYVRDKQMQVTIAYNHFGEGLIQRMPRHGYFHVVNNDYTHWVMYAIGGSANPTINSQGNRYLAPLNPFAKEVTKRVDTGSSVWKSWNWRSEGDLLLNGAFFTSSGAGAAASYARASSLGAKSSSLVGTITSGAGVLKCRR

SEQ ID NO: 177781 - protein, 32 aa, Glycine max
  Coding DNA Sequence Number=SeqID_61003
MAHSDNSGNGNDVDALHLHGRTTRSTGASLSW

SEQ ID NO: 177782 - protein, 63 aa, Glycine max
  Coding DNA Sequence Number=SeqID_61004
MEPFSLHQEQELQQAMPEPQVWGQNRLLWLVPSPLELVFLTAAGVPCTSSHFHNPSLVREISP

SEQ ID NO: 177783 - protein, 108 aa, Glycine max
  Coding DNA Sequence Number=SeqID_61005
MSPSQLLPIDNYRQRQPQQPDAMFLPWMLMKICCNRKSHWWNALVVDVALWKINVKNGVPTLADPWYQYLADNDLMSRDEVVFYYTFKKHGWDVLYRKQLIWDDDQSD

SEQ ID NO: 177784 - protein, 182 aa, Glycine max
  Coding DNA Sequence Number=SeqID_61006
MTTTNAPTASTPSPRSLSRCTPVYSFQAVFHVDRNYIEVPRSYHKQWAPHCPAYVKIQYNGAPHIIKVRKNGQQYYLADGLKQFRRNFNIHEGVLLLPTEAVHFVHASTPFMTVQHNSAVRDIWTISMHNGEQHVDDPWNRLLTDNDLMGGDEVIFYYRPNEHVWEIIFRKEPIWDEDDDST

SEQ ID NO: 177785 - protein, 69 aa, Glycine max
  Coding DNA Sequence Number=SeqID_61007
MTSFQILLLQLKTSKLVAKIEFGVNGFMLLVKERLATSMDFSSESMECIYRVKRKQRRGGENVVFKYIY

SEQ ID NO: 177786 - protein, 102 aa, Glycine max
  Coding DNA Sequence Number=SeqID_61008
MANNNHYWLCIYWTGRGQLTTTIIGPFGDYLGCCKSTMVVGHTTTSANFLGRGGGVSCKLELFPLMKLTALEFGILMSTEPKLIQLIQLLQPIVTCKLRIKV

SEQ ID NO: 177787 - protein, 150 aa, Glycine max
  Coding DNA Sequence Number=SeqID_61009
  Gene Ontology: Mol. function=DNA binding; Biological process=DNA integration
  Homolog annotation: Hit_ID=Q1SKC8; Match level="QueryCoverage=99%, HitCoverage=36%, E-value=5e-41, Identity=52%"; Hit description =Integrase, catalytic region
MVYEKACHLPAELEIKAHWAKKFLNSDFTASREKRKVQLQELEEMCLNTYESSKLYEERTNRYHERKILHREFKPGQQVLLYNLRLKLFPRKLKSRWSGPFTVKGIKPYGAIEIEDQSKDCSKLVNGKRLNIYLGGEVPQHIIVIKLKDP

SEQ ID NO: 177788 - protein, 188 aa, Glycine max
  Coding DNA Sequence Number=SeqID_61010
  Subcellular localization annotation: CTP_CleavageSite=52; ConfidenceScore=5.11e-01
DVDPGRKDPAFGVRSSYKLQSCSTPSSDAAQISWVVPIGMTVVVNVLAIVVVAVVDMSIVVMVAALPLVEKESGVVDGIPPIVDVGSLDVTKMVLSFFLCKHPMSHSFVNKVEGWVMEEAGFGDARLKDGGFSEFLEECRKKPSAFELAFVPYESHTWQVEMNSIDMSQKECSEIKAPHYHLMAIVNV

SEQ ID NO: 177789 - protein, 796 aa, Glycine max
  Coding DNA Sequence Number=SeqID_61011
  Gene Ontology: Mol. function=transcription factor activity; Cellular component=endoplasmic reticulum; Biological process=regulation of transcription, DNA-dependent
  Homolog annotation: Hit_ID=Q6YUW7; Match level="QueryCoverage=97%, HitCoverage=97%, E-value=0.0, Identity=52%"; Hit description =Chromosome structural maintenance protein-like
  Pfam annotation: Domain name=RINT1_TIP1; Domain location=293-795; Score=461.2; E_value=1.3e-135; Accession=PF04437.4; Description=RINT- 1  TIP-1 family
MEWLQTLPPPSHLSPSALSFLDHRLHTQLALAEAPTFVAELQTQCSELDRSLDELTRLLGAGLAAYTSFSGEIHGLFGDVTERLIALSSTVVPDGGRGEEDGKGFREELATLAKEVARLETVRVYAETALKLDTLVGDIEDAVSFTMSKNIRKHSSQNSQEMHMLAIKTLKTTEGILTSITKAHPQWKHLVSAVDHRVDRALAILRPQAIAEHRALLASLGWPPPLFALNSLDSDARTANQVANPLLTMQVDLKVQYSENFLALCNLQELQRQRKARQLEGHDREVALRQSLWVIEELVNPLSLASQRHFSKWVDKPEFIFTLVYKITRDYVDSMDELLQPLVDEAKLLGYSCREEWISAMVTSLTTYLAKEIFPSYISQLDEESVIGIQSSARISWLHLIDLTIAFDKRIKSLVEHSGILLSFDDDIMQKISSLSVFCDRPDWLDLWAEIELGDALGKLKPDIQDENNWRKKVEGVVLSSYTDDHKSPLISNAFLRHLASVIDRCRSLPSVILRSKFLRFAGVPIIRNFFDSILIRCQEAEGLTALTDDDAVIKVTISVNAAHYFESVLKEWSEDVFFLEMGMDEDDKTELESNSNSYGELLPESSRRVIFDDEIKKLEEFRTEWVEKISLVILRGFDSHSRDYVKNKRQWQKGEEGWTVSKTLIEALDYLQSKMSVVEVSLNDRDFVGVWRSLAAGIDRLIFNGILISNVKFHNSGVERFGSDLEVLFGVFGAWCLRPEGFFPKSSEGLKLLKMDENRVQECMGGGKRWLKENGIRRLSVTEAEKILKNRVFRS

SEQ ID NO: 177790 - protein, 113 aa, Glycine max
  Coding DNA Sequence Number=SeqID_61012
MREPFGLALFTFCYPEAASPMTCRDKLWSSARFCYFKSRGGRRQIMVIPHTFSRSRGDRVRWHAETNYGHSAPCHPGSIVSKGKQRQIMVILRLVSTKRNELDSIRTMLVIRY

SEQ ID NO: 177791 - protein, 441 aa, Glycine max
  Coding DNA Sequence Number=SeqID_61013
  Gene Ontology: Mol. function=transcription factor activity; Cellular component=nucleus; Biological process=regulation of transcription
  Homolog annotation: Hit_ID=Q2QXZ6; Match level="QueryCoverage=88%, HitCoverage=92%, E-value=6e-74, Identity=33%"; Hit description=GRAS family transcription factor containing protein
  Pfam annotation: Domain name=GRAS; Domain location=4-350; Score =241.6; E_value=1.7e-69; Accession=PF03514.5; Description=GRAS family transcription factor
MDGLGSPSQWLRELRWDSQGLNPISLLIDCAKCVASGSIKNADIGLEYIYQISSPDGNAVQRMVTYFSEALGYRIIKNLPGVYKSLNPSKTSLSSEDILVQKYFYELCPFLKFSYLITNHAIAEAMECEKVVHIIDLHCCEPTQWIDLLLTFKNRQGGPPHLKITGIHEKKEVLDQMNFHLTTEAGKLDFPLQFYPVVSKLEDVDFEKLPVKIGDALAITSVLQLHSLLATDDDMAGRISPAAAASMNVQRALHMGQRTFAEWLERDMINAYTLSPDSALSPLSLGASPKMGIFLNAIRKLQPKLVVITEQESNLNGSNLMERVDRALYFYSALFDCLDSTVMKTSVERQKLESKLLGEQIKNIIACEGVDRKERHEKLEKWIRRLEMAGFEKLGVLGDECSYMCWNMKNPLHCHGFQEVENELKEVALSMKTAKYLQMRY

SEQ ID NO: 177792 - protein, 164 aa, Glycine max
  Coding DNA Sequence Number=SeqID_61014
MSRRLPEACTSERHEKWMAQKRNIAWRQQQKHHFCMSHDSVTKIPASMDWRKTGVVTPIKDQGKCLSYWNMRKMPLNLVQIKESIITYIVLHYGAYWQMVVILPKENVVIWFCSLHNRPNNYLKGIINNTLKGFDDTPQSKSKATARWIVVKKKKEALSVSITS

SEQ ID NO: 177793 - protein, 99 aa, Glycine max
  Coding DNA Sequence Number=SeqID_61015
MGLRWRIGDGEGINMWQQPRVRKNSWHSFFTCPTSVIIWKQSGMWSGIEATMTSADGFKRRRANKVARSLARNANTFPHDYTFNDVPQCIYPFIEMEKI

SEQ ID NO: 177794 - protein, 175 aa, Glycine max
  Coding DNA Sequence Number=SeqID_61016
MVRNSLGLCGLEIKALRCELEDECQKLEEELHLQKSKTLSHSLCQGINTLNSNVKSDTAFQGGYYIITVFECRPDVTFKDGYYVITVFECRPDVTFKGGYYIITVFESRGDVTFKGGYYVITVFECRPDVTFKGVYYVITVFENFSLSKTVVIITVIKSNCVSTTLYTTTVYNRR

SEQ ID NO: 177795 - protein, 247 aa, Glycine max
  Coding DNA Sequence Number=SeqID_61017
  Gene Ontology: Mol. function=DNA binding
  Homolog annotation: Hit_ID=Q1SBB2; Match level="QueryCoverage=86%, HitCoverage=27%, E-value=2e-53, Identity=55%"; Hit description =Homeodomain-like
MVLPIKRRRLTACAKAETSRAIENSSGGLESEKVAFSQLSSFPDSHQNVCDSVSSRPNGSSIASLADRSVEVNNEEIILNEICQSRSKSCVEVEKCESQSAVTFNTPQVLLKSEDGEMVATVEEDGQCKKANDPCLSTDTQGVVEKPQRSSCDVGSMEQQPTNINPRRQSTRNRPLTVKAMESLGNEFLHVQRRRKKKDILSHIDAFSPCRKARTSKTKLHRHSSDHGTAVLVKEKHLSGDHKMEIV

SEQ ID NO: 177796 - protein, 545 aa, Glycine max
  Coding DNA Sequence Number=SeqID_61018
  Gene Ontology: Mol. function=DNA binding; Cellular component=nucleus
  Homolog annotation: Hit_ID=Q1SBB2; Match level="QueryCoverage=91%, HitCoverage=61%, E-value=1e-156, Identity=59%"; Hit description =Homeodomain-like
MESIQQNYNDDSMEHSSSSPPGSPDISDVVGALQLDPRVGEEYQVEVPGIIKESERLQLLMNPADSEVMLDSSLSFAIGLPISVTWIRNEVEDSGHERNLADVDGGKNSGQLGKSKNYVLVPGTLSNSWSEADAKSFLLGLFIFGKNFIKIKKFLENKGMGEILSFYYGKFFKSEEYHRWSDCRKIKGRKCIIGQKLLNGQRQHELLSRLIPHVSEESKDTLLQVSQSYVEGRTSVEEYILSIKSIVGLGVLVEAVGIGKEKEDLTSLAVELGKNNRVFSVPTCKAWASLGPSDIIKYLTGGLRLSKAKSNDLFWEAVWPRLLARGWHSEQPKNQGYVHSKDHLVFLIPGVKKFSRRKLVKGDHYFDSVSDVLSKVVAEPNLLVLEEETKVGSCNDEEPEKGLNKDDQFDYHRQCYLKPQASTTDHIKFMVIDTSLVHGGKSSDLMEFKSAPFKSVSKVEVNAAGITSKGAKHTRKVNHCKDMPDNIDKKLTKFTVIDTSRLYEGKLLKVRELTCLPVELENASKMTVLSRESKDSSSDEDSSSM

SEQ ID NO: 177797 - protein, 843 aa, Glycine max
  Coding DNA Sequence Number=SeqID_61019
  Gene Ontology: Mol. function=ATPase activity, coupled to transmembrane movement of substances; Cellular component=integral to membrane; Biological process=transport
  Homolog annotation: Hit_ID=Q9LK64; Match level="QueryCoverage=92%, HitCoverage=94%, E-value=0.0, Identity=52%"; Hit description =Multidrug resistance-associated protein 3
  Pfam annotation: Domain name=ABC_membrane; Domain location=284-553; Score=87.2; E_value=4.9e-23; Accession=PF00664.13; Description=ABC transporter transmembrane region
  Pfam annotation: Domain name=ABC_tran; Domain location=627-802; Score= 130.5; E_value=4.8e-36; Accession=PF00005.17; Description=ABC transporter
  Pfam annotation: Domain name=MMR_HSR1; Domain location=628-705; Score= -16.1; E_value=0.03; Accession=PF01926.13; Description=GTPase of unknown function
  Pfam module annotation: Pfam domain module=ABC_membrane::ABC _tran::MMR_HSR1; Domain location=284-553::627-802::628-705
MFYVFLHALSASIHLLFLAASSLSWLWNKVTLTPTTREEHSKEEKHNSNNNNTIFKTTVFCSLALSVFSFVLCLFNYFYWYTSGWSEQNVSTLLDLALKTLAWGVVSVSLLKGFSFVLFFSEEEKRFRFSFFFRAWCTFYLVFSCYSFVVDIVVLSKRPIQYLVSDAVSTCAGLFFCFVAYFVKNKGHVNGIEEPLLNGDANVGNEKEATGGDTVTPFSHAGVFSILTFSWVGPLVAVGNKKTLDLDDVPQLDTRDSVVGAFPSFRDKLEADSDANAINTWKDILFTAFLALLNTLASFIGPYLIDAFVQYLDGRRQYENQGYVLVFVFFFAKIVECLSQRHWFFRLQQIGIRMRALLVTMIYNKALTLSCQSKQGHTSGEIINFMTVDAERVGNFSWYMHDLWMVALQVVLALLILYKNLGLASIAALVATFVVMLANVPLGSLQEKFQNKLMESKDTRMKATSEILRNMRILKLQGWEMKFLSKITELRKTEQGWLTKYVYTTAMTTFVFWGAPTFISVVTIGACMLIGVPLESGKILSALATFRILQEPIYNLPDTISMIAQTKVSLDRISSFLRLDDLRSDVVEKLPRGSSDTAIEVIDGNFSWDLSSPNPTLQNINLKVFHGMRVAVCGTVGSGKSTLLSCVLGEVPKISGILKVCGTKAYVAQSPWVQSGKIEDNILFGEHMDRERYEKVLEACSLKKDLEIFSFGDQTVIGERGINLSGGQKQRIQIARALYQDADIYLFDDPFSAVDAHTGSHLFKECLLGLLSSKTVVYVTHQVEFLPAADLILVSTYFMKDGKISQCGKYADLLNSGTDFMELVGAHKEALSTLDSLDGLATI

SEQ ID NO: 177798 - protein, 47 aa, Glycine max
  Coding DNA Sequence Number=SeqID_61020
MASSLLLAMVLVLDLVAFALAVAAEQTRNTYYGFSYLSLNGETRATI

SEQ ID NO: 177799 - protein, 467 aa, Glycine max
  Coding DNA Sequence Number=SeqID_61021
  Gene Ontology: Mol. function=hydrolase activity, hydrolyzing O -glycosyl compounds; Cellular component=membrane; Biological process =carbohydrate metabolic process
  Homolog annotation: Hit_ID=Q8LB06; Match level="QueryCoverage=99%, HitCoverage=100%, E-value=1e-171, Identity=63%"; Hit description =Putative glucan endo-1-3-beta-glucosidase
  Pfam annotation: Domain name=Glyco_hydro_17; Domain location=29-352; Score=457.7; E_value=1.5e-134; Accession=PF00332.9; Description =Glycosyl hydrolases family 17
  Pfam annotation: Domain name=X8; Domain location=377-462; Score =140.8; E_value=3.8e-39; Accession=PF07983.3; Description=X8 domain
  Pfam module annotation: Pfam domain module=Glyco_hydro_17::X8; Domain location=29-352::377-462
MAMLLLIPLFLSSIALFTISSATTFSTHPGICYGQLGDNLPPPQKSVSLITSLHAKRVKLYDANPAILHALRDTSLQVSIMVPNDLIVNISRNQSLSDKWVSDNVVPYHPRTLIRYLLVGNEVTSSTAPNGTWPYLVPAMRRIKHSLKSLGIRKVKVGTSSAIDVLEASFPPSNGAFRKDLSAPVMKPMLKFLNRTKSFFFLDVYPFFSWSADPLNINLDYALFQSKNLTVTDPGTGLVYTNLFDQMVDAVYFAMNRLGFPGVRIFIAETGWPNGGDLDQIGANIFNAATYNRNFIKKVTRKPWLGTPARPGSALPSFLFALFNENQKPGPGTERHFGLLHPNGSRVYDVDLSGETPEAGFRPLPVPENNEKFKGEIWCVAARPHNATALAAALAYACSQGNGTCDPIQPKGKCFKPDSVFWHASYAFSAYWAQFRKVGGTCYFNGLATQTAKDPSYGSCKFPSVTL

SEQ ID NO: 177800 - protein, 63 aa, Glycine max
  Coding DNA Sequence Number=SeqID_61022
  Gene Ontology: Mol. function=oxidoreductase activity; Cellular component=chloroplast thylakoid membrane
  Homolog annotation: Hit_ID=Q1S3P9; Match level="QueryCoverage=79%, HitCoverage=15%, E-value=7e-17, Identity=76%"; Hit description =Alcohol dehydrogenase superfamily, zinc-containing
MGKKLMHAVQYDSYGGGPAGLKHVEVPLPTPSKDEVLIKVEAAGLNPFDWKKYMAISDSNIFN

SEQ ID NO: 177801 - protein, 552 aa, Glycine max
  Coding DNA Sequence Number=SeqID_61023
  Gene Ontology: Mol. function=ATPase activity, coupled to transmembrane movement of substances; Cellular component=integral to membrane; Biological process=transport
  Homolog annotation: Hit_ID=Q9LK64; Match level="QueryCoverage=98%, HitCoverage=59%, E-value=0.0, Identity=56%"; Hit description =Multidrug resistance-associated protein 3
  Pfam annotation: Domain name=ABC_membrane; Domain location=1-254; Score=51.6; E_value=2.5e-12; Accession=PF00664.13; Description=ABC transporter transmembrane region
  Pfam annotation: Domain name=ABC_tran; Domain location=326-509; Score= 162.4; E_value=1.2e-45; Accession=PF00005.17; Description=ABC transporter
  Pfam annotation: Domain name=MMR_HSR1; Domain location=327-413; Score= -14.8; E_value=0.023; Accession=PF01926.13; Description=GTPase of unknown function
  Pfam module annotation: Pfam domain module=ABC_membrane::ABC _tran::MMR_HSR1; Domain location=1-254::326-509::327-413
  Subcellular localization annotation: CTP_CleavageSite=80; ConfidenceScore=5.11e-01
MAWATPISTDVEPPVGGSTLIVIYVGLAVGSSFCVLVRSMLLVTVGYKTTTVLFNKMHLCIFRAPMSFFDSTPSGRVLNRASTDQSTVDTDIPYQIGSFAFSMIQLLGIIAVMSQVAWQVFIVFIPVIAVRIWYQQYYIPSARELSRLVGVCKAPIIQHFAETISGTSTIRSFDHQSRFQETNMKLTDGYSRPKFNIVGAMEWLCFRLDMLSSITFAFSLIFLISIPPGIIDPGIAGLAVTYGLNLNMIQAWMIWNLCNLENKIISVERILQYTIIPNGPPLVVEDNRPDPSWPSYGEVDIQDLQVCYDPHLPLVLRGLTCKFYGGMKTGIVGRTGSGKSTLIQTLFRIVEPTSGQIMIDNFNISSIGLHDLRSRLSIIPQDPTMFEGTVRNNLDPLEEYTDEQIWEALDKCQLGDEVRKKDGKLDSTVSENGENWSMGQRQLVCLGRVLLKKSKILVLDEATASVDTATDNLIQQTLRQHFSASTVITIAHRITSVIDSDMVLLLNQDIAAGLIEEYDTPTTLLENKSSFAQLVAEYTMRSKSSFEKSVDH

SEQ ID NO: 177802 - protein, 170 aa, Glycine max
  Coding DNA Sequence Number=SeqID_61024
MQFMLSPYGRRVSNLDDLAPCLDKMILLAEEEDRIIEAREEAPPSVPQFESQQFDMLGRSMETQGLGRRRESVDAEAHVIPAMPKRQHGMYYTPYQFTQEPSQMSPLYPYPYQSETSSDAYFMGTQPPLQLGYVMTDLFGSPSPAGTPEEGRPCGTSSRHNTHDDDDDDD

SEQ ID NO: 177803 - protein, 172 aa, Glycine max
  Coding DNA Sequence Number=SeqID_61025
  Gene Ontology: Mol. function=GTP cyclohydrolase I activity; Cellular component=cytoplasm; Biological process=aromatic compound biosynthetic process
  Homolog annotation: Hit_ID=Q8VYU3; Match level="QueryCoverage=83%, HitCoverage=31%, E-value=3e-60, Identity=77%"; Hit description=GTP cyclohydrolase I
  Pfam annotation: Domain name=GTP_cyclohydroI; Domain location=52-152; Score=34.2; E_value=4.5e-07; Accession=PF01227.12; Description=GTP cyclohydrolase I
MFCVLNALAVNEKCISSSIFGYRQKVKDIVQGALFPEAGLDNRVGHAGGAGGLVIVRDLDLFSYCESCLLPFPVKCHVGYVPSGERVVGLSKLSRVADVFAKRLQEPQRLADEVCSALHRGIKPAGVAIILQCTHIHFPDIEPVFLDSNHQGWVKILVSQFWGFETKCRCMG

SEQ ID NO: 177804 - protein, 58 aa, Glycine max
  Coding DNA Sequence Number=SeqID_61026
MSVDNKGQQQQGGRRRAKGEHKRDTENASSNCIHDGHMNSFHEKHAQTSTWHIVMIHE

SEQ ID NO: 177805 - protein, 638 aa, Glycine max
  Coding DNA Sequence Number=SeqID_61027
  Gene Ontology: Mol. function=protein binding; Cellular component =integral to membrane; Biological process=xylan catabolic process
  Homolog annotation: Hit_ID=Q1S5Q4; Match level="QueryCoverage=94%, HitCoverage=69%, E-value=1e-147, Identity=46%"; Hit description =Leucine-rich repeat
  Pfam annotation: Domain name=LRR_1; Domain location=117-140; Score =10.7; E_value=2.8; Accession=PF00560.23; Description=Leucine Rich Repeat
  Pfam annotation: Domain name=LRR_1; Domain location=142-171; Score =4.2; E_value=47; Accession=PF00560.23; Description=Leucine Rich Repeat
  Pfam annotation: Domain name=LRR_1; Domain location=189-209; Score =1.4; E_value=1.6e+02; Accession=PF00560.23; Description=Leucine Rich Repeat
  Pfam annotation: Domain name=LRR_1; Domain location=20-42; Score =12.0; E_value=1.6; Accession=PF00560.23; Description=Leucine Rich Repeat
  Pfam annotation: Domain name=LRR_1; Domain location=254-276; Score =11.3; E_value=2.1; Accession=PF00560.23; Description=Leucine Rich Repeat
  Pfam annotation: Domain name=LRR_1; Domain location=284-305; Score =10.3; E_value=3.3; Accession=PF00560.23; Description=Leucine Rich Repeat
  Pfam annotation: Domain name=LRR_1; Domain location=308-330; Score =9.7; E_value=4.4; Accession=PF00560.23; Description=Leucine Rich Repeat
  Pfam annotation: Domain name=LRR_1; Domain location=332-354; Score =12.9; E_value=1.1; Accession=PF00560.23; Description=Leucine Rich Repeat
  Pfam annotation: Domain name=LRR_1; Domain location=356-377; Score =2.5; E_value=98; Accession=PF00560.23; Description=Leucine Rich Repeat
  Pfam annotation: Domain name=LRR_1; Domain location=378-400; Score =4.3; E_value=46; Accession=PF00560.23; Description=Leucine Rich Repeat
  Pfam annotation: Domain name=LRR_1; Domain location=402-421; Score =10.4; E_value=3.2; Accession=PF00560.23; Description=Leucine Rich Repeat
  Pfam annotation: Domain name=LRR_1; Domain location=45-67; Score=8.2; E_value=8.5; Accession=PF00560.23; Description=Leucine Rich Repeat
  Pfam annotation: Domain name=LRR_1; Domain location=472-495; Score =7.9; E_value=9.4; Accession=PF00560.23; Description=Leucine Rich Repeat
  Pfam annotation: Domain name=LRR_1; Domain location=496-518; Score =14.4; E_value=0.41; Accession=PF00560.23; Description=Leucine Rich Repeat
  Pfam annotation: Domain name=LRR_1; Domain location=520-542; Score =14.8; E_value=0.31; Accession=PF00560.23; Description=Leucine Rich Repeat
  Pfam annotation: Domain name=LRR_1; Domain location=544-565; Score =10.7; E_value=2.9; Accession=PF00560.23; Description=Leucine Rich Repeat
  Pfam annotation: Domain name=LRR_1; Domain location=69-91; Score =17.6; E_value=0.045; Accession=PF00560.23; Description=Leucine Rich Repeat
  Pfam annotation: Domain name=LRR_1; Domain location=93-115; Score =13.0; E_value=1; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1; Domain location=117-140::142 -171::189-209::20-42::...
  Pfam module annotation: Domain location=254-276::284-305::308 -330::332-354::356-377::378-400::402-421::45-67::472-495::496 -518::520-542::544-565::69-91::93-115
MGGCQLKDLSPSIQYANFTSLKSLSLSANEFPSDLPKWLFNLSSGISSIELYSNSLKGKLPKALLNLKHLEVLNLEDNKLSGPIPYWLGKLEHLRYLALNLNKFSGSIPTSFGNLSSLTSLLVGHNQLSGVVSERNFAKLSKLRELDIYSSPPLIFDFDSYWVPPFQLQRLALAFAGPNLPVWLYTQRSIEWLDIYESSFEAQGKFWSFVSRVAQLYLKDNLIDVNMSKVLLNSTFIYMSSNDLKGGLPQLSSNVAFLDISNNSLSGTISPLLCDHKMLNGKNNLEYLDISLNHLSGGLTNCWKNWKSLVHVNFGSNNLTGKIPTSMSLLSNLTSLHLHENKLYGDIPLALQNCHSLLIFNVRENNFSGNIPNWIPHGAKALQLRSNHFSGVIPTQICLMSSLIILDVADNTISGHIPSCLHNITALVFNNASYNKLTFFFPIDGFSYYIFEDSLELVTKGQTIDYGMNLHFVSLIDMSSNNLSGIIPPQMFSLIGLYSLNFSHNKLTGQIPNEIGNMKNLESLDFSTNQLRGEIPQGLSNLSFLASLNLSFNNFTGKIPSGTQLQGFGALSYIGNRNLCGPPLTKFCLQVSEPKDTKAIDEDGDESAFWSWFYIGIGSGFGTGFLGVSYKFLYDLRG

SEQ ID NO: 177806 - protein, 197 aa, Glycine max
  Coding DNA Sequence Number=SeqID_61028
  Homolog annotation: Hit_ID=Q9AVH2; Match level="QueryCoverage=23%, HitCoverage=16%, E-value=6e-20, Identity=97%"; Hit description =Putative senescence-associated protein
MTEGCGEGFCLANLPGDAFSLWGNFFEAKKQMMADAKVGGAGLWPRAKFRIGWPPPPPRDQFCCQDFANFGLRPGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 177807 - protein, 78 aa, Glycine max
  Coding DNA Sequence Number=SeqID_61029
MDVQEKQKKSNYYFPSGALNQAPHHGGGGHDHDGLKSRLWVVLVPLSQNKKKRNHYYSSLQQEEQAENIYHQFGNIGR

SEQ ID NO: 177808 - protein, 999 aa, Glycine max
  Coding DNA Sequence Number=SeqID_61030
  Gene Ontology: Mol. function=nucleoside-triphosphatase activity; Cellular component=membrane; Biological process=defense response
  Homolog annotation: Hit_ID=Q2L3S2; Match level="QueryCoverage=83%, HitCoverage=82%, E-value=1e-158, Identity=37%"; Hit description =Putative ATPase
  Subcellular localization annotation: CTP_CleavageSite=52; ConfidenceScore=5.70e-01
MDIQEESPVFGSLKAMTTRNMSSSSSAFFSANQSPFFSPRSPSSCQLLESARLDAPSNRIHLGLAPSSTTSEIPEPNSLVNVRCTFSDVSASPAGCNSADLQKLNRISSSVGISSSSVSSYSNRREDGYSGQKEKRIKEDRNHRTSSTPGSTSFSSYRLRSCDVFIGLHGSKPPLLRFAKWLCAELETQGISCFVSDRARSRSSCKLGIAERAMDAASFGIIVITRKSFKNQYTIEELQFFCSKKNLIPIYFDLSPADCLVRDIIEKRGELWEKHGGELWLSYDGLEQEWKDAVHGLSRVDECKLEAQDGNWRDCILRAVTLLAMRLGRRSVAERLTKWREKVEKEEFPFARNENFIGRKKELSQLEFILFGDVTGDAEQDYIELKARPRRKSVRIGWGKSNVIDERWRERHMGNGSWKEKEPVVWKESEKEIEMQGIEFSKRHNHLRLKRGKYSKRKRGMKILYGKGIACVSGDSGIGKTELILEFAYRFHQRYKMVLWIGGGSRYIRQNYLNIRSLLEVDVGVENGLEKTKIRGFEEQEVAAISRVRKELMRNIPYLVVIDNLESEKDWWDHKLVMDLLPRFWGETHVIISTRLPRIMNLEPLKLSYLSGVEAMSLMLGSGKDYPVAEVDALRVIEEKVGRLTLGLAIISAILSELPITPSRLLDTINRMPLKEMSWSGKEAHSFRKNTFLLQLFDVCFSIFDHADGPRSLATRMVLVSGWFAPGAIPVSLLLLAAQKIPERCQRKCFWKKVQQLLTCGFTSSYAKKSELEASSLLLRFNIARSSTKQGYIHINELIKLYAQRRDDTGAAQAMIQAIINHGSISQNLEHLWAACFLLFGFGHDPVVVEVKVSELLYLVKRVVLPLAIHTFITYSRCTAALELLRLCTNALEAADQAFVTPVDKWLDKSLCWRSIQTNAQLNPCLWQELALCRATVLETRAKLMLRGAQFDIGDDLIRKAVFIRTSICGEDHPDTISARETLSKLTRLHANVQIHSST

SEQ ID NO: 177809 - protein, 237 aa, Glycine max
  Coding DNA Sequence Number=SeqID_61031
  Gene Ontology: Mol. function=GTP binding; Cellular component =intracellular; Biological process=small GTPase mediated signal transduction
  Homolog annotation: Hit_ID=Q1SE73; Match level="QueryCoverage=99%, HitCoverage=100%, E-value=2e-95, Identity=76%"; Hit description=Ras GTPase
  Pfam annotation: Domain name=Arf; Domain location=4-221; Score=292.8; E_value=6.3e-85; Accession=PF00025.11; Description=ADP-ribosylation factor family
  Pfam annotation: Domain name=MMR_HSR1; Domain location=18-129; Score=- 11.0; E_value=0.01; Accession=PF01926.13; Description=GTPase of unknown function
  Pfam annotation: Domain name=Miro; Domain location=19-129; Score=7.1; E_value=0.0011; Accession=PF08477.3; Description=Miro-like protein
  Pfam annotation: Domain name=Ras; Domain location=19-154; Score= -69.5; E_value=0.00045; Accession=PF00071.12; Description=Ras family
  Pfam module annotation: Pfam domain module=Arf::MMR_HSR1::Miro::Ras; Domain location=4-221::18-129::19-129::19-154
MGQAFRKLFDTFFGNTEMRVVMLGLDAAGKTTILYKFHIGEVLSTVPTIGFNVEKVQYKNVIFTVWDVGGQEKLRPLWRHYFDNTDGLIYVVDSLDRERIGKAKQEFQTIINDPFMLNSVILVFANKQDLFALNNLSFKDHRPLGMMVSKPLKNNWSEIWSMLIPFFIIKFQQMRGAMTPMEVCEGLGLFDLKNRKWHIQGTCALKGDGLYEGLDWLASTLKERKAAGYSSIGTSSF

SEQ ID NO: 177810 - protein, 910 aa, Glycine max
  Coding DNA Sequence Number=SeqID_61032
  Gene Ontology: Mol. function=protein transporter activity; Cellular component=nuclear pore; Biological process=protein import into nucleus, docking
  Homolog annotation: Hit_ID=Q1SB44; Match level="QueryCoverage=99%, HitCoverage=100%, E-value=0.0, Identity=73%"; Hit description =Importin-beta, N-terminal
  Pfam annotation: Domain name=CRM1_C; Domain location=608-881; Score =462.8; E_value=4.3e-136; Accession=PF08767.1; Description=CRM1 C terminal
  Pfam annotation: Domain name=IBN_N; Domain location=2-64; Score=-0.4; E_value=0.1; Accession=PF03810.9; Description=Importin-beta N -terminal domain
  Pfam annotation: Domain name=Xpo1; Domain location=51-206; Score =137.7; E_value=3.2e-38; Accession=PF08389.2; Description=Exportin 1 -like protein
  Pfam module annotation: Pfam domain module=CRM1_C::IBN_N::Xpo1; Domain location=608-881::2-64::51-206
MAAEKLRDLSQPIDVPLLDATVAAFYGTGSKEQVLEGVIKYRWNALPVDQRDGMKNFISDVIVQHEWPVRWRSFIPDLVSAAKTSETICENCMAILKLLSEEVFDFSRGEMTQQKIKELKHSLNRSFIFSGSREDIPLSEFQLIHELCLYVLSASQRTELIRATLSTLYAFLSWIPLGYIFESPLLKTLLKFFPIPAYRNLTLQCLTEVAALQFGNYYDAHIKMYNIFMGQLQTILPPTTNIPEAYSHGSSEEQVHVRILESTQENISALLLGLEYLINISYVDDTEVFKVCLDYWNVLVSELFEPNRSLENPAAANMIGLQVPGMIDGIGSQLLQHRQLYAGPMSKLRMLMICRMAKPEEVLIVEDENGNIVRETMKDNDVLVQYKIMRETLIYLSHLDHDDTEKQMLRKLSKQLSGEDWTWNNLNTLCWAIGSISGSMVEEQENRFLVMVIRDLLNLCEITKGKDNKAVIASNIMYVVGQYPRFLRAHWKFLKTVVNKLFEFMHESHPGVQDMACNTFLKIVQKCKRKFVITQVGNMIQAESDAQKRDEYLQKLMVLPNQRWMEIIGKAHQNADFLKDQDVIRNVLNILQTNTSVASSLGTYFLPQITLIFLDMLNVYRMFSELISKSIAEGGPFASRTSYVKLLRSVKRETLKLVETFLDKAEDQPQIGKQFVPPMMDPVLGDYARNVPDARESEVLSLFSTIVNKYKAAMVEDVPQIFEAVFQCTLELVPDVVCNLFQQLKLVMDSIIWAFRHTERNIAETGLNLLLEMLKKFQESEFCNQFYRTYFLTIEQEIFAVLTDTFHKPGFKFHVLVLQHLFCLAETGALTEPLWDAATNPYSYPSNAAFVREFTINLLSTSFPNMTASEDNKDLYAEEAAAQRERERQRMLSIPGLVAPSELQDEMVDS

SEQ ID NO: 177811 - protein, 523 aa, Glycine max
  Coding DNA Sequence Number=SeqID_61033
  Gene Ontology: Mol. function=GTP binding; Cellular component =intracellular; Biological process=RNA-dependent DNA replication
  Homolog annotation: Hit_ID=Q1SRW7; Match level="QueryCoverage=99%, HitCoverage=100%, E-value=0.0, Identity=78%"; Hit description=IMP dehydrogenase/GMP reductase
  Pfam annotation: Domain name=PPR; Domain location=148-182; Score =21.5; E_value=0.003; Accession=PF01535.11; Description=PPR repeat
  Pfam annotation: Domain name=PPR; Domain location=217-251; Score =34.8; E_value=3e-07; Accession=PF01535.11; Description=PPR repeat
  Pfam annotation: Domain name=PPR; Domain location=252-286; Score =42.7; E_value=1.3e-09; Accession=PF01535.11; Description=PPR repeat
  Pfam annotation: Domain name=PPR; Domain location=287-321; Score =36.9; E_value=6.9e-08; Accession=PF01535.11; Description=PPR repeat
  Pfam annotation: Domain name=PPR; Domain location=322-356; Score =49.7; E_value=1e-11; Accession=PF01535.11; Description=PPR repeat
  Pfam annotation: Domain name=PPR; Domain location=357-391; Score =10.0; E_value=0.49; Accession=PF01535.11; Description=PPR repeat
  Pfam annotation: Domain name=PPR; Domain location=392-426; Score =26.4; E_value=9.8e-05; Accession=PF01535.11; Description=PPR repeat
  Pfam annotation: Domain name=PPR; Domain location=427-462; Score =19.0; E_value=0.018; Accession=PF01535.11; Description=PPR repeat
  Pfam module annotation: Pfam domain module=PPR::PPR::PPR::PPR::PPR::PP R::PPR::PPR; Domain location=148-182::217-251::252-286::287-321::322 -356::357-391::392-426::427-462
  Subcellular localization annotation: CTP_CleavageSite=20; ConfidenceScore=5.06e-01
MAFQSLFSKYKILPSFFCTLVQHKPSYHHFHSFPTSQVSGTLLPDLVNEISRLLSDHRYPHHDLELSLNPFSAQLSTNLVEQVLKRCKNLGFSAHRFFLWAKSIPGFQHSVMSFHILVEILGSCKQFAILWDFLTEMRESHHYEINSEIFWLIFRAYSQANLPDGAIRSFNRMDEFGVKPTIHDLDKLLFILCKRKHVKQAQQLFHQAKNRFSLTAKTYSILISGWGEIGDSEKACDLFQAMLEQGCPVDLLAYNNLLQALCKGGRVDEAKNIFHDMLSKRVEPDAFTYSIFIHSYCDADDVQSAFRVLDKMRRYNLLPNVFTYNCIIKQLCKNEHVEEAYQLLDEMISRGVKPDTWSYNAIQAYHCDHCEVNRALRLMFRMEKDICLPDRHTYNMVLKLLIRIGRFDKVTEVWENMVDKKFYPSVSTYSVMIHGFCKKKGKLEEACKYFEMMIDEGIPPYVTTVEMLRNRLLGLGFIDHIEILAAKMRQSTSYAIQELANIMIGNRTAHNTLGRDEMDIESD

SEQ ID NO: 177812 - protein, 94 aa, Glycine max
  Coding DNA Sequence Number=SeqID_61034
MIRCILYSISSSSSTAGKQQECRFGERCAYLGSNSILNRIASKGGYLWRTKNKGNWGLLRVKNISMEILDFYESNRMFTDERINAALQKLSLRP

SEQ ID NO: 177813 - protein, 155 aa, Glycine max
  Coding DNA Sequence Number=SeqID_61035
MSRNWQPYFSRDQIKTLPNRKQKTVDKHCRCKNDAVIAGLARNQDTGSQGFRGVSTVPRKITILPPSEDVSAREDRRSETERKRGAMELMEGGRSGGEFEVCAQRGRSRTFTHRSGVGVGGHVELHPPIKGAVVAIHHAVEVFVRAEGLDHALSR

SEQ ID NO: 177814 - protein, 162 aa, Glycine max
  Coding DNA Sequence Number=SeqID_61036
MTTLCNPEERYQRTIMVNFVKLRHFQKDCLKCKFWFEKNGELNAHRFLTIQTISLNEKFIFIGNEVKAPVKIVETYCLKHNTGHRLDLLETPYGKQAKHTKKGATRSTQLLEIVHTDIYGPFDVSSFGKEKYFITIIDNYSHYGYVYLLPEISQEMNALEIY

SEQ ID NO: 177815 - protein, 508 aa, Glycine max
  Coding DNA Sequence Number=SeqID_61037
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q42707; Match level="QueryCoverage=90%, HitCoverage=83%, E-value=1e-119, Identity=47%"; Hit description =Furostanol glycoside 26-O-beta-glucosidase
  Pfam annotation: Domain name=Glyco_hydro_1; Domain location=41-508; Score=546.9; E_value=2.1e-161; Accession=PF00232.9; Description =Glycosyl hydrolase family 1
MEILSSSRICKIILTILSVVLLYNVSTKAQDLQRRSHFPKPGSSFPSDFLFGAGTSALQVEGAASEGGRGPSVWDDRVNRNKGAFIDGDKFPTMIQHYRRYKEDVQHLKNLGINSYRMSISWSRLLPDGTIKGGINQEGVDFYNLLIDELLANGITPFVTILHFDYPLAIHKNTGGFLNSSIVNYYKDYCELLFKTYGDRVKHWTTVNEPQVVGLFTYMHAYDNDDPEPCQTTKLCKQAYIVVHNYILCHAAAVKLYREKFYETQGGEIGLVLGSQSFEPYSSKSEDVAAAKRLMDFFMGWILDPVVYGDYPKIMRDLVGNRLPNFTEEEKNFVAGSTDFIGINYYTSHFAKHETNKTNMILSDNYDALGISVDFNAEGKTLGYLDKYGGNFVYPKGLYDVLQHIKKKYQNPNIYITENGIASFNITNPLKDTHRIKYLATHLNSTKAAIDNGVRVRGYFVWAAFDTFEFRAGFSQNWGLIHVDFKHDLMRQPTTAAKWYKRFLNHVI

SEQ ID NO: 177816 - protein, 552 aa, Glycine max
  Coding DNA Sequence Number=SeqID_61038
  Gene Ontology: Mol. function=nucleic acid binding; Cellular component= intracellular; Biological process=transport
  Homolog annotation: Hit_ID=Q9FME2; Match level="QueryCoverage=66%, HitCoverage=80%, E-value=1e-70, Identity=43%"; Hit description =Similarity to RNA-binding protein
  Pfam annotation: Domain name=GRP; Domain location=350-450; Score= -29.3; E_value=0.076; Accession=PF07172.2; Description=Glycine rich protein family
  Pfam annotation: Domain name=NTF2; Domain location=18-134; Score =149.7; E_value=7.9e-42; Accession=PF02136.11; Description=Nuclear transport factor 2 (NTF2) domain
  Pfam annotation: Domain name=RRM_1; Domain location=294-362; Score =46.7; E_value=7.6e-11; Accession=PF00076.12; Description=RNA recognition motif. (a.k.a. RRM, R
  Pfam module annotation: Pfam domain module=GRP::NTF2::RRM_1; Domain location=350-450::18-134::294-362
MTTSEQQVPPKTPAADIVGNAFVDQYYHMLHESPELVHRFYQDVSKLGRPEQNGIMGITTTMLDINKKILSLGYGELSAEIVSVDAQESYDGGVIVLVTGFMIGKDDIKQKFTQCFFLAPQEKGYFVLNDVFRYVDENGIQGSAHDIGSPAPPDTVSNPSVLETQVSEQISVTAEDGDEEVVYNPENGQAAIEEEEAPVPEVLDEIPDDSQMVAGLASQIEEVPKKSYAYIVMKEGAMPSSTVTPVPVKSAHKSQEQQGIAAPPPSSISETNGSVINTNEVGNIQEAEAEGYSIYVKGLPPTATPAVLENEFKKFGPIKSGGIQVRSQKGFSYGFVEFEVASAAQSALEASPISINGRLVVVEEKRSTNRGNAKIPAREKAYKAPSFRGEGARGRGNYGNGRTYGRGGDFNGRGEYGYRNGNRGGFSSRGGDGYQRNDHMGTGGGRMNRAGGSAVNPAVKTAGNGDEEEEGDEEENEVHPRVTEEVLAILDQAGSFGIVYGDSSDGAVYVYKNDGNDADLASAVHQSAPLTVLRRLTLEKNGNLRLYQWSVL

SEQ ID NO: 177817 - protein, 265 aa, Glycine max
  Coding DNA Sequence Number=SeqID_61039
  Gene Ontology: Mol. function=hydrolase activity; Biological process =guanosine tetraphosphate metabolic process
  Homolog annotation: Hit_ID=Q1SB52; Match level="QueryCoverage=87%, HitCoverage=25%, E-value=2e-76, Identity=64%"; Hit description=ATP -dependent DNA ligase; Metal-dependent phosphohydrolase, HD region; TGS; DNA ...
  Homolog annotation: Hit description=polymerase III clamp loader subunit, C-terminal
  Pfam annotation: Domain name=HD; Domain location=173-258; Score=4.2; E_value=0.015; Accession=PF01966.12; Description=HD domain
  Subcellular localization annotation: CTP_CleavageSite=83; ConfidenceScore=5.55e-01
MRFFSLPTTHFPGKITASSIIAIIHFTMSMSVLSCQRSTMLAAQNNSPFLRRFRSFKPHRSRFRCLLDQISAPTLLTSDNVIAAAAKAASVHSAVSSAITQVAVTAVAIASGACLSTKFDFLWPKLQEQSGTVMQDGVDVTGYPIFNDAKVQKAIAFARKAHRGQMRKTGDPYLTHCIHTGRILAALVPSSGKRAVDTVVAGILHDVVDDTCQSLRDIEAEFGDDVVKLVASVSRLSYINQRARMNESPNDSRRLLRIIFSGFLF

SEQ ID NO: 177818 - protein, 331 aa, Glycine max
  Coding DNA Sequence Number=SeqID_61040
  Gene Ontology: Cellular component=nucleus; Biological process =regulation of progression through cell cycle
  Homolog annotation: Hit_ID=Q1S7L6; Match level="QueryCoverage=98%, HitCoverage=98%, E-value=1e-103, Identity=59%"; Hit description =Cyclin, N-terminal
  Pfam annotation: Domain name=Cyclin_N; Domain location=49-183; Score =98.7; E_value=1.7e-26; Accession=PF00134.13; Description=Cyclin, N -terminal domain
MESSGTFFSLSSLLCDEVGEAGFFEDPDENPGIFYSLDNPCFVLEDEELYIEYLFKQETGFGSQNHHLFASDDHSNSRHWLRSARVDAIDWIFDTQAKFGFKVETAYLSVTYFDRFLSERSIDESKPWAIRLLSVACLSLAAKMEEQNVPPLSEYPIEDYRFENKVIKNMELMILSTLDWKMGSATPFAYLHYFVGKFCPGSRPQSIITKAIEHIVAMIKDVNLMDQRPSIIASAAILAALDATLTRKAMDLRINVISSWGNLESGHVFFCYNLIQEKRKSKVKTPCSNLMSTKSSSTCVLENQSDTFSGAKRKLSFEDSENCAGQKLHRP

SEQ ID NO: 177819 - protein, 510 aa, Glycine max
  Coding DNA Sequence Number=SeqID_61041
  Homolog annotation: Hit_ID=Q9LSG4; Match level="QueryCoverage=99%, HitCoverage=97%, E-value=7e-34, Identity=32%"; Hit description =Arabidopsis thaliana genomic DNA, chromosome 3, P1 clone: MJL12
  Subcellular localization annotation: CTP_CleavageSite=5; ConfidenceScore=5.16e-01
MTELSFSNKKNELSSNLFSIFFHFCFSIFSHPLYFSYFIFFSPYLLRILSFLSPLFITTTLLLVALLTFTPNNLDQEKGGSELSESKWGILLSVLQSFLAWLHSKADEIDEEMGLLGEVEAYLVMFQASIFEVVDPKSLQDCSEGFEAVDVECSVEGREDSRPMEEPKPSVNLDENLSSQQRGEPMLEYSSEVSAFSVGQYLEQDCLEKRIVVDEILHSQPKFESPSEEVPIFSARQSFEKDCPHRKILVENQINWDENPVEKVDKVEAPISIVEVKSLESLFQENQELEDLSCQKEHKEVKPLIAEFNKVEESKEKWPLRSGSKVVMGNRDNKVSTNSDGEFAFAASGRVKSLSQRLEANIGSPESNWVYSGKGMGNNNQALGSFGSMRVEKEWRRTLACKLFEERHNADGSEGMDMLWETYETESNKILKKSNTKRGKKKGEVENSEDDEEEEEEDMEGKLCCLQALKFSTGKMNLGMGRPNLLKFSKALKGIGWLHNVGKNGRKSNH

SEQ ID NO: 177820 - protein, 83 aa, Glycine max
  Coding DNA Sequence Number=SeqID_61042
  Subcellular localization annotation: CTP_CleavageSite=30; ConfidenceScore=5.18e-01
MTAIIDCSSSPFRHFQLNTNPKSRLSQFVNKQSVAHVTIFYQDKSYGHILGVPKLRATRTVFVKIKDISGKRERNQNSFHLHG

SEQ ID NO: 177821 - protein, 86 aa, Glycine max
  Coding DNA Sequence Number=SeqID_61043
MDDARRSRIEAHVMHGRGLVECVFAFACERRFCDEATVIVFGEEIVVKGYVICQSVVLCRDHENHHDLWDNFNGECFRGVIPQSNK

SEQ ID NO: 177822 - protein, 89 aa, Glycine max
  Coding DNA Sequence Number=SeqID_61044
MACCSSFYAFFFCLFLPMSFWRVLQFFLFVDWSRGQRLGLYLLLAFLGVLNFLVYVCGQMGLSSLSPPPSKKGGTLPAKLMEKVGIIGS

SEQ ID NO: 177823 - protein, 893 aa, Glycine max
  Coding DNA Sequence Number=SeqID_61045
  Gene Ontology: Mol. function=ATP-dependent helicase activity; Cellular component=nucleus; Biological process=mRNA processing
  Homolog annotation: Hit_ID=Q8H0U8; Match level="QueryCoverage=77%, HitCoverage=60%, E-value=0.0, Identity=76%"; Hit description=DEAD -box ATP-dependent RNA helicase 42
  Pfam annotation: Domain name=DEAD; Domain location=93-267; Score =244.1; E_value=3e-70; Accession=PF00270.19; Description=DEADDEAH box helicase
  Pfam annotation: Domain name=Helicase_C; Domain location=335-411; Score=115.8; E_value=1.3e-31; Accession=PF00271.21; Description =Helicase conserved C-terminal domain
  Pfam annotation: Domain name=ResIII; Domain location=89-262; Score= -27.2; E_value=0.0088; Accession=PF04851.6; Description=Type III restriction enzyme, res subunit
  Pfam module annotation: Pfam domain module=DEAD::Helicase_C::ResIII; Domain location=93-267::335-411::89-262
DDEFMKRVKKTKAEKLSLVDHSKIDYEPFKINFYSEVKEISKMTPEEAAVYRKQLELKIHGKDVPKPIKSWHQTGLPSKILETIKKMNFEMPMPIQAQALPVIMSGRDCIGIAKTGSGKTLAFVLPMLRHIKDQPPVVAGDGPIGLIMAPTRELVQQIHSDIKKFAKVLGLRCVPVYGGSGVAQQISELKRGAEIVVCTPGRMIDILCTSSGKITNLRRVTYLVMDEADRMFDMGFEPQITRIVQNIRPDRQTVLFSATFPRQVEILARKVLNKPVEIQVGGRSVVNKDITQLVEVRPDNERFLRLLEILGEWYEKGKILIFVHSQEKCDSLFKDLLRHGYPCLSLHGAKDQTDRESTISDFKSNVCNLLVATSIAARGLDVKELELVINFDVPNHYEDYVHRVGRTGRAGRKGCAITFISEEEARYAPDLLKALELSEQIVPNDLKALAGSFMAKVNQGLEQAHGTGYGGSGFKFNEEEDEVRKAAKKAQAKEYGFEEEKSDSEDEDEGIRKAGGDISQHSAFAQIIAATKGNAPALPTPILLPSLQVLPGTGLPLPANDGAARAAAIAALNLQDKLDKIRSEALPEHYEAELEINDFPQNARWKVTHKETLGPISEWSGAAITTRGQFFPPGKIPGPGERKLYLFIEGPTEHSVKSAKADLKRVLEDITNQALQLPGGTQPGKYSVVHNGTLLNTLVSRPNLGQVAHIVCLSLLPYRKGTLEALERRIAFAKVEVLQKEKKNKKAVNEDGKPPIPADSTSNDRSPHLLHSSSITPKKDIEDGPAYAQFSVTVNENLLTTNEKFSAERGRSIDGILHELLQKGDAAQKYMQGSRNMKIDNWILLDNYVHGRVLSSGSQTRALQLHSKRSKKHMSMKRHKKYGSLELPQEFQK

SEQ ID NO: 177824 - protein, 495 aa, Glycine max
  Coding DNA Sequence Number=SeqID_61046
  Gene Ontology: Mol. function=hydrolase activity; Biological process =guanosine tetraphosphate metabolic process
  Homolog annotation: Hit_ID=Q1SB52; Match level="QueryCoverage=79%, HitCoverage=47%, E-value=0.0, Identity=80%"; Hit description=ATP -dependent DNA ligase; Metal-dependent phosphohydrolase, HD region; TGS; DNA polymerase ...
  Homolog annotation: Hit description=III clamp loader subunit, C -terminal
  Pfam annotation: Domain name=RelA_SpoT; Domain location=26-143; Score= 90.6; E_value=4.8e-24; Accession=PF04607.7; Description=Region found in RelA  SpoT proteins
  Pfam annotation: Domain name=TGS; Domain location=379-434; Score =36.0; E_value=1.3e-07; Accession=PF02824.11; Description=TGS domain
  Pfam module annotation: Pfam domain module=RelA_SpoT::TGS; Domain location=26-143::379-434
MVLGDAGCTNKDTPMLKKIYFQNILSQVSTENEINMKRKDISIDKVYDARALRVVVGDKNGTLHGPAVQCCYSLLDIVHRLWTPIDGEFDDYIINPKPSGYQSLHTAVQGPDNSPLEVQIRTQRMHECAEQGLAAHWLYKETGNPFLSIDSMDEPETEASSYFSKDLEEGNSSDILLSKYKSLKAGHPVLRVEGSHLLAAIIISVENDERELLVAVSFGLAASEAVADRRSFQIKRWEAYARLYKKVSDEWWFEPGHGDWFTCLEKYTLCRDGMYHKQDQFGRLLPTFIQVINFTEQEESEYWAVVSAVFEGRQVDWITSRSKFDLVASTSVEAGINNKVNLLRTMLSWEEQLRSEVSFMQAKHDAKLYDLHGSLGEVVIICWPHGEILRLKAGSTATDAAQRVGLEGKLVLINGQLVLPNTKLRDGDVVEIKFIAKHRLRIHFHCTTLEAWFTIKKTVPTLNFACRQVLSVLYFKRSCYGKVSCTSIHCPKSFQ

SEQ ID NO: 177825 - protein, 54 aa, Glycine max
  Coding DNA Sequence Number=SeqID_61047
MKIPATLDETKNVFPGIFSSSCLAEKNYQMGKLFNLECGLIKESPPLLQSPCEP

SEQ ID NO: 177826 - protein, 647 aa, Glycine max
  Coding DNA Sequence Number=SeqID_61048
  Homolog annotation: Hit_ID=P59278; Match level="QueryCoverage=28%, HitCoverage=30%, E-value=5e-29, Identity=40%"; Hit description =Uncharacterized protein At1g51745
MESSGLGPVDCDVGSIVWVRRRNGSWWPGQILGPDHLSASHLTSPRSGTPVKLLGREDASVDWYNLEKSKRVKAFRCGEFDGCIERAESAQGMPLKKREKYARREDAILHALDLERQMLKTQEKIVDGSALTLTSDGSLHRKYNSGLGQVGVAHQVKRRKFVYLPEESSDSMDYKEIPVNVAMSASQFGGEYAYCSSLAEESESAFMDVVESDSLETGSANADSDSSEMELDKDDEMTTLSETGCDTEEQESTSSEELDELAISRDMPHLYPRPHISCNEAVSKWKLKGKRNNRNLVKRSVGAADGKGVVLYETDVEGLRSRLNHKRLVPSMHYYGNGISDVFADTDQMFGFEDEYSPTSKALAKGQNKIGHGVDCDEWAWEDQTAFKGYWENKGFARLYSDSYHFDGRMRSMLVDVDLKVQASYRKAPVPIVSITSKLDGKSIIGHPIQIESLKDGSSDKLFSAIDDFSNDGNGFEGSSVLPPAWRTARRTANFRVPRPRVLSSNGADSDADFCIGQERNIEYKKLNGGSSSHKASLSRKSGLNSPVHSVDKKSSKKMPKKVSLSSSQKTRTLSSLSIENNHGKKQLHDISFYQTNRLTKPEVSGLTTVACIPVKLVFSRLLEKINRPPLKAASNAALSNTGVERK

SEQ ID NO: 177827 - protein, 377 aa, Glycine max
  Coding DNA Sequence Number=SeqID_61049
  Gene Ontology: Mol. function=ATP-dependent helicase activity
  Homolog annotation: Hit_ID=Q8H0U8; Match level="QueryCoverage=58%, HitCoverage=18%, E-value=2e-24, Identity=37%"; Hit description=DEAD -box ATP-dependent RNA helicase 42
MDEGKHKSRKENHEVKDGDSKRSHRDRDRTGERGKDKNDGRHRDREKRDRESRRPERERSTDSEDRYDRDREKRKDKDKDVDRERSRDKKRERDRTDRVREKERERERKEDKERIRERERERERRDHEREKEKERERGRRVRGREKRREVDSDCSDGESKEQDRKRHRKEDGDYKRERERSVSKPSRKSEEHEGSPRKKSGEDDSDTKDEEKKPTREEEMEDEQKRLDEEMEKRRRRVQEWQELRRKKEEAEREKQGEASANEPESGKTWTLEGESDDEEGLGTGKQTGMDVDEDDKPADEEPKDVMVVDTDNGTIASDLQDGTAGAPEDEEIDPLDAFMNSMVLPEVEKLNNAVTSSLSDKAIDVKPKDKGNGQNR

SEQ ID NO: 177828 - protein, 832 aa, Glycine max
  Coding DNA Sequence Number=SeqID_61050
  Gene Ontology: Mol. function=RNA splicing factor activity, transesterification mechanism; Cellular component=spliceosome; Biological process=nuclear mRNA splicing, via spliceosome
  Homolog annotation: Hit_ID=Q6K476; Match level="QueryCoverage=57%, HitCoverage=100%, E-value=1e-154, Identity=60%"; Hit description =Putative U4/U6-associated RNA splicing factor
  Pfam annotation: Domain name=PRP3; Domain location=444-825; Score =584.8; E_value=8.2e-173; Accession=PF08572.1; Description=pre-mRNA processing factor 3 (PRP3)
MDDRVKSEKRSRDRHLERDDKYHRDSDDHRRHRSDRNHKRDHKSRDRDRTYDREGSRDRDYEREGSKDRLKVNRDEGREDLVEPRLSSHSHKRKEREHSEDRDYEDKKIRVSEERKEGRRERRKFGDKVKKEEEEEDGNDNIRGIHEAKVKEEVADGAHGSASSNDTAFIQNGALGSPAVAPMSVPETSLAPPSCFPIKVSSNSTTNENKGVSIIRSHEVTGKSSTDGSSSAAGKTGSLSIDALAKAKKALQMQKELSEKLKKIPQLNKSSSQNSQGSSNLGSMNESAVPSSAAGVALKSSTSASLGHVANMSMFPSTAFAASANTPVIGTSAVGIPNATLPNLEAVRRAQELAARMGFRQDPQFAPLINMFPGQMVTDVALLQKPTKAPVLRLDAQGREIDEQGNVINVTKPINLSTLKVNINKQKKEAFEILQPVLDVDPESNPHFDASMGINKTKLLRPKRMNFQFVEEGKWSKDAETIKLKSKFGEAQAKEHKAKQAQLAKAKAAPDINPNLIEITERVVIKEKPKDQIPEIEWWDVPLLHSGNYGDVDNGIIGEDKLKIEKINFYVEHPRPIEPPAEPAPPPPQPLKLTKQEQKKLRTQRRIAKEKERQEMIRQGVIEPPKPKVKISNLMKVLGSEATQDPTRLEKEIRTAAAEREQAHIDRNIARKLTPAELREKKERKLFDDPNTLETLVSLYRINDLSHPKARFRVDVNAQENRLTGCAVICDGISVVVVEGGSKSIKRYGKLMLRRINWSEVSKEKEENEDSDDDKPANKCVLVWQGSVAKPSFYRFSVHDCITEAAARKVFVDAGVPHYWDQAVNYKEDEAV

SEQ ID NO: 177829 - protein, 461 aa, Glycine max
  Coding DNA Sequence Number=SeqID_61051
  Gene Ontology: Mol. function=signal transducer activity; Cellular component=spindle; Biological process=cell division
  Homolog annotation: Hit_ID=Q9SZA4; Match level="QueryCoverage=83%, HitCoverage=85%, E-value=0.0, Identity=78%"; Hit description=WD -repeat protein-like protein
  Pfam annotation: Domain name=WD40; Domain location=127-165; Score =26.7; E_value=8.1e-05; Accession=PF00400.22; Description=WD domain, G-beta repeat
  Pfam annotation: Domain name=WD40; Domain location=169-206; Score =11.3; E_value=1.8; Accession=PF00400.22; Description=WD domain, G -beta repeat
  Pfam annotation: Domain name=WD40; Domain location=211-249; Score =42.3; E_value=1.6e-09; Accession=PF00400.22; Description=WD domain, G-beta repeat
  Pfam annotation: Domain name=WD40; Domain location=259-300; Score =20.9; E_value=0.0045; Accession=PF00400.22; Description=WD domain, G- beta repeat
  Pfam annotation: Domain name=WD40; Domain location=347-385; Score =33.4; E_value=7.9e-07; Accession=PF00400.22; Description=WD domain, G-beta repeat
  Pfam module annotation: Pfam domain module=WD40::WD40::WD40::WD40::WD4 0; Domain location=127-165::169-206::211-249::259-300::347-385
MDFDYAHYMLTEGNKGKENPDVCSPSREAYRKQLAESLNMNRTRILAFKNKPPAPVDLIPHEMSTHTHDNKPAKPKRFIPQTSEKTLDAPDLVDDYYLNLLDWGSANVLAIALGSTVYLWDATNGSTSELVTVDDEDGPVTSLSWAPDGRHIAVGLNNSEVQLWDTTSNRQLRTLRGGHRQRVGSLAWNNHILTTGGMDGRIVNNDVRIRSHVVETYSGHEQEVCGLKWSASGSQLASGGNDNLLYIWDRATASSNSATQWLHRLEDHTSAVKALAWCPFQGNLLASGGGSGDRCIKFWNTHTGACLNSIDTGSQVCSLLWNKNERELLSSHGFTQNQLTLWKYPSMVKMAELTGHTSRVLFMAQSPDGCTVASAAADETLRFWNVFGAPEAASKAAPKARAEPFSNVVELVLEARLQWRFSTTTGVDPASPGCHNLCRRESTNLAVCVETAVGGAAENRR

SEQ ID NO: 177830 - protein, 310 aa, Glycine max
  Coding DNA Sequence Number=SeqID_61052
  Gene Ontology: Mol. function=voltage-gated ion-selective channel activity; Cellular component=mitochondrial outer membrane; Biological process=anion transport
  Homolog annotation: Hit_ID=Q1S7K4; Match level="QueryCoverage=99%, HitCoverage=100%, E-value=1e-119, Identity=70%"; Hit description =Porin, eukaryotic type
  Pfam annotation: Domain name=Porin_3; Domain location=4-303; Score =143.5; E_value=5.8e-40; Accession=PF01459.12; Description=Eukaryotic porin
MSKGPGLFTDIGKKSKDLLTKDYNSDQKLTISSYSISGVALTSTSVKKGGLSTGDVAALYKYKNTIIDVKLDTASTISTTLTFNDVLPSTKTIASFKLPDYNSGKLEVQYFHDHATLTTAVALKQSPVIDVSATVGTPTIALGAEAGYDTSSGGFTKYTAGISVTRPDSSASVILLVSFTHKICVPNYLVISIILKANKLILNMYFPISGDKGDSIKASYLHHLDLLKKSAAVAEITRKFSTNENIFTVGGSFAVDPLTQVKARLNNHGKLGALLQHEIIPKSVFTVSGEIDTKALDKKPRFGLAIALKP

SEQ ID NO: 177831 - protein, 261 aa, Glycine max
  Coding DNA Sequence Number=SeqID_61053
  Gene Ontology: Mol. function=transferase activity, transferring glycosyl groups; Cellular component=integral to membrane; Biological process=metabolic process
  Homolog annotation: Hit_ID=Q5IFH8; Match level="QueryCoverage=80%, HitCoverage=45%, E-value=2e-48, Identity=46%"; Hit description =Triterpene UDP-glucosyl transferase UGT73K1
MYFSQTPSELLDDGLKKQFRKRNPKMEDLEAKISDSKPDDSIFAFRGHHVTILTTPSNAKLIPKHLNVHILNFPSEEVGLPSGLENISLAKDNNTAYKIWKASKLLKPEIENFLNHNPPHALIIDIMYTWRSTLNNSIPTFVYSPMPVFALCVVEAINRHPQTLASDSSLPYVVPGGLPHNVTLNFNPSSTSFDNMARTLLHAKENNKHGVIVNTFPELEDGYTQYYEKLTRVKVWHLGMLSLMVDYFDKRGKPQEDQVSE

SEQ ID NO: 177832 - protein, 100 aa, Glycine max
  Coding DNA Sequence Number=SeqID_61054
MAALFLDFVVVEAVPALVTVSALRRSRHGGIEALDDFNDTIDLEEFNNETNQMMLAMAKGLGFYTCLKLTTTLTNQSSAKVFESPTSTRERSRKQVGREL

SEQ ID NO: 177833 - protein, 143 aa, Glycine max
  Coding DNA Sequence Number=SeqID_61055
MKTSIGEELETLESRETHNLKPDFSIIVNTIKTILLLLRNIPVKKLVELKVLRTNGPVLNPESEPTPKPRNHTPLESKSPIDLSLKLAPSTLCEETHPSYQTLARIQSTIQSLSSVAVAALSVSVMREEDALGPSASRRLWKQ

SEQ ID NO: 177834 - protein, 115 aa, Glycine max
  Coding DNA Sequence Number=SeqID_61056
  Subcellular localization annotation: CTP_CleavageSite=44; ConfidenceScore=5.14e-01
MKTPNNPHCMASSHSTSRTVNKQLMQCNSTIKHQNKTLDLLVVPCVVPTEVIIVEGRKKRKEAGKSVAHQIDALRFGTEAVKSDFVALLASHTLQSARESVFTFSQLPALGKQEK

SEQ ID NO: 177835 - protein, 398 aa, Glycine max
  Coding DNA Sequence Number=SeqID_61057
  Gene Ontology: Mol. function=transferase activity, transferring glycosyl groups; Cellular component=integral to membrane; Biological process=metabolic process
  Homolog annotation: Hit_ID=Q5IFH8; Match level="QueryCoverage=97%, HitCoverage=96%, E-value=2e-96, Identity=43%"; Hit description =Triterpene UDP-glucosyl transferase UGT73K1
  Pfam annotation: Domain name=UDPGT; Domain location=9-395; Score= -130.6; E_value=0.00048; Accession=PF00201.9; Description=UDP -glucoronosyl and UDP-glucosyl transferase
MEGSEALKMYVLPFPSPGHTIPLINLAQILALKGHHITILTTPSNAQVLPNNLNVHTFDFPSDQVGLPSGLENAASAGDSVTAHKILKAALLLKPQIETLVQQNPPHAIYSHPQVLPSVVPFVVPAVLPHTITFDFNPSSAPGFDALAQLFLHTKHNNTHGIIVNSFEELEDGYTQCYQKLTGVKVWHVGMTSLMLNFTKKRACTSQKDQQQLEIAHGVEASGHEFLWVFPKNMHVEVEEWLPHGFEERTKENNRGMVVRGWVHQELILKHVAIGGFLTQCGWNSVTEGISAGVPLITMPRFAEQFLNEKLVTEVHKIGVEVGECEWSISSYDAGSKVVGWELIKNAVERVMKDEGGSLRKRAKDMQEKAHKAIQKGGSSYNNLTALVQSLKQKNIHG

SEQ ID NO: 177836 - protein, 257 aa, Glycine max
  Coding DNA Sequence Number=SeqID_61058
  Gene Ontology: Mol. function=transferase activity, transferring glycosyl groups; Cellular component=integral to membrane; Biological process=metabolic process
  Homolog annotation: Hit_ID=Q9M3H8; Match level="QueryCoverage=84%, HitCoverage=49%, E-value=1e-66, Identity=57%"; Hit description =Putative UDP-glycose
MWDKGAKTTNSSILFRARLANMLRVSRAWIFFMVDDECLKWLNTKESNSVVYICFGSLARLNKEQNFEIARGIEASGHKFLWVLPKNTKDDDVKEEELLLPHGFEERMREKKRGMVVRGWVPQGLILKHDAIGGFLTHCGANSVVEAICEGVPLITMPRFGDHFLCEKQATEVLGLGVELGVSEWSMSPYDARKEVVGWERIENAVRKVMKDEGGLLNKRVKEMKEKAHEVVQEGGNSYDNVTTLVQSLRRMMNVHG

SEQ ID NO: 177837 - protein, 396 aa, Glycine max
  Coding DNA Sequence Number=SeqID_61059
  Gene Ontology: Mol. function=pepsin A activity; Cellular component =endoplasmic reticulum; Biological process=proteolysis
  Homolog annotation: Hit_ID=Q1STA9; Match level="QueryCoverage=98%, HitCoverage=87%, E-value=1e-110, Identity=51%"; Hit description =Peptidase aspartic, active site
  Pfam annotation: Domain name=Asp; Domain location=49-391; Score= -101.9; E_value=1.4e-07; Accession=PF00026.14; Description=Eukaryotic aspartyl protease
MGADNSGFTIQLIRHNSPNYSPFYKSDELHMHRLGSNGVFTRVTSNNGDYLMKLTLGTPPVDVYGLVDTGSDLVWAQCTPCQGCYRQKSPMFEPLRSNTYTPIPCDSEECNSLFGHSCSPQKLCAYSYAYADSSVTKGVLARETVTFSSTDGEPVVVGDIVFGCGHSNSGTFNENDMGIIGLGGGPLSLVSQFGNLYGSKRFSQCLVPFHADPHTLGTISFGDASDVSGEGVAATPLVSEEGQTPYLVTLEGISVGDTFVSFNSSEMLSKGNIMIDSGTPATYLPQEFYDRLVKELKVQSNMLPIDDDPDLGTQLCYRSETNLEGPILIAHFEGADVQLMPIQTFIPPKDGVFCFAMAGTTDGEYIFGNFAQSNVLIGFDLDRKTVSFKATDCSNQ

SEQ ID NO: 177838 - protein, 540 aa, Glycine max
  Coding DNA Sequence Number=SeqID_61060
  Gene Ontology: Mol. function=transferase activity, transferring glycosyl groups; Cellular component=membrane
  Homolog annotation: Hit_ID=Q337B5; Match level="QueryCoverage=94%, HitCoverage=96%, E-value=1e-152, Identity=53%"; Hit description =Fringe protein, putative, expressed
  Pfam annotation: Domain name=DUF604; Domain location=258-515; Score =439.3; E_value=5.3e-129; Accession=PF04646.3; Description=Protein of unknown function, DUF604
  Pfam annotation: Domain name=Fringe; Domain location=123-377; Score= -89.1; E_value=0.014; Accession=PF02434.7; Description=Fringe-like
  Pfam module annotation: Pfam domain module=DUF604::Fringe; Domain location=258-515::123-377
  Subcellular localization annotation: CTP_CleavageSite=30; ConfidenceScore=5.09e-01
MVMMTRALKTIMSSYHDYGKNSRLCPLPISQSRSRQWRQCRIGTFAVAIAALLISTTAWLSLVFSDATTCCFHHLKDWESSPHFFNWKKCISHRLAKVTPPPALQYETVNAHLHNGSRTVEQEGLSLKHIVFGIAGSSQLWKRRKEYVKLWWRPNDMRGHVWLEEQVLEEPGDDLLPPIMISEDISYFRYTNPIGHPSGLRISRIVRESFCLGLSDVRWFVLCDDDTIFNVNNLVDVLSKYNSSEMIYIGSPSESHSANTYFSHSMAFGGGGIAISHSLAKALSEILDECIERYPKLYGSDDRLHACITELGIPLTWEHGFHQWDIRGDAHGLLSSHPIAPFVSIHHVEAVNPFYPGLSSLDSLKLFTNAMKADPKSFLQRSICYDHARHLTFSVSLGYVVQVLPNIVFPQELERSERTYSAWNGISQTNEFDFDAREPYKSVCKGPTRFFLKDTRREGNASWGSYVRGRDKDDFKKRILCFPHFPPLHNVGEIQVAVQHLSKNWHLVPRRLCCRQSQAGKEILQISVGECGKGTFSSVY

SEQ ID NO: 177839 - protein, 112 aa, Glycine max
  Coding DNA Sequence Number=SeqID_61061
  Gene Ontology: Mol. function=ubiquitin-protein ligase activity; Cellular component=ubiquitin ligase complex; Biological process =protein ubiquitination
  Homolog annotation: Hit_ID=Q10QD1; Match level="QueryCoverage=87%, HitCoverage=16%, E-value=2e-44, Identity=80%"; Hit description =Peptidylprolyl isomerase, putative, expressed
  Pfam annotation: Domain name=U-box; Domain location=38-97; Score= -1.2; E_value=0.00067; Accession=PF04564.6; Description=U-box domain
MGKKQHSKDRMFITKTEWATEWGGAKSKENRTPFKRLPFYCCSLTFTPFEEPVCTPDGSVFDNMNITPYIVKYGKHPVTGAPLKHQDLISLTFHKNSEGSSNLNPCMPANYC

SEQ ID NO: 177840 - protein, 394 aa, Glycine max
  Coding DNA Sequence Number=SeqID_61062
  Gene Ontology: Mol. function=protein binding; Biological process =response to light stimulus
  Homolog annotation: Hit_ID=Q1EPH5; Match level="QueryCoverage=38%, HitCoverage=22%, E-value=5e-10, Identity=29%"; Hit description =Nonphototropic hypocotyl 3 (NPH3) family protein
  Subcellular localization annotation: CTP_CleavageSite=62; ConfidenceScore=5.03e-01
ARLISRSSYLKRYLTGVSNLTLSPPLNITAETFAAVAEFCYSRRVHLTPSNVATVRVAAELLGMTGEENLREVTESYFERVVGIDASMVLRSCVALLPESETTASLASRCIEALVWEDDVSCLNDVVGMHPQDFQTVSYSLNRRLHNHDVLYKMVDLYLKENKYGKLTEEQKSEICNSIDCSRLSSHTLVDCVQNPRMPLRFIVRAILMEHLNTRRSVTAAARAPATTGAQQQPERTSLREILQRDTADRETTQIKETMDSTYSRIQSLERELRGMKKILHEHHQAEDDTRNNNNVLNSERFASFHFVPADAESSKIQRGGRGSVSSSGFVLDNVRRKNKEVAGGMCNLSVGSSCHDDSKTPKMTKFLRHSKLITGLKHAFRISKSTSNTTEET

SEQ ID NO: 177841 - protein, 588 aa, Glycine max
  Coding DNA Sequence Number=SeqID_61063
  Gene Ontology: Mol. function=ubiquitin-protein ligase activity; Cellular component=ubiquitin ligase complex; Biological process =protein ubiquitination
  Homolog annotation: Hit_ID=Q10QD1; Match level="QueryCoverage=81%, HitCoverage=79%, E-value=1e-174, Identity=65%"; Hit description =Peptidylprolyl isomerase, putative, expressed
  Pfam annotation: Domain name=Pro_isomerase; Domain location=247-399; Score=191.2; E_value=2.4e-54; Accession=PF00160.11; Description =Cyclophilin type peptidyl-prolyl cis-
MDELCRQSWLENQSDLKTTGNVFCYEAVKELNIKTKNWKELLTDEPFTKDDLITIQNPNALDSKVLLDFDHVKNSLKVDDEELQKMSSDPTYNINMSGDIKQMLKELGTEKGKETALHGGGGGKAQKERAAALAAILAARSRVEEDSKSNPNKEVKVSQAFSIVDAASASVHGRSAAAAKASADDKTAARIAMHMAGDRAPVNAKMVKSRFTTGAASRSFTSTSFDPVTKNEFEYVKVEKNPKKKGYVQLHTTHGDLNIELHCDIAPRACENFITLCERGYYNGVAFHRNIRNFMIQGGDPTGTGRGGESIWGKPFKDELNSKLVHSGRGVVSMANSGPHTNGSQFFILYKSANHLNFKHTVFGGVVGGLTTLSVMEKVPVDDDDRPLEEIKILSVTIFVNPYTEPDEGEEQDNAKEKNAEDEDNGKVGSWYSNPGAATSESGGTGVGGGVGKYLKARNAQAKSATVDNTGTDVVVKKRKVGVASSEFKDFSAWEFLLFLFSNQLSGVNANFSLGCHSQGHFKSVSLASFFIDFSGHNLASYTGDVQFRVQNMTLHLKWKMRNLCIMHITENKCKVEKWKEKPDYKIA

SEQ ID NO: 177842 - protein, 161 aa, Glycine max
  Coding DNA Sequence Number=SeqID_61064
MGEMNLTTRKKEGGYDELGALSREIQRRAIKREHNFQFLFSSETPSILVAFQACPAVPKIQGISNADAQYISQIAACRPCLYNSEQCTFLAMKKCIQDHTLYNTKPRENTFQQEKIRHKSLKRGAMLEHFQHQMPVHKSPKDELQMNKIVKPRKAYLVVDQ

SEQ ID NO: 177843 - protein, 282 aa, Glycine max
  Coding DNA Sequence Number=SeqID_61065
  Homolog annotation: Hit_ID=Q1S137; Match level="QueryCoverage=51%, HitCoverage=27%, E-value=1e-11, Identity=37%"; Hit description=FBD
MGKIPGLQHPSIIQRRSFELWQVYGLNTVTVHKQPTQLENDERFVVEDAAQNLEQRQTVISRCLDLEVVLVSAHAGVEVEVRDGVGGVARENGDVGERQEGGVGFVVLEKRFIVEVEGGDGMPQRLPALGEKARGNGFVSWEKEGNARNTFFEQLLLLFREPASSSLLREPASSLRGAPRLSSSSPRTVEDAGKNGKKGSRQRLPEEPVPETFRKKCSSGSYCREPFFPFFPASSTLVFYPKGRETNLFAEKKKTTLARLAEKKQVHGEEKKKQVHGREEEA

SEQ ID NO: 177844 - protein, 99 aa, Glycine max
  Coding DNA Sequence Number=SeqID_61066
MPKLLRANIYENYGFEIPLEALCNVEYLRFCLVAKGFKKRSGTVIGTASTLIVPDIKKRDEIATLPIFNPTNLQVTEFLNKKKLINLGTMISSLLDSLS

SEQ ID NO: 177845 - protein, 66 aa, Glycine max
  Coding DNA Sequence Number=SeqID_61067
MDKCWIHDVAKLKRLFLDIIQIWFADCGMSPKKVAYFASFQDIVEAKEYLKQKGVDCLCITGKGSG

SEQ ID NO: 177846 - protein, 126 aa, Glycine max
  Coding DNA Sequence Number=SeqID_61068
METTDLTIEVVHLAIEIANLEILLFGQELYQTTFCVAFSSFSGSCYVHPANSEWMKMPFCKYHFRMNILPESFRKTLFPGNFRKTLLPEERDSGRTKEHFPEERHPECFRKKVLPEDNLLLPEIFF

SEQ ID NO: 177847 - protein, 298 aa, Glycine max
  Coding DNA Sequence Number=SeqID_61069
  Gene Ontology: Mol. function=transcription factor activity; Cellular component=nucleus; Biological process=regulation of transcription, DNA-dependent
  Homolog annotation: Hit_ID=Q1S6U1; Match level="QueryCoverage=98%, HitCoverage=58%, E-value=1e-119, Identity=71%"; Hit description=GRAS transcription factor
  Pfam annotation: Domain name=GRAS; Domain location=1-204; Score=95.6; E_value=1.5e-25; Accession=PF03514.5; Description=GRAS family transcription factor
MLKFQELSPWTTFGHVASNGAILEALEGEPKLHIVDISNTYCTQWPTLFEALATRNDDTPHLRLTSVVTAGATAQKVMKEIGARMEKFARLMGVPFKFNVVHHVGQLSDLDFSVLDIKEDEALAINCVNTLHSIAAVGNHRDAVISSLRRLKPRIVTVVEEEADLDIGLEGFEFVKGFEECLRWFRVYFEALDESFPRTSNERLMLERAAGRAVVDLVACSPADSVERREKAARWARRMHGGGGFNTVAFSEEVCDDVRALLRRYREGWAMTQCSDAGIFLTWKEQPVVWASAWRALT

SEQ ID NO: 177848 - protein, 473 aa, Glycine max
  Coding DNA Sequence Number=SeqID_61070
MKSRMCHYVEFSWFFISSSVLDLTIVGLDDADGDSNAQGQCPHYLKTSCKANLDLGSAVYLLGYTEKQELTVGEGKVVIATDNLIKLSTDGIQWGPGSAGFDVHGNLAFMICDPMKLATSPNTKSPSTSTSSSSSSWKKDHPMQFGIPIPVICDWLNQHWEGNLDELNKPKLPIMRLMSTGPKSEHSCASFTLRQVFKSTEGDDDDTPSSSNNASKARDQGPSSSAATNAVEEESLITNPNVAHVQGIPTPEIYESPRVTAVPLRRKENIPLQLLDINFPPRTSKPAVFPQSSKPKTAENLAKEPLPENQVEGEQNKHTRPTTPIPDVSSTGSVNGAAQSEVQSSSSPVEVYEMQNGYSSEGETMYSAETAESRNYTSPREFNFQQVGRSQSCVSYNRWGAAPRSQVARGMMVENQRSFMHVKRMYSQGATTSQRSNDYFSPTVSSIMKRNSGSSKPPPRQSAVHSPSPRWMF

SEQ ID NO: 177849 - protein, 178 aa, Glycine max
  Coding DNA Sequence Number=SeqID_61071
  Gene Ontology: Mol. function=electron carrier activity; Cellular component=membrane; Biological process=electron transport
  Homolog annotation: Hit_ID=Q682V1; Match level="QueryCoverage=70%, HitCoverage=34%, E-value=1e-32, Identity=55%"; Hit description =Predicted GPI-anchored protein
  Pfam annotation: Domain name=Cu_bind_like; Domain location=34-117; Score=111.7; E_value=2.1e-30; Accession=PF02298.8; Description =Plastocyanin-like domain
MAFHRFLGLLILMTPIMFVQVVARQFDVGGKDGWVLKPTEDYDHWAQRNRFQVNDTLHFKYNKGSDSVVVVKKEDFDSCNINNPIQKMDGGDSTFQLSNSGLFYFISGNLDNCKNGQKLIVLVMAARQPIPRAALPPQKIPATSLTSPAPTPTDNSGSGRVGVSVGIVLMFTGFVGLV

SEQ ID NO: 177850 - protein, 131 aa, Glycine max
  Coding DNA Sequence Number=SeqID_61072
  Gene Ontology: Mol. function=nucleic acid binding; Biological process= DNA integration
  Homolog annotation: Hit_ID=Q0KIN0; Match level="QueryCoverage=98%, HitCoverage=7%, E-value=6e-17, Identity=43%"; Hit description =Integrase core domain containing protein
MKADIASQVGPLPQLMVEPTSARSNYFIGTYEYLAPEIINTKIISYAKADWAGSPLDRRITFGYCVLIGENMISRRSKKQGIVVRSGIEVEYNAMAIASCENTCIDNFSNNSNLVTLKLLHELSIIKSLST

SEQ ID NO: 177851 - protein, 190 aa, Glycine max
  Coding DNA Sequence Number=SeqID_61073
  Gene Ontology: Mol. function=binding; Cellular component =intracellular; Biological process=protein kinase C activation
  Homolog annotation: Hit_ID=Q2L3D0; Match level="QueryCoverage=91%, HitCoverage=44%, E-value=4e-43, Identity=38%"; Hit description =Selenium binding protein
  Pfam annotation: Domain name=PPR; Domain location=110-144; Score =41.4; E_value=3.1e-09; Accession=PF01535.11; Description=PPR repeat
  Pfam annotation: Domain name=PPR; Domain location=145-179; Score =12.8; E_value=0.23; Accession=PF01535.11; Description=PPR repeat
  Pfam annotation: Domain name=PPR; Domain location=44-78; Score=3.5; E_ value=2.9; Accession=PF01535.11; Description=PPR repeat
  Pfam annotation: Domain name=PPR; Domain location=9-43; Score=10.7; E_ value=0.4; Accession=PF01535.11; Description=PPR repeat
  Pfam module annotation: Pfam domain module=PPR::PPR::PPR::PPR; Domain location=110-144::145-179::44-78::9-43
MVSSNDGSRFMLVVGCGYAKKGEGEEALALYLRMQMEAYKPIQFTYSGILSSYLSMGCLEQGKWLLAHLMKPGQKLVVYVGNTLLHMYAKLGKIRDVEKFFDKLVKVDVVSCNSMLTRYAQHGLGKEAMQQFEEMISFGIEPNDITVLFVLSSCSHARLLDEGKHYFGLMRKYSIEPKVSHYATIIDLLG

SEQ ID NO: 177852 - protein, 330 aa, Glycine max
  Coding DNA Sequence Number=SeqID_61074
CEDEENDKVVLASNSDLAAAVDHPKTWFEGMIIWNWGKGFLPLSALLEILAYHVPNLLGGADRPIWGLTPDDRFSVKSIYDALNNSGTSLGKVALFGWCCKMGLKRMSKGKSVVYHITIHAPYVEFIYDGNSYSYLSGLFDVDQAMQISVHRQPFSEVLFGSHLLGVVSSIMLMPVINGGEKASYGGVLRDANGHWINGFTRQLGRCSIMAFLECEDYLHVLCEANSVADNLASKFHHSLQGLVFYDNSLAKCKILLWFDFIVTAYFVPVIENALKAVIDTFLTLIAASSIQGPRAVSVPANTAGSELAGVAAGLRGEAGEEGGGACNVL

SEQ ID NO: 177853 - protein, 70 aa, Glycine max
  Coding DNA Sequence Number=SeqID_61075
MEGSRDITAMTEGELTNTGVQKEIILKRKESSENFAAHAIFHNPPADAAYLRGSSHNRISYVIFLGLYQF

SEQ ID NO: 177854 - protein, 104 aa, Glycine max
  Coding DNA Sequence Number=SeqID_61076
RSFLIGATVIASFGYRKEHDDSWVKKGAYPIDDEGHLPVGEDSSLLQRILDRFDGLQTYVGERFDALELQVDMRFDKMDSRITKVEGDVTYICTCFDLPPPPSS

SEQ ID NO: 177855 - protein, 110 aa, Glycine max
  Coding DNA Sequence Number=SeqID_61077
  Homolog annotation: Hit_ID=Q7XYW5; Match level="QueryCoverage=72%, HitCoverage=62%, E-value=2e-13, Identity=50%"; Hit description=Seed specific protein Bn15D1B
MGPEPEEGVENARGAIAAAYSSSGGSVYDKNPDDQIHSGAVPDDVIQATQSGKYWAPHPQTGVFGPPGGAGDEAASAPTSTSTSTSDALEEKAWFRPTSLEDFEKPHTLP

SEQ ID NO: 177856 - protein, 72 aa, Glycine max
  Coding DNA Sequence Number=SeqID_61078
  Subcellular localization annotation: CTP_CleavageSite=10; ConfidenceScore=5.01e-01
MWVLTKTSCVAATIHTPTSCTTSDCVKIKPVSSSSDFKWRLHLRMRIDRIEGIKKLFFSFWRCSACASCSCD

SEQ ID NO: 177857 - protein, 450 aa, Glycine max
  Coding DNA Sequence Number=SeqID_61079
  Gene Ontology: Mol. function=pepsin A activity; Cellular component =membrane; Biological process=proteolysis
  Homolog annotation: Hit_ID=Q1STA9; Match level="QueryCoverage=92%, HitCoverage=92%, E-value=1e-110, Identity=51%"; Hit description =Peptidase aspartic, active site
  Pfam annotation: Domain name=Asp; Domain location=71-405; Score= -132.2; E_value=8.5e-06; Accession=PF00026.14; Description=Eukaryotic aspartyl protease
MVVYPTSFHLATIICLMLLPLHISATEGFSVNLIRKNSSHAHVLPLRRLMELSAMEKTLTPQSPIYAYLGHYLMELSIGTPPFKIYGIADTGSDLTWTSCVPCNNCYKQRNPMFDPQKSTTYRNISCDSKLCHKLDTGVCSPQKRCNYTYAYASAAITRGVLAQETITLSSTKGKSVPLKGIVFGCGHNNTGGFNDHEMGIIGLGGGPVSLISQMGSSFGGKRFSQCLVPFHTDVSVSSKMSFGKGSKVSGKGVVSTPLVAKQDKTPYFVTLLGISVENTYLHFNGSSQNVEKGNMFLDSGTPPTILPTQLYDQVVAQVRSEVAMKPVTDDPDLGPQLCYRTKNNLRGPVLTAHFEGADVKLSPTQTFISPKDGVFCLGFTNTSSDGGVYVYFQHLALLIALSWAKEMQYKKVIFEADCQRVVAAINSKKIELNEFGSIISKCRSMLRTE

SEQ ID NO: 177858 - protein, 162 aa, Glycine max
  Coding DNA Sequence Number=SeqID_61080
  Subcellular localization annotation: CTP_CleavageSite=19; ConfidenceScore=5.28e-01
MGGCCGCFKDTSAPQNPARVSEVHVPQSFRQGSPPAVSGGLLNDTSRRTLDFFLSDLPLGVTQEICADQTNTSLQTIDSTSTKKTVDGDNYETGTSSKSEKLKESVCKTQTALKLGSAKGSELELAKLGKAVILDEEESACPIYLGGDAVTASLFNFFGFQH

SEQ ID NO: 177859 - protein, 205 aa, Glycine max
  Coding DNA Sequence Number=SeqID_61081
  Gene Ontology: Mol. function=metal ion binding; Cellular component =intracellular; Biological process=metabolic process
  Homolog annotation: Hit_ID=Q6K2P5; Match level="QueryCoverage=87%, HitCoverage=23%, E-value=9e-36, Identity=41%"; Hit description =Putative pentatricopeptide (PPR) repeat-containing protein
MVDVDGRAGKIFEAEELIREMPMKPDSVIWSSLLGSCRKHGETRLAKLAADKFKELEPNNSLGYVQMSNIYSSGGSFTKAGLIRNEMSDFKVRKEPGLSWVEIGKQVHEFGSGGQYHPNRGAILSRLEIVIGQLKEMGYVPELSLALYDTEVEHKEDQLFHHSEKMALVFAIMNEGQGTAVTFNNLPTERHSNDPRINKLGNVMA

SEQ ID NO: 177860 - protein, 181 aa, Glycine max
  Coding DNA Sequence Number=SeqID_61082
  Gene Ontology: Cellular component=integral to membrane
  Homolog annotation: Hit_ID=Q8S8T8; Match level="QueryCoverage=99%, HitCoverage=91%, E-value=8e-57, Identity=62%"; Hit description =Expressed protein
  Pfam annotation: Domain name=PLAC8; Domain location=40-164; Score =74.5; E_value=3.3e-19; Accession=PF04749.7; Description=PLAC8 family
MKNQHGYVPPAYIPLGQSDSEAVDVSLLSTNGSNQMQAQWSSGICACCDDMQSCCIGCLCPCFLFGKNAEFLGSGTFLGSCVTHFILWSVVNTACCLLTDGLFWGLPGCLVSCYACGYRKALRSKYNLPYSKIVKGKFLDFEEGRKHPVGILLPIFAVILVPSVKSTVRYVKDLGIVKPQT

SEQ ID NO: 177861 - protein, 125 aa, Glycine max
  Coding DNA Sequence Number=SeqID_61083
  Gene Ontology: Mol. function=structural constituent of ribosome; Cellular component=large ribosomal subunit; Biological process =translation
  Homolog annotation: Hit_ID=Q2HVI3; Match level="QueryCoverage=79%, HitCoverage=40%, E-value=2e-40, Identity=82%"; Hit description =Peptidase, cysteine peptidase active site; Ribosomal protein L30
  Pfam annotation: Domain name=Ribosomal_L30; Domain location=82-124; Score=11.1; E_value=0.0048; Accession=PF00327.10; Description =Ribosomal protein L30pL7e
  Pfam annotation: Domain name=Ribosomal_L30_N; Domain location=11-81; Score=101.7; E_value=2.2e-27; Accession=PF08079.2; Description =Ribosomal L30 N-terminal domain
  Pfam module annotation: Pfam domain module=Ribosomal_L30::Ribosomal _L30_N; Domain location=82-124::11-81
MGEAKALVPESVVKKEKRNEEWALEKKQELDAAKKKRFETRKLIFNRAKQYSKEYDEQQKELIRLKREAKLKGGFYVEPEAKLLFIIRIRGINAMDPKTRKILQLLRLRQRPSKLQCSDPEMLIP

SEQ ID NO: 177862 - protein, 323 aa, Glycine max
  Coding DNA Sequence Number=SeqID_61084
  Gene Ontology: Mol. function=hydrolase activity; Biological process =aromatic compound metabolic process
  Homolog annotation: Hit_ID=Q94F26; Match level="QueryCoverage=51%, HitCoverage=36%, E-value=1e-34, Identity=56%"; Hit description =Lipase-like protein
MGGSIAVHVAARRSLSTLAGLLVVDVVEGTAMTSLIHMQKILSSRMQHFSSIEKAVHGCPWCRSHVPGGKNQAHQKCSFVEVENASVQIEWSVRGGSLRNIDSARVSIPATLKYDDSKKWLVPLLAFQNIAIFTELSWKRLNNIGKAGLSDKFLSCPVPKLLLLAGTRMPSWIKSVKLIGHVHRPLEAQGERVEEGHWRNEEVVKRDLMVNNTSKDLETVLCDQTEPKPPSLTGRAQLKACVADFRSEKEKRWRSLAQRCAKKWWKSTVSENSVDSESKWERLLLRVSIRLSEQAHDTREVEPPCELAAAPPPTKSSSSPFEK

SEQ ID NO: 177863 - protein, 965 aa, Glycine max
  Coding DNA Sequence Number=SeqID_61085
  Gene Ontology: Mol. function=binding; Cellular component=Golgi stack; Biological process=protein amino acid phosphorylation
  Homolog annotation: Hit_ID=Q5Z9G2; Match level="QueryCoverage=43%, HitCoverage=85%, E-value=1e-127, Identity=55%"; Hit description =Putative crp1 protein
  Pfam annotation: Domain name=PPR; Domain location=117-151; Score =29.1; E_value=1.5e-05; Accession=PF01535.11; Description=PPR repeat
  Pfam annotation: Domain name=PPR; Domain location=152-186; Score =17.1; E_value=0.062; Accession=PF01535.11; Description=PPR repeat
  Pfam annotation: Domain name=PPR; Domain location=187-221; Score =15.8; E_value=0.1; Accession=PF01535.11; Description=PPR repeat
  Pfam annotation: Domain name=PPR; Domain location=222-256; Score =28.5; E_value=2.3e-05; Accession=PF01535.11; Description=PPR repeat
  Pfam annotation: Domain name=PPR; Domain location=257-291; Score =43.7; E_value=6.3e-10; Accession=PF01535.11; Description=PPR repeat
  Pfam annotation: Domain name=PPR; Domain location=292-326; Score =41.1; E_value=3.9e-09; Accession=PF01535.11; Description=PPR repeat
  Pfam annotation: Domain name=PPR; Domain location=327-361; Score=2.6; E_value=3.7; Accession=PF01535.11; Description=PPR repeat
  Pfam annotation: Domain name=PPR; Domain location=362-396; Score =14.0; E_value=0.16; Accession=PF01535.11; Description=PPR repeat
  Pfam annotation: Domain name=PPR; Domain location=427-461; Score =39.0; E_value=1.7e-08; Accession=PF01535.11; Description=PPR repeat
  Pfam annotation: Domain name=PPR; Domain location=462-496; Score =38.4; E_value=2.5e-08; Accession=PF01535.11; Description=PPR repeat
  Pfam annotation: Domain name=PPR; Domain location=747-780; Score =24.8; E_value=0.0003; Accession=PF01535.11; Description=PPR repeat
  Pfam annotation: Domain name=PPR; Domain location=82-116; Score=23.1; E_value=0.00098; Accession=PF01535.11; Description=PPR repeat
  Pfam annotation: Domain name=PPR; Domain location=933-965; Score=0.4; E_value=6.7; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR; Domain location=117-151::152 -186::187-221::222-256::257-291::292-326::327-361::362-396::427 -461::462-496::747-780::82-116::933-965
  Subcellular localization annotation: CTP_CleavageSite=32; ConfidenceScore=5.06e-01
MDIHSVFRSMQISLSYNHGNPLLRIPRAIVTQCSKKSNFLKFPNRWVRNKGVKEVGSEFDSKSKTMLFKIPDIGENEELSSNLCSQFICECCKEGDLDRAMSLLSQMEAKGFHLSSTAYACLIEALGNVGRTSEADMLFKEMICDGYKPKLNFYTSLLRGFLKKGLLGLANGVLKEMDYSGIWRSKETYQIFLDYYVGAGRLEDTWSTINVMKQKGFPLNSFVYSKVVGIYRDNGMWKKAIEVLEEIRERGISLDIHICNSIIDTFGKYGELDEALKLFKKMQEEGVRPNIVTWNSLIKWHCKEGDFMKSFHLFTDMQEQGLYPDPKIFVTIISCMGEQGKWGIIKKYFESMKIRGNKEYGAVYAVLVDIYGQYGKFQNARECVQALKSEGVLVSPSIFCVLANAYAQQVIMVLQIMEAEGIEPNIVMLNMLINAFGNAGRYMEAMSVYHHIKESGVSPDVVTYTTLMKAFIRAKKFDEVPIIYKEMENDRCTPDRKARQMLQVALMFEERKLRFSTMSSLSNENKDPCVCSFGRAAVHVDVISRSLRRIPPEILIVVFIKESVFALLSKESVGPINESTKKISIKPESTVTDKTTTSAKQGMMVLGGASNFSALMLCSRKLVRYVFFKRCFLRNLCSSSAEPETIATNIDAQIRALSTQGNIEEALSLLYTHSSLSLQTYASLFHACAQKKCLQHGMTLHHYVLHKDPTIQNDVFLTNHIINMYCKCGHLAYARYVFDQMSHRNIVSWTALISGHAQSGLVRECFSLFSGLLAHFRPNEFAFASLLSACEEHDIKCGMQVHAVALKISLDANVYVANSLITMYSKRSGFGGGYAQTPDDAWTMFKSMEFRNLVSWNSMIAGFNFVDLGTKPFASLHICTAMELGLIVPHYLVGLISEIEVVTALIKSYANLGGHISDCYRIFHDTSSQLDIVSWTALISVFAERDPEQAFLLYCQLHRQSYLPD

SEQ ID NO: 177864 - protein, 39 aa, Glycine max
  Coding DNA Sequence Number=SeqID_61086
MAVVKAYRACYSDTWPTQASLFKTLNLVFDRPRMTTTAR

SEQ ID NO: 177865 - protein, 52 aa, Glycine max
  Coding DNA Sequence Number=SeqID_61087
MLLPEKGIKEEIVMALEDESGFEIIDNQIYKINFETCSGDKYYQIQTGHRLK

SEQ ID NO: 177866 - protein, 66 aa, Glycine max
  Coding DNA Sequence Number=SeqID_61088
  Gene Ontology: Mol. function=electron carrier activity; Cellular component=mitochondrial respiratory chain; Biological process =electron transport
  Homolog annotation: Hit_ID=P00072; Match level="QueryCoverage=53%, HitCoverage=32%, E-value=9e-12, Identity=80%"; Hit description =Cytochrome c
MASFDQAPPGDVKSGDKIFRTKCAQCHTVEKGAGHKQAETVQKQYALETDCSLVRSTFSSMILKFY

SEQ ID NO: 177867 - protein, 242 aa, Glycine max
  Coding DNA Sequence Number=SeqID_61089
  Gene Ontology: Mol. function=oleoyl-[acyl-carrier-protein] hydrolase activity; Cellular component=chloroplast; Biological process=fatty acid biosynthetic process
  Homolog annotation: Hit_ID=Q42712; Match level="QueryCoverage=72%, HitCoverage=44%, E-value=6e-77, Identity=80%"; Hit description =Oleoyl-acyl carrier protein thioesterase, chloroplast precursor
  Pfam annotation: Domain name=Acyl-ACP_TE; Domain location=85-242; Score=121.7; E_value=2.1e-33; Accession=PF01643.8; Description=Acyl -ACP thioesterase
  Subcellular localization annotation: CTP_CleavageSite=50; ConfidenceScore=5.34e-01
MLKLSCNGLDRAHSLAQCGFAGRPACVVPRRRISGVSGFWSPGGRAIRVSAAVVSAKDGAVATRVEAESGTLADRLRVGSLTEDGLSYKEKFIVRSYEVGINKTATVETIANLLQEVGCNHAQSVGYSTDGFATTPTMRKLRLIWVTARMHIEIYKYPAWWFEKSKLNDSNRSDVVEIETWCQGEGRVGTRRDFILKDYASDAVIGRATSKWVMMNQDTRRLQKVSDDVKEEYLVFCPREPR

SEQ ID NO: 177868 - protein, 38 aa, Glycine max
  Coding DNA Sequence Number=SeqID_61090
  Gene Ontology: Mol. function=electron carrier activity; Cellular component=mitochondrial respiratory chain; Biological process =electron transport
  Homolog annotation: Hit_ID=P00060; Match level="QueryCoverage=79%, HitCoverage=27%, E-value=2e-09, Identity=93%"; Hit description =Cytochrome c
MFILVMRYIPGTKMVFPGLKKPQERADLIAYLKESTAQ

SEQ ID NO: 177869 - protein, 322 aa, Glycine max
  Coding DNA Sequence Number=SeqID_61091
  Gene Ontology: Cellular component=membrane; Biological process =hypersensitive response
  Homolog annotation: Hit_ID=Q8GYN5; Match level="QueryCoverage=70%, HitCoverage=91%, E-value=9e-33, Identity=40%"; Hit description=RPM1 -interacting protein 4
  Pfam annotation: Domain name=NOI; Domain location=188-268; Score =50.4; E_value=6.1e-12; Accession=PF05627.2; Description=Nitrate -induced NOI protein
MSFVSFLCFFSVDNSEQHSNVPKFGNQESEDNVLDTAHSDKAQKGQSGSKMINPNDTKENSDIVSSADLPHSKPRVHSEDPSGKGSVRTTHELQKSREDGDPKQFTDSPARHGGGDSSHRGHGVGSADNRKRPSRQSTGPEHNIDRSPLHRQAKTPGRDSPSWEGKNSYDSSHGTPGRSRLRPSYRGDETPDEGAAVPKFGEWDESNPASADGYTHIFNKVREEKQVGAGHVPGTPNGRQYAARNQRANDKAQLSILVDLYAPPPSFFALLLLLDHMLIRLMKAPSCYEQKFCSLVPRIRGLGDLQKREIKERNFLIILLAH

SEQ ID NO: 177870 - protein, 592 aa, Glycine max
  Coding DNA Sequence Number=SeqID_61092
  Gene Ontology: Mol. function=protein binding; Cellular component=DNA replication preinitiation complex; Biological process=regulation of progression through cell cycle
  Homolog annotation: Hit_ID=Q9LSG6; Match level="QueryCoverage=99%, HitCoverage=99%, E-value=0.0, Identity=66%"; Hit description=CDC45 (Cell division cycle 45)-like protein
  Pfam annotation: Domain name=CDC45; Domain location=24-592; Score =291.5; E_value=1.6e-84; Accession=PF02724.5; Description=CDC45-like protein
MREQNVESFYAKLRQTALSSSSSPVLIFPSTSDVDSLCALKIIFHILESDSIQYACYPVSSFHEIHKYTNSSSNDEPLSVVLVNWGNHRDLSNTLNLPSNARVFVVDSHRPIHLRNLSDQNDAVVVLFTKEDEGQSDLAYDFDLTTLANAATTVDSDSDSESESESDSDSDSGSERTGSRKRRKKNPQDDDDGDDEDPIKLYRKLKKGYYKLGTFHGKPSGCLMYELADKLRKNTNELLWIACISLTDQFVHERLSDERYHDGVMELEQHINSSGNLDAVTSVTLKDGTKIRAPNSLRITYEDQPRLMLLQEWSLFDSMMCSSYIATKLKTWSENGIKKLKLLFGTMGFALGDCQQKFQHMNLEVKRKMKKEFERFLPEYGLTDFYYRSFIRTLKYSSKISAADVVYGVTALLESFVRSDGSCASKQFGVAYDALSLNNIDNLRTGMHHAIKIQRAILRQGSAAITKNGCIRSGRSFRWLKLEDSNDATLLGYPQALTKFCYFIMDALREKGAKMKPLICACVSQEPGKVLIVGVCGRPRLGGAQGNAFGIAFRTAAEEIGTEFFHELFESSWIVLDASAVNSFMVRLTKKL

SEQ ID NO: 177871 - protein, 110 aa, Glycine max
  Coding DNA Sequence Number=SeqID_61093
  Gene Ontology: Mol. function=receptor activity; Cellular component =endoplasmic reticulum; Biological process=intracellular protein transport
  Homolog annotation: Hit_ID=Q9FH68; Match level="QueryCoverage=92%, HitCoverage=40%, E-value=9e-14, Identity=46%"; Hit description =Arabidopsis thaliana genomic DNA, chromosome 5, TAC clone:K16E1
MIQLLFLVIFVEGVLAFLLLVKIGPLRDLVIKSLDQLKMGKGPATVKTIAGTMSVILLSSLMSIIKIQNKGAKLGTMSPMDQVLWRSHLLEASLMVHFMIFLSFEAPSVA

SEQ ID NO: 177872 - protein, 67 aa, Glycine max
  Coding DNA Sequence Number=SeqID_61094
MEARKERMEQVKKEEIKGSRNTSKEENATKGDTVSKRVIRLVAHWNSLLLLPELVTSSTTLGSLLLE

SEQ ID NO: 177873 - protein, 72 aa, Glycine max
  Coding DNA Sequence Number=SeqID_61095
MKSSDMRGYRMVICTFRQPGANEPIDAQRLTLSSAPSVILTREVRCSFRRPETFKSDDAQDSSLLGRDNRVR

SEQ ID NO: 177874 - protein, 184 aa, Glycine max
  Coding DNA Sequence Number=SeqID_61096
  Gene Ontology: Mol. function=transcription factor activity; Cellular component=nucleus; Biological process=regulation of transcription, DNA-dependent
  Homolog annotation: Hit_ID=Q9C9I2; Match level="QueryCoverage=90%, HitCoverage=87%, E-value=5e-45, Identity=59%"; Hit description =Putative TINY; 48985-48434
  Pfam annotation: Domain name=AP2; Domain location=14-78; Score=142.2; E_value=1.4e-39; Accession=PF00847.10; Description=AP2 domain
MPSSSSSHVVGAASSAYRGVRKRKWGKWVSEIREPGTKTRIWLGSFETPEMAAAAYDVAALHFRGRDARLNFPELASTLPRPVSNNADHIRMAAHQAALRLRTNPAAPDTAGSAGSSSSAPLTVRLSPTQIQAINDSPMDSPQTWMQMPDTFMMHDQSMMFASNGYSFEDNEWEHMQNDSLWDP

SEQ ID NO: 177875 - protein, 133 aa, Glycine max
  Coding DNA Sequence Number=SeqID_61097
  Gene Ontology: Mol. function=receptor activity; Cellular component =endoplasmic reticulum; Biological process=intracellular protein transport
MDKYYRISIGSFTLFLGFLIDRTHHYLQKLINLRSNAGASKEELENLKKETVQLKEKDEKASKEIKQLKEELSCLSKSLEKIKSESEEKDKKVETAEAHVASLQKQAADLLLEYDRLLEENQNLQAQTLGHKS

SEQ ID NO: 177876 - protein, 558 aa, Glycine max
  Coding DNA Sequence Number=SeqID_61098
  Gene Ontology: Mol. function=transcription regulator activity; Cellular component=nucleus; Biological process=regulation of transcription
  Homolog annotation: Hit_ID=Q1RZ85; Match level="QueryCoverage=97%, HitCoverage=79%, E-value=1e-112, Identity=34%"; Hit description =Asp/Glu racemase; Polynucleotidyl transferase, Ribonuclease H fold
  Pfam annotation: Domain name=PPR; Domain location=172-206; Score =28.9; E_value=1.8e-05; Accession=PF01535.11; Description=PPR repeat
  Pfam annotation: Domain name=PPR; Domain location=234-268; Score =41.0; E_value=4e-09; Accession=PF01535.11; Description=PPR repeat
  Pfam annotation: Domain name=PPR; Domain location=269-303; Score =12.2; E_value=0.27; Accession=PF01535.11; Description=PPR repeat
  Pfam annotation: Domain name=PPR; Domain location=335-369; Score =46.1; E_value=1.2e-10; Accession=PF01535.11; Description=PPR repeat
  Pfam annotation: Domain name=PPR; Domain location=370-404; Score =14.5; E_value=0.14; Accession=PF01535.11; Description=PPR repeat
  Pfam annotation: Domain name=PPR; Domain location=406-440; Score =14.4; E_value=0.15; Accession=PF01535.11; Description=PPR repeat
  Pfam annotation: Domain name=PPR; Domain location=472-506; Score=9.2; E_value=0.61; Accession=PF01535.11; Description=PPR repeat
  Pfam annotation: Domain name=PPR; Domain location=71-105; Score=18.3; E_value=0.028; Accession=PF01535.11; Description=PPR repeat
  Pfam module annotation: Pfam domain module=PPR::PPR::PPR::PPR::PPR::PP R::PPR::PPR; Domain location=172-206::234-268::269-303::335-369::370 -404::406-440::472-506::71-105
MYTLTLKDTILGHIKRCFSPKSLESVYASMIKTNTTQDCFLVNQFISACSNLSCINLAASAFANVQNPNVLVFNALIRGCVHCCYSEQALVHYMHMLRNNVMPTSYSFSSLIKACTLLVDSAFGEAVHGHVWKHGFDSHVFVQTTLIEFYSTFGDVGGSRRVFDDMPERDVFAWTTMISAHVRDGDMASAGRLFDEMPEKNVATWNAMIDGYGKLGNAESAEFLFNQMPARDIISWTTMMNCYSRNKRYKEVIALFHDVIDKGMIPDEVTMTTVISACAHLGALALGKEVHLYLVLQGFDLDVYIGSSLIDMYAKCGSIDMALLVFYKLQTKNLFCWNCIIDGLATHGYVEEALRMFGEMERKRIRPNAVTFISILTACTHAGFIEEGRRWFMSMVQDYCIAPQVEHYGCMVDLLSKAGLLEDALEMIRNMTVEPNSFIWGALLNGCKLHKNLEIAHIAVQNLMVLEPSNSGHYSLLVNMYAEENRWNEVAKIRTTMKDLGVEKRCPGSSWVEINKTVHLFAASDTYHPSYSQLHLLLAELDDQLRLAGYVPELGSIL

SEQ ID NO: 177877 - protein, 82 aa, Glycine max
  Coding DNA Sequence Number=SeqID_61099
MYADRVESGTRRSVKERLDGNFSTDSTRQHRITGKRKCTIEQLWNCLGLELWTWEDAFIGEIVGKYLARVGIYDDVVADIED

SEQ ID NO: 177878 - protein, 643 aa, Glycine max
  Coding DNA Sequence Number=SeqID_61100
  Homolog annotation: Hit_ID=Q5EC26; Match level="QueryCoverage=12%, HitCoverage=97%, E-value=1e-22, Identity=81%"; Hit description =Putative phosphatidylinositol glycan class S
  Subcellular localization annotation: CTP_CleavageSite=37; ConfidenceScore=5.18e-01
MAEISNSPPTSNPVEENTQTPKTTRNTKPGVKRLIISVTVLFSFILGFPLLWKSVKIYRAPLPFDRVDSFSSQIESKPLSFPCRFLAIFIGFDFMVSNGNVGAAIERKMSDLSHGGDCGGCGGNYSVSVAVGGGGIDAVYFGGKLRGNDEDADELVKSVVSEYGGGNMYSVVVVNEEGEVRSVVGKHRHAWIVGRVEEEEAVWRAAEIFVEVFVNGRDEEGSVRSEFMPVGADGRIVLSFSLLNADPRDWIYDCSEGWNYSQADGLVEKTCWHVDTFGDKANINDADVKYSINLLYNVGLSFPVRNFREIDETLLWPVIEALQPIANITVESQVLYHTPKSSFSNWDDKHGSHIFRTEDLPFFVNSNEWHLDTSVAAGGRYIPSAKECPLQLELSSGEISKTNGFISPMWGGVVVWNPRSCIKDLESRDPVRHTISSQIYLCMFGNCLVLVNNHLKIYAHEAGKKCMPILKQDLQKLFEVLMGQLRQLLGLKSDNLYVGKSGASILLGSERGFTEWELDVLSRKHICFNLQSCATTLGSLSRLVQSLPRMIIMDEIGKQVKFSLEAAKSAQSNASIGIYDASAAIFSASYYACPPSCFTRMEKVQARKKEVLGIEGQSKSFINLLSSDNKMKLVSWDLGPSVW

SEQ ID NO: 177879 - protein, 527 aa, Glycine max
  Coding DNA Sequence Number=SeqID_61101
  Gene Ontology: Mol. function=nucleic acid binding; Cellular component= membrane; Biological process=DNA integration
  Homolog annotation: Hit_ID=Q1S1G2; Match level="QueryCoverage=83%, HitCoverage=54%, E-value=3e-38, Identity=31%"; Hit description =Integrase, catalytic region; Zinc finger, CCHC-type; Peptidase aspartic, catalytic
  Pfam annotation: Domain name=zf-CCHC; Domain location=191-208; Score =12.6; E_value=0.0083; Accession=PF00098.13; Description=Zinc knuckle
  Pfam annotation: Domain name=zf-CCHC; Domain location=229-246; Score =12.9; E_value=0.0073; Accession=PF00098.13; Description=Zinc knuckle
  Pfam module annotation: Pfam domain module=zf-CCHC::zf-CCHC; Domain location=191-208::229-246
MWYQSSSHEEFCCALKFTFQFLFFLTPFTMNELTPNTKSYLYLHPSENPVVALVSPALDSSNYHSWSRSMVKALSAKNTVEFINGNAPEPLKTDRTYGAWSRCINMVVSWIVHSVSVAIRQSILWMNKAEEIWDDLKSRYAQEDLLRISDLQQEASSMKQAQQERQLSGTNSLPNFNLESKESASINAVKIVCEFCGRIGHTESVCYKKHGVPSNYEGRSKSYNTRNGKTCTHCGKIGHTIDVCHKKHGFPPGYKFGNGKVVANNIVAVEGKATSDQMKRHESQDLVRFSPEQYQALLALIQQPSSGSSASTQSQIASISSCSTNTTTDSGATDHVSSSLTNFHSYHQVSPIMDTNTKAKIGTVEGIIHQTTCVETPKQNGIVEPYLINCIPTPFLNKKSPYEKLYAHPCDISNLRVFGYVCYVSTLKSHRQKLDPRAHPCIFIGFKPHTKGYLVYDLHSHSITTSRNIVFYEDHFPLFPDNQTLPTLHSYISPIPFSSNPDKFDSPIPPSVNPSPLTPLTLPYAAP

SEQ ID NO: 177880 - protein, 91 aa, Glycine max
  Coding DNA Sequence Number=SeqID_61102
CEDRKVTAQDLRLKLQKKGLHPGGQTGKSSVHGERDLRERLSGTMTQQPKNYDPPKPKVAARASSKSIDVEPAVHIKRSATKKLSRKGCQL

SEQ ID NO: 177881 - protein, 327 aa, Glycine max
  Coding DNA Sequence Number=SeqID_61103
  Gene Ontology: Mol. function=hydrolase activity, hydrolyzing O -glycosyl compounds; Cellular component=cell wall; Biological process= carbohydrate metabolic process
  Homolog annotation: Hit_ID=Q9SV60; Match level="QueryCoverage=81%, HitCoverage=88%, E-value=1e-93, Identity=59%"; Hit description =Xyloglucan endotransglucosylase/hydrolase protein 2 precursor
  Pfam annotation: Domain name=Glyco_hydro_16; Domain location=63-251; Score=298.0; E_value=1.7e-86; Accession=PF00722.11; Description =Glycosyl hydrolases family 16
  Pfam annotation: Domain name=XET_C; Domain location=266-326; Score =67.7; E_value=3.7e-17; Accession=PF06955.3; Description=Xyloglucan endo-transglycosylase (XET)
  Pfam module annotation: Pfam domain module=Glyco_hydro_16::XET_C; Domain location=63-251::266-326
MEVHNFANNNNHSPLMCQARESKIQILAWVNLDMSSLFLIFLILLVADGVLVRGSINITEISFDQNYEVTWGDNHVVSLNQGKEIQLTMDNSSVIPFSLQEGSGFGSKMSYGSGLFHLRIKVPDRNSAGVVTAYYLTSQGRSHDELDFEFLGNREGKPYRLQTNVFVDGQGNREQRILLWFDPTADFHNYRILWNQHQIVFYVDNIPIRVYKNKSDIGVGYPTKPMQIQASLWDGDSWATNGGKTKTDWSYAPFRASFQGFDVSGCQVPTSNISQNCSSDKYWWNTQKFWRLDSVRQRQYERVKHKYMTYGYCADRNRYPEIPLECL

SEQ ID NO: 177882 - protein, 223 aa, Glycine max
  Coding DNA Sequence Number=SeqID_61104
  Gene Ontology: Mol. function=hydrolase activity, hydrolyzing O -glycosyl compounds; Cellular component=cell wall; Biological process= carbohydrate metabolic process
  Homolog annotation: Hit_ID=Q9SV61; Match level="QueryCoverage=79%, HitCoverage=83%, E-value=4e-31, Identity=36%"; Hit description =Putative xyloglucan endotransglucosylase/hydrolase protein 1 precursor
  Pfam annotation: Domain name=Glyco_hydro_16; Domain location=32-141; Score=23.4; E_value=3.7e-09; Accession=PF00722.11; Description =Glycosyl hydrolases family 16
  Pfam annotation: Domain name=XET_C; Domain location=166-211; Score =16.8; E_value=0.00028; Accession=PF06955.3; Description=Xyloglucan endo-transglycosylase (XET)
  Pfam module annotation: Pfam domain module=Glyco_hydro_16::XET_C; Domain location=32-141::166-211
MAHLHKQQNFCFVLLFVALTIAYARKAIEVSFQQNYKVVWGKHHVFFVQHGREVQLSIDKTSGAGFRSKLEYASGFFQMRIKIPNKDTHTHTFYVDEIPIGVFKNYSNVEVSFPSKQMHVTASIWNGEPWASNGKRIDWKQAPFTAQFQGFNIHGCRTQNRKKHACYSPYLWWNDKRHWELNPQQQRAYEDVGKKHLLYDYCSDRAIEENCTKNVKLIRSLIN

SEQ ID NO: 177883 - protein, 191 aa, Glycine max
  Coding DNA Sequence Number=SeqID_61105
MVFFLFPNASLEPEMKMSLNENENESQSEGVQVESLCFSIPSLKWFELCSDEQEFNVVVKAENLVNFVCDLEGLHKVTLDALNLKSLTVMGDVLQVHITKSLFSIEEAVIEAELCFYLTSQVATCEITQFVREHYEGVFLFACLALYVSSMTIPTSRNLVKLELIPDYCPDFRRSCISHVLLKLFESAYLQ

SEQ ID NO: 177884 - protein, 116 aa, Glycine max
  Coding DNA Sequence Number=SeqID_61106
SQFQLQMQSQGLALPPEPEVGPSFAHGSTTILSIPLDNDQVKVGVEEVRDADARIPVPTQEVQLVGQTLNIFLAWPTHLVKRYSEQVMWDATVFGMFNDNFPLYIKHEDLSEIAHN

SEQ ID NO: 177885 - protein, 416 aa, Glycine max
  Coding DNA Sequence Number=SeqID_61107
  Gene Ontology: Mol. function=alanine-glyoxylate transaminase activity; Cellular component=mitochondrion; Biological process =photorespiration
  Homolog annotation: Hit_ID=Q940M2; Match level="QueryCoverage=99%, HitCoverage=82%, E-value=0.0, Identity=77%"; Hit description=Alanine- -glyoxylate aminotransferase 2 homolog 1, mitochondrial precursor
  Pfam annotation: Domain name=Aminotran_3; Domain location=3-353; Score=234.4; E_value=2.5e-67; Accession=PF00202.11; Description =Aminotransferase class-III
MQYLFDENGRRYLDAFAGIVTISCGHCHPEVLNAIMEQSKLLQHTTTIYLHHAIADFAEALASKVPGNLKVVYFVNSGSEANDLAMLMARLYTGNMGMISLRNAYHGGSSSTIGLTAMNTWKYPIPEGEVHHIMNPDPYRGIFGSDANRYARELQDHIDYGTSGKVAGFIAETIQACIIHPSCLISKLQSGIYSHTHLSVGAGGAVELAPGYLKLVYDIVHKAGGVCIADEVQCGFARTGSHFWGFETQGVIPDIVTMAKGIGNGLPLAAVVTTPEIASVMAQKLQFNTFGGNPVCSAGGLAVLRVLDKEKRQSHCADVGSHLIQRLRSLMQIHDIIGDVRGRGLMVGIEFVTDRKEKTPAKAETTALHERFRELGILVGKGGLHGNVFRIKPPMCFTKDDADFVVDALDYAISKL

SEQ ID NO: 177886 - protein, 431 aa, Glycine max
  Coding DNA Sequence Number=SeqID_61108
  Gene Ontology: Mol. function=gamma-glutamyltransferase activity; Cellular component=endoplasmic reticulum; Biological process =cellular response to nitrogen starvation
  Homolog annotation: Hit_ID=Q680I5; Match level="QueryCoverage=99%, HitCoverage=67%, E-value=1e-123, Identity=54%"; Hit description =Putative gamma-glutamyltransferase
  Pfam annotation: Domain name=G_glu_transpept; Domain location=1-430; Score=380.3; E_value=3e-111; Accession=PF01019.11; Description=Gamma- glutamyltranspeptidase
MYAGNTTLKAKGGLSVAVPGELAGLHEAWKQHGKLPWKRLIKPAEFLARRGFKVSPFLHMQMEASESDILEDKGLRSIFAPNGKLLNIGDICYNNKLAETLRTISESGPQAFYDGLIGLNLVKDVQNAGGILSMKDLKSYTVKQKEPISNDVLGLTLLGMPPPSGGHPMMLLLNILDQYKLPSGLSGALGFHREIEALKHVFAVRMNLGDPDFVNITEVLSDMLSHSFAKVLKNDINDNKTFGPSHYGGSYVTTRFTTEQLCSERHGLQQNNYLVSRLIQLEPPMSFNRQVKWNPINDHGTSHLSIIDPERNAIAMTCTVNSYFGSKILSPSTGIVLNNEMDDFSIPRNVTKDVPPPAPANFIMPGKRPLSSMSPTIVLKDGKLKAVVGASGGGFIIGGTAEVLLNHFVKGLNPFSSVTAPRVYHQCLSFK

SEQ ID NO: 177887 - protein, 555 aa, Glycine max
  Coding DNA Sequence Number=SeqID_61109
  Gene Ontology: Mol. function=catalytic activity; Cellular component =nucleus; Biological process=metabolic process
  Homolog annotation: Hit_ID=Q1RVD3; Match level="QueryCoverage=98%, HitCoverage=89%, E-value=0.0, Identity=59%"; Hit description=AMP -binding enzyme, putative
  Pfam annotation: Domain name=AMP-binding; Domain location=41-473; Score=286.4; E_value=5.5e-83; Accession=PF00501.18; Description=AMP -binding enzyme
MEGSIRCSANYVPVTPISFLERAAVAYRDNISVVFGDITYTWAQTHQRCIKLASSISQLGVCLSPRHVVAVLAPNVPAMYELHFAVPMSGAVLCTLNTRHDSEMVSTLLKQTEAKLVFVYYQLLDIAQAALEILSKTTTTTTTKLPLLVLISECGHPSPPHAKGTLTYEDLIAKGTLEFEVRRPKDELDPITISSTSGTTANPKSVIYSHRGVYLNALVSIILNEMRSMPVYLWCVPMFHCNGWCIPWSIAAQGGTNVCLSSVTAEAIFDNIFRHKVTHMGGAPTILNMIINSPLRKPLSGKVAVMTGGAPPPPDVIFKMENLGFNVTHAYGSTEAYGPAAINAWKPEWDNQPRDAKAKLKTRQGVRHVGMEDLDVKDPHTMKSVPADAKTIGEVMFRGNTVMCGYLKNLKATQEAFKGGWFRSGDMGVKHPDGYIELRDRSKDTIICGGESVSSIELEAVIFSHPAVFEASVVGRPDDYWGETPCAFVKLKEGCSATADEIILFCQNRLPPFMAPRTVLFADLPKTSTGKTQKFLLREKAKAMGSFFKKNISSL

SEQ ID NO: 177888 - protein, 65 aa, Glycine max
  Coding DNA Sequence Number=SeqID_61110
MALSDKRMLYQVFHSSNRIVPRVGTIIDEFKELENKFQLRIFSWTPRSLKRGSTCNDVANGMLDG

SEQ ID NO: 177889 - protein, 510 aa, Glycine max
  Coding DNA Sequence Number=SeqID_61111
  Gene Ontology: Mol. function=4-coumarate-CoA ligase activity; Cellular component=peroxisome; Biological process=phenylpropanoid metabolic process
  Homolog annotation: Hit_ID=O24540; Match level="QueryCoverage=96%, HitCoverage=98%, E-value=1e-171, Identity=65%"; Hit description=4 -coumarate--CoA ligase
  Pfam annotation: Domain name=AMP-binding; Domain location=69-433; Score=288.3; E_value=1.5e-83; Accession=PF00501.18; Description=AMP -binding enzyme
MITLAPSLDTPKTDQNQVSDPQTSHVFKSKLPDIPISNHLPLHSYCFQNLSQFAHRPCLIVGPASKTFTYADTHLISSKIAAGLSNLGILKGDVVMILLQNSADFVFSFLAISMIGAVATTANPFYTAPEIFKQFTVSKAKLIITQAMYVDKLRNHDGAKLGEDFKVVTVDDPPENCLHFSVLSEANESDVPEVEIHPDDAVAMPFSSGTTGLPKGVILTHKSLTTSVAQQGGECSFVDAEVRDRDTAGADTAAPSVGGDGGAPAGVGVGKESDAAPLGKELEEALRNRMPQAVLGQGYGMTEAGPVLSMCLGFAKQPFQTKSGSCGTVVRNAELKVVDPETGRSLGYNQPGEICIRGQQIMKGYLNDEAATASTIDSEGWLHTGDVGYVDDDDEIFIVDRVKELIKYKGFQVPPAELEGLLVSHPSIADAAVVPQKDVAAGEVPVAFVVRSNGFDLTEEAVKEFIAKQVVFYKRLHKVYFVHAIPKSPSGKILRKDLRAKLETAATQTP

SEQ ID NO: 177890 - protein, 287 aa, Glycine max
  Coding DNA Sequence Number=SeqID_61112
  Gene Ontology: Mol. function=hydrolase activity
  Homolog annotation: Hit_ID=Q5N8H1; Match level="QueryCoverage=75%, HitCoverage=46%, E-value=5e-67, Identity=60%"; Hit description =Hydrolase-like protein
  Subcellular localization annotation: CTP_CleavageSite=71; ConfidenceScore=5.79e-01
MPIFSNSSPCCTAAAAAVVNSSNRKTRFVSPSWRNCKVTSPILRLSENDKFNVSRLAPSHSRRSVKDRNISMALVGETVGVGQKGQVAGSSSILAYDLIQGALVRWSSVMDRSLPEPPTAVFLHGILGCRKNWGTFARRLAQEFPTWQFLLVDLRCHGDSASIQKKDPHTVASAAMDVLKLVRDLRITPRVLVGHSFGGKVVLSMVDQAAKPLARPVRMKVPEVTPLSQKIILVHMWDLFSYKVGAWFTMAWILDATPGKVRAGGDGEDHPEELISFLSTLPKEVDL

SEQ ID NO: 177891 - protein, 520 aa, Glycine max
  Coding DNA Sequence Number=SeqID_61113
  Homolog annotation: Hit_ID=Q53N80; Match level="QueryCoverage=36%, HitCoverage=68%, E-value=2e-82, Identity=76%"; Hit description =Rieske [2Fe-2S] domain, putative
  Pfam annotation: Domain name=AP2; Domain location=349-415; Score =96.2; E_value=9.9e-26; Accession=PF00847.10; Description=AP2 domain
  Pfam annotation: Domain name=Rieske; Domain location=163-271; Score =1.5; E_value=0.0027; Accession=PF00355.16; Description=Rieske [2Fe -2S] domain
  Pfam module annotation: Pfam domain module=AP2::Rieske; Domain location=349-415::163-271
MHNVARILKWMSCGWCGEGSGCDGGSWLWVASKMMGLGSSATRVGHLELVQFGIEMWLKRVHYPVVWTLAIHRCKGNAEADKARGCFFTFSLQQLSLPSSMAANLLPLSISCSSKTHILCLPSPPKPLFLCRHSLLRYRSTPRLTCKAAQVSVAEESSASGDNWVPVVPLSALPKGERRVIIQDGETILLLWYKDQVFAIENRSPAEGAYTEGLLNAKLTQDGCIVCPSTDSTFDLRTGDIKEWYPKNPVLRVLTPALRKLFIYPVKTDEQNIYISIRGGVRSDASAEIVFSGKAQPGFTATDVNVDEVKMIVDEDQEGFGFTGKNEIINGRAAVIGFLLLLDFELLTAKKLKGVRRRKWGKWVSEIRVPGTQGRLWLGTYATQEAAAVAHDVAVYCLRRPSSLDKLNFPETLSSFSLQLRDMSPRSVQKVASDIGMDVDARNILAGKTSTVVAETNYESDERSRTVCDVDGGGADEHSDVFRWDAVGNEDGGSWHGSGGDCKERDQALSISIEDYLELS

SEQ ID NO: 177892 - protein, 517 aa, Glycine max
  Coding DNA Sequence Number=SeqID_61114
NYCYRDRNPCPDSTSTIIAAVDEIEDNLYYFSDVISAGIPDVARLITDSILMLLIFPLLLPSLRVVDANDMQSGVVTSLYLLCCILRIVKIKDLANTIVVALFYPLETFTRFSRGKVNGYISEFGLTSISQEPDDDNIAKGNAGCLTVNVPNSSSSSGFDPESVMSEDNCSSSNLALREVLLSYVTKGDDVLVWGSLSVLATLLQTKELDESMLDRLGILPQRKQHKKQLLEGILISLVGGRNNDMVEDLTCLPRKQALVGEASGEDQLFSSENSLMRDGSGCELDVYLEKIKEQYGLSFLPSDFLMSPRVPRFQVLDALVSLFCRSNISAETLWDGGWLLRQLLPYSEAEFNSHHLELLQVSYKNSATALVKEVRGFWPDLLITVLCNEWRKCKKAMESSYPPKEPKCILFPSQMLSSEEDIPEGSSFAAGEKMHELVKVCTYSLPVIFFKVHYSIHANTVGLFNSVLHQLQIFTLGRPLPEKPLIYPPGDLPANSRAQTSGLDVSGPKPGTEVSL

SEQ ID NO: 177893 - protein, 454 aa, Glycine max
  Coding DNA Sequence Number=SeqID_61115
  Gene Ontology: Mol. function=kinase activity; Cellular component =intracellular; Biological process=intracellular protein transport
  Homolog annotation: Hit_ID=Q9LFL3; Match level="QueryCoverage=89%, HitCoverage=100%, E-value=1e-159, Identity=70%"; Hit description=TOM (Target of myb1)-like protein
  Pfam annotation: Domain name=GAT; Domain location=281-377; Score =19.2; E_value=2.2e-05; Accession=PF03127.5; Description=GAT domain
  Pfam annotation: Domain name=VHS; Domain location=93-229; Score=79.7; E_value=9.1e-21; Accession=PF00790.9; Description=VHS domain
  Pfam module annotation: Pfam domain module=GAT::VHS; Domain location =281-377::93-229
MLEPHGTPLLKQTGEDEKVLLKPKKEKGREERLYRVLTRCLCLRRKEEKMSENLMEKVSALGERLKIGGVEVGRKMSEGMSSMSFKLKEFFQPGPNQADKLVEDATSEALDEPEWALNLDLCDLVNTDKLNCVELVRGIKKRIILKSPRVQYLALVLLETLVKNCEKAFSEVAAERVLDEMVKLIDDPQTVVNNRNKALMMIEAWGESTGELRYLPVYEETYKSLRSRGIRFPGRDNESLAPIFTPPRSVSSAPEADVNLQQQFEHDIPEQFHHDVPVLSFTPEQTKEALDVARNSIELLSTVLSSSPQQDALQDDLTTTLVQQCRRSQTTVQRIVETAGDNEAVLFEALNVNDEIQKVLTKYEELKQPATTPLHPEPAMIPVAVEPDESPYHSKEDALIRKPAGSRTGVEGGSNDDMMDDLDEMIFGKKGGEASDGGHETKKQPSSKDDLISF

SEQ ID NO: 177894 - protein, 118 aa, Glycine max
  Coding DNA Sequence Number=SeqID_61116
MRGQRVFSLSFLDPSSPRLASGLPGPPKDFWVKELARLGEPVSLGVSIISPGRAVIAPNARFSINRHEGEAEERFQGQKVRELREERKKKKEEEMKLRRDCDQSLCCSLFGVLHATIG

SEQ ID NO: 177895 - protein, 138 aa, Glycine max
  Coding DNA Sequence Number=SeqID_61117
  Subcellular localization annotation: CTP_CleavageSite=46; ConfidenceScore=5.23e-01
MTPKTCSLPASAPDRTSSIKRAILNRLARIGEFRLSATFLAQRMALCSANKHNSSFFQILPRALPRNVALSGWLAKPADSFSTRSYSSTNTSLLAQRMDSSGTLSRMTLRLANMDKSSFFLILPRAQPREWCAQRMAR

SEQ ID NO: 177896 - protein, 102 aa, Glycine max
  Coding DNA Sequence Number=SeqID_61118
MELETKEIVGHVCFKLKFYSSLFSALLLSLPRDAAHPPLPSPLRLFLTHHRLLLSFSLIRDPLCRMQFWSGGQGLKTERLEMEDGDEIDAMLHQTGGGHKFL

SEQ ID NO: 177897 - protein, 297 aa, Glycine max
  Coding DNA Sequence Number=SeqID_61119
  Homolog annotation: Hit_ID=Q1SKD7; Match level="QueryCoverage=73%, HitCoverage=56%, E-value=2e-15, Identity=25%"; Hit description =Ankyrin
MAPKKISAKRARKAATGEGSSAAPQVEIEFDGCHFRSKEHQCCFEVIKDWSFLKERRVQILDGESAEFHAKVSRRHWTQVIEPMAKYDPEVVMEFYANAWPTKEGVMDKHSGVRGQWIPYDIDAINQFLGHPLILEEGQRCKYTERRSQFSGFDEEAIDQLLCSPGHDFARSIVGRQVRIMHTSMTTLTQICMTLLLSNILPSDHNSDLTLPKCQLVYSIMTQISVHMAQLISDAIHQFVDITPPRYPVDPEKSNRALGFSTLITGLCQFYRVPVAPTKLIQPPINRSFIEKYCMLR

SEQ ID NO: 177898 - protein, 124 aa, Glycine max
  Coding DNA Sequence Number=SeqID_61120
MADSKLLIYEGSATVHNAPLCSYQVKVSVEKVQDVDARVPMPTQEGLEGPPKPIDRSDLDVNPLYLMTLTIPQLFLKPLQVSWDAIVFGVYNDNFPLYIKHEDLSKIAHGCHGLSIFVIQMWIL

SEQ ID NO: 177899 - protein, 93 aa, Glycine max
  Coding DNA Sequence Number=SeqID_61121
MRFCNVIVVTTTMNVAVSNSKVVALWGLMPLFDGRTEKQREGRERKANGNKDTSTWLFEENKGGYIPCGSLACKGFYKVERNLKNRWLLGDWM

SEQ ID NO: 177900 - protein, 120 aa, Glycine max
  Coding DNA Sequence Number=SeqID_61122
  Subcellular localization annotation: CTP_CleavageSite=39; ConfidenceScore=5.76e-01
MLNQASPTSTTPSGAMVLPPRSKTPPTTAKNTQSTTRVTSSTKQPNAWWYSLIDDNNNNNIINKSNKRISKSKQESLVLMWVLLTVEEIGERCHSRRSYCRCNTRWCWSTSMACCGTSRR

SEQ ID NO: 177901 - protein, 107 aa, Glycine max
  Coding DNA Sequence Number=SeqID_61123
SFCVGAVDEGEVNGEKDLEGTIGVHKGIIVDKPDESEEEAEKVIPSTTFATAPLGSCNPHGLWRPWRLMVVASQVINGDYGYEEEGGTRERRINLKKKKTKQKSLNH

SEQ ID NO: 177902 - protein, 328 aa, Glycine max
  Coding DNA Sequence Number=SeqID_61124
  Gene Ontology: Mol. function=protein methyltransferase activity; Cellular component=cytoplasm; Biological process=protein amino acid methylation
  Homolog annotation: Hit_ID=Q6L4V6; Match level="QueryCoverage=97%, HitCoverage=40%, E-value=3e-26, Identity=27%"; Hit description =Putative zinc finger protein
MEWFYCSNNECPACRTHCSSRRSLREDPNFDNLIGLLYSNIDKYEEEVVLKRMQKAYAKTYERQSIALGKKPAAATSTKRSKAKFLRSSSSRPTRRSPRNIAAAFAGSSSSRERALPPIAEEEEIEEVPDTDISESEIEAQTPQHVPAATKTVHGTNEAVKDIISSADKLVWGKSAQRSNNRSNSRNVAALRSNRIARFIDHLKVSQENDDELDIFIKLVSFEEKRVPNLPRPYLSCRPTLSIKQLCQYVALETSLQTEEIELYLVKECQPDIISGDGKLDEDNNKFEFLAEEEVTMAQLKTNNLSFGHLVIAYKRKRWNLNEGLFLG

SEQ ID NO: 177903 - protein, 343 aa, Glycine max
  Coding DNA Sequence Number=SeqID_61125
  Gene Ontology: Mol. function=metal ion binding
  Homolog annotation: Hit_ID=Q9SFU2; Match level="QueryCoverage=97%, HitCoverage=98%, E-value=2e-42, Identity=35%"; Hit description =Putative RING zinc finger protein
  Pfam annotation: Domain name=zf-C3HC4; Domain location=295-332; Score= 22.3; E_value=0.00077; Accession=PF00097.15; Description=Zinc finger, C3HC4 type (RING finger)
MSASDNSRARELAGLTLDDVLGNQKRPSSTPPSQQLPKSRTLLDIIKEDESNKKDRRSWKAFKDKLRLKRAGSAWTSTIHIPTSDVPIPNPNSRIFTQFGHRNSVQSPTQTLTLTHSDSDMSTPYDARQVEDLDPAAADDSGYPATMPPAVRPQFSRRGSTRFDGDPSGENTAGTLRPQLSRRNSTNMPSEPYKRGRVVTFRDTFDDEDDGGEKPGEGRALSAREAVAAQEAAEAAAQEAEEAEEQAPVMMSLMDLLEETDREMGLEGSRYILSDDDEDEDEDDDGGEGSMEHTCCVCMVRHKAAAFIPCGHTFCRMCSRELMVSRGNCPRCNNFILEILDIF

SEQ ID NO: 177904 - protein, 306 aa, Glycine max
  Coding DNA Sequence Number=SeqID_61126
MDYSNDNKEPWDWHREDYCLQRSFNYEISPGIWNGVSQNEDLSFVFNDETTPVKACGDFAYNVNNSGLISESNNVQKESDKCLKSSYQIKRRRMLQFNSQDGGHLLSNEQMSSAYLKGKEEPKEDVFPEFSQWVSGTPGSASASNYEDLESAEGWLADCFKDAEMQLCPDDLNFSGADEVQVDVADLGNFPPACEQNVVQHGFTQTPKNIIFKGGKSFIETPTKLAASVAYPFAFIKPCGAHGDVTLKEINQRILSPPPPLKSQQQSMEDPSAYPKSAFSGKPVVGKTRIHIEGGKGSITIMRTKG

SEQ ID NO: 177905 - protein, 50 aa, Glycine max
  Coding DNA Sequence Number=SeqID_61127
MEITKGDILGVTTSFYAALEKDMTVIEGFRECELIDLNHTLVAVVVESCN

SEQ ID NO: 177906 - protein, 378 aa, Glycine max
  Coding DNA Sequence Number=SeqID_61128
  Gene Ontology: Mol. function=zinc ion binding
  Homolog annotation: Hit_ID=Q1SAG6; Match level="QueryCoverage=99%, HitCoverage=89%, E-value=4e-57, Identity=39%"; Hit description =Cyclin-like F-box; FBD
  Pfam annotation: Domain name=F-box; Domain location=6-54; Score=35.6; E_value=1.7e-07; Accession=PF00646.23; Description=F-box domain
  Pfam annotation: Domain name=FBD; Domain location=297-347; Score =40.6; E_value=5.4e-09; Accession=PF08387.1; Description=FBD
  Pfam annotation: Domain name=LRR_2; Domain location=157-182; Score =19.6; E_value=0.011; Accession=PF07723.3; Description=Leucine Rich Repeat
  Pfam module annotation: Pfam domain module=F-box::FBD::LRR_2; Domain location=6-54::297-347::157-182
MSPMVDRISSLPDTLLCHILSFLPTKEAIATTSLLSKRWSPLWLSVSTLRFNDQCYLQNKDTYFRFLQLVYTVMLSRDVAQPIQRFYLACMSSLCDTSMVNTWVTTVIQRKVQRLELSLPSTINLPCCILTSTTLVVLKLSGLTVNRVSSSPVDLPSLKALHLRRVHFLELRWLLQILSACPLLEDLLIRSLHVTNFSSDEQLKRLPKLVRADISDSFIYIPLTGFYHVEFLRTEVAWNLFFDKNHTFFNLSYLELKFICQFHDWDWLIKLLHQCPNLQILVIDKENGFTKTSVDENWVYPRFVPKGLSSKLKRCCVRNYEGQEGELQFARYIMQNARVLGALTICSTTSSNPEAKLQMIKKLSTCPRISVTCELSFE

SEQ ID NO: 177907 - protein, 208 aa, Glycine max
  Coding DNA Sequence Number=SeqID_61129
  Gene Ontology: Mol. function=ER retention sequence binding; Cellular component=endoplasmic reticulum; Biological process=ER to Golgi vesicle-mediated transport
  Homolog annotation: Hit_ID=Q9ZTN2; Match level="QueryCoverage=63%, HitCoverage=61%, E-value=3e-54, Identity=78%"; Hit description=ER lumen protein retaining receptor
  Pfam annotation: Domain name=ER_lumen_recept; Domain location=77-208; Score=159.1; E_value=1.2e-44; Accession=PF00810.9; Description=ER lumen protein retaining receptor
MEMLWNPVAWGKECGDNNNCGIINVRGLQIVNPQDCLCREPEILRYLGLLIWHPTNPLPLGLGEGQRLFYPLPYEEKGSTSVSLKTQELYALVFACRYLDIFTNYVSLYNTTMKLIFLGSSFSIVWYMRYHKVVRRSYDKDQDTFRHYFLVLPCLLLALLINEKFTLKEVMWTFSLYLEAVAILPQLVLLQRTRNIDNLTGQYVFLLG

SEQ ID NO: 177908 - protein, 78 aa, Glycine max
  Coding DNA Sequence Number=SeqID_61130
  Pfam annotation: Domain name=4F5; Domain location=15-71; Score=61.0; E_value=3.8e-15; Accession=PF04419.5; Description=4F5 protein family
MRGFKKLRESNARSNARGSQRDRDRERAQARTGAKGKQKDDGLTPEQRRERDAKALQEKAAKKAAQGAGGNNAAGSKK

SEQ ID NO: 177909 - protein, 655 aa, Glycine max
  Coding DNA Sequence Number=SeqID_61131
  Gene Ontology: Mol. function=gamma-glutamyltransferase activity; Cellular component=endoplasmic reticulum; Biological process =cellular response to nitrogen starvation
  Homolog annotation: Hit_ID=Q680I5; Match level="QueryCoverage=95%, HitCoverage=99%, E-value=0.0, Identity=54%"; Hit description =Putative gamma-glutamyltransferase
  Pfam annotation: Domain name=G_glu_transpept; Domain location=86-650; Score=720.8; E_value=9.4e-214; Accession=PF01019.11; Description =Gamma-glutamyltranspeptidase
MSRLHKSTTGQQQQFHSLHQILSPYMSSVVVSVLLWHAIAVLLLSNLASAEGIEATNGGTKHRGEVIYAHNGAVATDDGRCSRIGKDVLREGGHAVDAAVASALCLGVVSPASSGLGGGAFMLLRLNNGVAKAFDMRETAPALSCKDMYAGNTTLKAKGGLSVAVPGELAGLHEAWKQHGKLPWKRLVKPAEFLARRGFKVSPYLHMQMEASESDILEDKGLRSIFAPNGKLLNIGDICYNNKLAETLRTISESGPQAFYDGLIGLNLVKDVQNAGGILSMKDLKSYTVKQKEPISNDVLGLTLLGMPPPSGGHPMMLLLNILDQYKLPSGLSGALGFHREIEALKHVFAVRMNLGDPDFVNITGVLSDMLSHSFAKVLKNDINDNKTFGPSHYGSSYVTTRFTTEQLCSERHGLQQNNYLVSRLIQLEPPMSFNRQVKWNPINDHGTSHLSIIDPERNAISMTSTVNSYFGSKILSPSTGIVLNNEMDDFSIPRNVTKDVPPPAPANFIKPGKRPLSSMSPTIVLKDGKLKAVVGASGGGFIIGGTAEVLLNHFVKGLNPFSSVTAPRVYHQLLPNVVNYENWTTVFGDHFEVPADIRKALKSKGHVLKGLAGGTICQFIVLDTIVPSKQNKGIENETLVAVSDPRKGGFPAGF

SEQ ID NO: 177910 - protein, 239 aa, Glycine max
  Coding DNA Sequence Number=SeqID_61132
MTTLTQIWMTLLLSNIQTSDHNSDLPLPKCQLVYTILTRMSIHVAQLIADVIYLFAGMAPTRHPLDPDKSNRALGFPALITGLCQSFGVPVAPSKVIRPPITRAFIEKYCTERQAQGDAPQAADALPPHQAGPAGSFDTEQYLRHLVRQQAANHRAHVQTHDCLYQLSLSLQSQGFTSFPCPTPDQLWAKVAWPRDWPEARAGEAPAEAPAEAPDEANEAREDEEMTDLLDFLGGSGAT

SEQ ID NO: 177911 - protein, 415 aa, Glycine max
  Coding DNA Sequence Number=SeqID_61133
  Gene Ontology: Mol. function=protein dimerization activity; Cellular component=endoplasmic reticulum; Biological process=proteolysis
  Homolog annotation: Hit_ID=Q7N102; Match level="QueryCoverage=99%, HitCoverage=94%, E-value=1e-167, Identity=70%"; Hit description =Aminobenzoyl-glutamate utilization protein A
  Pfam annotation: Domain name=M20_dimer; Domain location=227-328; Score=41.5; E_value=2.8e-09; Accession=PF07687.4; Description =Peptidase dimerisation domain
  Pfam annotation: Domain name=Peptidase_M20; Domain location=113-415; Score=110.8; E_value=4e-30; Accession=PF01546.18; Description =Peptidase family M20M25M40
  Pfam module annotation: Pfam domain module=M20_dimer::Peptidase_M20; Domain location=227-328::113-415
MTNSLSMLVADLYPQLQAWRRDFHRYAESGWFEFRTATLVAEELDRLGYRLQLGREVIKAESRMGLPSSDDLEAQEQRARNQGALEKWLPHFSGGFAGIVATLDTGRPGPTIAYRVDMDALDLNELLEPEHLPFREGFASCNSGMMHACGHDGHTTIGLGLAHVFKSLEPQLSGTVKLIFQPAEEGTRGAKSMVEAGVVDDVDFFTAVHIGTGVPAGELVCGSDSFMATSKLDVTFRGVASHAGARPEDGRNALLAAAQAALGLYAIPRHSEGSSRINVGVLQAGTGRNVIADRAFMKVETRGATNEINAFVYQQALNAIEGAAKMHGVACDIALMGAAQSSKPTQPWVDYIRRQAQQVTELTSVVDRREQAAGSEDATYMMERVKSRGGQASYVIFGTELSAGHHNEKFDFNEQ

SEQ ID NO: 177912 - protein, 154 aa, Glycine max
  Coding DNA Sequence Number=SeqID_61134
  Gene Ontology: Mol. function=RNA-directed DNA polymerase activity; Biological process=RNA-dependent DNA replication
  Homolog annotation: Hit_ID=Q9SS44; Match level="QueryCoverage=43%, HitCoverage=30%, E-value=2e-26, Identity=64%"; Hit description =Transcription initiation factor IIB-2
VPIKLKGKFYRTAVRPAILYGTECWAVKSQHETKVGVAEMRMLRWMCEKTGRLCSEESRPDGEKANKPKKTIKKDLELNDLDRSDDEAAVLPAADGGRQELAGATVGLGDDGGEAAVSFINGVRLQNEAALGAHRVPRRVVEHHLRLPLAVAAE

SEQ ID NO: 177913 - protein, 289 aa, Glycine max
  Coding DNA Sequence Number=SeqID_61135
  Gene Ontology: Mol. function=oxidoreductase activity; Cellular component=proton-transporting two-sector ATPase complex; Biological process=ATP synthesis coupled proton transport
  Homolog annotation: Hit_ID=Q1SCC5; Match level="QueryCoverage=95%, HitCoverage=73%, E-value=1e-122, Identity=75%"; Hit description=2OG -Fe(II) oxygenase
  Pfam annotation: Domain name=2OG-FeII_Oxy; Domain location=209-284; Score=57.3; E_value=5.1e-14; Accession=PF03171.10; Description=2OG -Fe(II) oxygenase superfamily
MDSTYDRKAEVKAFDDSKAGVKGLVESGVTKIPRMFHSGKLDLDIIETSGGDSKLIIPIIDFKDIHSNPALRSEVIGKIRSACHEWGFFQVINHGIPISVLDEMIDGIRRFHEQDTEARKEFYTRDSKKKVVYFSNLGLHSGNPVNWRDTIGFAVSPDPPKPEHIPSVCRDIVIEYTKKIRDVGFTIFELLSEALGLNSSYLNELSCGEGLFTVGNYYPACPEPELTMGAAKHTDGNFMTLLLQDQIGGLQVLHQNQWVNLPPVHGALVVNVGDLLQIGFDASMSEHKA

SEQ ID NO: 177914 - protein, 147 aa, Glycine max
  Coding DNA Sequence Number=SeqID_61136
  Gene Ontology: Mol. function=RNA-directed DNA polymerase activity; Cellular component=intracellular; Biological process=RNA-dependent DNA replication
MASQCNYGEKRQTSTVGYVLTTHTNTKCVQKTPTHYRASTLLVDEASKYPVLSFLDAYSSFNQIQMFPSNEDKMTFLIDNANYYYTIMLFGLENVEVTYQRLMDKIFLNQIERNMRVYVDEMVIKSQNMDSYAKDLAEIFKEMRKWD

SEQ ID NO: 177915 - protein, 762 aa, Glycine max
  Coding DNA Sequence Number=SeqID_61137
  Gene Ontology: Mol. function=protein serine/threonine kinase activity; Cellular component=membrane; Biological process=protein amino acid phosphorylation
  Homolog annotation: Hit_ID=Q1SF47; Match level="QueryCoverage=95%, HitCoverage=86%, E-value=0.0, Identity=47%"; Hit description=Protein kinase; EGF-like, subtype 2; S-locus glycoprotein; Curculin- like (Mannose-binding) lectin; Apple-like
  Pfam annotation: Domain name=B_lectin; Domain location=71-180; Score =106.8; E_value=6.2e-29; Accession=PF01453.15; Description=D-mannose binding lectin
  Pfam annotation: Domain name=PAN_2; Domain location=337-407; Score =71.4; E_value=2.9e-18; Accession=PF08276.2; Description=PAN-like domain
  Pfam annotation: Domain name=Pkinase; Domain location=522-745; Score =132.3; E_value=1.3e-36; Accession=PF00069.15; Description=Protein kinase domain
  Pfam annotation: Domain name=Pkinase_Tyr; Domain location=522-753; Score=107.0; E_value=5.3e-29; Accession=PF07714.7; Description =Protein tyrosine kinase
  Pfam annotation: Domain name=S_locus_glycop; Domain location=195-320; Score=129.1; E_value=1.2e-35; Accession=PF00954.11; Description=S -locus glycoprotein family
  Pfam module annotation: Pfam domain module=B_lectin::PAN _2::Pkinase::Pkinase_Tyr::S_locus_glycop; Domain location=71-180::337- 407::522-745::522-753::195-320
MCFSSCANLFFVLFILFCYVLDVAIAVDTITSSQPVKDPETLRSKDGNFTLGFFSPQNSKNRYVGIWWKSQSTVVWVANRNQPLNDSSGIITISEDGNLVVLNGQKQVVWSSNVSNTSSNTTSQFSDYGKLVLTETTTGNILWDSFQQPSDTLLPGMKLSSNSTSMRVKLASWKSPSNPSVGSFSSGVVERINILEVFVWNETQPYWRSGPWNGGIFTGIPSMSPYRNGFKGGDDGEANTEIYYTVPSALTFTIYMLNSQGQYEEKWWYDEKKEMQLVWTSQESDCDVYGMCGPFTSCNAQSSPICSCLKGFEPRNKEEWNRQNWTGGCVRRTQLQCERVKDHNTSRDTKEDGFLKLQMVKVPDFPEGSPVEPDICRSQCLENCSCVAYTHDDGIGCMSWTGNLLDIQQFSEGGLDLYIRVAHTELDKGTNTKIIITITVIIGTVMIVTCAYVMWRTSNHPGRIWNLIKSARKGNNRAFVRFNNDETPNHPSHKVIEELSQVTLPELLLFNFERVATATNSFDLSNKLGQGGFGPVYKGKLQDGQEIAVKRLSRASGQGLEEFMNEVVVISKLQHRNLVRLFGCCAEGDEKMLIYEYMPNKSLDVFIFDQSRSKLLDWRKRSSIIEGIARGLLYLHRDSRLRIIHRDLKASNILLDEELNPKISDFGMARIFGGTEDQANTNRIVGTYGYMSPEYAMQGLFSEKSDVFSFGVLVLEIVSGRRNSSFYDNVHALSLLGFVCLNNSFLTHLQGFLPFAGTTSKH

SEQ ID NO: 177916 - protein, 653 aa, Glycine max
  Coding DNA Sequence Number=SeqID_61138
  Gene Ontology: Mol. function=protein serine/threonine kinase activity; Cellular component=membrane; Biological process=protein amino acid phosphorylation
  Homolog annotation: Hit_ID=Q1SF47; Match level="QueryCoverage=98%, HitCoverage=85%, E-value=1e-148, Identity=44%"; Hit description =Protein kinase; EGF-like, subtype 2; S-locus glycoprotein; Curculin- like ...
  Homolog annotation: Hit description=(Mannose-binding) lectin; Apple -like
  Pfam annotation: Domain name=Adeno_E3_CR2; Domain location=435-478; Score=7.7; E_value=0.08; Accession=PF02439.6; Description=Adenovirus E3 region protein CR2
  Pfam annotation: Domain name=B_lectin; Domain location=70-180; Score =98.6; E_value=1.9e-26; Accession=PF01453.15; Description=D-mannose binding lectin
  Pfam annotation: Domain name=PAN_2; Domain location=340-410; Score =78.5; E_value=2.1e-20; Accession=PF08276.2; Description=PAN-like domain
  Pfam annotation: Domain name=Pkinase; Domain location=511-653; Score=- 48.3; E_value=1.1e-05; Accession=PF00069.15; Description=Protein kinase domain
  Pfam annotation: Domain name=Pkinase_Tyr; Domain location=511-651; Score=-47.0; E_value=1.4e-09; Accession=PF07714.7; Description =Protein tyrosine kinase
  Pfam annotation: Domain name=S_locus_glycop; Domain location=195-323; Score=120.3; E_value=5.5e-33; Accession=PF00954.11; Description=S -locus glycoprotein family
  Pfam module annotation: Pfam domain module=Adeno_E3_CR2::B _lectin::PAN_2::Pkinase::Pkinase_Tyr::S_locus_glycop; Domain location= 435-478::70-180::340-410::511-653::511-651::195-323
MGSSSCVKFFFVFILCCHVLDVGTAIDTITSSQSIKDTETLTSTDGNFTLGFFTPQNSTNRYVGIWWKSQSTVIWVANRNQPLNDSSGIVTISEDGNLVVLNGHKQVIWSTNVSKTSFNTSSQFSDSGKLVLAETTTGNILWDSFQQPSNTLLPGMKLSINKSTGKKVELTSWESPYNPSVGSFSSSLVQRKNIVELFIFNGTQLYWRSGPWNGGIFTGIAYMSTYLNGFKGGDDGEGNINIYYTVSSELGPLGFLIYMLNSQGRLEEKWWDDEKQEMGLMWASRKSDCDIYAICGSFAICNAQSSPICSCLKGFEPRNKEEWNRQHWTSGCVRNTGLLCERVKDQNTSIDTNEDGFLELQMVKVPDFPERSPVDPDKCRSQCLENCSCVAYSHEEMIGCMSWTGNLLDIQQFSSNGLDLYVRGAYTELEHDEGTNTTIIIIITVTIGTVFIVICACAYVMWRTSNHPGVKVTLSFSFQLKYGTRSSQEGKGATNIWLVLTMGVVAATNNFHLSNKLGQGGFGPVYKGKLPDGQEIAVKRLSRASGQGLEEFMNEVVVISKLQHRNLVKLFGCCAEGIGRGLLYLHRDSRLKIIHRDLKASNVLLDEALNPKISDFGMARIFGGTEDQANTNRRLLVEEGTQDFTTTTMLLAF

SEQ ID NO: 177917 - protein, 843 aa, Glycine max
  Coding DNA Sequence Number=SeqID_61139
  Gene Ontology: Mol. function=protein serine/threonine kinase activity; Cellular component=membrane; Biological process=protein amino acid phosphorylation
  Homolog annotation: Hit_ID=Q1SF47; Match level="QueryCoverage=96%, HitCoverage=95%, E-value=0.0, Identity=48%"; Hit description=Protein kinase; EGF-like, subtype 2; S-locus glycoprotein; Curculin- like (Mannose-binding) lectin; Apple-like
  Pfam annotation: Domain name=B_lectin; Domain location=71-181; Score =93.2; E_value=8.1e-25; Accession=PF01453.15; Description=D-mannose binding lectin
  Pfam annotation: Domain name=PAN_2; Domain location=339-409; Score =71.2; E_value=3.3e-18; Accession=PF08276.2; Description=PAN-like domain
  Pfam annotation: Domain name=Pkinase; Domain location=525-802; Score =139.3; E_value=1.1e-38; Accession=PF00069.15; Description=Protein kinase domain
  Pfam annotation: Domain name=Pkinase_Tyr; Domain location=525-796; Score=123.6; E_value=5.5e-34; Accession=PF07714.7; Description =Protein tyrosine kinase
  Pfam annotation: Domain name=S_locus_glycop; Domain location=196-322; Score=100.2; E_value=6.1e-27; Accession=PF00954.11; Description=S -locus glycoprotein family
  Pfam module annotation: Pfam domain module=B_lectin::PAN _2::Pkinase::Pkinase_Tyr::S_locus_glycop; Domain location=71-181::339- 409::525-802::525-796::196-322
MGFSSRANLFFVLLMLCCCVLDVGIAIDTITSSQSIKDPEVLTSKDGNFTLGFFTPQNSTNRYVGIWWKSQSTIIWVANRNQPLNDSSGIVTIHEDGNLVLLKGQKQVIWTTNLSNSSSNRTSQFSDYGKLVLTEATTGNILWDSFQQPSNTLLPGMKLSTNNSTGKKVELTSWKSPSNPSVGSFSSGVVQGINIVEVFIWNETQPYWRSGPWNGRLFTGIQSMATLYRTGFQGGNDGEGYANIYYTIPSSSEFLIYMLNLQGQLLLTEWDDERKEMEVTWTSQDSDCDVYGICGSFAICNAQSSPICSCLKGFEARNKEEWNRQNWTGGCVRRTQLQCERVKDHNTSTDTKEDGFLKLQMVKVPYFAEGSPVEPDICRSQCLENCSCVAYSHDDGIGCMSWTGNLLDIQQFSDAGLDLYVRIAHTELDKGKNTKIIIIITVIIGAVVIITCSCAYVMRRTSNHPAKIWHLIKLRKGNRNGFVQSKFDETPEHPSHRVIEELTQVQQQEMFVFDFKRVATATNNFHQSNKLGQGGFGPVYKGKLQDGQEIAVKRLSRASGQGLEEFMNEVVVISKLQHRNLVRLFGSCIEGEEKMLLYEYMPNKSLDVFIFDPSKSKLLDWRKRISIIEGIARGLLYLHRDSRLRIIHRDLKASNILLDEELNPKISDFGMARIFGGTEDQANTLRVVGTYGYMSPEYAMQGLFSEKSDVFSFGVLVLEIVSGRRNSSFYDNENFLSLLGFAWIQWKEGNILSLVDPGTYDPSYHKEILRCIHIGFLCVQELAVERPTMATVISMLNSDDVFLPPPSQPAFILRQNMLNSVSSEEIHNFVSINTVSITDIHGR

SEQ ID NO: 177918 - protein, 237 aa, Glycine max
  Coding DNA Sequence Number=SeqID_61140
  Gene Ontology: Mol. function=oxidoreductase activity, acting on single donors with incorporation of molecular oxygen, incorporation of two atoms of oxygen; Cellular component=proton-transporting two -sector ATPase ...
  Gene Ontology: Cellular component=complex; Biological process=ATP synthesis coupled proton transport
  Homolog annotation: Hit_ID=Q1SCC5; Match level="QueryCoverage=99%, HitCoverage=90%, E-value=6e-37, Identity=58%"; Hit description=2OG -Fe(II) oxygenase
  Pfam annotation: Domain name=2OG-FeII_Oxy; Domain location=118-219; Score=69.6; E_value=9.9e-18; Accession=PF03171.10; Description=2OG -Fe(II) oxygenase superfamily
MVVKNINQLEENIDSTYDRKAEVKAFNDPKAGVKASDSKFSIPIIDLKDIHSGPALHSEIISKTRSACHEWVFFQVISHGIPISVLDKMIDGIRRFHEQVTEASGLHPSYLKELNCAEGLFILGHYYPACPEPELTMGTTKHTDSNFMTLLLQDQLGGLQVLHQNQWVNVPPVHGALVLITNDEFVSVYHLCDEFVSVYHRVLSQNTPKNIVASFFLNSHDSVEGTSRVLLDARNIL

SEQ ID NO: 177919 - protein, 164 aa, Glycine max
  Coding DNA Sequence Number=SeqID_61141
  Homolog annotation: Hit_ID=Q5SND3; Match level="QueryCoverage=44%, HitCoverage=13%, E-value=2e-16, Identity=63%"; Hit description =Putative PPR2
  Subcellular localization annotation: CTP_CleavageSite=49; ConfidenceScore=5.50e-01
MASLSTTAPGVPPFPPPTAARRAASRRFQASPRLDPEPDPEPPSPSSLSASLVVTDERTRRIARELEKLKARERKEMRNRKVASQKAVSVILWREATKAMIDKSGGGRKKKGPINSKKLLPRTVLEALHERVTALRWESALKVFSCSLSQVQCGVSLGWDEVTG

SEQ ID NO: 177920 - protein, 385 aa, Glycine max
  Coding DNA Sequence Number=SeqID_61142
  Gene Ontology: Mol. function=protein serine/threonine kinase activity; Cellular component=membrane; Biological process=protein amino acid phosphorylation
  Homolog annotation: Hit_ID=Q9ZT06; Match level="QueryCoverage=99%, HitCoverage=69%, E-value=4e-47, Identity=44%"; Hit description =Receptor-like protein kinase
  Pfam annotation: Domain name=B_lectin; Domain location=41-110; Score =5.2; E_value=0.00078; Accession=PF01453.15; Description=D-mannose binding lectin
  Pfam annotation: Domain name=Pkinase_Tyr; Domain location=298-385; Score=-162.3; E_value=0.016; Accession=PF07714.7; Description =Protein tyrosine kinase
  Pfam module annotation: Pfam domain module=B_lectin::Pkinase_Tyr; Domain location=41-110::298-385
TPSQSIKDPETLRSKDGKFTLGFFTPQNSTNRYVGIWWMSQSTIIWVADRNQPLNDSSGKVTISEDGNLVLVLMEASTGNILWDSFQHPSNTLLPGLELTTNIRAVVHGMVGSLHGYRTRTLRILMAFKANKKKQGGMMRRKTRKFHGLVQNPIVIQGSKGNGIDKTGVVDALGAQACSVKRTVEDQKHKTGCMSWTGNLLDIQQFSSAELVLYVRVAYAELEHVIIAAILIVTCACAMWRTYNHQARKRNNKASLLFNNDETSEHPSQKVIEELSQVTLPELLQLDFEMVAIATNNFHLPNKLGQGGFGPVYKGKLQDGQEIAVKRLSRASGQGLEEFMNEVVVISKLQHRNLVKLFGCCIEGDEKMLIYEYMPNKSLDVLIFG

SEQ ID NO: 177921 - protein, 224 aa, Glycine max
  Coding DNA Sequence Number=SeqID_61143
  Gene Ontology: Mol. function=DNA binding; Cellular component=nucleus; Biological process=regulation of transcription
  Homolog annotation: Hit_ID=Q0PJH0; Match level="QueryCoverage=75%, HitCoverage=100%, E-value=1e-86, Identity=91%"; Hit description=MYB transcription factor MYB111
  Pfam annotation: Domain name=Myb_DNA-binding; Domain location=28-63; Score=19.2; E_value=0.015; Accession=PF00249.21; Description=Myb -like DNA-binding domain
  Pfam annotation: Domain name=Myb_DNA-binding; Domain location=69-114; Score=47.2; E_value=5.5e-11; Accession=PF00249.21; Description=Myb -like DNA-binding domain
  Pfam module annotation: Pfam domain module=Myb_DNA-binding::Myb_DNA -binding; Domain location=28-63::69-114
MDVKKGGSVVQAQVKLQKHNEKEMGMRKGPWAVEEDTILVNYIATHGLRRSGKSCRLRWLNYLRPDVRRGNITLQEQILILDLHSRWGNRWSKIAQQLPGRTDNEIKNYWRTRVIKQAKQLKCDVNSKQFRDTLRYVWMPRLLERLQPTSQALEPNQSGLVLHASSSLLPSNSDHSIERGSDLWPGFNNQMLLEQGSGGDLLESLWDDDNMCFLQQLSYDLQMK

SEQ ID NO: 177922 - protein, 350 aa, Glycine max
  Coding DNA Sequence Number=SeqID_61144
  Gene Ontology: Mol. function=transcription regulator activity; Cellular component=nucleus; Biological process=regulation of transcription
  Homolog annotation: Hit_ID=Q5SND3; Match level="QueryCoverage=95%, HitCoverage=65%, E-value=1e-139, Identity=71%"; Hit description =Putative PPR2
  Pfam annotation: Domain name=PPR; Domain location=135-169; Score =19.0; E_value=0.018; Accession=PF01535.11; Description=PPR repeat
  Pfam annotation: Domain name=PPR; Domain location=170-204; Score =15.1; E_value=0.12; Accession=PF01535.11; Description=PPR repeat
  Pfam annotation: Domain name=PPR; Domain location=205-239; Score =40.1; E_value=7.5e-09; Accession=PF01535.11; Description=PPR repeat
  Pfam annotation: Domain name=PPR; Domain location=240-274; Score =16.9; E_value=0.074; Accession=PF01535.11; Description=PPR repeat
  Pfam annotation: Domain name=PPR; Domain location=275-309; Score =40.1; E_value=7.5e-09; Accession=PF01535.11; Description=PPR repeat
  Pfam annotation: Domain name=PPR; Domain location=28-62; Score=29.0; E_value=1.7e-05; Accession=PF01535.11; Description=PPR repeat
  Pfam annotation: Domain name=PPR; Domain location=310-344; Score=7.1; E_value=1.1; Accession=PF01535.11; Description=PPR repeat
  Pfam annotation: Domain name=PPR; Domain location=64-98; Score=20.0; E_value=0.0084; Accession=PF01535.11; Description=PPR repeat
  Pfam annotation: Domain name=PPR; Domain location=99-133; Score=33.8; E_value=6e-07; Accession=PF01535.11; Description=PPR repeat
  Pfam module annotation: Pfam domain module=PPR::PPR::PPR::PPR::PPR::PP R::PPR::PPR::PPR; Domain location=135-169::170-204::205-239::240 -274::275-309::28-62::310-344::64-98::99-133
MLGKCKQPEKAHELFQAMVDEGCVLDCESYTALLSAYSRSGLLDKAFSLLEEMKNTPGCQPDVQTYSILLKSCLQVFAFDKIQSLLSDMTNRGIKPNTVTYNTLIDAYGKARKFSEMESILVEMLADRYCQPDVWTMNSTLRAFGNIGQIETMEKCYEKFQNAGIQPNVQTFNILLDSYGKAQDYKKMSAVMEYMQKYHYSWTIVTFNIVIDAFGKAGDLKQMEYLFRLMRSERIKPSCVTLCSLVRAYARAGKPEKISGVLRFVENSDVLLDTVFFNCLVDAYARLGCLAEMKGVLEMMKQNGCKPDIVTYRTMIKTYTYKGMDSHAKELRELLPTVNRPPLKRDKPDF

SEQ ID NO: 177923 - protein, 282 aa, Glycine max
  Coding DNA Sequence Number=SeqID_61145
  Gene Ontology: Mol. function=DNA binding; Cellular component=nucleus; Biological process=regulation of transcription
  Homolog annotation: Hit_ID=Q0PJK7; Match level="QueryCoverage=99%, HitCoverage=100%, E-value=7e-97, Identity=64%"; Hit description=MYB transcription factor MYB76
  Pfam annotation: Domain name=Myb_DNA-binding; Domain location=33-80; Score=45.6; E_value=1.7e-10; Accession=PF00249.21; Description=Myb -like DNA-binding domain
  Pfam annotation: Domain name=Myb_DNA-binding; Domain location=86-131; Score=48.0; E_value=3.1e-11; Accession=PF00249.21; Description=Myb -like DNA-binding domain
  Pfam module annotation: Pfam domain module=Myb_DNA-binding::Myb_DNA -binding; Domain location=33-80::86-131
MDTISVQAMRSLSDSDSLSSATYASEEDMKIKKGPWTEEEDSVLINYVNFQGEGQWNSLARSAGLKRTGKSCRLRWLNYLRPNVRRGNITLQEQLLILELHSRWGNRWAKIAEELGGRTDNEIKNYWRTRVVKQAKQLKCDVNSKQFRDTVRFVWMPRLMEQIQASFRIVPSDSSHGLDQTTLCNTQQTESSTDANPTMFCDNSMVSSYSSEVDLQPLSLSDTSTTSSSESAEKKESISSSLWQQWDYSDLQAFEPCNGFGDADLWTDENIWFLQQHLADHL

SEQ ID NO: 177924 - protein, 279 aa, Glycine max
  Coding DNA Sequence Number=SeqID_61146
  Gene Ontology: Mol. function=RNA-directed DNA polymerase activity; Cellular component=plastid chromosome; Biological process=RNA -dependent DNA replication
  Homolog annotation: Hit_ID=Q1RUM6; Match level="QueryCoverage=81%, HitCoverage=44%, E-value=1e-100, Identity=77%"; Hit description =Pentatricopeptide repeat
  Pfam annotation: Domain name=PPR; Domain location=104-138; Score=3.3; E_value=3; Accession=PF01535.11; Description=PPR repeat
  Pfam annotation: Domain name=PPR; Domain location=139-173; Score =22.0; E_value=0.0021; Accession=PF01535.11; Description=PPR repeat
  Pfam annotation: Domain name=PPR; Domain location=174-208; Score=5.7; E_value=1.6; Accession=PF01535.11; Description=PPR repeat
  Pfam annotation: Domain name=PPR; Domain location=209-243; Score =25.7; E_value=0.00016; Accession=PF01535.11; Description=PPR repeat
  Pfam module annotation: Pfam domain module=PPR::PPR::PPR::PPR; Domain location=104-138::139-173::174-208::209-243
MLLRRYSVESPSNCIPPSTLILHRLLSSNQNQDVEKVLGILSSISTPEQLKQSLKSIVNILDEMRDRDLSPDVITYTCIICGLGLIGQPDKARNVLKEYGCYPDAAAYNIRNFCIAKRLGDAPGLVEEMASKGLSPNATTYNLFFRVFCWSNDLQSSWNMYQRMMIEGCLPNTQFCMFLMRLFKRHEKVEMAMQLWGDMVEKGFGSYTLVSDVLFDLLCDMGKLEEAEKCFLEMVEKGQKPSHVSFRRIKVLMELANRHEALQSLTQKMAIFRRPLQVR

SEQ ID NO: 177925 - protein, 84 aa, Glycine max
  Coding DNA Sequence Number=SeqID_61147
MGFEVFHPHLQLVGLWPRDSFASGDRKRRDPMRHEEKLSLEMSRSTAKLKVWPNLLPFWWKLQPSPLRSNDAVSLVEILGGGEG

SEQ ID NO: 177926 - protein, 77 aa, Glycine max
  Coding DNA Sequence Number=SeqID_61148
  Gene Ontology: Mol. function=catalytic activity; Biological process =metabolic process
MNAKRREDMVGVLPRKRILMQHGELQGIRDTTSYTIIPDHNIQSTLYMSPYARTQSTLRELKRCFLKKRIIGVREQS

SEQ ID NO: 177927 - protein, 321 aa, Glycine max
  Coding DNA Sequence Number=SeqID_61149
  Gene Ontology: Mol. function=calmodulin binding
  Homolog annotation: Hit_ID=Q9FJI9; Match level="QueryCoverage=94%, HitCoverage=60%, E-value=1e-107, Identity=62%"; Hit description =Similarity to calmodulin-binding protein
  Pfam annotation: Domain name=Calmodulin_bind; Domain location=30-319; Score=489.9; E_value=3.1e-144; Accession=PF07887.2; Description =Calmodulin binding protein-like
VKEEVEAALKRHLTSMKQTCGKEFHTTELRNLQLQFENSICLPVFTGARIEGEDGSNLRISLVDALTGKVVSTGPESSAKVEIVVLEGDFEEESETWMPEEFKSNIVREREGKKPLLTGDVILYLKDGIGMVGEISYTDNSSWTRSRRFRLGARVVDNFDGVGIREAKTESFIVRDHRGELYKKHHPPSLSDEVWRLEKIGKDGAFHKRLSREKILTVREFLTLLNLDPAKLRSILGTGMSAKMWEVTVEHARTCVLDTTRHVYFPSNSQEPGVVFNAVGQVTGLLSECEYVTVEKLTETEKAFIPHHLLLSLLFPSFSSL

SEQ ID NO: 177928 - protein, 60 aa, Glycine max
  Coding DNA Sequence Number=SeqID_61150
  Gene Ontology: Mol. function=zinc ion binding; Cellular component =intracellular
  Homolog annotation: Hit_ID=Q53J16; Match level="QueryCoverage=80%, HitCoverage=26%, E-value=4e-19, Identity=83%"; Hit description =Pollen-specific protein SF3, putative
  Pfam annotation: Domain name=LIM; Domain location=11-60; Score=17.3; E_value=5.4e-05; Accession=PF00412.12; Description=LIM domain
MASFAGTTQKCTACEKKVYWVEQLTADNKVYHKSCFRCHHCKGTLKVENRETEYEECVPE

SEQ ID NO: 177929 - protein, 492 aa, Glycine max
  Coding DNA Sequence Number=SeqID_61151
  Homolog annotation: Hit_ID=Q1SR88; Match level="QueryCoverage=67%, HitCoverage=62%, E-value=7e-12, Identity=33%"; Hit description=IMP dehydrogenase/GMP reductase
  Pfam annotation: Domain name=DUF674; Domain location=1-444; Score =102.9; E_value=9.2e-28; Accession=PF05056.3; Description=Protein of unknown function (DUF674)
MASNQEATIPLRYWVDNEQKRVVMAEASGDFVDVLFSFLTLPLGTIIRLGNQFQQPVEIGCINNLYESVQNLRPDVFWNNICQKMLLAPRNPLEASYQRLKVKVDGTEPTKKLMRKKMELLEESKDEASGVDGVFVKGDAMFLIFDDLKVLRSSPSDSLQTPLLFGHTDFSKMQEMSQDVGPREKVQIHWIQNIFVTCTYDMYIFSILKHALTSKSPLSDVFIPNRKKIEPSYSFSPDTGPSHWKGSVEIKLMVSKSKNKVLFAEADGDFVDFLVSFLTTPLGSILNLMNGKSSLGSIDNLYASVKKLNASWFIGSSNKSLLNPRVAPQFGCGSNPLNASQEYTPTYWYGTVVVKDNNEGRTMISKKKEMLEYPAKLKLFEPRCYDGAREAAVGFMKRPCLFVVSDDLKVRQLTTTSSIQYMQELGNVKFDDLKEHMVEIRKSHEALNLLRASLTSKEVGLTRSLLKKWKCQRCIPFWDSILGCVGMEENET

SEQ ID NO: 177930 - protein, 94 aa, Glycine max
  Coding DNA Sequence Number=SeqID_61152
  Gene Ontology: Mol. function=zinc ion binding; Cellular component =intracellular
  Homolog annotation: Hit_ID=Q53J16; Match level="QueryCoverage=60%, HitCoverage=30%, E-value=3e-25, Identity=80%"; Hit description =Pollen-specific protein SF3, putative
  Pfam annotation: Domain name=LIM; Domain location=1-45; Score=29.3; E_ value=2e-06; Accession=PF00412.12; Description=LIM domain
VAVDGKSYHKSCFRCTHGGCVISPSNYIAHEHRLYCRHHHTQLFKQKGNFSQLDKHENVQVITEITITQHTENTTQHPDPSNGNTDTTPAEESS

SEQ ID NO: 177931 - protein, 82 aa, Glycine max
  Coding DNA Sequence Number=SeqID_61153
MRDEEAKRNQGCCGGEIRRGKEWRRERRRGEEKESGDEEKEMRCDSDTNSDDGVAVVAMTMTMTMMETMVVAIVMEEGGNKP

SEQ ID NO: 177932 - protein, 79 aa, Glycine max
  Coding DNA Sequence Number=SeqID_61154
MDKLRLSSIVRTPIAASNKIDVSAVPECGVRLSYVVARGSQVYPSNLPNKAMAIFVDDKDFRSRGDYHINEEKTHKPES

SEQ ID NO: 177933 - protein, 177 aa, Glycine max
  Coding DNA Sequence Number=SeqID_61155
  Gene Ontology: Mol. function=molecular_function; Cellular component =membrane; Biological process=auxin mediated signaling pathway
  Homolog annotation: Hit_ID=Q9FL08; Match level="QueryCoverage=98%, HitCoverage=50%, E-value=1e-24, Identity=33%"; Hit description =Nodulin-like protein
MEKLKIGSSISKIKVIGAVLSISGALVVTLYKGSFIITFRIQPSLLDETSNWVIGGLVFAIASVSFAAWNITQAVILKEYSSQSTIIAYYCLFGTIQSEILSLFVVRDSNVWKISPNDKLICIFYSAIAGSAVTFSVTAWCIKRKGPVFVSMFKPAGIAIAAFSSVVFLCETLHFGR

SEQ ID NO: 177934 - protein, 1428 aa, Glycine max
  Coding DNA Sequence Number=SeqID_61156
  Gene Ontology: Mol. function=DNA binding; Cellular component=nucleus; Biological process=transcription
  Homolog annotation: Hit_ID=Q53J12; Match level="QueryCoverage=99%, HitCoverage=88%, E-value=0.0, Identity=41%"; Hit description=BAH domain-containing protein, putative
  Pfam annotation: Domain name=TFIIS; Domain location=148-234; Score =39.0; E_value=1.6e-08; Accession=PF08711.1; Description =Transcription factor S-II (TFIIS)
  Subcellular localization annotation: CTP_CleavageSite=34; ConfidenceScore=5.75e-01
MQPGGRSPKPVSSPTSTSQLKSGSDSVQNSVSSFSSHVKGRKRERVDQGQESVKRDRSTKNDDGDSGNFKADSILKTEIAKVTEKGGLIDPEGVEKLVQLMVPDGNEKKIDLASRSMLAAVIAATEKFDCLSRFVQLKGLPVFDEWLQEAHKGKLGEGIGSRDGDKSVDDFLFVLLRALDKLPVNLQALQACNIGKSVNHLRTHKNLEIQKKARGLVDTWKKRVEAEMIINDARSCSVQTVPWPARQRLSEVAQGGNKHSSGSADVAMKSSVTQLSASKTASPKIAPGENTTRSTSASPGSTKSVPSPAPATANLKDGQPHAAAVSGSSDLPVANARDEKSSSSSPSHNSQSYSSDHAKAGGFSGKEDARSSTAMSVNKVSGGSSRHRRSMNGFPGSTPSRRQRETGSSRNSSHKNLISEKISQSGLREKANDGTLLEGHTPKLIVKIPNRGRSPAQSATAGSSDDPSIMNSRASSPALSEKHDQFDRCSKEKSDFYRANIGADINTESWQSNDFKDVLTGSDEGDGSPAAITDEQCRTGEDCKKVSDVSKTTSSSPGSESKARNLQDASYSSINALIEGVKYTEADDVGMNLLARVAAGEISKSESGMPAGSPKKNTTTIEQSYAGNAAVVKSSEEYLVQDKCYSNAEHMKQDSRSGDFGTDDDIRAFEGKATGEHNPSSMDLQVTETSLESKGKLIVKSSGTSAGIPESTFQEVRDIDSSKLVKEKKVVVRVDAVNNVDEVNVVAREGETEAIEKLSHTCEEVDVKCDNHASEGLSCDKETAGKSPATCVPSDSVKATDENALQSSGYIVDKVPEYLNERESEKNDDMAAQDHAKQSLKQKNESENDAIMVPENRGLCSGATGLDAEYVEENSGTKEVCDQDAGAGQILHTDLPSFPSREMDQHSGQRDSKLAAMESEEAEECTSTTGDASSASVAGVSEVDTKVEFDLNERLNADDGKCSEIPGSTPAARLVSPVPFSASSMSFGILSITVAAAAAAKGPFVPHEDLLKSKKELGWKGSAATSAFRPAEPRKVMEIPLDMSTTPIPNDEARKQSRVPLDFDLNVSDEIILDDLSSQNCARQTDCVTRSDDGHDPNKSMASHVRCSGGLGLDLNLVDGASDVGNCTLSSSHKMDVPLTQFKSAASGPPNGKMSVLRDFDLNDGPIVDEVTTEHLMSTRSARNSVPSQPPISGLRMSNAEVGNVSSWFPSTGNTYSAVTISSIMSDRGDKPFSIVAPNVSERVLGPATGSNPFGPDIYRGAVLSSSPAVPYQSAPFQYPVFPFNSSFPLPSASFSGGSTPYVDTTSGGRLCFPVVNSQLIGSVGNVSAHYPRPYVVSFPDGSNSSGAENSRKRARQGLDLNAGPGSDLEGRDESSPLVPRQLSVASSQAQLEEQARMFHLSSDVLKRKEPDGGWDGYKQSSWQYHNL

SEQ ID NO: 177935 - protein, 499 aa, Glycine max
  Coding DNA Sequence Number=SeqID_61157
  Gene Ontology: Mol. function=serine-type endopeptidase activity; Cellular component=chloroplast thylakoid membrane; Biological process=proteolysis
  Homolog annotation: Hit_ID=Q6Z806; Match level="QueryCoverage=92%, HitCoverage=77%, E-value=0.0, Identity=73%"; Hit description =Putative DegP2 protease
  Pfam annotation: Domain name=Trypsin; Domain location=127-314; Score =66.4; E_value=9.5e-17; Accession=PF00089.16; Description=Trypsin
MGDNKRKRGRKAKTPASETLDHPAPVTTTAPNSTSTAMDDVFSVGNVELIDTTASPHHRRLRARPNHSEKPHALPTGRRHARPLDNGGGDFSVPSDVVGVSPAVAMEADPAAWVARALPAMDSVVKVFCVHTEPNFSLPWQRKRQYSSSSSGFVIGGRRVLTNAHSVEHYTQVKLKKRGSDTKYLATVLAIGTECDIAMLTVDDDEFWQGMSPVEFGELPTLQDAVTVVGYPIGGDTISVTSGVVSRIEILSYVHGSTELLGLQIDAAINSGNSGGPAFNDKGNCVGIAFQSLKHEDAENIGYVIPTPVIMHFIQDYEKNGGYTGFPILGVEWQKMENPDLRMAMGMKPDQKGVRIRRIDPTAPESKVLKPSDVILSFDGVDIANDGTVPFRHGERIGFSYLISQKYTGDNAAIKVLRNSDIFKFDIKLDSHRRLIPAHSKGKPPSYYIIAGFVFTTVSVPYLRSEVLLFVLLLLILIWMHFRFSALSMFLPPKWHLNV

SEQ ID NO: 177936 - protein, 191 aa, Glycine max
  Coding DNA Sequence Number=SeqID_61158
  Gene Ontology: Mol. function=GTP binding; Cellular component =intracellular; Biological process=small GTPase mediated signal transduction
  Homolog annotation: Hit_ID=Q0PZE6; Match level="QueryCoverage=78%, HitCoverage=64%, E-value=9e-50, Identity=67%"; Hit description=Small GTPase
  Pfam annotation: Domain name=Ras; Domain location=3-147; Score=45.4; E_value=1.1e-12; Accession=PF00071.12; Description=Ras family
MAKVVMFHLLPLSSLGQEDYNRLRPLSYRGADVFVLAFSLVSHASYENVLKKWVPELQHFAPGIPVVLVGTKLDLREDKHYLADHPGLVPVTSEQGEELRKLVGATYYIECSSKTQQLSTPGETSLVVVVNMNVKSVFDAAIKVVIKPPQKQEKKKPRRGCLLSVHFFHIITTPARETFLLVKRDSSISVY

SEQ ID NO: 177937 - protein, 109 aa, Glycine max
  Coding DNA Sequence Number=SeqID_61159
MGYPSMILNPQDVNQPFFHVKNPPNSQHLQGEKEKEKDQMGVKRNLVEWTPFIAMATVECLDVELSTLSKAAMSRGMNHFVLVGYSNALATLILLPSPFFIDSYTLTFS

SEQ ID NO: 177938 - protein, 329 aa, Glycine max
  Coding DNA Sequence Number=SeqID_61160
  Gene Ontology: Mol. function=metal ion binding; Cellular component =integral to membrane; Biological process=ubiquitin cycle
  Homolog annotation: Hit_ID=Q8GW38; Match level="QueryCoverage=79%, HitCoverage=72%, E-value=6e-54, Identity=43%"; Hit description=RING -H2 finger protein ATL1D
  Pfam annotation: Domain name=PHD; Domain location=142-184; Score=1.0; E_value=0.045; Accession=PF00628.19; Description=PHD-finger
  Pfam annotation: Domain name=zf-C3HC4; Domain location=140-181; Score= 29.2; E_value=1.5e-05; Accession=PF00097.15; Description=Zinc finger, C3HC4 type (RING finger)
  Pfam module annotation: Pfam domain module=PHD::zf-C3HC4; Domain location=142-184::140-181
MRSINGKLKYSSYYPQSPFSAFEAPNDGNISNNKEATTPSSLSRISPLILLVIIVLAVIFFVYGLVHLILWFFMKRPLSPSSLYSYSNRFHENSTRSRVLQRQLQQLFRLHDSGLDQALIDALPVFYYQELLGSKEPFDCAVCLCEFSKEDKLRLLPMCTHAFHMNCLDMWLLSNSTCPLCRASLSEYMENQNQNQNSMLNVGNSNSLVLPRGEEENNGCSDSQRSVGKRVFSVRLGKFRNSGVEGGEVGGDGGCSLNERRCYSMGSYRYVVRDLNLQVVLSHGDDVLENGNVEGKRIGDSTKGESFSVSKIWLWSKNTTFHDSNAPFP

SEQ ID NO: 177939 - protein, 75 aa, Glycine max
  Coding DNA Sequence Number=SeqID_61161
MAEDYLQEEKKRVRNPFVPIENRIEKEFRWFIIRENSLQYSIAELHQDKITESHNRKGEADSIFHLSNSIQLSTR

SEQ ID NO: 177940 - protein, 244 aa, Glycine max
  Coding DNA Sequence Number=SeqID_61162
  Gene Ontology: Mol. function=molecular_function; Cellular component =membrane; Biological process=auxin mediated signaling pathway
  Homolog annotation: Hit_ID=Q9FL08; Match level="QueryCoverage=77%, HitCoverage=52%, E-value=4e-29, Identity=34%"; Hit description =Nodulin-like protein
  Pfam annotation: Domain name=DUF6; Domain location=82-208; Score =47.7; E_value=4e-11; Accession=PF00892.11; Description=Integral membrane protein DUF6
  Pfam annotation: Domain name=TPT; Domain location=71-208; Score= -23.8; E_value=0.014; Accession=PF03151.7; Description=Triose -phosphate Transporter family
  Pfam module annotation: Pfam domain module=DUF6::TPT; Domain location= 82-208::71-208
  Subcellular localization annotation: CTP_CleavageSite=60; ConfidenceScore=5.69e-01
MKSALQSFFSFSLSAAFYSSVALSPTVLSIAGALLVTLYKGSPIISFRTQPSPTQPLPPLLAETSNWVIGGLFFATASISLAAWNITQAAILKGYSSQLTILAYYCLFGTIQSAILSLIVVRDPNDWKISPDIDLIAVFYSAVVGSVVTFSVNTWCIKKKGPVFVSLFKPVGIAIAAFSTVVFLGETLHVGSVVGAVIIAIGFYTVLWAQSKGENAKGFQVDGLSSPSAQASPLLEFHESNVLA

SEQ ID NO: 177941 - protein, 163 aa, Glycine max
  Coding DNA Sequence Number=SeqID_61163
  Homolog annotation: Hit_ID=Q9FMB9; Match level="QueryCoverage=34%, HitCoverage=11%, E-value=3e-19, Identity=75%"; Hit description =Cysteine-tRNA ligase
MRHKRKIQPPKIPEGFHLTELVSGLNTLETSHHSPSSSTAIPSSGKLLREGKAQQVSSPPHLPPLQLQPLRPACRLRLPWLLPTSLLKPFHPSATDTAVELPRQQLAHNRAGEQVAVDSRNRHPADFALCKAAKPGEPSWDSPWDPGGPGWHIECSLEGLISR

SEQ ID NO: 177942 - protein, 67 aa, Glycine max
  Coding DNA Sequence Number=SeqID_61164
MAISPCIGNRQSNWRVPHHKSRLGLSGFAVMAQAFLALQGWQAHATKGKLPLLWASLNLLDSKFAIK

SEQ ID NO: 177943 - protein, 59 aa, Glycine max
  Coding DNA Sequence Number=SeqID_61165
MDCPAGLAVRAGLRIGLFDPWGLRDELTRSAVNAGLCRRGGLTRLPTPTSMGNLCGACM

SEQ ID NO: 177944 - protein, 385 aa, Glycine max
  Coding DNA Sequence Number=SeqID_61166
  Gene Ontology: Mol. function=galactosyltransferase activity; Cellular component=membrane; Biological process=protein amino acid glycosylation
  Homolog annotation: Hit_ID=Q6F2F5; Match level="QueryCoverage=97%, HitCoverage=95%, E-value=1e-144, Identity=63%"; Hit description =Putative glycosyltransferase
  Pfam annotation: Domain name=Galactosyl_T; Domain location=152-326; Score=170.6; E_value=4.1e-48; Accession=PF01762.12; Description =Galactosyltransferase
  Subcellular localization annotation: CTP_CleavageSite=51; ConfidenceScore=5.10e-01
MTWKSRGDLLPKSVMSQKWMIFLCVGSFCAGMFFTNRMWTIPEPKGLARTTAMEAEKLNVVSEGCNSRILQEKEVKRETKGIYSEVFKTQNAIQTLDKTISNLEMELAAAKAAQESIRSGAPVAEDIKMSESSGRRRYLMVVGINTAFSSRKRRDSVRETWMPQGEKRKKLEEEKGIIIRFVIGHSATSGGILDRAIEAEDRKHGDFLRLDHVEGYLELSAKTKTYFATAVNLWDADFYIKVDDDVHLLSLPLSCRGVRYHEPEYWKFGEAGNKYFRHATGQLYAISKDLATYISNNKHVLHKYANEDVSLGSWFIGLDVDHIDDRRLCCGTPPGEDCEWKAQAGNVCVASFDWTCSGICRSAERIKEVHKRCGEGEKALWNASF

SEQ ID NO: 177945 - protein, 40 aa, Glycine max
  Coding DNA Sequence Number=SeqID_61167
MARCISTRVEKGHQRQCSSFGRRRFSATLKEYRGRLSLNI

SEQ ID NO: 177946 - protein, 221 aa, Glycine max
  Coding DNA Sequence Number=SeqID_61168
  Gene Ontology: Mol. function=oxidoreductase activity; Cellular component=cytoplasm; Biological process=leukotriene metabolic process
  Homolog annotation: Hit_ID=Q0PIN2; Match level="QueryCoverage=86%, HitCoverage=54%, E-value=5e-27, Identity=36%"; Hit description =Phenylpropenal double-bond reductase
MGSVVESREWYLAAYSPHGVPNSDNLKLRTVALSLSSDSIPDGHVSLQILFLSVDPYLRTRLTGTLDGLYIQQYPLNEVITAYGVGRVIGSKDSKYTEGDLILTPSAPVAEYCILPSSRVIRKIDAASGISLPDYLSALGVPGFAAWVGIVVLGDPKPGSNVFISAASGAVGMSAGQLAKIRGCRVIGSTGSDEKALRHLSNLRKRSPTYLPRPICWPRTI

SEQ ID NO: 177947 - protein, 127 aa, Glycine max
  Coding DNA Sequence Number=SeqID_61169
  Gene Ontology: Mol. function=oxidoreductase activity; Cellular component=cytoplasm; Biological process=leukotriene metabolic process
  Homolog annotation: Hit_ID=Q0PIN2; Match level="QueryCoverage=95%, HitCoverage=34%, E-value=6e-35, Identity=56%"; Hit description =Phenylpropenal double-bond reductase
YFPDGIDVYLDNVGGKMLESVLNHVNKYARIPLCGMISQYNKVWTEREGVRNLLNMVGKEVRMEGFMLESYWHRFEDFAKEMEGYIKEGKVTSKNKINIGIESFLDSLASLFSSSNIGKVVVQVNKA

SEQ ID NO: 177948 - protein, 93 aa, Glycine max
  Coding DNA Sequence Number=SeqID_61170
MRTRRKKKAPRTARTHSGADLNIDRNNKREDRATQQRCEEVGRCGGGICRKSCTIAVKQIGKSSEGITKMTWTLILGRRRCMQKGFCHPQIGG

SEQ ID NO: 177949 - protein, 235 aa, Glycine max
  Coding DNA Sequence Number=SeqID_61171
  Gene Ontology: Mol. function=oxidoreductase activity; Cellular component=cytosol; Biological process=leukotriene metabolic process
  Homolog annotation: Hit_ID=Q0PIN2; Match level="QueryCoverage=92%, HitCoverage=61%, E-value=5e-48, Identity=47%"; Hit description =Phenylpropenal double-bond reductase
MGEEVKSLVVEEEMGVVESKEWYLVSYAPHGVPTTDHLKLRKVRLSIAPESIPDAHVAIEMLLFSVDPYLRGRFTGTLDGLYFPQFELNQVITIFGIGRVKRSNDSKYEEGDIVLSASFPVAEYCVMPSSEIDAKIDAASGISLPDYLSTLGVPGFAAWLGIEVVADPKPGSNVFISAASGGVGMIAGQLAKIRGCRVIGSTGSDEKVRLIKEEFGYDDGFNYKKEEDLDAVLSK

SEQ ID NO: 177950 - protein, 45 aa, Glycine max
  Coding DNA Sequence Number=SeqID_61172
MAPKTCSASGKCTGSHKCINYLCKKKENHSREMMCKNKYRTRWSS

SEQ ID NO: 177951 - protein, 129 aa, Glycine max
  Coding DNA Sequence Number=SeqID_61173
MNFLTTHNKGWEQELSPYNQYEEERTSNLESVFEEFRAYHDSSKANQNSMQNHEIHFGMSYSIENFQGRPELQPYYQNEAERGSNLDKLLMQFMETTKSTQQALQSVEIQVGELAKAVTQFMSRRENPL

SEQ ID NO: 177952 - protein, 126 aa, Glycine max
  Coding DNA Sequence Number=SeqID_61174
MQSQGLALPPKHEVAPSASRVSTKGSCVDPSPTDPETSDSDKCGLYIEENPSRLVTLGRLYEGSTVVHNIPLLHGQVKVGVEEVKGAQAPVPVPLRGLTSGAGTEHLPCLADTSYEACIRTTVSPA

SEQ ID NO: 177953 - protein, 75 aa, Glycine max
  Coding DNA Sequence Number=SeqID_61175
MDCLEEQTSQGSFVPHGRQDVLTTSIGRPKHPGHVRAAGASVTIKQYFRLAPQSSRNSSSIPPEELEKLTQQIRD

SEQ ID NO: 177954 - protein, 256 aa, Glycine max
  Coding DNA Sequence Number=SeqID_61176
  Gene Ontology: Mol. function=oxidoreductase activity; Cellular component=cytoplasm; Biological process=response to red or far red light
  Homolog annotation: Hit_ID=Q4W8C0; Match level="QueryCoverage=85%, HitCoverage=61%, E-value=1e-108, Identity=86%"; Hit description =Gibberellin 2-oxidase
  Pfam annotation: Domain name=2OG-FeII_Oxy; Domain location=71-194; Score=113.6; E_value=5.8e-31; Accession=PF03171.10; Description=2OG -Fe(II) oxygenase superfamily
MLTTSVICAMTSIGLSSYCGATLPTFPSICAVNDYIEAVKELTCEVLDMVEEGLWVQDKFSLSKLIRDVHSDSLLRINQYPPVSLKGTKNWDTSKLEAHQLQSQNNNNNNNNIGFGEHSDPQILTIMRSNNVDGLQISTHDGLWIPVPPDPNEFFVMVGDALQVLTNGRFVSVRHRVLTNTTKARMSMMYFAAPPLNWWITPLPKMVTPHNPSLYKPFTWAQYKQAAYSLRLGDARLDLFKIQRQQDTHLIAPAST

SEQ ID NO: 177955 - protein, 111 aa, Glycine max
  Coding DNA Sequence Number=SeqID_61177
  Homolog annotation: Hit_ID=Q1RZ53; Match level="QueryCoverage=90%, HitCoverage=26%, E-value=6e-13, Identity=40%"; Hit description =Cyclin-like F-box; F-box protein interaction domain
MFGFGYDPSSDKYKVVAIALTMLSLDVSQKTEMKVYSAGDSSWRNLKGFPVLWTLPKVGGVYLSGTLNWVVIKGKETIHSEIVIISVDLEKEACRSLFLPDDFCFVDTNQF

SEQ ID NO: 177956 - protein, 71 aa, Glycine max
  Coding DNA Sequence Number=SeqID_61178
MPGEKDSVGDSLDITLVALFQKQTRYPSGISLTPQCNPLHEPTRWEWNYELTSHDSMWISGMDPRQTFFIS

SEQ ID NO: 177957 - protein, 137 aa, Glycine max
  Coding DNA Sequence Number=SeqID_61179
  Gene Ontology: Mol. function=oxidoreductase activity; Biological process=response to red or far red light
  Homolog annotation: Hit_ID=Q4W8C0; Match level="QueryCoverage=93%, HitCoverage=36%, E-value=4e-64, Identity=91%"; Hit description =Gibberellin 2-oxidase
MVAPCPTSMMVRTKKTKAMGVPTIDLSMERSKLSELVVKACEEYGFFKVVNHSVQKEVIARLEEEGKEFFSKTSSEKRQAGPANPFGYGCRNIGPNGDMGHLEYLLLHTNPLSISERSKTIANDPTKFSLSGMREML

SEQ ID NO: 177958 - protein, 359 aa, Glycine max
  Coding DNA Sequence Number=SeqID_61180
  Homolog annotation: Hit_ID=Q2KBS6; Match level="QueryCoverage=36%, HitCoverage=38%, E-value=1e-48, Identity=74%"; Hit description =Probable translation factor sua5 protein
  Pfam annotation: Domain name=Sua5_yciO_yrdC; Domain location=246-359; Score=5.8; E_value=2.7e-07; Accession=PF01300.8; Description=yrdC domain
GLQRNGVLTHPKLSYRIDSNEGVPGGEGDTHTLFRCEQAFGRISRYEERWLPKERVYYSHDEVAALTGRKLEAAADATHSRLNGFHQSIRFPKMVFHHLLNDRPHLGYCHVTAATTSFDAERHVLWSFYFANFFAELSGAENFFENIDARYSRMYFAVAINALPDQEIAVDTSDHQGDIAATKPPGTSSFFLRHVVVPKPTTSFGQCALALSILPGNTLLTALKGSIMARHIHIENERETALQAAVTELAAGQPIALPTETVYGLAADATNPAAIARIYETKGRPQFNPLICHMADIAMAERYAIFDPMSLDLAQAFWPGPLTLVLPLKPASDIHALATAGLDTVGIRVPQGFAGDLIR

SEQ ID NO: 177959 - protein, 69 aa, Glycine max
  Coding DNA Sequence Number=SeqID_61181
MRKFGDDKSWIQLINFSYLHLNIRPYEEKSMILPLCMSNNGDFFMLKFTRNADDEYQTILYDQRDDVSS

SEQ ID NO: 177960 - protein, 105 aa, Glycine max
  Coding DNA Sequence Number=SeqID_61182
  Gene Ontology: Mol. function=transporter activity; Cellular component= intracellular; Biological process=transport
  Homolog annotation: Hit_ID=Q9LRX7; Match level="QueryCoverage=61%, HitCoverage=10%, E-value=2e-10, Identity=50%"; Hit description =Phosphatidylinositol/phosphatidylcholine transfer protein-like
MTPAIKEPLWQRIQNLEAVVTEMANKPNTIPPEKEDILQESLSRIKCIEYDLQKTKKALLATASKQVELAESLESLKESKFDETLPSGLRLLEECGLWGVHSPNV

SEQ ID NO: 177961 - protein, 434 aa, Glycine max
  Coding DNA Sequence Number=SeqID_61183
  Gene Ontology: Mol. function=transporter activity; Cellular component= intracellular; Biological process=transport
  Homolog annotation: Hit_ID=Q9LRX7; Match level="QueryCoverage=85%, HitCoverage=59%, E-value=1e-135, Identity=63%"; Hit description =Phosphatidylinositol/phosphatidylcholine transfer protein-like
  Pfam annotation: Domain name=CRAL_TRIO; Domain location=187-373; Score=108.2; E_value=2.4e-29; Accession=PF00650.10; Description =CRALTRIO domain
  Pfam annotation: Domain name=CRAL_TRIO_N; Domain location=80-170; Score=42.5; E_value=1.4e-09; Accession=PF03765.5; Description =CRALTRIO, N-terminus
  Pfam module annotation: Pfam domain module=CRAL_TRIO::CRAL_TRIO_N; Domain location=187-373::80-170
LVSILDPGLDLLLLKVVLVFPLVQRQSRCKLLVLNRMPGEEVLAQEDERGRCFEPETSEDEWRKSRARSLRRKAMTASTRLAYSLRKRNTRVANSDFASIFIEDVRDANEEKAVNSFRQVLLTRDLLPDSHDDYHEMLRFLKARKFDIDKTVQMWADMLHWRKEYGVDSILQEFVYKEYEEVQCYYPHGYHGVDKEGQPVYIERLGKVEPSKLMSVTTVDRFLKYHVQGFEKMFKEKFPACSIAAKRHIDKTTTILDVHGVNWVSFSKVAHDLVMRMQKIDGDNYPETLNQMFIVNAGSGFKLLWNTAKGFLDPMTTAKIHVLGNKFQSRLLQIIDSSQLPDFLGGSCSCPNDGGCLRSDKGPWNDPDILKLLHSREAMKLTKFGSSSVADGVDVKSYASKVKSTGISEPLSASEVRLNPSAFVQSVPSSEKVS

SEQ ID NO: 177962 - protein, 149 aa, Glycine max
  Coding DNA Sequence Number=SeqID_61184
MCADLLAKLGTSTEAEFLPSSCPDIESLVQLKDVLGCRALVGTWQGELINRLCLRLMLKYQTGCNNIRGFMGFKFPSRCGLFGGLGIKQSRWICWVRPPLRAVTLKVDGSMMGSPPRAGFGGLCRVHHGSFLVGLYGHVGGQEILYAEI

SEQ ID NO: 177963 - protein, 75 aa, Glycine max
  Coding DNA Sequence Number=SeqID_61185
MTPTRGGVVWEAKIVDFSLTDFKQEDAINECEFKHWKVLLQSCLVFNPSSSPSLFISSSIPNIEDCREVGGTSEL

SEQ ID NO: 177964 - protein, 393 aa, Glycine max
  Coding DNA Sequence Number=SeqID_61186
  Gene Ontology: Mol. function=calpain activity; Cellular component =intracellular; Biological process=proteolysis
  Homolog annotation: Hit_ID=Q1S668; Match level="QueryCoverage=96%, HitCoverage=95%, E-value=2e-60, Identity=38%"; Hit description =Cyclin-like F-box; F-box protein interaction domain
  Pfam annotation: Domain name=F-box; Domain location=1-48; Score=36.0; E_value=1.3e-07; Accession=PF00646.23; Description=F-box domain
  Pfam annotation: Domain name=FBA_1; Domain location=220-386; Score= -53.9; E_value=0.097; Accession=PF07734.3; Description=F-box associated
  Pfam module annotation: Pfam domain module=F-box::FBA_1; Domain location=1-48::220-386
MAKETFPIELIVEILSWLPVKPLIRFRCVSKTWKSLISHPIMVKLHLQRSSKNPHVLLTFEDNNRNNDNCYSFAATCSIRRLLENPSSTVDDGCYQFNDKNHFVVGVCNGVVCLLNSLDRDDYEEYWVRFWNPATRTMFEDSPRLSLHWRKYKTGRNDWVCGYPRCGFGYDGLSDTYKVVIILSNVKLQRTEVRVHCVGDTRWRKTLTCPVFPFMEQLDGKFVGGTVNWLALHMSSSYYRWEDVNVNEIVIFSYDLNTQTYKYLLLPDGLSEVPHVEPILGVLKGCMCLSHEHRRTHFVVWQMMDFGVEKSWTQLLNVSYQHLQVHDFPSCPMIPLCMTENNDLFLLANNEGEEFVVYNRKDNRVQCTEGFKNGKFSFFSYDYVQSLVFPYPN

SEQ ID NO: 177965 - protein, 170 aa, Glycine max
  Coding DNA Sequence Number=SeqID_61187
  Pfam annotation: Domain name=GRP; Domain location=1-111; Score=2.7; E_ value=3.5e-05; Accession=PF07172.2; Description=Glycine rich protein family
MERKFISVVVLGVCLVLGMSQYVDARNLEKKSKEEVKKPESCLDGGSIGGVGGIGGIGGAGGGGGGLGGGYGGGAGGDSGLGGGYGGGAGGGGVGGLGGGSGLGGGYGGGSGLGGGIGGGIYKGIGIGGGIYKGIGIGGGIYKGIGGGVGAIGGVGGVIGGFKHVEAKKP

SEQ ID NO: 177966 - protein, 1263 aa, Glycine max
  Coding DNA Sequence Number=SeqID_61188
  Gene Ontology: Mol. function=RNA-directed RNA polymerase activity; Cellular component=nuclear RNA-directed RNA polymerase complex; Biological process=electron transport
  Homolog annotation: Hit_ID=Q647I4; Match level="QueryCoverage=87%, HitCoverage=98%, E-value=0.0, Identity=60%"; Hit description =Putative RNA-dependent RNA polymerase RdRP2
  Pfam annotation: Domain name=RRM_1; Domain location=137-213; Score =17.6; E_value=0.0034; Accession=PF00076.12; Description=RNA recognition motif. (a.k.a. RRM, R
  Pfam annotation: Domain name=RdRP; Domain location=657-1046; Score =647.9; E_value=8.2e-192; Accession=PF05183.3; Description=RNA dependent RNA polymerase
  Pfam module annotation: Pfam domain module=RRM_1::RdRP; Domain location=137-213::657-1046
MESGNFFYNAGILIKTTRQCNWRVLSAHKPLARLAIPSLKANRQYGWRFPPAWPDPEEPACTLLHLARLSLLVGTFYKSTPNAKICQVLFVFGRKLNTSRDPFPPTVAVPVLLTLSVTLVGSIIMGTTTTTTLSNTVRVSNIPQSATAKDLLDFLESTVGPSTVFALEIFSDNPNWKSRGFGRVQFETLDARSRALSLSQLNHLLFHRHFLRLSETDADIIFRPQHRLHNGVLYAGFVLSDHRMSVLESWEGVAGWVLPLRKRLDFWVWHNGDCYRLEFLFEDILESHGYCLGEDAKLNALLLKMKFGPRIYKKKTGADVAAKFRGDRYRFCKEDFEFLWVRTTDFSPLKSIGHSTSFCWEIVEEHLALDVFKSFPLYKENLRDLALEDGEEFCSSTEAVPLVKRASQSKLPYEALFQLNSLVHTQKISLASVDDELIDLLAGLDEETRAVIFLKLHKMSFTCYEPLKFVKTQLHVLSNKKKGLPQSSQKRLTDSNIMSCHRALITPTKIYCLGPELETSNHVVKHFASHASDFMRITFVEENWNKLPTNAVSTGVQKGLFSKPLKTEIYKRILTILRDGIVIGSKRFEFLAFSASQLRSNSVWLFASNDNLKAADIREWMGCFNNIRSVSKCAARMGQLFSSSMQTFEVVSQDVEIIPDVEVISDGVSYCFSDGIGKISQSFARQVAQKLKLDHTPSAFQIRYGGFKGVIAVDRRSFRKLSLRSSMLKFESKNSMLCVTKWSESMPCFLNREIISLLSTLGVKDEVLLAMQHDQLDLLGRMLTDSKAALEVLESLNGADSKSILVKMLHEFNEPNSEPYLSMMLKAYYAYQLSDLKSRCRIFVPKGRVLVGCLDETGLLNYGQVFVRITVTKTREKFGDENLRKVDGDDNTCIIVGKVVVTKNPCLHPGDIRVLDAIYSEELEEKGLRDCLVFPQKGHRPHPNECSGGDLDGDLFFISWDKDLIPCQTEAPMDYTGRRPRIMDHKVTLEEIQQFFVDYMINDTLGAISTAHLVHADREQDKAKSRKCLELAELHSMAVDFAKTGAPAAMPRVLKPREFPDFMERVDKPMYISKGVLGKLYRAIIESQMQIRYSFVWSEKHAEEAYDRSLEVNGFEAFLETASTHKEMYAEKMSSLMDFYGAETEDEMLLGNLQNRASYLQRDNRRYGDMKDRILLSVKNLQREAKEWFETSCEPHEYKPMASAWYHVTYHPSYYCRESPCFLSFPWIVGEILLQISGFIYNQVQRIKWVGLLQNRFTKIPGL

SEQ ID NO: 177967 - protein, 861 aa, Glycine max
  Coding DNA Sequence Number=SeqID_61189
  Gene Ontology: Mol. function=catalytic activity; Cellular component =alpha,alpha-trehalose-phosphate synthase complex (UDP-forming); Biological process=trehalose biosynthetic process
  Homolog annotation: Hit_ID=Q2TSD5; Match level="QueryCoverage=97%, HitCoverage=98%, E-value=0.0, Identity=65%"; Hit description =Trehalose 6-phosphate synthase
  Pfam annotation: Domain name=Glyco_transf_20; Domain location=60-547; Score=840.6; E_value=8e-250; Accession=PF00982.11; Description =Glycosyltransferase family 20
  Pfam annotation: Domain name=Hydrolase_3; Domain location=595-833; Score=-74.6; E_value=0.0083; Accession=PF08282.2; Description =haloacid dehalogenase-like hydrolase
  Pfam annotation: Domain name=Trehalose_PPase; Domain location=596 -827; Score=324.8; E_value=1.5e-94; Accession=PF02358.7; Description =Trehalose-phosphatase
  Pfam module annotation: Pfam domain module=Glyco_transf_20::Hydrolase_ 3::Trehalose_PPase; Domain location=60-547::595-833::596-827
MVVRSCSNLSDLVSKDSLNSPQTPGALPRHLSVPGIMSDVDSKLTGNDDSNAFSSELHQKKIIIAANFLPLNAQKDEISGKWCFTYDEDSILVPLKDGPSSDTEVLYVGSLKVDVDASEQEKVSLQLLEEFNCLPTFIPSDIQKLFYNGFCKQHLWPLFHYMLPLYPDYCNRFDKSLWQAYVSANKIFADKVMEVMNPEHDYVWVHDYHLMVIPTFLRKRYSWIKIGFFLHSPFPSSEIYRALPVRDEILKALLNADLIGFHTFDYARHFLSCCSRILGLEYESKRGYIRLKYFGRTIFIKILPVGIHMDRLQSAFNHSSFSVNVREMSEKFKEKKLILGVDDMDIFKGISLKLLAIEQLLQQYPELLGELILVQIVNPPRSTGKDVEEARNEMHIIANRINERFGLLDYEPVIIINRHVPLYEKASYYALAECCIVDAVRDGMNLVPYEYIVCRQGSPTMDEALDIGSESPRTSALVVSEFIGCSPSLSGAIRVNPWDINAVADALNLAITMPSGEKQLRHEKHYRYVSSHDVAYWAKSFVQDLEYSCKDHYSKNRWGIGFGLNFRVLSLSPTFRKLNKDHAVSAYERTNCRAFFLDYDGTVVPSVVKTPSSEIIDVLNILCSDPKNTVFIVSGRGETTLSEWFDQCENLGIAAEHGYYLNQQSAWEMNHTSTSFSWKEIVEPVMRLYTEATDGSYIETKESALVWHYYDADPDFGSWQAKQLLDHLEGLFANEPVTVKKGKHIIEVKSLGITKGLVVEGILSKMTKNGKIPDFVLCIGDDRSDEDMFESLLNKVYSGTSSPAPEIFACTVGQKPSKARYYLEDTEDVMRLLQALGTVSVPKSTSPEEDSFGKTEACFDV

SEQ ID NO: 177968 - protein, 35 aa, Glycine max
  Coding DNA Sequence Number=SeqID_61190
MAEEQMKVSETMAKGRVADILRRLFITALECTSKN

SEQ ID NO: 177969 - protein, 113 aa, Glycine max
  Coding DNA Sequence Number=SeqID_61191
MECIGVTWVSAETLFEKPLGFLLGEGGVGLDGGGVEAHEEKGSGSNDDASGFNNKRRMRLGFGGEGRWRGRRKRIREWKMGKALEGEVSVNIGTTPGKTECHNEEKARSSSCE

SEQ ID NO: 177970 - protein, 80 aa, Glycine max
  Coding DNA Sequence Number=SeqID_61192
MEEPFRVLDHLIELEPEELEWLLLKANMHIYNNNHTNMRKLFEEILKKDLLREEVFHGLVMATLRSNELLKGLLKRVEEQ

SEQ ID NO: 177971 - protein, 474 aa, Glycine max
  Coding DNA Sequence Number=SeqID_61193
  Gene Ontology: Mol. function=DNA binding; Cellular component=nucleus; Biological process=regulation of transcription, DNA-dependent
  Homolog annotation: Hit_ID=Q9FR43; Match level="QueryCoverage=88%, HitCoverage=91%, E-value=6e-66, Identity=36%"; Hit description =Anther-specific myb-related protein 2
  Pfam annotation: Domain name=Myb_DNA-bind_2; Domain location=27-80; Score=-4.7; E_value=0.034; Accession=PF08914.1; Description=Rap1 Myb domain
  Pfam annotation: Domain name=Myb_DNA-binding; Domain location=25-72; Score=47.4; E_value=4.9e-11; Accession=PF00249.21; Description=Myb -like DNA-binding domain
  Pfam annotation: Domain name=Myb_DNA-binding; Domain location=78-123; Score=45.4; E_value=2e-10; Accession=PF00249.21; Description=Myb-like DNA-binding domain
  Pfam module annotation: Pfam domain module=Myb_DNA-bind_2::Myb_DNA -binding::Myb_DNA-binding; Domain location=27-80::25-72::78-123
MARTVSNSNETAAKEEGEVRNGVRKGPWTPEEDAILMDYVKKHGEGNWNSVQKNSGLLRCGKSCRLRWANHLRPNLKKGAFSQEEEQVIIDLHSKLGNKWARMAAQLPGRTDNEIKNFWNTRMKRRQRAGLPLYPPEVHAEATSYLLQHHRYLEQQQQQQPHSSSSFSLLLSSCYPNKLNDPNQTHHHSNANLLQSQPDHSANRYINPSQQFKFSNENSGSNGNFAFPLSPLSPYGSSSSTLLNHSFGGGDHGFIAGSPYEPFSLVQGSTTDISSNQTPTPASSYASGVDGLMGASSMVNNNNNNNDYYEVAPLSPPQGNSGLLDALVMEAQGLSHNEKSKSEEDPNLAGKLSCKRKKMEYAEEGGTVPAMKKNSGNSTTNESQRDDDISSSQLAKGKEQIGEDPLEEMNGMDDDLVSLLNHFPLEMPMPEWYRRGGNQSLGLENQPKASLPDPADQEHAWTLGTCWNNMPRIC

SEQ ID NO: 177972 - protein, 36 aa, Glycine max
  Coding DNA Sequence Number=SeqID_61194
MRNERGRFAIDYLIRMIGRAHAKLGATEFEKFAPKA

SEQ ID NO: 177973 - protein, 151 aa, Glycine max
  Coding DNA Sequence Number=SeqID_61195
MKEFYHTVRQVEVEDALRQGESESLWCKILRSKYGEGYSSGEVSKREQDTGVWWVEGWGMVMAELVGVGKTDGSVWILGIEIPAPQVLDKYLEQVLQLAGSGDGTAQRSSEALCSTPYGKLLEETSKLGFGSMVRNNMGPMAAPKWDYLSQ

SEQ ID NO: 177974 - protein, 82 aa, Glycine max
  Coding DNA Sequence Number=SeqID_61196
MGLRKKGEVGELHEAISTHGSKLVGGGHMNSARQWHSWGSEKKWRMENWRIALHNNFAGLQTPITTHSSKLVGGGHMNSARQ

SEQ ID NO: 177975 - protein, 88 aa, Glycine max
  Coding DNA Sequence Number=SeqID_61197
MQHVTGQQAANHRGQVQWNESFYRYTLHQQSQDPSPFPWPTPEQFRATVAWPGDEPDFQTEAGPIEASEDEDGAQEDDDMTNVLKYFM

SEQ ID NO: 177976 - protein, 74 aa, Glycine max
  Coding DNA Sequence Number=SeqID_61198
MLQAPGGLVDNDRRREALCVRFTADGEANVSEVGGREGRGGGGGGGGRVEAENKEGNKQPFEGCTIRNLRIPND

SEQ ID NO: 177977 - protein, 153 aa, Glycine max
  Coding DNA Sequence Number=SeqID_61199
  Gene Ontology: Mol. function=nucleic acid binding; Biological process= RNA-dependent DNA replication
MAGILHPMKGVSIKEVEQGFFLFRFFHKLDVQRILKRGPWSFDGHLLVLGVIKEGESPSQVPLYTVPFWVQEHNIPAAFMTFAPGQNIGNYLGEFLEYNNKNNLSFWRKYMRLRVLINVRKPLKRTKKIRKPGGEAKEVAFKYDRLGNFCYFC

SEQ ID NO: 177978 - protein, 103 aa, Glycine max
  Coding DNA Sequence Number=SeqID_61200
MVEWCGGVLANCHRQFVGGAIRYVKREHLIDVTEVFRVCHTLTIEHAYLLCISLDVLLNDGHGGAMTVFHGGFSKKRHRIAVAWRVWDGGVMAAAVAMAVVAG

SEQ ID NO: 177979 - protein, 135 aa, Glycine max
  Coding DNA Sequence Number=SeqID_61201
  Homolog annotation: Hit_ID=Q8SEU5; Match level="QueryCoverage=44%, HitCoverage=17%, E-value=2e-24, Identity=90%"; Hit description =Ribosomal protein S4
MKLLSTRKLPLFHADLPITEMHRGTERTSYIPFLLNPETRSDVIPVRLHFRETIPQARQPISRRRDLSSILSPERLDGTSCPERHQKGKKVESPKDNSIVATGFVAKLGSGTISISNVLFIPSLNCKLFSVSQLT

SEQ ID NO: 177980 - protein, 143 aa, Glycine max
  Coding DNA Sequence Number=SeqID_61202
  Subcellular localization annotation: CTP_CleavageSite=65; ConfidenceScore=5.20e-01
MTCVKTLPPLSSIHDANPLSLYVALFSTDTLPLNHHTSSPCRPLCHRHHMPSSSIAPSQRSTVAREQHRVASGFLQKVRLLIFHRFDLVGGRTLQLQVVSFGQKLDMGCFDLRGIQSDLGLGEKGCLVGAVLCFRHNRQVNLI

SEQ ID NO: 177981 - protein, 126 aa, Glycine max
  Coding DNA Sequence Number=SeqID_61203
  Gene Ontology: Mol. function=ATPase activity, coupled to transmembrane movement of substances; Cellular component=integral to membrane; Biological process=transport
  Homolog annotation: Hit_ID=Q1S3P7; Match level="QueryCoverage=92%, HitCoverage=97%, E-value=5e-49, Identity=72%"; Hit description =Cyclic peptide transporter
  Pfam annotation: Domain name=ABC_tran; Domain location=2-90; Score =17.2; E_value=5.1e-09; Accession=PF00005.17; Description=ABC transporter
ALPEGYATKVGERGVQLSGGQKQRVAIARAVLKNPEILLLDEATSALDLESERVVQQALDKLMKNRTTVIVAHRLSTITNADQIAVLEDGKIIQRGTHARLVENTDGAYYKLVSLQQQQHIQEHND

SEQ ID NO: 177982 - protein, 961 aa, Glycine max
  Coding DNA Sequence Number=SeqID_61204
  Gene Ontology: Mol. function=ATPase activity, coupled to transmembrane movement of substances; Cellular component=integral to membrane; Biological process=transport
  Homolog annotation: Hit_ID=Q8LPK2; Match level="QueryCoverage=99%, HitCoverage=96%, E-value=0.0, Identity=53%"; Hit description =Multidrug resistance protein 2
  Pfam annotation: Domain name=ABC_membrane; Domain location=570-848; Score=140.3; E_value=5.1e-39; Accession=PF00664.13; Description=ABC transporter transmembrane region
  Pfam annotation: Domain name=ABC_tran; Domain location=239-457; Score= 190.2; E_value=5.1e-54; Accession=PF00005.17; Description=ABC transporter
  Pfam module annotation: Pfam domain module=ABC_membrane::ABC_tran; Domain location=570-848::239-457
MYIQVGNFMHYISRFIAGFTIGFVRVWQISLVTLAIVPLIALAGGLYAYVTIGLIGKVRKSYVRAGEIAEEARVKVIGNVRTVQAFAGEERAVRSYKVALMNTYRNGRKAGLAKGLGLGSMHCVLFLSWALLVWFTSVVVHKNIANGGNAFTTMLNVVISGLSLGQAAPDISAFIRAKAAAYPIFEMIERDTMSKASSENGKKLSKLEGHIQFKDVCFSYPSRPDVVIFNNFCIEIPSGKILALVGGSGSGKSTVISLIERFYEPLSGQILLDGNNIRELDLKWLRQQIGLVNQEPALFATSIRENILYGKDDATLEEVNQAVILSDAQSFINNLPDGLDTQNQPFEMQREGVGYNNQLSARADPTVNERVHMHPLVGERGIQLSGGQKQRIAISRAIVKNPSILLLDEATSALDSESEKSVQEALDRVMVGRTTVIVAHRLSTIRNADMIVVIEEGGKVVEIGNHEELISNPNNNVYASLVQIQEKAFSQSHISGDPYLGGSSRYLGGSSRHLGESSSRATSFRGSFRSDKESTSKAFGDEAEGSVGSSSRHVSARRLYSMIGPDWFYGVFGTLGAFIAGAQMPLFALGISHALVSYYMDWHTTRHEVKKVALLFCGAAVLTITAHAIEHLSFGIMGERLTLRAREKMFSAILKSEIGWFDDINNTSSMLSSRLETDATFLRTVVVDRSTILLQNVGLVVASFIIAFMLNWRITLVVLATYPLIISGHISEKLFMQGFGGNLSKAYLKANMLAGEAVSNIRTVAAFCAEQKVLDLYAHELVEPSKRSFNRGQIAGIFYGISQFFIFSSYGLALWYGSVLMEKELSSFKSIMKSFMVLIVTALAMGETLALAPDLLKGNQMVASIFEVMDRKTGILGDVGEELKTVEGTIELKRIHFCYPSRPDVVIFNDFNLKVLAGKNIALVGHSGCGKSSVISLILRFYDPTSGKVMIDGKMFEQLML

SEQ ID NO: 177983 - protein, 151 aa, Glycine max
  Coding DNA Sequence Number=SeqID_61205
  Gene Ontology: Mol. function=ATPase activity, coupled to transmembrane movement of substances; Cellular component=integral to membrane; Biological process=transport
  Homolog annotation: Hit_ID=Q8LPK2; Match level="QueryCoverage=87%, HitCoverage=12%, E-value=1e-47, Identity=63%"; Hit description =Multidrug resistance protein 2
MDINEGRKKEKGTQQERRKVPFLKLFSFADFYDCVLMAIGTVGACVHGASVPVFFVFFGKIINVIGLAYLFPKEASHEVSKVACWMHTGERQAAKMRMAYLRSMLNQDISLFDTEASTGEVISSITSDIIVVQDALSEKLQNGGYGHVYII

SEQ ID NO: 177984 - protein, 108 aa, Glycine max
  Coding DNA Sequence Number=SeqID_61206
  Gene Ontology: Mol. function=endonuclease activity
  Homolog annotation: Hit_ID=Q2HS44; Match level="QueryCoverage=95%, HitCoverage=49%, E-value=9e-12, Identity=35%"; Hit description =Hemopexin
MTMECQLLGLPLEGYWYTWVRSQGTTNAVEGRLNRASLINLITPISYRISIHLQVYTKKKEFVRMRFRFENVWLDKKELEEVVQFSWQQAAQESIPHKIKACTGELEN

SEQ ID NO: 177985 - protein, 113 aa, Glycine max
  Coding DNA Sequence Number=SeqID_61207
MPTYIRASDPNQHPCASSYTTHYACLITLRHDLAKLTFWCLPWGTVKHFRHPLFLPCFLLLSMARPTRTRTSTSRNGGRVMQSSQGGDPSPDPWLGDSKKIGLEMQEKALGFS

SEQ ID NO: 177986 - protein, 74 aa, Glycine max
  Coding DNA Sequence Number=SeqID_61208
MAAKASSAQVKDVIIAEVIRTSWYLWITGIIGAIYALEITLSKGRSKLWLEFDSSLVVLAFKDPSIVPWNLRNC

SEQ ID NO: 177987 - protein, 72 aa, Glycine max
  Coding DNA Sequence Number=SeqID_61209
MAQIKDMGRENEKARREGEKVRMAADKALKVLEVNLRHFVIHSQQGEAAHNDRPIWCVPIAREIKGVFDKIQ

SEQ ID NO: 177988 - protein, 184 aa, Glycine max
  Coding DNA Sequence Number=SeqID_61210
MIYPPSPIRWHVKCKMTRTKKIDQMTIRWRSRCHRVVVHGRQDVLTATIGRPEHPSRVGAARAGVTIKQYFGPTRGSQFQSQIKSQGLALPPEPEVGPSAARVSTKESCIDHSGNDPDMCDSDKCGLYIDENPPCLVALGRVYEGSIIIHNIPLLHDQVKVGVEEVRDADALIPVPIEEVKLVG

SEQ ID NO: 177989 - protein, 62 aa, Glycine max
  Coding DNA Sequence Number=SeqID_61211
MENWRTVLGDDIRVAPDSKRLAMTFMGLRIKVENGELAYRARQSHSRGSRLEGGGHMNSARQ

SEQ ID NO: 177990 - protein, 89 aa, Glycine max
  Coding DNA Sequence Number=SeqID_61212
MDYGTQSDIRAKSYCRLNLLRASTFNFERLDLRASEFNFERLDVLRDSIRHPSKKLLSFKIAESFNIQFRASRCITGLNQTCEQNIIVV

SEQ ID NO: 177991 - protein, 407 aa, Glycine max
  Coding DNA Sequence Number=SeqID_61213
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=P56757; Match level="QueryCoverage=95%, HitCoverage=82%, E-value=0.0, Identity=85%"; Hit description=ATP synthase subunit alpha
  Pfam annotation: Domain name=ATP-synt_ab; Domain location=73-262; Score=300.3; E_value=3.5e-87; Accession=PF00006.15; Description=ATP synthase alphabeta family, nucleotide-binding domain
  Pfam annotation: Domain name=ATP-synt_ab_C; Domain location=274-374; Score=127.9; E_value=2.8e-35; Accession=PF00306.17; Description=ATP synthase alphabeta chain, C terminal domain
  Pfam module annotation: Pfam domain module=ATP-synt_ab::ATP-synt_ab _C; Domain location=73-262::274-374
MGDGLMIQEGSSVKATGRIAQIPVSEAYLGRVINALAKPIDGRGEISASESRLIESPAPGIISRRSVYEPLQTGLIAIDSMIPIGRGQRELIIGDRQTGKTAVATDTILNQQGQNVICVYVAIGQKASSVAQVVNTLQERGAMEYTIVVAETADSPATLQYLAPYTGAALAEYFMYRERHTLIIYDDLSKQAQAYRQMSLLLRRPPGREAYPGDVFYLHSRLLERAAKLSSQLGEGNGQIFLSADLFNAGIRPAINVGISVSRVGSAAQIKAMKQVAGKLKLELAQFAELEAFAQFASDLDKATQNQLARGQRLRELLKQSQSAPLTVEEQIITIYTGTNGYLDSLEIGQVRKFLVELRAYLNTNKPQFKEIISSTKTFTGEAEVLLKEAIQEQMELFLLQEQVEKN

SEQ ID NO: 177992 - protein, 107 aa, Glycine max
  Coding DNA Sequence Number=SeqID_61214
MLKIGDSAKVVIKQDMKGRRHKYGFNNNKREKAEKKRVVDDETGDKHQLDERGTSNNLKVVHSGTKEFKIASNKRDLFLGFSEHQERLRKKLALEEGRIFAANEQLS

SEQ ID NO: 177993 - protein, 296 aa, Glycine max
  Coding DNA Sequence Number=SeqID_61215
  Gene Ontology: Mol. function=glycerol kinase activity; Cellular component=mitochondrial outer membrane; Biological process=glycerol -3-phosphate metabolic process
  Homolog annotation: Hit_ID=Q6RUF8; Match level="QueryCoverage=59%, HitCoverage=39%, E-value=1e-79, Identity=74%"; Hit description =Glycerol kinase
  Pfam annotation: Domain name=FGGY_C; Domain location=70-275; Score =40.6; E_value=1.2e-09; Accession=PF02782.6; Description=FGGY family of carbohydrate kinases, C-terminal domain
  Pfam annotation: Domain name=PPR; Domain location=44-78; Score=27.2; E_value=5.8e-05; Accession=PF01535.11; Description=PPR repeat
  Pfam annotation: Domain name=PPR; Domain location=79-113; Score=3.4; E_value=3; Accession=PF01535.11; Description=PPR repeat
  Pfam module annotation: Pfam domain module=FGGY_C::PPR::PPR; Domain location=70-275::44-78::79-113
MTRAGHSLGIYLASLLIFRLGYARKHSLAMKIFNLLPDNHKCSATYTALISVYFSVRRVNEALEIHKIMCSKEFCPVLGTYDGLLTGLERNGKYAEAEHYRKAKKIKSLLANSGSQERLVAITGDAVQWLRDSLGIISSASKIEEMALQVESTGGVYFVPAFNGLFAPWWREDARSVCIGITRFTSKAHIARATLESMCFQVKDVLDSMHKDSGETYLVGCPAIRPTDIETTTLGAAYTVGLAIGIWKEDYLFNTKDKLKNANVFRPLMTEELRKKKVASWCKAVSKTFDLADLFL

SEQ ID NO: 177994 - protein, 89 aa, Glycine max
  Coding DNA Sequence Number=SeqID_61216
MTILLQLPYEYIDNNPVPTIVFKGRPRTFHTFIIFIIFAFSGATNALVAFNKSRFSRLCGIMQWVLWLLLWQFSCGHCVAHVSIRKAGL

SEQ ID NO: 177995 - protein, 273 aa, Glycine max
  Coding DNA Sequence Number=SeqID_61217
  Gene Ontology: Mol. function=4 iron, 4 sulfur cluster binding; Cellular component=membrane; Biological process=electron transport
  Homolog annotation: Hit_ID=P0AAK1; Match level="QueryCoverage=70%, HitCoverage=95%, E-value=4e-84, Identity=79%"; Hit description =Formate hydrogenlyase subunit 2
DIEQADKQPAQAKRHQPDGVQRRDRNGVTDERHERVHGVSVEQNHPACRQRHQAADRPANPGDPAAQVRYRAGHHHRRVANIAVDGQLAFTLAGTGDVANVNQNQRVGWAGAHAGRALFIKAAQIALHRNGADAGHPVQQRADACRSRRRGRGFWRVGIRRNMQRAAAGKFNGAERAGNAAQLAAYAQAFVQLDSAVHAGDGIYGTDTRTRGIFTVMAELRGRLFFITHDVQARHGLQPMQAMRFRTRRLTGSTANADRRVSNYKTVHRVILW

SEQ ID NO: 177996 - protein, 201 aa, Glycine max
  Coding DNA Sequence Number=SeqID_61218
  Gene Ontology: Mol. function=lyase activity; Biological process =regulation of transcription, DNA-dependent
  Homolog annotation: Hit_ID=P0AEV4; Match level="QueryCoverage=74%, HitCoverage=93%, E-value=2e-33, Identity=60%"; Hit description =Formate hydrogenlyase regulatory protein hycA
GAGLDAGKRPDLQPDSGDAFCVVLHSLLFDKFQSPLGRGHVDVNAVEMTRRHRKVDSQLHRAASSAVTGPVASLLQLSGSGHHPVESASSPCDELRGAGGYALVLFGHFTINVTLADNFNSHTIEYYLETKDGEKQCIAKAQLMADGMVDGHVSNRDRQQVLEHYLEKIAPVYNGLYAAVEHDLPVNLKQLMDGNASANVA

SEQ ID NO: 177997 - protein, 102 aa, Glycine max
  Coding DNA Sequence Number=SeqID_61219
MSEIEKVQEQMKADMEAMKDQMATMIEAMLNMKKIMESNAAIVATTSATTEVDPTHLSGINQPSRLVPNMLGQGGKALGSTGCNDPPRHYDITTLNRDNFNF

SEQ ID NO: 177998 - protein, 112 aa, Glycine max
  Coding DNA Sequence Number=SeqID_61220
TKFRALLSLSLHSSPSSSKLLSMASYGAKESIDEEDPRPTSSNGACINVALHLGIRVDGRVVATPHGDLVGYRSRIDHMESHEFGLQQDIPVDPMNLDRLHQIDMRGNHYID

SEQ ID NO: 177999 - protein, 297 aa, Glycine max
  Coding DNA Sequence Number=SeqID_61221
  Gene Ontology: Mol. function=ribonucleoside-diphosphate reductase activity; Cellular component=ribonucleoside-diphosphate reductase complex; Biological process=DNA replication
  Homolog annotation: Hit_ID=Q8D117; Match level="QueryCoverage=49%, HitCoverage=20%, E-value=5e-53, Identity=68%"; Hit description =Ribonucleoside-diphosphate reductase 2, alpha subunit
ERGRSRLEATAQHLGQQFPRQRFIAARQRQRHHAGALLKGFQIAFAVEGFQRVAGIKLPRTEEGVKTEAPGVSLFVQLAQEGEIVLVQHPSFIIAFGHQIAQAFAVRVEWHAVGLDVLQEKLACGFMIFAELDAAIGVIQVQHRVERVFKAVEIGNLTFLRNDVARQAEARAKVAIARSNHTANTAPALRGVERNTPRRQAETGDKPAGDFVGTEAAPVVVVRHYDRHLAIAERFELIDGFRLAIEVNQLVVDATAIHGIFGGVTLDTLALSVARYEAKTLLLRTSSLLTSGSELMC

SEQ ID NO: 178000 - protein, 112 aa, Glycine max
  Coding DNA Sequence Number=SeqID_61222
  Homolog annotation: Hit_ID=Q8ZML5; Match level="QueryCoverage=98%, HitCoverage=95%, E-value=3e-48, Identity=80%"; Hit description =Putative cytoplasmic protein
MYLRPDEVARVLEKAGFEMDVLTPKTYGYRRGENYVYVNREARMGRTALIIHPTLKEKSQHFAEPASEMKTCDHYTQFPLYLMGDSQEHYGIPHGFSSRMALERYLQGVFGA

SEQ ID NO: 178001 - protein, 105 aa, Glycine max
  Coding DNA Sequence Number=SeqID_61223
  Homolog annotation: Hit_ID=P0ADQ7; Match level="QueryCoverage=79%, HitCoverage=76%, E-value=1e-18, Identity=56%"; Hit description =Hypothetical protein ygaM
  Pfam annotation: Domain name=DUF883; Domain location=10-105; Score =124.4; E_value=3.1e-34; Accession=PF05957.3; Description=Bacterial protein of unknown function (DUF883)
MFNRTSKNDDIDINQDVNELADSLEALLKSYGSEAKDEVDSARSQAQALLKQTRAKLNGSGNRVTQAARDAGYQVDAYVHDKPWYGVGVGAAVGLVLGALLMSRR

SEQ ID NO: 178002 - protein, 387 aa, Glycine max
  Coding DNA Sequence Number=SeqID_61224
  Homolog annotation: Hit_ID=P0A951; Match level="QueryCoverage=46%, HitCoverage=96%, E-value=6e-83, Identity=83%"; Hit description =Spermidine N(1)-acetyltransferase
  Pfam annotation: Domain name=Acetyltransf_1; Domain location=106-187; Score=78.3; E_value=2.4e-20; Accession=PF00583.14; Description =Acetyltransferase (GNAT) family
  Pfam annotation: Domain name=FR47; Domain location=113-197; Score= -5.2; E_value=0.041; Accession=PF08445.1; Description=FR47-like protein
  Pfam module annotation: Pfam domain module=Acetyltransf_1::FR47; Domain location=106-187::113-197
MSVQAEILNLLNDLKQNDGLTMVLRNAARFIPKVECAAAQQPFSHLKEHRMTVKLRPLEREDLHFVHQLDNNASVMRYWFEEPYEAFVELSDLYDKHIHDQTERRFVVEHDGQKAGLVELVEINHVHRRAEFQIIIDPAHQGKGLASRAAKLAMDYGFSVLNLYKLYLIVDQENEKAIHIYTKLGFEVEGVLKHEFFINGEYRNTIRMCIFQQQYLAQHKSGNAMVIHTTIKRIDHQPAWETEQRNIAQHVPQVGAGLDGQRQRYIARTLQHHLIMFLTEIGAIGFRQIHRLRRIALRHRAAGFILHGETRALRHRVNFYRLRFGADNGGTAAQQQRTGGKKMSQVHSRRQSPRYPAAWCDSSRQSAVRPPVATRGTYRAACSQTAP

SEQ ID NO: 178003 - protein, 355 aa, Glycine max
  Coding DNA Sequence Number=SeqID_61225
  Gene Ontology: Mol. function=nucleoside-triphosphatase activity; Cellular component=membrane; Biological process=cobalt ion transport
  Homolog annotation: Hit_ID=Q48HF1; Match level="QueryCoverage=93%, HitCoverage=87%, E-value=4e-71, Identity=41%"; Hit description =Dipeptide ABC transporter, ATP-binding protein
MAEARVDAIVDVIASQQLKRFRQRAAQPVARMQRSVGILKHHLHIAPQLAGKGFARLHGGIRQRHLAAPVRVQSGHHPQQRRFTAAGRPHQTETLAGRHLQVHIVHHAPRDPAPAGVRHASLYPDGRPTACGRPFVHHHHPLTVLGDLLQIVTDQQQAHIALLHQATNQRQHLIAHGVIERRGWLIGNQQSGIGNQRDRQHHALAHAAGELMRIALHQLARLGQAHRVQHLAHFLFALGAAQLAVQHQRLFNLPANGARRVERVFRILHDHRHFAAAQADPVALAQVQGVCARHLQPVSLQLQRGRQQAHQRTRGQGFARAGFTDQRHAFAAKGKADVIHQQRVVAANRQPLRIN

SEQ ID NO: 178004 - protein, 795 aa, Glycine max
  Coding DNA Sequence Number=SeqID_61226
  Gene Ontology: Mol. function=hydrolase activity, acting on acid anhydrides, catalyzing transmembrane movement of substances; Cellular component=integral to membrane; Biological process =magnesium ion transport
  Homolog annotation: Hit_ID=P22036; Match level="QueryCoverage=99%, HitCoverage=87%, E-value=0.0, Identity=70%"; Hit description =Magnesium-transporting ATPase, P-type 1 (EC 3.6.3.2) (Mg(2+) transport ATPase, P-type 1)
  Pfam annotation: Domain name=Cation_ATPase_N; Domain location=30-103; Score=68.5; E_value=2.1e-17; Accession=PF00690.16; Description=Cation transporterATPase, N-terminus
  Pfam annotation: Domain name=E1-E2_ATPase; Domain location=120-368; Score=267.4; E_value=3e-77; Accession=PF00122.10; Description=E1-E2 ATPase
  Pfam annotation: Domain name=Hydrolase; Domain location=372-670; Score=55.4; E_value=1.9e-13; Accession=PF00702.16; Description =haloacid dehalogenase-like hydrolase
  Pfam module annotation: Pfam domain module=Cation_ATPase_N::E1-E2 _ATPase::Hydrolase; Domain location=30-103::120-368::372-670
MTDMKLNQEKKAWNTVRPARQKTARYLIEDEAAFTADETLLRLRSDALGLVEREAEARLQIYGRNQVEHDKAPPALVQLIQAFNNPFIYVLLALALVSFFTDYWMPLRHGEETDLTGVIIIVTMVTLSGLLRFWQEFRTNKAAQALKSMVRTTATVLRRESVQQAPQKQEVDITSLVPGDIIYLSAGDLVPADVRLLDSRDLFISQAILTGESLPVEKYDVTGHVASKQASASDKDASLLELGSVCLMGTNVSSGSAKAVVVATGGETYFGSLAKSIVGNRTQTAFDRGVNSVSWLLIRFMLVMVPVVLLINGLTKGDWLDASLFALAVAVGLTPEMLPMIVSSNLAKGAIAMSRRKVIVKRLNAIQNLGAMDILCTDKTGTLTQDNIILEHHLDCAGVENSRVLMLSWLNSHYQSGTPNLMDRAILRYGKGRISADMSDYYSKVDELPFDFVRRRVSVVVRDRRLNQQMLICKGAVEEMLSIASAEREGKLIQPLNETRRAELLALAHQYNQQGFRVLLVASRALAEPGLQQALSVANEQGLTIEGLLTFLDPPKESAAKAITALNENGVTVKVLTGDNPVVTARICQQVGIDCGEILTGEAIAAMSDEQLAQAAARSSVFAKLTPLQKSRILRALQQQGHTVGFLGDGINDAPALRDADVGISVDSAADIAKESSDIILLEKDLMVLEEGVMKGRETFGNIIKYLNMTASSNFGNVFSVLVASAFIPFLPMLAIHLLIQNLMYDLSQLALPWDKMDREFLRKPRKWDARNIKRFMLWIGPTSSIFDITTFALM

SEQ ID NO: 178005 - protein, 445 aa, Glycine max
  Coding DNA Sequence Number=SeqID_61227
  Gene Ontology: Mol. function=nucleotidyltransferase activity; Biological process=DNA modification
  Homolog annotation: Hit_ID=UPI00005F74CD; Match level="QueryCoverage =99%, HitCoverage=56%, E-value=0.0, Identity=78%"; Hit description =COG3378: Predicted ATPase
  Pfam annotation: Domain name=D5_N; Domain location=7-141; Score=55.8; E_value=1.4e-13; Accession=PF08706.1; Description=D5 N terminal like
  Pfam annotation: Domain name=Pox_D5; Domain location=341-440; Score =81.9; E_value=2e-21; Accession=PF03288.6; Description=Poxvirus D5 protein-like
  Pfam module annotation: Pfam domain module=D5_N::Pox_D5; Domain location=7-141::341-440
MSASEKAELLAEHYGNTLAVPPVGEGLCRYTRGAWQMLPHRQLSREIAALFQKVRAPFSAAGINSILDTLKLMVPQMGDPARRLIGFRNGVFDTVSGQFSAHRQEHWLRTVNSVDYTPSRAGENLADYAPHFWQWLTRVAGGNHDKQERILAALFMVLANRYDWQLFLEVTGPGGSGKSVMAAIARLLAGADNTTSATIDNLESARERASVVGYSLIILPDQEKWSGDGAGIKAITGGDAVAIDPKYRDAYAAYIPAVILAVNNNPMQFSDRSGGVSRRRVIITFPDAIPLAERDPQLLDKITNELSVIVRHLMQRFANPNEARTLLQAQQSSDEALTIKRQADPLVDFCGYLTVLGTPEGMMIGNANIIPPNPRRYLYHAYLSFMAARGYQHVMNLTAFGLAVPQTLKEYEHTLLKRRTKQGMQTNVVLSEECEADWLPKCGTV

SEQ ID NO: 178006 - protein, 304 aa, Glycine max
  Coding DNA Sequence Number=SeqID_61228
  Gene Ontology: Mol. function=sequence-specific DNA binding; Cellular component=intracellular; Biological process=regulation of transcription, DNA-dependent
  Homolog annotation: Hit_ID=Q3P902; Match level="QueryCoverage=94%, HitCoverage=94%, E-value=7e-80, Identity=54%"; Hit description=Helix- turn-helix, AraC type:AraC-type transcriptional regulator, N- terminal
  Pfam annotation: Domain name=AraC_N; Domain location=24-175; Score =122.9; E_value=9e-34; Accession=PF06719.3; Description=AraC-type transcriptional regulator N
  Pfam annotation: Domain name=HTH_AraC; Domain location=190-236; Score= 38.0; E_value=3.3e-08; Accession=PF00165.13; Description=Bacterial regulatory helix-turn-helix proteins, araC family
  Pfam annotation: Domain name=HTH_AraC; Domain location=242-286; Score= 19.5; E_value=0.012; Accession=PF00165.13; Description=Bacterial regulatory helix-turn-helix proteins, araC family
  Pfam module annotation: Pfam domain module=AraC_N::HTH_AraC::HTH _AraC; Domain location=24-175::190-236::242-286
MAALLQAARHYADEHHNGAGVAATPVDGVFILRETAPTALQFAITKPLIAMVLQGSKRVTMGTDRFDFGAGESLLITMDVPTVSQVISASADTPYYSLVVELDAAVICELMANMVGLEAATDLPVSIDQIEEDVAEAALRLLNMLSRPHALAVLGSQLVRELHYWLLSGRHGSALRALGSTDSHARRIARAVAIIRANYAQPLRMKTLADAAGMSLSVFHTHFRHITTLTPLQFQKQLRLLEARRLMLTEGTAIGIAANAVGYESVTQFTREYSRLFGSPPARNIRETRALERSVLSGEPAWRS

SEQ ID NO: 178007 - protein, 251 aa, Glycine max
  Coding DNA Sequence Number=SeqID_61229
  Gene Ontology: Mol. function=oxidoreductase activity; Cellular component=membrane; Biological process=metabolic process
  Homolog annotation: Hit_ID=Q3P901; Match level="QueryCoverage=99%, HitCoverage=100%, E-value=1e-100, Identity=72%"; Hit description =Short-chain dehydrogenase/reductase SDR
  Pfam annotation: Domain name=Epimerase; Domain location=5-246; Score=- 66.6; E_value=0.088; Accession=PF01370.11; Description=NAD dependent epimerasedehydratase family
  Pfam annotation: Domain name=KR; Domain location=6-192; Score=-36.1; E_value=3e-05; Accession=PF08659.1; Description=KR domain
  Pfam annotation: Domain name=adh_short; Domain location=3-175; Score =84.3; E_value=3.9e-22; Accession=PF00106.15; Description=short chain dehydrogenase
  Pfam module annotation: Pfam domain module=Epimerase::KR::adh_short; Domain location=5-246::6-192::3-175
MTTLSLVTGASRGLGRNTALSIARHGGEVIVTYRTGKEAADAVVNEIQALGRKAVALQLDTSNVSSFPGFVAAVRNILKGDWGRETFDHLINNAGHGEMADFSATTEEQFDALFNVHVKGVFFLTQSLLPLLVDGGRIINFSSGLTRVSFPGFSAYSAAKGAVEILSVYMAKELGSRGITVNTVAPGAIETDFLGGAVRDIPDYNQAFAGMTALGRVGLPDDIGPMIASLLGPDNRWVTGQRIEVSGGQSI

SEQ ID NO: 178008 - protein, 318 aa, Glycine max
  Coding DNA Sequence Number=SeqID_61230
  Pfam annotation: Domain name=DUF680; Domain location=39-108; Score= -14.7; E_value=0.024; Accession=PF05079.3; Description=Protein of unknown function (DUF680)
MARFELSFTSYFHIAHGWPLRHTVAHLCQKRPQKREYIMKKTIIALSAILLTSTAFAATHATDETVADAKAGANTAKEKLHQAQHQGEEQQLKAKHAAEGKSDSLTSKASENSQKAWNSTKEGTEKGWDATKEGAQKGWNKTKEGASDLKKKVSESCSRGMANGMDLALMQIVNDVSLVEVQHATDREQAKSEVLLSGSSTGIIIPGKILEAAVKITDNRYILFVTDDVLYEESLTIVLIDSSQGIQEIVTIGNEYNSGTFEQLHISDHSLQFRFIGDYIWSLKLEESPKFQLPFFSDPKGVSRSKAFTRFMNITALP

SEQ ID NO: 178009 - protein, 167 aa, Glycine max
  Coding DNA Sequence Number=SeqID_61231
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSVPRWQNEREPTNGSLFWPNIVEEERDTGLIGEGRIKATRAESQWIVAARPLCHLQYPV

SEQ ID NO: 178010 - protein, 370 aa, Glycine max
  Coding DNA Sequence Number=SeqID_61232
  Gene Ontology: Mol. function=ATP-dependent DNA helicase activity; Biological process=DNA repair
  Homolog annotation: Hit_ID=UPI00006805F1; Match level="QueryCoverage =100%, HitCoverage=57%, E-value=1e-157, Identity=73%"; Hit description=similar to Superfamily I DNA and RNA helicases
MNHRSQRRIVTLINKIWETELEGRTQPTKGSAQHPRTEKAGGTVRLFLGDTSRSPEDKVLSERWCAERMFQISGIADWNQGQYQLLALEHKLVATRGSFLDVYEAMVLLDPNAAAPSGSGDNKGPSTVQILLNELAHLEACVSNEGIVNEFKATEVFRRYGGLDNMPEDSEARVYRTDEMLEAIAVFAMACANPGSTVAEVLAPVLNAKLFEVDHRLQEAYADKSPAPPAPGRGEDESKQTRIRRGWCALFAAPWKQLKCYRNYLAGISELATHQVVKGSEFKHVMVVMDDALAGGNLIKYDKFFGGAELSPTDKKNAESGKETTIDRTLRLLYVTCSRAQESLALVLWSSDPAAAMARIKESQWFYEEE

SEQ ID NO: 178011 - protein, 47 aa, Glycine max
  Coding DNA Sequence Number=SeqID_61233
MKSGFTLFVRKHSSLTTHEILLYWAGTIECNGVGKCRGCPTLSHPRH

SEQ ID NO: 178012 - protein, 190 aa, Glycine max
  Coding DNA Sequence Number=SeqID_61234
  Homolog annotation: Hit_ID=Q1STP5; Match level="QueryCoverage=90%, HitCoverage=30%, E-value=5e-10, Identity=29%"; Hit description=IMP dehydrogenase/GMP reductase
MVKIMVRTRGLGRALARVIGRARRQQVHIAVDEGVPQVTEDVPHMAEDVPQMTEDVPHMADDVLQMSEDTPQMTADVDATVAEDLDRDGAEGSHADEGFPGGPRDPSVLTSFAEHVAHAIWTGQECPELKLVSHGRKVALIGRPMPKIEGLVVATGLSPLIGCSVVTGDPGLIFAFVERWHRETSTIHLP

SEQ ID NO: 178013 - protein, 74 aa, Glycine max
  Coding DNA Sequence Number=SeqID_61235
  Homolog annotation: Hit_ID=Q1SEE1; Match level="QueryCoverage=83%, HitCoverage=4%, E-value=1e-07, Identity=47%"; Hit description =Integrase, catalytic region; Zinc finger, CCHC-type; Peptidase aspartic, catalytic
SSATKENTLKLSDIRDLILSEDVRKRDLRESSNHVSNSALNTKGRGRTTQKGQNGRGRSSGLRIIKNRGGGGLN

SEQ ID NO: 178014 - protein, 67 aa, Glycine max; identical to SEQ ID NO: 119071
  Coding DNA Sequence Number=SeqID_61236

SEQ ID NO: 178015 - protein, 155 aa, Glycine max
  Coding DNA Sequence Number=SeqID_61237
MVIDQSFLFELTQLSSDGVPFEGTLDDEWKFDFSISDTRRMVCTNQSDMTGRLLAGSLAFECRIMHYLIVRILLPRSSYLAHDAPAQAAEDHSPSPPPQRDDSSSLMHNILDRLDGLHTFFGERFDSLDNCIDAIDARFAGMDTRITQLEEDMSY

SEQ ID NO: 178016 - protein, 582 aa, Glycine max
  Coding DNA Sequence Number=SeqID_61238
  Gene Ontology: Mol. function=transporter activity; Cellular component= membrane; Biological process=transport
  Homolog annotation: Hit_ID=UPI00005F9076; Match level="QueryCoverage =98%, HitCoverage=85%, E-value=0.0, Identity=61%"; Hit description =COG4771: Outer membrane receptor for ferrienterochelin and colicins
  Pfam annotation: Domain name=Plug; Domain location=1-104; Score=74.8; E_value=2.7e-19; Accession=PF07715.5; Description=TonB-dependent Receptor Plug Domain
  Pfam annotation: Domain name=TonB_dep_Rec; Domain location=353-543; Score=43.4; E_value=7.5e-10; Accession=PF00593.14; Description=TonB dependent receptor
  Pfam module annotation: Pfam domain module=Plug::TonB_dep_Rec; Domain location=1-104::353-543
ISVISKQQIEDKAYRDVTDALKDVPGVVVTGGGSSSDISIRGTASQYTLFKVNGKRVSTRSTRPNSDNSGIEQGWLQPLESIERIEVISGPMSSLYGSDAMGGVINVITKKVSNTKAWTGSLHGDATFQENNDSGDIFQTNAYASGPLIDGLLGAKVTGLLSRRAEDKIVNGYNEQKMRNGGITLNFTPDEQNDFDLDFARELQDRNSTPGMSKATETCRGTTCTPNTKSETRYEHTTYSLTHSGYYDDFNTTSYIQQEETNNPDREMRSYNTTFNNQNQIFLADHTLTLGGQYRYEKLRDNGNQLEAADGLNKLTRWSWALFAEDEWAMTESFTLTGGLRMDKDQNYGTNWTPRGYGVWHLADQWTLKGGVSAGYRAPDLRQSSASWGQVTGGGRLDGIIVGNPDLKPEKSLSEEIALLWDNNDNLNAGVTLFNTDFKDKITEVRRCNSSSDPACTIGDHSYDFVSDRVNVDKANMRGVESTFGWKITRDVNWTANYTYTESEQKSGQFSGKPLNKMPKHMFNTTLDWQATPDVGFWSRLNLRGKTSEYLSRTSMSQGTPSYTQVDVGLRYNANKNLLVTA

SEQ ID NO: 178017 - protein, 152 aa, Glycine max
  Coding DNA Sequence Number=SeqID_61239
  Gene Ontology: Mol. function=protein transporter activity; Cellular component=membrane; Biological process=intracellular protein transport
  Homolog annotation: Hit_ID=Q9LGF8; Match level="QueryCoverage=54%, HitCoverage=23%, E-value=5e-13, Identity=52%"; Hit description =Putative syntaxin of plants 31
  Pfam annotation: Domain name=SNARE; Domain location=49-117; Score =27.5; E_value=4.8e-05; Accession=PF05739.9; Description=SNARE domain
MAPFQLEVAMLGLTQKNWKQVDGESQPLLQQQQQQQQEVVPLQDSYMQSRAEALQNVESTIHELSNIFNQLATLVSQQGEIAISLLLLVQHVNGHVGVLSAVGQIDPKSTPALSHSRACFKFTIPAPCRLGQIGFSRDRVCWLLTKVGGCRS

SEQ ID NO: 178018 - protein, 198 aa, Glycine max
  Coding DNA Sequence Number=SeqID_61240
  Homolog annotation: Hit_ID=Q9LGF8; Match level="QueryCoverage=20%, HitCoverage=11%, E-value=4e-13, Identity=92%"; Hit description =Putative syntaxin of plants 31
  Pfam annotation: Domain name=SNARE; Domain location=155-196; Score =9.3; E_value=0.04; Accession=PF05739.9; Description=SNARE domain
  Subcellular localization annotation: CTP_CleavageSite=82; ConfidenceScore=5.62e-01
MKVHENRRQLFSSSASKDSANPFIRQRPLAARAAASTSSAPALPWANGSPSSSQAFPKILVACVCCFLAICCVMQTLCCWPSLAQRNSRTIETLPGQEYLVGQTGWSKMHVEKQAGPLKTFSFVGKQVDGESQPLLQQQQQQQEVVPLQDSYMQSRAEALQNVESTIHELSNIFNQLATLVSQQGEIAIRQYKTFQYI

SEQ ID NO: 178019 - protein, 376 aa, Glycine max
  Coding DNA Sequence Number=SeqID_61241
  Gene Ontology: Mol. function=transporter activity; Cellular component= integral to membrane; Biological process=transport
  Homolog annotation: Hit_ID=Q6Z1Z0; Match level="QueryCoverage=94%, HitCoverage=75%, E-value=1e-107, Identity=58%"; Hit description =Putative sulfate transporter-like
  Pfam annotation: Domain name=Sulfate_transp; Domain location=33-355; Score=-113.9; E_value=0.00092; Accession=PF00916.10; Description =Sulfate transporter family
MKSIAAVALADPTFSIPEIMASGILTGATLLVLGVTGLMQLVYKLIPLCVVRGIQLAQGLSFALTAVKYVRKVQDLPRSKSLDQRYWFGFDGLVLAIVCVCFIVIVNGAGEDHDHDHGHGHGEESTHQTQARISKVRKIRRVIFALPSAFLVFVLGVVLTFIRRPRVMHEIKFGPSSIEVVKMSRHAWKQGFIKGTIPQLPLSILNSVIAVCKLSSDLFPGKDFSVTSLSVTVGLMNLVGGWFGAMPCCHGAGGLAGQYKFGGRSGGCVALLGAAKLILGFVLGSSLAHFFNQFPVGILGVLLLFAGVELAMASRDINTKEDSFVMLLCTAVSLVGSSAALGFLCGMIVFVLLKLRDWTNGKPINAIWKHEGPEEQ

SEQ ID NO: 178020 - protein, 379 aa, Glycine max
  Coding DNA Sequence Number=SeqID_61242
  Gene Ontology: Mol. function=zinc ion binding
  Homolog annotation: Hit_ID=Q69L44; Match level="QueryCoverage=91%, HitCoverage=47%, E-value=4e-90, Identity=46%"; Hit description=SWIM zinc finger family protein-like
MIFAVIPFARVDDFVKGESSNPECPASFRIESRRKRPVGSIAKPRVDGYLEYTLYWCSYGPEDYRESDSGVGDGTSTKPASGKGSRPGRRHMMRGCLCHFTVKRLYTRPLLALIIYNQRRHVDKSGAPCHGLLDRDAVGTRAMYAPRISDELRQKVMSMLYVGISLDKIIQHHAEGMQKQGGPQNRDDFLTRNDVRNMERTVRNSSHELHENDECSVKIWVQRHQKHVFYFQDNSGSEPFVLGIQTDWQLQQMLRYGNNSFISFHSSFGLKKLKYPICSLLVFNSSQNAIPVAWIITSSSVGKAIHKWIVLLCERLRTKDPRWRPNAILLDDPSLDYSIIRDPHLNSKWSEILLIAERLSSVASYYVPGMFAVLGLKNF

SEQ ID NO: 178021 - protein, 56 aa, Glycine max
  Coding DNA Sequence Number=SeqID_61243
LPTRHTDTKTKDQILNHSSQKIKNIQITASNMLQRSSLNLPINMGQTPPIMYLEGQ

SEQ ID NO: 178022 - protein, 80 aa, Glycine max
  Coding DNA Sequence Number=SeqID_61244
MAIISPTKISQPPFPRGYNPNMTCTYHGGVSKHSIEHCMTLKHKDFHVYAITVNNSHNANNMDKFNVLVSHSLAITSLLI

SEQ ID NO: 178023 - protein, 135 aa, Glycine max
  Coding DNA Sequence Number=SeqID_61245
  Subcellular localization annotation: CTP_CleavageSite=75; ConfidenceScore=5.30e-01
MILHVIRRPNSLKAIPSGVANYRNLPFDGRATRGLTGASSKKGKCTKSPPTFIQGKCRKNQNVWSTNFNRERFRSCFYARGRRETLRRWTINDLLVFERRETLRRWTINDLLGWSTKAGLLLLRILNCDEKIRPT

SEQ ID NO: 178024 - protein, 162 aa, Glycine max
  Coding DNA Sequence Number=SeqID_61246
MKFSNLLSKGNAEKDSKNHGESHPQPQYNQHLLQSKTKNMPQSLQVKNVTEWKVRQADLELGYLKSAFPDYAKQSLRDAYLANSSDLDYSIDLLHHFDDDEAKFFISRFNLGFVNYKFLIVFTLQINGDKSSVRHWILGMLQNLYQQLKLVLRQIWHKFKSE

SEQ ID NO: 178025 - protein, 437 aa, Glycine max
  Coding DNA Sequence Number=SeqID_61247
  Homolog annotation: Hit_ID=Q75GB5; Match level="QueryCoverage=26%, HitCoverage=34%, E-value=5e-20, Identity=45%"; Hit description =Putative senescence-associated protein
  Pfam annotation: Domain name=DUF581; Domain location=333-391; Score =74.4; E_value=3.7e-19; Accession=PF04570.5; Description=Protein of unknown function (DUF581)
MGCFEIIMLRKRNRSVQKDQHHMCEANSEHYSQSHHALVGRNNIKGHSIFNVPCLFVGLGPKGLLDSDSVRSPTSPLDARVLSNLGNPVRKPRSSPHEKRWDCCKVGLGIVESLEDCSRFSGKILQSPESKRVSLSPQIMIKAPNCQIHRDSFEGSKSLPKDFCKAPYYAPQNGSVIHKGECESESTVLFEIGESGLELELFGKTRSCSLDSCSPLKALSGVATSYSDSDTDNFAMKDVSSPPHFIGGSQNSNNFTPTKPNSTTLSISSSNEFIKSLSASEIELSEDYTCVISHGPNPKTTHIFGDCILETHSNVFKTHFKSEEKEKRVNPLGNNKLGSPNPYPSSDFLSFCHHCNKKLEEGKDIYIYGGEKAFCSFTCRAMEIMIDEELEKSTSNPPCENSPNPKLDRTLMLQKDKGAFAEVRLWLDIKLCSSETD

SEQ ID NO: 178026 - protein, 599 aa, Glycine max
  Coding DNA Sequence Number=SeqID_61248
  Gene Ontology: Mol. function=lactate transporter activity; Cellular component=integral to membrane; Biological process=lactate transport
  Homolog annotation: Hit_ID=P33231; Match level="QueryCoverage=84%, HitCoverage=92%, E-value=0.0, Identity=69%"; Hit description=L -lactate permease
  Pfam annotation: Domain name=Lactate_perm; Domain location=107-599; Score=938.6; E_value=2.6e-279; Accession=PF02652.5; Description=L -lactate permease
MQDVVTLGLIGLNLRFIRAAMRAPLPHGHITRKITPAALLWVNNALTIWSQKARQLQCGPTNCGAEPGNNLRRTPAFADAPHPSGDLWRNGMQVWQQNYDPLNNLWLSSLVAVIPIVFFFFALIKLKLKGYQAGTITVVLALLVALLLYGMPVPQALASVAYGFLYGLWPIAWIIVAAVFVYKISVKTGQFDIIRASILSITPDQRLQMLIVGFSFGAFLEGAAGFGAPVAITAALLVGLGFNPLYAAGLCLIVNTAPVAFGAMGIPIIVAGQVTGLDSFQIGQMAGRQLPFLTLIVLFWIMAIMDGWRGIKETWPAVMVAGGSFAIAQYLSSNFLGPELPDIISSLASLICLTLFLRRWQPVRIFRFKEPAPETAPSGTQRYTLAQIVRAWMPFLFLTATVTLWSIPPFKALFAKGGALYDWVFSVPVPLLHELVARMPPVVSAATPYAALFKFDVVSATGTAILLAAVISVIFLRMKPAAALRTFGETLKELALPIYSIGMVLAFAFISNYSGLSATLALALAHTGQAFTFFSPFLGWLGVFLTGSDTSSNALFAALQATTAQQIGVSDVLLVAANTTGGVTGTMISPQSIAIACAA

SEQ ID NO: 178027 - protein, 402 aa, Glycine max
  Coding DNA Sequence Number=SeqID_61249
  Gene Ontology: Mol. function=aminoacyl-tRNA ligase activity
  Homolog annotation: Hit_ID=Q2PF39; Match level="QueryCoverage=72%, HitCoverage=39%, E-value=7e-60, Identity=40%"; Hit description =Aminoacyl-tRNA synthetase
MQAVEEGGGGEERNARFEENDLDLEISKLRGRWELASVLNFLDVFGPILGKDLNLSAEDIEIGLVKPDASLARLHIQLLKGIPPVSKTLEDSDKWVTALCKNLTTWWPWVAKGEIPLVPSKGVEISKYKELDPLDRLLLLKALCEVRAQQHDAVSYINDALKEGTQISTFRKDAVGRDGTGTSYWYDATSKGQSHRLYREIITSDSIPNDKDEECLSLPTIQWETLASNLEDFSKVAEKFAISKSAVEVAVSMKLQDDAIPALEKLRKKKERAIKQKQRQDMLLKKDFQNSHYSGNTRSCRTRRPISYTFVENHGSSEEDGVDGELGNLEAPSSHAVSYPKGVRCSKRLAGVPSHTILESRGLTAKQRLRQRPTRNSAMESINVSDSEDEAREGKRDLSEST

SEQ ID NO: 178028 - protein, 118 aa, Glycine max
  Coding DNA Sequence Number=SeqID_61250
MELVRHQEEDRELDWRRRNWSARSRCPVSDTKTIYTNTGANEIRENEVVVDMNMRDESNGLSGNKPDEDAITPPFPHRAKLRQRQSHDEDKYVTVTEMNLLQHSKLCHSSETLLLKTS

SEQ ID NO: 178029 - protein, 338 aa, Glycine max
  Coding DNA Sequence Number=SeqID_61251
  Gene Ontology: Mol. function=acetylglutamate kinase activity; Cellular component=cytoplasm; Biological process=amino acid biosynthetic process
  Homolog annotation: Hit_ID=Q1SYL0; Match level="QueryCoverage=99%, HitCoverage=99%, E-value=1e-131, Identity=74%"; Hit description =Acetylglutamate kinase
  Pfam annotation: Domain name=AA_kinase; Domain location=77-315; Score= 183.1; E_value=6.6e-52; Accession=PF00696.18; Description=Amino acid kinase family
  Subcellular localization annotation: CTP_CleavageSite=44; ConfidenceScore=5.73e-01
MAGAAKTLTNLCPSFPFTTKPQNPLTTHHSFPSTRLRHRAISAVANPVQPPLTTTEGQYRVDVLSESLPFIQKFRGKTIVVKYGGAAMKSPELQASVINDLVLLSCVGLRPVLVHGGGPEINSWLGRLNIPAVFRDGLRVTDADTMEIVSMVLVGKVNKTLVSLINKAGATAVGLSGMDGRLLTARPAPKAAALGFVGEVARVDPTVLRSLIDTNHIPVVTSIAADESGQPYNINADTVAGELAAALGAEKLILLTDVAGILEDRNDPDSLVKKIDIKGVKKMMEDEKVGGGMIPKVNCCVRSLAQGVTTASIIDGRVPHSLLLEILTDEGAGTMITG

SEQ ID NO: 178030 - protein, 267 aa, Glycine max
  Coding DNA Sequence Number=SeqID_61252
  Gene Ontology: Mol. function=voltage-gated potassium channel activity; Cellular component=membrane; Biological process=potassium ion transport
  Homolog annotation: Hit_ID=Q1SYJ7; Match level="QueryCoverage=88%, HitCoverage=46%, E-value=2e-68, Identity=53%"; Hit description =Cyclic nucleotide-binding; Cation channel, non-ligand gated
  Pfam annotation: Domain name=Ion_trans; Domain location=95-241; Score= 22.9; E_value=0.00068; Accession=PF00520.21; Description=Ion transport protein
  Pfam annotation: Domain name=Ion_trans_2; Domain location=172-247; Score=47.6; E_value=4.1e-11; Accession=PF07885.6; Description=Ion channel
  Pfam module annotation: Pfam domain module=Ion_trans::Ion_trans_2; Domain location=95-241::172-247
MVALRMSMSSLVRRRSSDEITNSASVSSSLFPAFGTTIFDIEGYSKSNLRKYVIAPYDRRYQLWQTFLVALVVYSAWASPFELAFRELLVGSLLPVDLLVDAFFAVDIILTFFVAYLDTSTYLLVDDHKKIALRYVKKLHFTMDVASTVPFEQIHQILTGKPTKSEVSGFLIMLRLWRLRRVSELFASVGLGYTYSMYWSVATLTTVGYGDFYAVNLTEKLFSTIYMLFNIGLTSYIIGNMTNLLVHSSVRNFVMVNFMTISMVVYI

SEQ ID NO: 178031 - protein, 93 aa, Glycine max
  Coding DNA Sequence Number=SeqID_61253
MVDTYRFAAMIDSLNKREGRGRFESGVLFLHLPNMQVAGGSGDFVHERHMASAGGRAKLVGDFKLPHWNRWSCWRHQPRVSFSGRFQLFQIAV

SEQ ID NO: 178032 - protein, 121 aa, Glycine max
  Coding DNA Sequence Number=SeqID_61254
  Homolog annotation: Hit_ID=Q5ZD36; Match level="QueryCoverage=44%, HitCoverage=2%, E-value=6e-18, Identity=75%"; Hit description=Zinc finger-like
MPRYVHNLILKRKGSMMHFDEGLFARHKGGESTKVVTKGLRGKSASKKLTEEEVLVEKNFDLAFLLIYEFNLPAVDIYASVAASLAERKRGSQLTEFFRNIKGTIDDDDWDQGEVYKRTHL

SEQ ID NO: 178033 - protein, 88 aa, Glycine max
  Coding DNA Sequence Number=SeqID_61255
MASSEPIAPEAEPESRLSSLIYEKSNEVQGFMENMFRTITEINQNSAVVEEEIEKCKGSGLERKRALDEEKDNFQKAAYAVLDMLNRE

SEQ ID NO: 178034 - protein, 123 aa, Glycine max
  Coding DNA Sequence Number=SeqID_61256
MMITIFSDKGYDQQASQVAHCEEAVTTLPFCRGCGRGPPRWLLAARRRTDDGYSRVIGEEIFNGFVATGYRYFMKEMVINNEGLLGKRRNNGERKKKCRCEKLPPTTTANGDRKVAGREEEYI

SEQ ID NO: 178035 - protein, 294 aa, Glycine max
  Coding DNA Sequence Number=SeqID_61257
  Gene Ontology: Mol. function=voltage-gated potassium channel activity; Cellular component=membrane; Biological process=potassium ion transport
  Homolog annotation: Hit_ID=Q1SYJ7; Match level="QueryCoverage=99%, HitCoverage=47%, E-value=1e-119, Identity=73%"; Hit description =Cyclic nucleotide-binding; Cation channel, non-ligand gated
  Pfam annotation: Domain name=cNMP_binding; Domain location=62-151; Score=52.6; E_value=1.3e-12; Accession=PF00027.19; Description =Cyclic nucleotide-binding domain
MLAHMQLKFQTAELQQEVLQDLPKTIRSSIARHLFQNIVETTYLFKGVSDDFITQLVSETKAEYYPSKVDIILQNEMPTYFYILVSGSLDVLIYKNGSEQFLFKLESGGMAGEIGVMFNIPQPFTVRSRGLSQVIRINHHHFKQMVQPFSDDGKTIIYNFIKYFKGLKGKVLEEIYVTELLGDFHDEHLTRNEGTDEEVSRYQEAPYAEGRTGNSKALSNPVPVRVKIHGHHPNEHKMGNETTPKLILLPNSVEDLFSVAEKKFGNRGSKILMADGSEVEELSTIRENDELYIL

SEQ ID NO: 178036 - protein, 158 aa, Glycine max
  Coding DNA Sequence Number=SeqID_61258
MEKDALWHGLLTQRYGCLDQLGECQAQSRSTKWQDLMRIDVGDNWFSSRVVRQISNGQDTFFWEDCLVWKFMFEGSLSMSFLSGDGTTDGDFTFYSPIGFDDRGQMADLGQAAYCVALVRRGVMVEDGGGCVEFTISSDMQFAGVFGFTRIILFFMER

SEQ ID NO: 178037 - protein, 479 aa, Glycine max
  Coding DNA Sequence Number=SeqID_61259
  Gene Ontology: Mol. function=hydrolase activity, hydrolyzing O -glycosyl compounds; Cellular component=cytoplasm; Biological process= carbohydrate metabolic process
  Homolog annotation: Hit_ID=Q2TI56; Match level="QueryCoverage=97%, HitCoverage=98%, E-value=1e-175, Identity=61%"; Hit description=BglY
  Pfam annotation: Domain name=Glyco_hydro_1; Domain location=5-471; Score=581.8; E_value=6.4e-172; Accession=PF00232.9; Description =Glycosyl hydrolase family 1
MQHPNPGAFPHGFLWGASTSAYQVEGAWNEDGKGPSVIDKGHFPEGMTDFTVTSDHYHRFREDIALLAELGLKTYRFSIAWSRIYPQGDGELNPAGIQFYQQLIDEICRHGIEPLVTLYHFDLPWALQQDGGWSNRRTVTAFERFAITCFEHYGDRVKYWLTINEQNMMILKGEVIGTLPAGTVDAQKTLYQQNHHMMLAQAKAMIACHQRLPQAKIGPAPNISCIYAASARPEDVLAADNFSAIRNWLYLDLAVHGHYNNVVWAFLQQRGWLPHIETEDMATIAAGQPDFIAFNYYASATVSADMPEVARGELNSKQQADQQMAGIDKSVYVGCNNPHLQQNQFGWYIDPVGFRITAREIYARYRLPLIVTENGLGAFDTLEAGNKVYDDYRIAYLREHIAQLRLAIADGVELFGYCPWSAIDLVSTHQGISKRYGFIYVNRDEHDLRDLARYRKKSFFWYQQLIRNNGAQPDAEVEY

SEQ ID NO: 178038 - protein, 195 aa, Glycine max
  Coding DNA Sequence Number=SeqID_61260
  Pfam annotation: Domain name=DUF1218; Domain location=45-161; Score =138.2; E_value=2.2e-38; Accession=PF06749.3; Description=Protein of unknown function (DUF1218)
MAVTVKLMALTVSFFGLLSFILGVIAENKKPPAGTPVFGKDGVTCKFPADPTVALGYLSVIFLIASTVVGYLSLFYPYKGKTVPQGVLFKSMTFAVFFNVALFSTGLAATMLLWPTITEHLHLKRNVHLDLTYTCPTAKTGLFGGGAFLSLDSSLFWLVALLVADNAREDFLDEDKDDKLDVELPSLANHADMVI

SEQ ID NO: 178039 - protein, 141 aa, Glycine max
  Coding DNA Sequence Number=SeqID_61261
MAESFCLSASNIAVQRAQFTGAHQFDDQLQGGLFWAAGRMGNFMRHQISLLIVVSAAQFSPDCAANGRGAGTHSHAFRTTGMVQKESVMLIGFVLLVSACGHDACDALPVSERIYPTKVACEQMADRIHKVRPNVVLLCGE

SEQ ID NO: 178040 - protein, 408 aa, Glycine max
  Coding DNA Sequence Number=SeqID_61262
  Gene Ontology: Mol. function=methyltransferase activity; Cellular component=cytoplasm; Biological process=regulation of transcription, DNA-dependent
  Homolog annotation: Hit_ID=Q1SM58; Match level="QueryCoverage=99%, HitCoverage=61%, E-value=1e-162, Identity=72%"; Hit description=SAM (And some other nucleotide) binding motif; Skb1 methyltransferase
  Pfam annotation: Domain name=PRMT5; Domain location=53-408; Score =363.8; E_value=2.7e-106; Accession=PF05185.6; Description=PRMT5 arginine-N-methyltransferase
MGACLLPAPKGTSCANYARCVNQILQGSNNMQLWLRVPLVKPDDDSMDAKSVALVDSWETWNSFRLLCEHHSQLSVALDILSTLPSPNSLGRWFGEPVRAAILHTDCFLTNSHGCPCLSKRHQSLITGFFNHSIQFIQKQVWMQMIILVQIHKGIPCGHIWTTLDIFTKEWILFLSKNVLRHSIICYYISLDPLSILCQLGYRDFLQSPLQPLMDNLEAQTYETFERDAVKYIQYQRAVSKALLDRVPDEEASVKTIVLMVVGAGRGPLVRASLQAAEETGRKLKVYAVEKNPNAVVTLHALVKLEGWEDTVTIVSSDMRHWSAPEKADILVSELLGSFGDNELSPECLDGAQRFLKQDGISIPSSYVHKFPPTSDSFKVKAHKDLVHFETAYVVKMHNVAKLAPTQP

SEQ ID NO: 178041 - protein, 418 aa, Glycine max
  Coding DNA Sequence Number=SeqID_61263
  Gene Ontology: Mol. function=ubiquitin thiolesterase activity; Biological process=ubiquitin-dependent protein catabolic process
  Homolog annotation: Hit_ID=Q1SM56; Match level="QueryCoverage=96%, HitCoverage=37%, E-value=0.0, Identity=83%"; Hit description =Peptidase C19, ubiquitin carboxyl-terminal hydrolase 2; Ubiquitin carboxyl-terminal ...
  Homolog annotation: Hit description=hydrolase, N-terminal region 1
  Pfam annotation: Domain name=ubiquitin; Domain location=306-380; Score=10.6; E_value=0.022; Accession=PF00240.13; Description =Ubiquitin family
MVLHHFMLRNMLFCPHGQLMPEQAPGAKRVLIPEIFWLFLYEDAVSVKPDDPLGGPTFSSDSDECSQCSNELSEVACLEDSLRLVKQKQRQNHEKLFQAKSLQLSLHSKYFLVPLSWISKWRNYISPTLKNSDKPETLDGVIDSLLCEKHSRLIERPPELVFRRGAIIQRESSAGGLTIVSENDWKCFCEEWGGIETKGISATIDHVNDSENVLTGSSEEMQVCKDQLSTADKMNFENGTGQNLIKTCPEVCESCIGERESCELMQKLNYCNEDICVILVRGKEVPRSILEASKGFVETDRRVSKRSRKSKNGNSISLKVSASTSLYQLKMMIWESFGVVKENQILHKGDRIIVGDDECATLADVNIFAGDQIIVRDSEIHENRDIADELCDDKMDLQHTEEGFRGTLLTANVSSQVV

SEQ ID NO: 178042 - protein, 351 aa, Glycine max
  Coding DNA Sequence Number=SeqID_61264
  Gene Ontology: Mol. function=ubiquitin thiolesterase activity; Cellular component=nucleus; Biological process=ubiquitin-dependent protein catabolic process
  Homolog annotation: Hit_ID=Q1SM56; Match level="QueryCoverage=94%, HitCoverage=29%, E-value=1e-141, Identity=72%"; Hit description =Peptidase C19, ubiquitin carboxyl-terminal hydrolase 2; Ubiquitin carboxyl-terminal ...
  Homolog annotation: Hit description=hydrolase, N-terminal region 1
MRHRMSELSQFNLVYDLSAVLIHKGTGANSGHYIAHIKDVNTGQWWEFDDEHVTNLGFHPFGEESSSSTTKSIKTDAIHSDNSEAMVADSNGNGLNATHSLSSQVETFLSSDAYMLMYHLKQTKNVGESGGVICGANHKESEGVVVAVQNGVPLPSHIYDEIQSFNASYDDACRRYNNRKELELSLISERRQEVRSVLAEAPVQPLEQPFYWISSEWLRQWADNIIPMVLTLQCICSPLDNTPVQCSHGKVPVSKVTSMKRLSAKAWDTLFSKYGGGPALSHDNHCRDCLIHGAMTVVSADTYRDRRESMKSLARDILDGNCLDGKYYISRPWYGNILFHLMPFMLPQKGD

SEQ ID NO: 178043 - protein, 329 aa, Glycine max
  Coding DNA Sequence Number=SeqID_61265
  Gene Ontology: Mol. function=ubiquitin thiolesterase activity; Cellular component=nucleus; Biological process=ubiquitin-dependent protein catabolic process
  Homolog annotation: Hit_ID=Q1SM56; Match level="QueryCoverage=90%, HitCoverage=27%, E-value=1e-141, Identity=82%"; Hit description =Peptidase C19, ubiquitin carboxyl-terminal hydrolase 2; Ubiquitin carboxyl-terminal ...
  Homolog annotation: Hit description=hydrolase, N-terminal region 1
  Pfam annotation: Domain name=UCH; Domain location=92-324; Score=13.6; E_value=2.5e-07; Accession=PF00443.19; Description=Ubiquitin carboxyl- terminal hydrolase
QKQGDDGNGTSEIWRKIHNTGVVSKDDMNQLYMIWKPVCSGCRVNTKDNPNCFCALVPPPNGARKSGLWQKMSDVVESLGHDPTKDLRASADSPAGLTNLGATCYANCILQCLYMNKSFREGMFSVERDVLQQHPVLDQLARLFVQLHISKMAFIDSSPFVKTLELDNGVQQDSHEFLTLLLSLLERCLSHSKVPKATTIVQDLFRGSVSHVTTCSQCGRDSEASSKMEDFYELELNVKGLKSLDESLDEYLTAEELNGDNQYFCESCKTRVDATRSIKLCTLPKVLNFQLKRYVFLPKRASPGTKVTLCLGDQLVMGLNSKTASLHMQ

SEQ ID NO: 178044 - protein, 393 aa, Glycine max
  Coding DNA Sequence Number=SeqID_61266
  Gene Ontology: Mol. function=DNA photolyase activity; Cellular component=mitochondrion; Biological process=DNA repair
  Homolog annotation: Hit_ID=Q1SM50; Match level="QueryCoverage=98%, HitCoverage=62%, E-value=1e-130, Identity=62%"; Hit description =Deoxyribodipyrimidine photolyase, class 1
  Pfam annotation: Domain name=FAD_binding_7; Domain location=117-383; Score=-42.2; E_value=1.5e-06; Accession=PF03441.4; Description=FAD binding domain of DNA photolyase
MRGLKQVVTSPEESSGITVSNNIPKLQLVWGTTMYHLDDLPFDATSLPDVYTQFLLLMLANGIQNLQLVETKCTIRSCIKLPASLGPPPTVQDWGCLPSLEQLGLSSQSVNKGMKFVGGETAALSRVYEYFWKKDLLRVYKETRNGMLGPDYSTKFSPWLASGSLSPRFIYEEVKRYENDRLANSSTYWVLFELIWRDYFRFLSVKYGNSLFHLGGPRKVQRNWSQDKNLFESWRDGCTGLCVHFLFVIWALIGAWEQNGLRHVFWIMIHVLIMETGLMDQELGMIPEKIVISASQNKEILTFTNKCYNCKNSVHWVVLILGGHMAQTYDPEGEYVAYWLPQLRKIPKEKRNFPGNLIYIPQIVPLKFGTTSGHNKDKFFGARRTNDRGSKRR

SEQ ID NO: 178045 - protein, 278 aa, Glycine max
  Coding DNA Sequence Number=SeqID_61267
  Gene Ontology: Mol. function=calcium ion binding; Cellular component =oxygen evolving complex; Biological process=photosynthesis
  Homolog annotation: Hit_ID=P82715; Match level="QueryCoverage=68%, HitCoverage=67%, E-value=1e-70, Identity=61%"; Hit description =Thylakoid lumenal 35.8 kDa protein, chloroplast precursor
  Pfam annotation: Domain name=PsbP; Domain location=68-261; Score= -41.3; E_value=0.0099; Accession=PF01789.7; Description=PsbP
  Subcellular localization annotation: CTP_CleavageSite=51; ConfidenceScore=5.50e-01
MVFPSSSLSLPLSFFPIPTLLPNNLIFRNNNWTILNQRKCPLSEERPRFSCCALKPTSQNRIFRRDLMLLGLTSLSLPMPLSVTLAEEEPKMASFLDEINAYSYMYPVELPSDNFSFKWIESRKPERYSSAAPLSPDARLRIVSERVDFIDNVIISVTIGPPNSSYIKSKDKSEWTAKDVADSVLADRSSLRVTSSQRLEESSVLNTHSSETDESSTYRHYLASTAERDGYLYSISASTVSPRWEKLGPFLDKAVSSFRLLSPTENYVPPYKDPWRFW

SEQ ID NO: 178046 - protein, 232 aa, Glycine max
  Coding DNA Sequence Number=SeqID_61268
  Gene Ontology: Mol. function=GPI anchor binding; Cellular component =anchored to membrane; Biological process=cell adhesion
  Homolog annotation: Hit_ID=Q40315; Match level="QueryCoverage=67%, HitCoverage=58%, E-value=3e-32, Identity=50%"; Hit description =Putative surface protein
  Pfam annotation: Domain name=Fasciclin; Domain location=36-131; Score= -14.2; E_value=0.055; Accession=PF02469.12; Description=Fasciclin domain
MGYTRSSLLFLAFVLALFCSTIHGLDITKLLGQYPEYAQFNKYLTETKLADQINSLNAVTVLALDDAAMASLSAKPQDAVKAILSTHVLVNFYDEKKLMEAEGSRAKVETLFQSSGVAKPNQGYIYVALINEGEIAFGSAAAAPNAPFEVVLVRSVTSQPDAASILQVSKPIVAPGVESAASATVPLATAAVADNIAQSPAALAPAPSSASRVCMELAGVASAIASLVMLAL

SEQ ID NO: 178047 - protein, 228 aa, Glycine max
  Coding DNA Sequence Number=SeqID_61269
  Gene Ontology: Mol. function=DNA photolyase activity; Cellular component=mitochondrion; Biological process=DNA repair
  Homolog annotation: Hit_ID=Q1SM50; Match level="QueryCoverage=74%, HitCoverage=28%, E-value=2e-67, Identity=76%"; Hit description =Deoxyribodipyrimidine photolyase, class 1
  Pfam annotation: Domain name=DNA_photolyase; Domain location=115-228; Score=-3.9; E_value=2.7e-05; Accession=PF00875.8; Description=DNA photolyase
  Subcellular localization annotation: CTP_CleavageSite=71; ConfidenceScore=5.43e-01
MGCHVSHFQLLDYSHPQQNPTPTLYMAILHCTSLPFLSLRTTISSSKSTLTSTRIPLFLAMNSFAKSEPVSSSASSSSSTYQQVPEQDANNDLDRVADNTFRRYTSNVTKGSGKGTAIVWFRNDLRVLDNEALYKAWLSSETVLPVYCVDPRLFATTYHFGFPKTGALRAQFLLECLADLRKNLMKRGLNLLVQHGKPEEILPSLAKSFQAHTVYAQKETCSEELNVE

SEQ ID NO: 178048 - protein, 421 aa, Glycine max
  Coding DNA Sequence Number=SeqID_61270
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=Q6I8E6; Match level="QueryCoverage=57%, HitCoverage=74%, E-value=1e-130, Identity=100%"; Hit description =Pseudo-atpA
  Pfam annotation: Domain name=ATP-synt_ab; Domain location=97-323; Score=-5.0; E_value=1.8e-07; Accession=PF00006.15; Description=ATP synthase alphabeta family, nucleotide-binding domain
  Pfam annotation: Domain name=ATP-synt_ab_N; Domain location=1-41; Score=9.0; E_value=0.029; Accession=PF02874.13; Description=ATP synthase alphabeta family, beta-barrel domain
  Pfam module annotation: Pfam domain module=ATP-synt_ab::ATP-synt_ab _N; Domain location=97-323::1-41
MVEFASGVKGIALNLENENVGIVVFGSDTAIKEGDLVKRTGSIVDVPAGKAMLGRVVDALGVPIDGRGALSDHERRRVEVKAPGIIERKSVHEPMQTGLKAVDSLVPIGRGQRELIIGDRQTGKTAIAIDTILNQKQMNSRATSESETLYCVYVAIGQKRSTVALRYGLQFLLFFAVFYLISTNINMASVDTFESLVRRLAFYLGNQALSRLLLQRGCSVGLTVAIAVLFGDTPSVGNNMMDPSGSSGSSGGGGSESSWTGALLSSETLSGTGSVNQPAEGMPVPPANPVVEQAGPANPEDTTEIIGGDSIDSIRNRLLQSYGNPSAEQISRASYDADDLFQVKVEIIRGMTPLDPEGDWPGRGARALDNPRTSTGEDSLENLYRLKDDLNENGRDSETFKRLKDKVFRRPRPLEDANSTT

SEQ ID NO: 178049 - protein, 76 aa, Glycine max
  Coding DNA Sequence Number=SeqID_61271
MRDVTNGIRANLSHYGVVQGRIRQKLVGMKCVNGDKIYFKNLYWFVWSIIDPKASKVDFQGFKKGLPRKDSDQQGC

SEQ ID NO: 178050 - protein, 161 aa, Glycine max
  Coding DNA Sequence Number=SeqID_61272
  Homolog annotation: Hit_ID=Q016Y8; Match level="QueryCoverage=96%, HitCoverage=6%, E-value=1e-18, Identity=34%"; Hit description =Homology to unknown gene
MQVARRLDSQLAESILENNGQLAFEKLATATLEKLMPRIEGKGQFGLAKWKLVYAPQIPSLVSSGATVDPFTLLAANLSFGTDVEVQLGKRIQKHSLVAKSFQCWNSRLYCYSLARIVRQMKESQMAMEWTLTYKLTSRLHLCLKNGSSKCVLFEYSASQD

SEQ ID NO: 178051 - protein, 551 aa, Glycine max
  Coding DNA Sequence Number=SeqID_61273
  Gene Ontology: Mol. function=RNA-directed DNA polymerase activity; Cellular component=integral to membrane; Biological process=RNA -dependent DNA replication
  Homolog annotation: Hit_ID=Q1T5K4; Match level="QueryCoverage=88%, HitCoverage=53%, E-value=2e-97, Identity=37%"; Hit description=RNA -directed DNA polymerase
MNIKSHVSEISSHLNSSTFKKEALWVAAQSHESLLRQKVRSRWIKEGDCNSWYFHLMMNANRRNNSLKGVMIDGTWINKPARVKEEEDEVKRAIWDCESEKSPGLDGRNFKFIKKFWQIIKPDVLRFLDEFYVNGTFPRDCNASFIVLIPKVADPQILNDYRPISLIGYMYKIVSKMLAKRLKKVMPLIIDETQFAFIRDRHLLHSVIIANEVIEEAKRSKKSYLVFKVDYEKAYNSVSWEFLLYMLRRTGFSSKWIKWIEGCLRSASLSILVNGSPSTEFIPQRGLRQGDPLAPLLFNVVVEALNGLMREAVEKNLFRGFPVDSNNVGISILQFANDTIFFGETSMENVKAIKAILRTFELTSSLKINFVKNCFEAIGVSDQWKQDAANYLNCNLLVIPFVYLGIPIGANLRRCQLWDSIINKVPSRVVDKLVFTTQIPMGIKENYELGYWSQNMVAGGAWMQHLGTPTNPYGGGTLKWLFIIRNRVGLFKMERCGGLGVVIRQMGAHKDTRWEWEFIWRRPLFDSEIAMAVSFLRDVEGKIIQPHRRDL

SEQ ID NO: 178052 - protein, 149 aa, Glycine max
  Coding DNA Sequence Number=SeqID_61274
  Homolog annotation: Hit_ID=Q016Y8; Match level="QueryCoverage=86%, HitCoverage=6%, E-value=2e-23, Identity=41%"; Hit description =Homology to unknown gene
MAVNESIQVEKDMEEVQIKPNIGICLSNLKLVLGPELKIVYPFILNFAVSGELELNGLAHPKCIKPRGTLTFENGEVDLVAMQVRLKREHLNVARFEPDNGLDPMLDLTLVGSERQYRIHRRASNWQDFVEQDALSPIEVNDTALHYLA

SEQ ID NO: 178053 - protein, 144 aa, Glycine max
  Coding DNA Sequence Number=SeqID_61275
MALLQRRPAPVQHRARIVDQRVARHAVLLLLAAQIHLKELIEALCLFAATVQRGAERHIEKAAHAVCALLPVTGQRHKQAILQINLFQQTTQIFRMFTGGDLINAIGFQRQVKTARVDRAIRVSGGRKGEIDITVIVQTLFHNA

SEQ ID NO: 178054 - protein, 291 aa, Glycine max
  Coding DNA Sequence Number=SeqID_61276
  Gene Ontology: Mol. function=pseudouridylate synthase activity; Cellular component=chromatin; Biological process=rRNA processing
  Homolog annotation: Hit_ID=P75966; Match level="QueryCoverage=75%, HitCoverage=100%, E-value=8e-86, Identity=70%"; Hit description =Ribosomal large subunit pseudouridine synthase E
  Pfam annotation: Domain name=PseudoU_synth_2; Domain location=43-189; Score=74.8; E_value=2.7e-19; Accession=PF00849.12; Description=RNA pseudouridylate synthase
  Subcellular localization annotation: CTP_CleavageSite=29; ConfidenceScore=5.23e-01
MRRLLPTAKPMRKTSQRIHQHKRPAAPARQPARRDTRPKGPRRVILFNKPFDVLPQFSDEAGRRTLKDFVPVSEVYAAGRLDRDSEGLMILTNDGALQAQLTQPGKRTGKIYYVQVEGVPQESDLSRLRSGITLNDGPTLPAGAEVVPEPAWLWPRTPPIRERKAIPTCWLKITLYEGRNRQVRRMTAHIGFPTLRMIRFAMGDYQLQDLAPGEWRDISDRTANYWLWKSALTAALPGISRPAILRPMKRCWKPRNRRDAAFAAGGRKRAAVAAGGPLSAAADSAVSVAIS

SEQ ID NO: 178055 - protein, 145 aa, Glycine max
  Coding DNA Sequence Number=SeqID_61277
  Gene Ontology: Mol. function=ATP binding; Biological process=viral genome replication
  Homolog annotation: Hit_ID=Q9LTU4; Match level="QueryCoverage=67%, HitCoverage=6%, E-value=5e-25, Identity=49%"; Hit description =Helicase-like protein
MVESERLSYIRNNQKKLRVDKFCSLQQSLDDGSTKGLNKATDRPDIISRVFKLKYEQMLMDLTKNHMLGKVIAYMYTIEFQKRGLPHVHLLLFLHPDNKYSSSDEIDQIISAEIPSQQDDPELHSLVKNHMVHGPCGTLILDLYA

SEQ ID NO: 178056 - protein, 62 aa, Glycine max
  Coding DNA Sequence Number=SeqID_61278
MPLKNNDLGLIHRWIVMKFKHQKKESHEDSTSGGFNPFSVSLTFGNSIKAVGGKTEGISGNR

SEQ ID NO: 178057 - protein, 109 aa, Glycine max
  Coding DNA Sequence Number=SeqID_61279
MKTLRFEHRSLVKHLKYKSVVALVMGYDEGGWWRLGRQQLHGQLWMTSGVVGAKVVRRHAAMLVGVAPTLLKVQGCMCSEAESDLEVEAACNIGGGWWGWCVMLMECGK

SEQ ID NO: 178058 - protein, 72 aa, Glycine max
  Coding DNA Sequence Number=SeqID_61280
METISPADGGDVIIVRVSNNLNQGLSFTIHCKTHNQDLGTQVVNPGYFERFELHHDNAAGTKFLFNMERCIN

SEQ ID NO: 178059 - protein, 74 aa, Glycine max
  Coding DNA Sequence Number=SeqID_61281
  Gene Ontology: Mol. function=sequence-specific DNA binding
  Homolog annotation: Hit_ID=Q8S4Q2; Match level="QueryCoverage=71%, HitCoverage=37%, E-value=2e-13, Identity=74%"; Hit description =Ethylene-responsive transciptional coactivator-like protein
  Subcellular localization annotation: CTP_CleavageSite=56; ConfidenceScore=5.05e-01
MEVSREKPNVVVQIAKGTGPPQPQGRQPSSPLRRGGADAEEVRRRFQQVTRPGAGRSEAGGGDGAGGAERVAAE

SEQ ID NO: 178060 - protein, 108 aa, Glycine max
  Coding DNA Sequence Number=SeqID_61282
MELEKMRLDFNRELELQKKQILERAQAEIAKIQEVDEEDTDTSETNASSGTNLRLRKKNDMEQSFQWHLILLYLKMRRYDLRKGGDIWIECTSFGGKIVYRLEKSCTQ

SEQ ID NO: 178061 - protein, 46 aa, Glycine max
  Coding DNA Sequence Number=SeqID_61283
MKAKEEKVQVAVDSLNETDPLSEAYNSFSRLRNPRRKSVIDVIAQR

SEQ ID NO: 178062 - protein, 524 aa, Glycine max
  Coding DNA Sequence Number=SeqID_61284
  Gene Ontology: Mol. function=serine-type endopeptidase inhibitor activity; Cellular component=mitochondrion; Biological process =negative regulation of cell proliferation
  Homolog annotation: Hit_ID=Q5VMT5; Match level="QueryCoverage=99%, HitCoverage=33%, E-value=1e-159, Identity=53%"; Hit description =Putative Spo76 protein
  Pfam annotation: Domain name=HEAT; Domain location=2-36; Score=2.8; E_ value=19; Accession=PF02985.12; Description=HEAT repeat
  Pfam annotation: Domain name=HEAT; Domain location=209-245; Score =1.1; E_value=31; Accession=PF02985.12; Description=HEAT repeat
  Pfam annotation: Domain name=HEAT; Domain location=333-364; Score =11.7; E_value=1.6; Accession=PF02985.12; Description=HEAT repeat
  Pfam annotation: Domain name=HEAT; Domain location=94-130; Score=5.1; E_value=10; Accession=PF02985.12; Description=HEAT repeat
  Pfam module annotation: Pfam domain module=HEAT::HEAT::HEAT::HEAT; Domain location=2-36::209-245::333-364::94-130
MKPFFSAIVTPELLEHQDSDVKLLVATCVCEITRITAPEAPYSDDVLKNIFQLIVGTFSGLSDTSGSSFDQRVAILDTLAKYRSCVVMLDLECDDLVNEMFTTFFAVARDDHPEIVLSSMQTIMAVLLEESEDVHQDLLSILLSMLGRGKTDVTGAARKLSMNVIQQSMEKLEPSIKQFLLSLMSGGSKTMNSQVQYHEVIFDLYCCAPQTLSGVLPYVTEELMADQLETRLKAVNLVGDIIALPGFSTAEAFQPTFSEFLKRLTDRDFGVRMSVLEHSQLFILLPYLLNLFGYNFLAALCDRLLDFDENFQKQVVDVICDVACHTLNAVPLETVQLVAERLSDKSLLVRKHTLERLAEIYRVFCENNSIAVNPGEYDWIPRKIIRCFYDKDFRSDIIESILCGSLFPSEFSINDIVKRWVEIFSGFDKVEVKALEKILEQKQRLQEEMQKYLVLRQTSQEKDIPEAQKKIVFGFRAMSRSFADPIKAEESFQILDQLQDANIWKILTDLVDPNTSFHQTCVYR

SEQ ID NO: 178063 - protein, 54 aa, Glycine max
  Coding DNA Sequence Number=SeqID_61285
MAQKPHLQLEELGSKLESLPSDDNALTELLKLCPLFSVWGAKAKNTVAILIFRN

SEQ ID NO: 178064 - protein, 142 aa, Glycine max
  Coding DNA Sequence Number=SeqID_61286
  Gene Ontology: Mol. function=transition metal ion binding; Cellular component=endoplasmic reticulum; Biological process=electron transport
  Homolog annotation: Hit_ID=P49098; Match level="QueryCoverage=99%, HitCoverage=99%, E-value=1e-45, Identity=62%"; Hit description =Cytochrome b5
  Pfam annotation: Domain name=Cyt-b5; Domain location=7-81; Score =97.8; E_value=3.4e-26; Accession=PF00173.18; Description=Cytochrome b5-like HemeSteroid binding doma
MDEERKVYTLAQVSEHNTSKDCWLIIDGKVYNVTKFLDDHPGGDDVLVSSTGKDATDDFEDVGHSKGARAMLDDLYIGDIDPSTIPTKVQNTPPTQPQNNQDKTSSSSSSSSDFMTKMLQFLLPLLILGVAVGIRFYNTKST

SEQ ID NO: 178065 - protein, 170 aa, Glycine max
  Coding DNA Sequence Number=SeqID_61287
  Homolog annotation: Hit_ID=Q8S8H5; Match level="QueryCoverage=30%, HitCoverage=56%, E-value=4e-11, Identity=69%"; Hit description =Expressed protein
MVVVSSQSLIKNFVPHCPEALRCEAIGRWNPQAPKSMFQTLDNYLSSFCLTAAMDGIDEWKDPAEEALDGGRGMFCILPLAKALVHKASQSLLEVESIKLHINCAVISVKKASEKPELFSHQMLQSALDDGVKSFMTSLKNVGSKGFILNKNSQSQAFNNPSHSLTGSNE

SEQ ID NO: 178066 - protein, 109 aa, Glycine max
  Coding DNA Sequence Number=SeqID_61288
  Gene Ontology: Cellular component=membrane
  Homolog annotation: Hit_ID=Q6K688; Match level="QueryCoverage=81%, HitCoverage=33%, E-value=4e-23, Identity=42%"; Hit description =Putative tumor differentially expressed protein 1
MCANQLLGINGNQLEEILTIEADDLIWNEKHKDYQKAPADNFHHPTSMVHTIPGIPLGKGFHEGSGDLTEDPGDDEREGEEAAVGDPGGTAADSRYDGPAGVACAGRAA

SEQ ID NO: 178067 - protein, 102 aa, Glycine max
  Coding DNA Sequence Number=SeqID_61289
  Gene Ontology: Mol. function=microtubule motor activity; Cellular component=microtubule associated complex; Biological process =microtubule-based movement
  Homolog annotation: Hit_ID=Q0WLK7; Match level="QueryCoverage=40%, HitCoverage=5%, E-value=2e-11, Identity=83%"; Hit description =Kinesin like protein
MDEKYGRTSQCSLVHTNLAQHMDHLIVLISRIFAYEQTSSGKTHTTSGITEYAHKDREFVNFVDLAGSERASQAMTAGTTLRECSHINRSLLSLGTVIRKLR

SEQ ID NO: 178068 - protein, 55 aa, Glycine max
  Coding DNA Sequence Number=SeqID_61290
  Homolog annotation: Hit_ID=Q9FJD4; Match level="QueryCoverage=80%, HitCoverage=4%, E-value=5e-08, Identity=82%"; Hit description =Importin beta
MEFYKYLEMGLQNFEDYQVFAIRVGVVGDAQMYSVQSLGGENSVLLSYCLMSENQ

SEQ ID NO: 178069 - protein, 140 aa, Glycine max
  Coding DNA Sequence Number=SeqID_61291
  Homolog annotation: Hit_ID=Q40975; Match level="QueryCoverage=84%, HitCoverage=84%, E-value=9e-09, Identity=29%"; Hit description=S1 self-incompatibility protein precursor
  Pfam annotation: Domain name=Self-incomp_S1; Domain location=31-138; Score=51.7; E_value=2.5e-12; Accession=PF05938.2; Description=Plant self-incompatibility protein S1
MILSMKQVFSLVIFIAFWEFSSGVADGGDVIIVRVSNNLNQGLSFTIHCKTNNQDLGTQVVNPGYFERLELHHDNAADTKFLFCKITWRDASIDYVIYQDARDFRRRCITDCNWEVNNENLLGTNQYTLKPDIIVPWPKN

SEQ ID NO: 178070 - protein, 581 aa, Glycine max
  Coding DNA Sequence Number=SeqID_61292
  Gene Ontology: Mol. function=oxidoreductase activity; Cellular component=intracellular; Biological process=lignin catabolic process
  Homolog annotation: Hit_ID=O24044; Match level="QueryCoverage=98%, HitCoverage=98%, E-value=0.0, Identity=66%"; Hit description=Laccase
  Pfam annotation: Domain name=Cu-oxidase; Domain location=166-319; Score=214.2; E_value=2.9e-61; Accession=PF00394.12; Description =Multicopper oxidase
  Pfam annotation: Domain name=Cu-oxidase_2; Domain location=431-565; Score=186.4; E_value=7.1e-53; Accession=PF07731.4; Description =Multicopper oxidase
  Pfam annotation: Domain name=Cu-oxidase_3; Domain location=40-156; Score=239.8; E_value=5.9e-69; Accession=PF07732.5; Description =Multicopper oxidase
  Pfam module annotation: Pfam domain module=Cu-oxidase::Cu-oxidase _2::Cu-oxidase_3; Domain location=166-319::431-565::40-156
MELASFCSLRAIFLFSCALWIMPELTLAKHAKITRHYNFNVQLQNVTRLCQTKSIVTINGRFPGPRVIAREGDRLVIKVTNNVPYNVTIHWHGVRQLRSAWADGPAYVTQCPIQTGQTFVYNFTVTGQRGTLWWHAHISWLRTTLYGPIVILPKKHVPYPFPQTFKEVPIIFGEWWKADTETVINQAMQTGLAPNLSNAYTINGFPGFLYNGTTKDTFKLKVKAGKTYLLRLINAALNNELFFGIANHTLTVVEADAVYVKPFRTNYVLITPGQTINVLLKTKSKAPNAAFVIAARPYATGPAAFDNTTATGLLEYKKSSVSNTKTKNKKLRLLRPVLPKFNDTIFAMKFNKKVRSLANARFPAKVPKTVDKHFFFTVGLGISSCPKNQACQGPNNTRVTAAVNNVSFVMPNIALLQAHFFNKSKGVYTTDFPANPPFRFNYTGTPPNNIMISSGTKAVVLPFNASVELILQDTSIIGAESHPLHLHGFNFFVVGQGNGNFDPKKDPSKFNLVDPAERNTIGVPSGGWVAVRFFADNPGVWFMHCHLEVHTSWGLKMAWIVQDGKLHHQKLPPPPSDLPKC

SEQ ID NO: 178071 - protein, 68 aa, Glycine max
  Coding DNA Sequence Number=SeqID_61293
MARSFSNGKVLSALVADEFSNTLTYFETKACMHDWVCETKAGDTERAVKEKSIGCQVLWIKDCPEAVT

SEQ ID NO: 178072 - protein, 936 aa, Glycine max
  Coding DNA Sequence Number=SeqID_61294
  Gene Ontology: Mol. function=serine-type endopeptidase inhibitor activity; Cellular component=mitochondrion
  Homolog annotation: Hit_ID=Q5VMT5; Match level="QueryCoverage=89%, HitCoverage=52%, E-value=1e-172, Identity=44%"; Hit description =Putative Spo76 protein
MGWQELCLLFVKGGTDTMSEAYSSLIFKLLGEGQVMIIARFCPDLFSGTEVELVNLLKDNNDMIKEGVLNVLAKAGGTIREQLAVTSSSVDLMLERLCLEGSRRQAKYAVHALAAITKDDGLKSLSVLYKRLVDMLEEKTHLPAVLQSLGCIAQTAMPVFETRESEIEEFIINKILKSDSKEDHSIISWDDKSDLCVLKIYGIKTIVKSYLPIKDAHVRPGIDGLLDILRNMLSYGEISKDLQSSSVDKAHLRLASAKAVLRLSRLWDHKIPVDIFHLTLRATEISFPQARKVFLSKVHKYIKDNLLDAKYACALIFNISGTKDSKPEEFAEDKQNLDDIIHMHYQARAWLLSGQSDANLLTTYPENILPYLVHALANISCPNIDECKDVEAYENIYRQLHLILSMLMQRVEDGKSKVALNKENEIISTITSIFWSIKQSEDVVDSSKSKNSHAICDLGLAITKRLVQKDVDLQGLSPLVSLPPMLYKACEKESDPMVSGVKSWLADGSVLAHFISLELEMVPSQLAKDDSLKDSEKDKNEMPLGKIIKDIKSQGTKGKKVKKKKAVPAETKKAENDIDILNMVREINLDNLGSSTNFEASNGHENSLSKKLQKDPECATIKKRKAEVTLVPVPKRKRSSFAHGKSRSNSTPPKGPPRVSGEDSSEVKFPLGAKFNPDTHSKQRKKVKDNEASIEAKVKASKSYHDNDSDKSEEHGMKSPDNTKPTDKSKNNNLKSSIGSAKKLKRKSIGGLAKCTTKEEESDAEDLIGCRIKVWWPLDKKFYEGTVKSYDSLKRKHVILYKDGDVEVLNLEKEQWKLIASKPTKKLKLSKTVSSPEVSTGKKQRSSSGSASRKTKKIDNGKKSPSKHVKHGRKGASKINSHHEDAKESSELSNPEDISKAEINSGNESNFCASIFGTSIADMLAVDQYQSVSIIS

SEQ ID NO: 178073 - protein, 128 aa, Glycine max
  Coding DNA Sequence Number=SeqID_61295
GTSFVVQVEGTSTWVIVTENKRGYISCGSVQVEGTSTWLFKENKGGAVSESENESARVIVRVRARKTVTERECGGGTVGTSQYKELSQSEKVRTRWWHSGHVAPGGVELGESREEEEEENMSTEMIQK

SEQ ID NO: 178074 - protein, 408 aa, Glycine max
  Coding DNA Sequence Number=SeqID_61296
  Gene Ontology: Mol. function=magnesium ion binding; Cellular component=chloroplast; Biological process=metabolic process
  Homolog annotation: Hit_ID=Q5UBY0; Match level="QueryCoverage=96%, HitCoverage=72%, E-value=1e-128, Identity=54%"; Hit description =Wound-inducible putative cytosolic terpene synthase 1
  Pfam annotation: Domain name=Terpene_synth; Domain location=1-106; Score=-18.7; E_value=5.2e-06; Accession=PF01397.11; Description =Terpene synthase, N-terminal domain
  Pfam annotation: Domain name=Terpene_synth_C; Domain location=111 -365; Score=349.6; E_value=5.1e-102; Accession=PF03936.6; Description= Terpene synthase family, metal binding domain
  Pfam module annotation: Pfam domain module=Terpene_synth::Terpene _synth_C; Domain location=1-106::111-365
MPDVEPRTVVDVFYKFKDQTGNFNERLANDIQGMMSLYEASQLRFHGEEILEEAHNFTHIQLSKSLTTQLSPYLEAQVQHILVQSFHKGMPRLEATYNISFYQEDPSHDKYLLSFAKVDFDILQKLHKKEVSSVTKWWIKDLNVSTKLPFVRDRIVEGSFWILGVYFEPQHSLARRIMLKIVGILTIIDDMYDAYGTIDELELFTNAIERWDICCLDDLPEYMKICYTTLLDCFEEIEEEMMKRLVQAQMTQARWFHCNYTPIVDEYMQVTTISSCYPMLIIISYIGMRDTTEEILIWATSDPIIVIAASTICRIMDDIVGNEVEQERGHVASSLECYIKQHNTSRKDAIDQLRKMVDNAWKDINEACLNPTQVPMTFLKPIVNLARVIDVLYKDEDNYTNAGGKVPS

SEQ ID NO: 178075 - protein, 67 aa, Glycine max
  Coding DNA Sequence Number=SeqID_61297
  Subcellular localization annotation: CTP_CleavageSite=31; ConfidenceScore=5.35e-01
MPISPCGSTSWDRAHKTPSGLRGAQQGPGISSSSYGSLSVLQGARPPARSCHCDLITFVSQVIVGHT

SEQ ID NO: 178076 - protein, 102 aa, Glycine max
  Coding DNA Sequence Number=SeqID_61298
  Subcellular localization annotation: CTP_CleavageSite=41; ConfidenceScore=5.54e-01
MATPSTPSSHPPPSELATPSSSTSNKTRKTTRLRSLANKLVGAKKPVIHVDPVTGKVDGPHRKKLRTYLGIVARDKDVQKKAQAIQKQNIAPHVLFRGGYDF

SEQ ID NO: 178077 - protein, 256 aa, Glycine max
  Coding DNA Sequence Number=SeqID_61299
  Gene Ontology: Mol. function=oxidoreductase activity, acting on single donors with incorporation of molecular oxygen, incorporation of two atoms of oxygen; Cellular component=nucleus; Biological process=response to DNA damage stimulus
  Homolog annotation: Hit_ID=Q2HV29; Match level="QueryCoverage=100%, HitCoverage=94%, E-value=1e-113, Identity=76%"; Hit description=2OG -Fe(II) oxygenase
  Pfam annotation: Domain name=2OG-FeII_Oxy; Domain location=145-256; Score=5.7; E_value=0.033; Accession=PF03171.10; Description=2OG -Fe(II) oxygenase superfamily
MNVLKLKAVSEENPNETVKRETVDLGNGSDVVYIQRLIPSDQSWKWFHYLDKHIPWTRPTIRVFGKSFLQIALLYMAMIDKRKGPYDINVMLRSSLQPRDTCYVATPGLTELTYSGYQPHAYSWDDYPPLKDMLDAVHKALPGSSFNSLLLNRYNGGNDYVGWHSDDEKLYGPTPEIASLTFGCDRDFVLKKKPYGSDEPASKRLKKGSHDADQHTFRLRHGSLLVMRGYTQRDWIHSVPKRAKAEATRINLTFRR

SEQ ID NO: 178078 - protein, 78 aa, Glycine max
  Coding DNA Sequence Number=SeqID_61300
MARTKKSCQMTFEATKEIADGSDVTIKQYFGPTSRSSCTSTSMAPEDMQSQGLTLPPELEASPSTPHVSTKGSCIDPS

SEQ ID NO: 178079 - protein, 39 aa, Glycine max
  Coding DNA Sequence Number=SeqID_61301
MESEEKEEWREKSIDVVLVYSAFSNDLIRTSLQYLCPRD

SEQ ID NO: 178080 - protein, 75 aa, Glycine max
  Coding DNA Sequence Number=SeqID_61302
MQDSQRDVYLRAYLNDALKGFNDSQGSKFKATVRWIVVKVTQSKGDIAEFLTTIEVPCSRKPFADLNFQNLNKGL

SEQ ID NO: 178081 - protein, 105 aa, Glycine max
  Coding DNA Sequence Number=SeqID_61303
MIGSIVARGQSVKASLGAWGYLEFTVWYYDQLNVGVVLRDNTGMFIWSSSCKTRAEREKTNCPVDKAKKKNGGFILYRMLIHYHSPARSEHPLNLSFNAETEDKS

SEQ ID NO: 178082 - protein, 244 aa, Glycine max
  Coding DNA Sequence Number=SeqID_61304
  Homolog annotation: Hit_ID=Q6H975; Match level="QueryCoverage=99%, HitCoverage=31%, E-value=6e-44, Identity=44%"; Hit description=STY-L protein
  Subcellular localization annotation: CTP_CleavageSite=43; ConfidenceScore=5.28e-01
INQGVTSLPLKGWPLASGIDQLKPNFGVQASKPNLTTQNQFVLASQQQQALAQAQAQNNLGNSNYGDMDPRRLSGLPRGSLSAKDGQSTRNEGSICSQMQSDSPKMKMAQSQQSLSHSQQQEQLQQQSNRKRKSGAANSTGTGNTAAPSPTSSPSTHTPGDGLNTASSLQHVNSVQKSMMMYGTETTGGLASSSNLLDDMDRFGDVDALDDNVESFLSNDGVDGGNLYGTVKQSPAEQLKDLQK

SEQ ID NO: 178083 - protein, 293 aa, Glycine max
  Coding DNA Sequence Number=SeqID_61305
  Gene Ontology: Mol. function=glutamate N-acetyltransferase activity; Biological process=arginine biosynthetic process
  Homolog annotation: Hit_ID=Q67YT8; Match level="QueryCoverage=97%, HitCoverage=69%, E-value=2e-78, Identity=46%"; Hit description=MRNA, complete cds, clone: RAFL24-09-C04
  Pfam annotation: Domain name=DUF647; Domain location=1-288; Score= -146.5; E_value=4.7e-05; Accession=PF04884.5; Description=Protein of unknown function, DUF647
  Subcellular localization annotation: CTP_CleavageSite=42; ConfidenceScore=5.17e-01
MDWSQAMFTAMGVGFSNSLPSAAALNWVLKDGLGRLSRCIYTASLASAFDTNLKSAVHQSFAIGDNLGEISAKAQIQTVCFDILGLMLAALVNLWIENHRRQQAGLHYFIYPFFAAMDLFGIYQGLKTVHLQTLTKDRLEIILSTWIECGYVPSPAEVSEKEGINFLGVKGKSLWPIRIGCLNPKDQVPKWSMKTIQCITDEDYYFVCAEIFDGLRRTGKALLLNSTRWEIIIEESHASDSTMEDWSVIVEDAKRSTERDMSNLIEQMVGKGWMVKNILLSTQEQTRYSFVCD

SEQ ID NO: 178084 - protein, 134 aa, Glycine max
  Coding DNA Sequence Number=SeqID_61306
  Homolog annotation: Hit_ID=Q67YT8; Match level="QueryCoverage=75%, HitCoverage=22%, E-value=1e-10, Identity=36%"; Hit description=MRNA, complete cds, clone: RAFL24-09-C04
MKKLPFDILHIVPSDSSRNEEVPHNRAKRPQPPIIKTHVRSRTAAAVDAHDLQAVSGPEESRDTGGAPHHEWEPNWLRRRALLDASIGDAVEGGSERGKDRESPKNEVLLSGCWLLGVWKVSYASTEGNLFKPV

SEQ ID NO: 178085 - protein, 120 aa, Glycine max
  Coding DNA Sequence Number=SeqID_61307
  Gene Ontology: Mol. function=protein serine/threonine kinase activity; Biological process=protein amino acid phosphorylation
  Homolog annotation: Hit_ID=Q2RAY6; Match level="QueryCoverage=92%, HitCoverage=12%, E-value=2e-19, Identity=50%"; Hit description=D -mannose binding lectin family protein
  Subcellular localization annotation: CTP_CleavageSite=36; ConfidenceScore=5.07e-01
MLDSIYQPKVTGFGLSKLHNRNILNNSSFSMIRGTRGYMASEWVYNLPITSNVDVYSYGIVLLEMTTGKSQTMDVETVDGQNRTMEDKDVRPTMKQVIEMFQSHESDAHSWICFMFVQER

SEQ ID NO: 178086 - protein, 752 aa, Glycine max
  Coding DNA Sequence Number=SeqID_61308
  Gene Ontology: Mol. function=protein serine/threonine kinase activity; Cellular component=membrane; Biological process=protein amino acid phosphorylation
  Homolog annotation: Hit_ID=Q2QWY4; Match level="QueryCoverage=94%, HitCoverage=96%, E-value=1e-161, Identity=39%"; Hit description=D -mannose binding lectin family protein, expressed
  Pfam annotation: Domain name=B_lectin; Domain location=73-181; Score =96.1; E_value=1.1e-25; Accession=PF01453.15; Description=D-mannose binding lectin
  Pfam annotation: Domain name=PAN_2; Domain location=290-357; Score= -6.0; E_value=0.0055; Accession=PF08276.2; Description=PAN-like domain
  Pfam annotation: Domain name=Pkinase; Domain location=471-744; Score =198.1; E_value=2.2e-56; Accession=PF00069.15; Description=Protein kinase domain
  Pfam annotation: Domain name=Pkinase_Tyr; Domain location=471-744; Score=71.6; E_value=2.6e-18; Accession=PF07714.7; Description =Protein tyrosine kinase
  Pfam annotation: Domain name=S_locus_glycop; Domain location=162-278; Score=-13.3; E_value=0.00035; Accession=PF00954.11; Description=S -locus glycoprotein family
  Pfam module annotation: Pfam domain module=B_lectin::PAN _2::Pkinase::Pkinase_Tyr::S_locus_glycop; Domain location=73-181::290- 357::471-744::471-744::162-278
  Subcellular localization annotation: CTP_CleavageSite=32; ConfidenceScore=5.51e-01
MALSITLFLLASLLSFQISSSSSSLRKGSSLSVENPQHVLVSPNGMFSAGFLAIGENAYSFAIWFTEPHFHSPNTVTWMANRDQPVNGKGSKLSLTHAGNIVLVDAGFNTAWSSNTASLAPAELHLKDDGNLVLRELQGTILWQSFDFPTDTLVPGQPLTRHTLLVSARSESNHSSGFYKFFFSDDNILRLVYDGPDVSSNYWPNPWQRRLKLDSDGNLRVYGRKSAVEKWYVSWKAIRNDCIIHGVCGPNSTCGYDPKSGRTCKCLPGYRLRNHSDWSYGCEPMFDLTCNWNETTFLEMRGVEFYGYDNYYVEVSNYSACENLCLQNCTCQGFQHSYSLRDGLYYRCYTKTKFLNGQRLPRFPGTTYLRIPKSYSLSVKESAIDSVDDHHVCSVQLQRAYIKTLESRVVRVLLWFAAALGAFEMVCIFVVWCFLIRTGQKSNADQQGYHLAATGFRKFSYSELKKATKGFSQEIGRGAGGVVYKGILSDQRHAAIKRLNEAKQGEGEFLAEVSIIGRLNHMNLIEMWGYCAEGKHRLLVYEYMENGSLAQNLSSNTLDWSKRYNIVLGTARVLAYLHEECLEWILHCDIKPQNILLDSNYQPRLADFGLSKLLNRNNPNNPSISMIRGTRGYMAPEWVFNLPITSKVDVYSYGIVVLEMVTGKSPTTSIDDINGEETYDGRLVTWVREKRSNSNTSWVEQIIDPVIGLNYDKSKIEILITVALKCVLEDRDSRPNMSQVVEMLQCHGSDSH

SEQ ID NO: 178087 - protein, 343 aa, Glycine max
  Coding DNA Sequence Number=SeqID_61309
  Gene Ontology: Mol. function=serine-type endopeptidase inhibitor activity; Cellular component=membrane
  Homolog annotation: Hit_ID=Q9SFT8; Match level="QueryCoverage=91%, HitCoverage=73%, E-value=1e-100, Identity=63%"; Hit description =Putative integral membrane protein
  Pfam annotation: Domain name=DUF6; Domain location=14-143; Score=8.9; E_value=0.02; Accession=PF00892.11; Description=Integral membrane protein DUF6
  Pfam annotation: Domain name=DUF6; Domain location=166-304; Score =17.5; E_value=0.0066; Accession=PF00892.11; Description=Integral membrane protein DUF6
  Pfam annotation: Domain name=DUF914; Domain location=68-337; Score= -196.7; E_value=0.008; Accession=PF06027.3; Description=Eukaryotic protein of unknown function (DUF914)
  Pfam annotation: Domain name=UAA; Domain location=40-271; Score= -171.9; E_value=0.08; Accession=PF08449.2; Description=UAA transporter family
  Pfam module annotation: Pfam domain module=DUF6::DUF6::DUF914::UAA; Domain location=14-143::166-304::68-337::40-271
EAILLKDNDAGNEASESLVLEEVDVIQERNNGSELLPADKVVGVSADQVNVIENISNHLDEKGRWSRCRVAKVSLLICPFWFLAQLTFNLSLKYTTVTSNTILSSASSLFTFLVSLAFLGERFTWLKLFSVLLCMAGTIIVSLGDSQSGLATVASNPLLGDIFALASAGLYAVYITLIRKKLPDDDGKSGEASTAQFLGFLGLFNVLIFLPVALILHFTKKESFSTLTWKQLGLIIGKGLLDNVLSDYLWAKAVLLTSTTVATAGLTIQVPLAAIVDTLTGNAPRFMDYLGAIAVMIGFTGINIPSDTFSKSTETTVALENENLNTRTEELTLSISQDSVAIS

SEQ ID NO: 178088 - protein, 93 aa, Glycine max
  Coding DNA Sequence Number=SeqID_61310
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q8L7J2; Match level="QueryCoverage=97%, HitCoverage=17%, E-value=6e-40, Identity=78%"; Hit description=Beta -glucosidase
MDDPNDPLISIKDALKDEKRIKYHNDYLINLQASITEDGCNVQGYFVWSLLDNWEWQSGFTSRFGLYFIDYKDNLKRYPKHSVEWFKNFLKST

SEQ ID NO: 178089 - protein, 748 aa, Glycine max
  Coding DNA Sequence Number=SeqID_61311
  Gene Ontology: Mol. function=protein serine/threonine kinase activity; Cellular component=cell surface; Biological process =protein amino acid phosphorylation
  Homolog annotation: Hit_ID=Q5QLR7; Match level="QueryCoverage=95%, HitCoverage=94%, E-value=1e-148, Identity=40%"; Hit description=S -receptor kinase-like
  Pfam annotation: Domain name=B_lectin; Domain location=78-186; Score =108.3; E_value=2.2e-29; Accession=PF01453.15; Description=D-mannose binding lectin
  Pfam annotation: Domain name=PAN_2; Domain location=316-380; Score= -2.3; E_value=0.0023; Accession=PF08276.2; Description=PAN-like domain
  Pfam annotation: Domain name=Pkinase; Domain location=468-740; Score =194.2; E_value=3.1e-55; Accession=PF00069.15; Description=Protein kinase domain
  Pfam annotation: Domain name=Pkinase_Tyr; Domain location=468-740; Score=80.6; E_value=4.9e-21; Accession=PF07714.7; Description =Protein tyrosine kinase
  Pfam module annotation: Pfam domain module=B_lectin::PAN _2::Pkinase::Pkinase_Tyr; Domain location=78-186::316-380::468 -740::468-740
  Subcellular localization annotation: CTP_CleavageSite=38; ConfidenceScore=5.38e-01
MDFPTSLFFLLLLLSFQCSSSLSSLNKGSSLSVEKHTQDSIVSPNQMFCAGFFQVGENAFSFAIWFNDPHTHNNNHNNRNVVWIANREQPVNGKLSKLSLLNSGSIVLLDADQITTWSSNTASNAPLELNLQDDGNLVLRELQGTILWQSFDSPTDTLLPGQPLTRYTQLVSSRSKTNHSSGFYKLLFDNDNLLRLIYDGPDVSSSYWPPQWLLSWDAGRFSFNSSRVAVFNSLGIFNSSDNYGFSTNDHGKVMPRRLTLDSDGNVRVYSRNEASKKCTCNFDPKRGRICSCLPGHTVKNHSDWSYGCEPMFNLSCNGNDSTFLELQGFEFYGYDSNYIPNSTYMNCVNLCLQDCNCKGFQYRYDGEYSTCFTKRQLLNGRRSTRFEGTIYLRLPKNNNFSKEESLHKEYVRKPENRFVRFFLWLATAVGALEVTRQKSGADQQGYHQAEMGFRKYSYSELKEATKGFNQEISRGAEGIVYKGILSDQRHVAIKRLYEAKQGEEEFLAEVSIIGRLNHMNLIEMWGYCAEGKHRLLVYEYMENGSLAQNLSSNTLDWSKRYSIALGTARVLAYLHEECLEWILHCDIKPQNILLDANYQPKVADFGLSKLLNRNNLNNNLRFSVIRGTRGYMAPEWVYNSPITSKVDVYSYGIVLLEMITGKNPTTGVHSNAGEESYNGRLVTWVREKRGDASWLEHIIDPAIKTNFDECKMDLLARVALDCVEVNKDRRPTMSQVVEMLQSHDCLRC

SEQ ID NO: 178090 - protein, 761 aa, Glycine max
  Coding DNA Sequence Number=SeqID_61312
  Gene Ontology: Mol. function=protein serine/threonine kinase activity; Cellular component=cell surface; Biological process =protein amino acid phosphorylation
  Homolog annotation: Hit_ID=Q5QLR7; Match level="QueryCoverage=98%, HitCoverage=94%, E-value=1e-173, Identity=43%"; Hit description=S -receptor kinase-like
  Pfam annotation: Domain name=B_lectin; Domain location=48-156; Score =116.3; E_value=8.8e-32; Accession=PF01453.15; Description=D-mannose binding lectin
  Pfam annotation: Domain name=PAN_2; Domain location=307-372; Score= -11.3; E_value=0.02; Accession=PF08276.2; Description=PAN-like domain
  Pfam annotation: Domain name=Pkinase; Domain location=481-755; Score =191.8; E_value=1.6e-54; Accession=PF00069.15; Description=Protein kinase domain
  Pfam annotation: Domain name=Pkinase_Tyr; Domain location=483-755; Score=76.8; E_value=6.7e-20; Accession=PF07714.7; Description =Protein tyrosine kinase
  Pfam annotation: Domain name=S_locus_glycop; Domain location=180-295; Score=-8.3; E_value=0.00015; Accession=PF00954.11; Description=S -locus glycoprotein family
  Pfam module annotation: Pfam domain module=B_lectin::PAN _2::Pkinase::Pkinase_Tyr::S_locus_glycop; Domain location=48-156::307- 372::481-755::483-755::180-295
GSSLSVEKHAEDVIVSPNQMFCAGFFQVGENAFSFAIWFNDPHTHNNNHTVVWMANREQPVNGRLSKLSLLNSGNMVLVDAGQITKWSSNTASHAPVKLHLQDDGNLVLLDLQGTILWQSFDTPTDTLLPGQLLTRHTQLVSSRSQTNHSPGFYKMLFDDDNVLRLIYDGPDVSSTYWPPPWLLSWQAGRFNYNSSRVAVLNSIGNFTSSDNYDFSTDDHGTVMPRRLKLDSDGNARVYSRNEALKKWHVSWQFIFDTCTIHGICGANSTCSYDPKRGRRCSCLPGYRVKNHSDWSYGCEPMFDLACSGNESIFLEIQGVELYGYDHKFVQNSTYINCVNLCLQDCNCKGFQYRYDGNQIFSCYTKLQLWNGRRSPSFNGTINLRLPNSNNFSKEESESADDHVCSVQLHKDYVRKAANRFERFSLWLATAVGALEMICLLMIWGFLIRSQQKSSANKLGYHLAAVGIRKYSYSELKKATEGFSQEIGRGAGGVVYKGILSDQRHAAIKRLYDAKQGEGEFLAEVSIIGRLNHMNLIEMWGYCAEGNHRLLVCEYMGNGSLEENLSSNTLDWSKRYNIALGVARVLAYLHEECLEWILHCDIKPQNILLDASYQPKVADFGLSKLLNRDNLHSNSTVSMIRGTRGYMAPEWVYNLPITSKVDVYSYGIVLLQMITGKSPTTGVQSIDGEESHNGRLVTWVREKRSATSWLEQIMDPAIKTNYDERKMDLLARVALDCVEEKKDSRPTMSQVVEMLQSHETN

SEQ ID NO: 178091 - protein, 113 aa, Glycine max
  Coding DNA Sequence Number=SeqID_61313
MQRPRTRDNVLCYLPSTEVTVVRQRCRQMTEVTTRSQQKFQTNGEGVRARDGVYKYTVLDYLLRNLLRRSSQSTSLNQSRAVHMALKNVTYLRKYHRLPYYDGFGTTDVKCAS

SEQ ID NO: 178092 - protein, 73 aa, Glycine max
  Coding DNA Sequence Number=SeqID_61314
  Gene Ontology: Mol. function=ATPase activity, coupled to transmembrane movement of ions, phosphorylative mechanism; Cellular component=membrane; Biological process=metabolic process
  Homolog annotation: Hit_ID=Q5JNL2; Match level="QueryCoverage=90%, HitCoverage=11%, E-value=2e-18, Identity=70%"; Hit description =Haloacid dehalogenase-like hydrolase-like
MDGTLLNSKNQISSTTVNALREATSRGVKIVIATGKAHPAVIDIFKMVDLTRKDGIVSEFSPGVFLQPGCPYM

SEQ ID NO: 178093 - protein, 236 aa, Glycine max
  Coding DNA Sequence Number=SeqID_61315
MCMSINHHFAATYAFSLRRNSPFSDSTTALIDATTSHRLSYSELIHRNENESTRFPCDSIRCGNNSILIELHGDGEGFTFFFRAMVPSEKLAAKSTTLEARSATLIYGFSGTVNVMVELVWSEVGCALLIVWDPYIKIELYVDIDQVSSSSTSVGTMSWIGCSTTPTNNNVFLPHVGIDIYQQCSNVEFVKILVMIMIVKMMFILAMMTPMMTMKVKHNNSLGFVITFLQRELGPF

SEQ ID NO: 178094 - protein, 86 aa, Glycine max
  Coding DNA Sequence Number=SeqID_61316
MDRVYIASLATANTCVATYLRWEGKAKSKGVSSKKENGWESPPMFIRGKHYKNQKEGLQILKIRVWELFTHGEERIVKALDLETIF

SEQ ID NO: 178095 - protein, 243 aa, Glycine max
  Coding DNA Sequence Number=SeqID_61317
  Gene Ontology: Mol. function=tetracycline:hydrogen antiporter activity; Cellular component=integral to membrane; Biological process=tetracycline transport
  Homolog annotation: Hit_ID=Q83RJ1; Match level="QueryCoverage=99%, HitCoverage=55%, E-value=5e-71, Identity=61%"; Hit description =Putative transport protein
  Pfam annotation: Domain name=MFS_1; Domain location=1-241; Score= -1.6; E_value=0.00037; Accession=PF07690.6; Description=Major Facilitator Superfamily
MAVLDGAIANVALPTIARELNASPAESIWIVNAYQIAIVISLLSLSFLGDMFGYRRVYQVGLVLFVFTSLFCALSSSLNMLTVARVLQGFGALSGTRHGHQLADRGRSPAPPVPRVAAAILSIASWKWLFLINVPLGVVALWLALRFLPDNTQKAKQQKILIADRLRAGRKWLADCGYAAGAAADRRGVCAASAGDAGAAAASRFAAHSGVFVVDRHLDLFILCTNAGDGVAAVFPAKRTGPG

SEQ ID NO: 178096 - protein, 189 aa, Glycine max
  Coding DNA Sequence Number=SeqID_61318
  Pfam annotation: Domain name=DUF1723; Domain location=24-73; Score =42.6; E_value=1.3e-09; Accession=PF08330.1; Description=Protein of unknown function (DUF1723)
PSPEIEGLVVVTGLSPLITCSLDIGERGLVSTFAERWHKETSSFQLSVGEDTITLDDVTLLLHLTITGAFHNFEALHVDDVVFLLVELLGVPKRQEMRRYNTTTQNPHFLLSIVLLFLKYVQCWIYEHFPLVAYAIAAGDYDERKPHACHWKSRKAFPVSMYLKRLDRLMSDAMCWIPYGDHHALESFN

SEQ ID NO: 178097 - protein, 91 aa, Glycine max
  Coding DNA Sequence Number=SeqID_61319
MVVLEFALGTIRAKRPWLGLHHMTLFSFLRWHQFCLSFYLNPSFDDFSSYLLMQSYPARALDRRLQVDWARDAREGPRVLMSLRVDFGPMG

SEQ ID NO: 178098 - protein, 99 aa, Glycine max
  Coding DNA Sequence Number=SeqID_61320
MGCTNLKEFAPRGTIRFDIIVWIWFAADQFLAMLHDSDLHLVHGGDEGGERLLGAVDLAITEGRLFEGHDGDLSEALKILDGVVAKGNDITNIEGLDEA

SEQ ID NO: 178099 - protein, 142 aa, Glycine max
  Coding DNA Sequence Number=SeqID_61321
  Gene Ontology: Mol. function=chitin binding; Cellular component =extracellular region; Biological process=chitin metabolic process
  Homolog annotation: Hit_ID=UPI00006A17C9; Match level="QueryCoverage =88%, HitCoverage=100%, E-value=5e-15, Identity=32%"; Hit description= UPI00006A17C9 related cluster
MARTCSPLKVRTCSPLKVRACSPTKVKAHDPLTARACSPLKLKVHDPLKARTCSPLKVKVRTCSPLKARTYSPLEVRACSPLMVRTCSPLKARTCSPLKVRTCSPLKVRMCSPLKVRACSPTKVRTCSPLKVRVPSTQGEGG

SEQ ID NO: 178100 - protein, 91 aa, Glycine max
  Coding DNA Sequence Number=SeqID_61322
MLKDGDHEVRTSRNVVVDFHLDVVADSLTKCQLSEDSDQPKQKLEASKNQDEDKEGTAEEEGKKNNTADPKGGELSMGAKPKVISSPDLLG

SEQ ID NO: 178101 - protein, 437 aa, Glycine max
  Coding DNA Sequence Number=SeqID_61323
  Gene Ontology: Mol. function=protein serine/threonine kinase activity; Cellular component=membrane; Biological process=protein amino acid phosphorylation
  Homolog annotation: Hit_ID=Q9LRY1; Match level="QueryCoverage=86%, HitCoverage=91%, E-value=1e-138, Identity=67%"; Hit description =Receptor protein kinase-like protein
  Pfam annotation: Domain name=APH; Domain location=95-273; Score= -13.2; E_value=0.05; Accession=PF01636.13; Description=Phosphotransfer ase enzyme family
  Pfam annotation: Domain name=Pkinase; Domain location=92-366; Score =160.8; E_value=3.6e-45; Accession=PF00069.15; Description=Protein kinase domain
  Pfam annotation: Domain name=Pkinase_Tyr; Domain location=92-366; Score=145.4; E_value=1.6e-40; Accession=PF07714.7; Description =Protein tyrosine kinase
  Pfam module annotation: Pfam domain module=APH::Pkinase::Pkinase_Tyr; Domain location=95-273::92-366::92-366
MSCFSCFTSNEKKVAKKPNNGQRIQQPAINSPKESAQPVQPRPDNNFNKAKATPQTEPKINKEANKDNGNNNNNIAAQTFTFRELASITKNFRQECLIGEGGFGRVYKGRLEKTNQEVAVKQLDRNGLQGNREFLVEVLMLSLLHHQNLVNLIGYCADGDQRLLVYEYMPLGSLEDHLLDVHPQQKHLDWFIRMKIALDAAKGLEYLHDKANPPVIYRDLKSSNILLDKEFNAKLSDFGLAKLGPTGDKSHVSSRVMGTYGYCAPEYQRTGQLTVKSDVYSFGVVLLELITGRRAIDNTRPTREQNLVTWAYPVFKDPHRYSELADPLLQANFPMRSLHQAVAVAAMCLNEEPSVRPLISDVVTALTFLGTAPGSQDLTGIAPVDLPSPPQEAISSAPFNLLDDDVVMDRQRAVAEAIEWGTNSRNKAPLRDSSTSL

SEQ ID NO: 178102 - protein, 233 aa, Glycine max
  Coding DNA Sequence Number=SeqID_61324
MEDHRYLGPNPWNVDFLVRLLELRRQTCHVNNVDPNKYGFYDGIYNFAVELGLLPCNPFIMWFRCANGNYRPLANDSNVMLMYVKNPNSSYIHLYATKNKDEFWHEPLFIEVVPTVIEPFIELVNQPVNACMYEAMNDVVNEAANASMNEAMNEHGLSGGSSPDIDSEYVGLDEELSYANDMSDFEEKLDCIGVVHSDSDMEEIYKEKGLRGNNLNWIRMGRPNFLLGSCLLV

SEQ ID NO: 178103 - protein, 136 aa, Glycine max
  Coding DNA Sequence Number=SeqID_61325
  Homolog annotation: Hit_ID=Q1SBL9; Match level="QueryCoverage=30%, HitCoverage=8%, E-value=2e-13, Identity=80%"; Hit description=Beta -glucosidase, putative
MNNTDKAIILEIVVFIANDVKAGDMKVLVEKTLVMQTTVMWKGSLMKGGALDWACAIGAVFHHGVDEPRELVLGDIREQVKVVYEGAVKEGGRGLSVWDTFSHSFGKIQDGSNADVAVNQYHRYDVRWISMVAKLP

SEQ ID NO: 178104 - protein, 48 aa, Glycine max
  Coding DNA Sequence Number=SeqID_61326
MEAKKQKMRGNVSTVQMNANDERSALSEFCSSNWSATFAKRDMTGLAN

SEQ ID NO: 178105 - protein, 81 aa, Glycine max
  Coding DNA Sequence Number=SeqID_61327
MVLRRGIVATVVVVNVIFQIQICLSEINRQSFPKGFVFGTAASAFQNDDVDFAVGVGKGVDDGDRVVILDSSVKEMMRKSR

SEQ ID NO: 178106 - protein, 48 aa, Glycine max
  Coding DNA Sequence Number=SeqID_61328
KLKQKRGASAEKESVGTRKFIVLLLEIRIGKGTRKWKRPKRQRHICLP

SEQ ID NO: 178107 - protein, 145 aa, Glycine max
  Coding DNA Sequence Number=SeqID_61329
  Subcellular localization annotation: CTP_CleavageSite=43; ConfidenceScore=5.08e-01
MGAKTLPLIGEPNSSNTSSTSSLMDKGISESDSIVTGQVPLPMAFSLTNLNATCQGNLMLKPPSNAIKIIEDMCSNPYNNYGDKKIMKRYGCVHGLGEFTMGDEFAQTMDEINFVGGIDNGYERPKEEKVQVVGVSLSEAYALSE

SEQ ID NO: 178108 - protein, 425 aa, Glycine max
  Coding DNA Sequence Number=SeqID_61330
  Homolog annotation: Hit_ID=Q9FKB4; Match level="QueryCoverage=95%, HitCoverage=77%, E-value=3e-69, Identity=36%"; Hit description =Genomic DNA, chromosome 5, TAC clone:K24G6
VFGTTHLKFTPRLQELPLKCIGLGALVDFNGAKASDLVPVVGQMLLMGSIFLTYMAGVIPVEKSYASYQKTISDKNVFPESSDISGSSAKQNSGFESKYVLNVVREKLLNSLNALANKDYSGDIIVQSAKRPLSLSAVARGPKLRLLWAAFQQVEEEAGALALSLSAVTRGPKLRLLWVAFQQVNSFSISTAVGMDDLFETFYEIIQRSCHSTCTAWLEKEFFLLKGSADKELASMILEKVKGDITIVQSITRSGKKDLYAELLSYLTFGSLREDCYYDSRIFAVHGISILEDLVIALADGVASVYLEFISVDSDVSSKTNSLDMSLCALSTRELQKLRNEVALNQWLYHNMDTVVSMYEDRFDLCILESQPVDVTDSIQTEEQNWWKRLTQQNSKAMSPELHCIDISHFSMPVKRTKELRAVTG

SEQ ID NO: 178109 - protein, 74 aa, Glycine max
  Coding DNA Sequence Number=SeqID_61331
  Homolog annotation: Hit_ID=O24035; Match level="QueryCoverage=53%, HitCoverage=14%, E-value=5e-08, Identity=67%"; Hit description =Pantoate--beta-alanine ligase precursor
MKLRHHSRHPSEENGPALPSSRAWVYVDEELAGLGHEGEVARVEEAHGGDQPDELALGPHRAISALCALDLEGG

SEQ ID NO: 178110 - protein, 86 aa, Glycine max
  Coding DNA Sequence Number=SeqID_61332
MVVVRVNERCLGRGRGGGRISANFSSCKRASPAACTKVRGCKAWTSRRISGDSPEIKQLRMKGGGSPIIRFAKSSNSDRYWPTEPF

SEQ ID NO: 178111 - protein, 103 aa, Glycine max
  Coding DNA Sequence Number=SeqID_61333
MPDRHMYRRKLDCVPHQNPLYTVVVVQIQLPAALMSHSQWRKNVVGSLQGNGVYVKGKQEHERTQGKGSGGRQRKKSKSRKCKKEKSVTNATKRGISIGIAQS

SEQ ID NO: 178112 - protein, 169 aa, Glycine max
  Coding DNA Sequence Number=SeqID_61334
MGLQCLQKSRPRGELSIVGHPLEPRKCSSLHIKQGDCETIAFRGAVIFKVGVGLGLAEGLGKKSLGIGGGAEENVLKGTWESIVRMRVWHGEKDNKSTKNVRCKVSRARIRGLAPPEMRKEQSTKEEGRSLITIPSKAIWEGFAEASVLAVFFKRSREAILLQCRIETL

SEQ ID NO: 178113 - protein, 83 aa, Glycine max
  Coding DNA Sequence Number=SeqID_61335
MVFQSKVFLGTDVVSYVMRIAIGVTRSGISNLQVENPASMRVRWLNRKAPPVGWVKANIDGSVRDNGCQASCAEVLRNSYRLK

SEQ ID NO: 178114 - protein, 196 aa, Glycine max
  Coding DNA Sequence Number=SeqID_61336
  Gene Ontology: Mol. function=chitin binding; Cellular component =extracellular region; Biological process=chitin metabolic process
  Homolog annotation: Hit_ID=UPI000066154C; Match level="QueryCoverage =94%, HitCoverage=100%, E-value=1e-17, Identity=43%"; Hit description= Homolog of Homo sapiens "Keratin-associated protein 10-1
LHVLAIRGAARPHLQRTTCPRLERATRPHLGGLHVLAIRGLHALPFRGLHVLAIRGLHSLALRLHALALRGLHVLTFRGLHAVTFRGLHVLALRGLHALTLGTSYSSPLRGLHALALRGLHVLTIRGLQALTFRGLHVLALRGLHALTLGTSYPHCQRATRPHLERTTRPRQQRAARPHLQRTTPPRLERAACPHL

SEQ ID NO: 178115 - protein, 122 aa, Glycine max
  Coding DNA Sequence Number=SeqID_61337
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q6PP98; Match level="QueryCoverage=99%, HitCoverage=33%, E-value=4e-45, Identity=80%"; Hit description =Mitochondrial pyruvate dehydrogenase kinase isoform 2
  Pfam annotation: Domain name=HATPase_c; Domain location=32-117; Score= 17.4; E_value=0.001; Accession=PF02518.16; Description=Histidine kinase-, DNA gyrase B-, and HSP90-like ATPase
MWQGMLVRMHVLCVIVNMAVPQMFAFTGILILLFPHLHLMVFELVKNSLRAVQERFMDSDEVAPPIRIIIADGIEDVTIKVSDEGGGIPRSGLPRIFTYLYSTAGISLSVEHELSDIGTMEN

SEQ ID NO: 178116 - protein, 70 aa, Glycine max
  Coding DNA Sequence Number=SeqID_61338
  Subcellular localization annotation: CTP_CleavageSite=49; ConfidenceScore=5.30e-01
MAGGTLLGEQLWLIQDNMWSKTAIPRARHSLSCPSTTFVSTALSAIVVSSKTASSLGTPRCFAIIFAMAP

SEQ ID NO: 178117 - protein, 54 aa, Glycine max
  Coding DNA Sequence Number=SeqID_61339
MAEALRAWAIAQGSRALKPPMSGAIMVEAQVYVISGTIANWYFSKEHQTLRVLE

SEQ ID NO: 178118 - protein, 76 aa, Glycine max
  Coding DNA Sequence Number=SeqID_61340
RRPTRREEEEEVGEEEAEGGTEVGGVSGGGARRTSGGEVKVRRSMEGSNRRVNWDWEWEGKRSKQSSECGEKKREE

SEQ ID NO: 178119 - protein, 78 aa, Glycine max
  Coding DNA Sequence Number=SeqID_61341
MNIAITTTMIIIVIVVVTIVAFIAQPSLPPSLFSPPPPPNDKGGNNDNHGGDDCSVRGIDGKDDYGGNEFMVVGKQQF

SEQ ID NO: 178120 - protein, 40 aa, Glycine max
  Coding DNA Sequence Number=SeqID_61342
MSSAATMHKSCAEIGLDFKSHTVTIAFQLLSFSPVDVDVE

SEQ ID NO: 178121 - protein, 357 aa, Glycine max
  Coding DNA Sequence Number=SeqID_61343
  Gene Ontology: Mol. function=nucleic acid binding; Cellular component= intracellular
  Homolog annotation: Hit_ID=Q2Z1Y7; Match level="QueryCoverage=69%, HitCoverage=58%, E-value=4e-42, Identity=39%"; Hit description=Pm27 protein
  Pfam annotation: Domain name=DUF1644; Domain location=22-228; Score =172.8; E_value=8.9e-49; Accession=PF07800.3; Description=Protein of unknown function (DUF1644)
MAGVKRRLCSDSDIHALHKELDEVSCPICMDHPHNAVLLLCSSHEKGCRSYICDTINTNNSGNSFDINLTVQSDMHDVNELHQNEINALLSVGLAQGSRQGDAQDPNRLLDQHDEGILETADSENLQDRAVIEDLNADNSSESKLNLKCPLCRGAVLNWKVVEEARNYLNMKKRSCSRDSCSFVGDYLELRRHARRVHPTSRPSNIDPTRERAWRHFEDQREYGDIVSAIQSAVPGAVLVGDYVLENGDGIGRLPDERAEGNIGNANGPWLTTTILFQMMDSTVEIVREPRAHSSAWTRHRRSDERRRYLWGENLLGLHDNDIEDDLRIFRDAGEDASPVPRRRRRLTRTRSNEDQP

SEQ ID NO: 178122 - protein, 143 aa, Glycine max
  Coding DNA Sequence Number=SeqID_61344
  Homolog annotation: Hit_ID=Q1SR99; Match level="QueryCoverage=28%, HitCoverage=16%, E-value=3e-12, Identity=80%"; Hit description=Alba, DNA binding
MDRYQKVEKPKPESPINENEIRITTQGAIRNYITYASSLLQVLFLFRYRWFWRMRIPCVFCGLGVFLWWHFRELGFGFCLICLFAECWFKGLSIDGQAAGHLIHSQELKPVDSLHFLGFATYGLLTAPAIATESQPITLYTVH

SEQ ID NO: 178123 - protein, 121 aa, Glycine max
  Coding DNA Sequence Number=SeqID_61345
  Gene Ontology: Mol. function=long-chain-alcohol O-fatty -acyltransferase activity
  Homolog annotation: Hit_ID=Q84XY9; Match level="QueryCoverage=57%, HitCoverage=20%, E-value=2e-13, Identity=58%"; Hit description=Wax synthase isoform 1
  Subcellular localization annotation: CTP_CleavageSite=36; ConfidenceScore=5.29e-01
MRHLPMTTKNATTSGPNATRCNRHPRRSITFFVAISAANTDNHEIPPMTPKVLKGCGKCCLGLMGREAMGMKWRMFGGDRVRGPWLKEKRMSLKVSSQTRKKVVGPPRWKEERLKGRVRKR

SEQ ID NO: 178124 - protein, 388 aa, Glycine max
  Coding DNA Sequence Number=SeqID_61346
  Pfam annotation: Domain name=F-box; Domain location=3-50; Score=36.7; E_value=7.8e-08; Accession=PF00646.23; Description=F-box domain
MMTDITNLSTDLIELILSLLPIPTLIRASTVCKLWHSIISSSSFSTLSNHLKQPWFFLHGIHNISSKNNQSFAFDPSSNTWFLLPTPQHHHQSQYQSNTSFIGTSSFFFITAPNFLYTPILHPSWHPTPPLHFPRINPLLGVFHDAKDQNFGHHPKFIVVGGVKFIGNLVDIEDRLDVEIYDPLVGSWELGPPLPPDFRSGNSSSSLSSALFRGKFYVFGIYSCFVSSFDLHKRVWSDVHTLRPRHEVVFSFLVACREMLVLAGVCNFPHGSSSFVLWKVDERTMWFTQIDVMPHDLLCSLFDGDEDDKFASLKCVGLGDLIYVFNEDYHRMYPACVCEIDGESGRCVWRRVPQLPSLMSRFHKVVSFCSTVSLYSILGERQLPGLQY

SEQ ID NO: 178125 - protein, 220 aa, Glycine max
  Coding DNA Sequence Number=SeqID_61347
MREIAHPSKHKHLPTSHQEGEHNLMTRPKGVNVTPDPFMQRALEREEEEFPDLKSGGRGGPSSQDPTRGVENWGVEEVGGSDEEEGAGANEGGVGLVLEEGSKAKDWLFFEEMLWMPWRKNHGCLRWLERVEKEEEEIMECHSLQTVEALIKVGIGRRDRISSMSMFVADKNPKRKLLGVAAFELFSSRRFETTNIINTPLGWGNEKVFGSKKEVYGSDG

SEQ ID NO: 178126 - protein, 51 aa, Glycine max
  Coding DNA Sequence Number=SeqID_61348
MERNGMRTFRDDERSVVGAGEKKRRKEGGKRRGAYGKMLHFPEDSDTELKG

SEQ ID NO: 178127 - protein, 698 aa, Glycine max
  Coding DNA Sequence Number=SeqID_61349
  Gene Ontology: Mol. function=zinc ion binding; Biological process =defense response to fungus
  Homolog annotation: Hit_ID=Q9FJ71; Match level="QueryCoverage=99%, HitCoverage=51%, E-value=1e-134, Identity=40%"; Hit description =Arabidopsis thaliana genomic DNA, chromosome 5, P1 clone:MTE17
MASSDDEGEAQPLSVSNYHFEDNKDAPVCFSVLPIQWSESQSPVGKKMQVFLHGFVDNGLQKFFVQVVAWRFDLSYVRPEILVLSKDGRWIKLEKPRKSYEDTIIRTILITIHFLSYVKKNPDSSAKSVWDNLSKNKEFRSYEVMPSQNDLLNHMTLMGEAAKRDTALAKSKRYFIAKFLRSAIVILSTIPAAINVVVVLLLMVLEDKDKLKIKKPSDKEVKDLARPGFIIDDIDNDMIDEFGEDSDGEDELFDSVCAICDNGGQLLWSFHANEEDGEESTCASLGFSRKEVDEIQNFYCKNCEYNQHQCFACGTLGCSDKFSGAEVFKCASATCGFFYHPHCVAKLLHGIVEDAPKELEEKIAEGGPFTCPTHYCCECKEMEDKKKHDFQFAVCRRCPRSYHRKCLPREIAFDDIEDEDIITRAWEDLLPNNRILIYCLEHEIDDELGTPIRDHIKFPNVKATVREIDAEENAKSATKERVILNKNNIDSKNLFGKKATAKVSKLPGKMSSGKVGDKKSEKISRSNISRKKINEASRCFNENKRSTISKETKKSDGAENRPSLGAKLFALKQNSSEHINSGNEADDVAKNTLVVKPTKKLSSTLPALDADSKRRLLALFKEATSSVTLENVIKEHKFAATHTHSLKSVVEKTITLGKLEGSVEAVRTALRMLEDGHNIRDAEAVCGPDVLNQIFKWK

SEQ ID NO: 178128 - protein, 206 aa, Glycine max
  Coding DNA Sequence Number=SeqID_61350
  Homolog annotation: Hit_ID=Q9FKA9; Match level="QueryCoverage=19%, HitCoverage=24%, E-value=3e-07, Identity=60%"; Hit description =Genomic DNA, chromosome 5, TAC clone:K24G6
MEDDVKVAKVGESQREDSSRVFPCLFCSRKFYSSQALGGHQNAHKKERTAARKAKKASEHSCVSFPSPLPTPMVFAPTHLGILNPAMFITAHAARLPHLPSHQISEQFGSNGAPRFGNALFYRGSSKNRLHDDGKSSTFCWGDTSQHMQLLSNNQNLGIWNNGTSIYLTNIQVALRLKQQTHFNDLKASQPKHTSYSVTHLQPPTT

SEQ ID NO: 178129 - protein, 1042 aa, Glycine max
  Coding DNA Sequence Number=SeqID_61351
  Gene Ontology: Mol. function=catalytic activity; Cellular component =intracellular; Biological process=metabolic process
  Homolog annotation: Hit_ID=Q10K51; Match level="QueryCoverage=67%, HitCoverage=94%, E-value=0.0, Identity=55%"; Hit description =Pentatricopeptide, putative
  Pfam annotation: Domain name=ABC_tran; Domain location=940-1042; Score=-61.6; E_value=0.049; Accession=PF00005.17; Description=ABC transporter
  Pfam annotation: Domain name=PPR; Domain location=125-159; Score =20.1; E_value=0.0082; Accession=PF01535.11; Description=PPR repeat
  Pfam annotation: Domain name=PPR; Domain location=224-258; Score =45.8; E_value=1.5e-10; Accession=PF01535.11; Description=PPR repeat
  Pfam annotation: Domain name=PPR; Domain location=259-293; Score=4.3; E_value=2.3; Accession=PF01535.11; Description=PPR repeat
  Pfam annotation: Domain name=PPR; Domain location=325-359; Score =36.0; E_value=1.3e-07; Accession=PF01535.11; Description=PPR repeat
  Pfam annotation: Domain name=PPR; Domain location=427-461; Score =31.4; E_value=3.2e-06; Accession=PF01535.11; Description=PPR repeat
  Pfam annotation: Domain name=PPR; Domain location=463-497; Score=6.4; E_value=1.3; Accession=PF01535.11; Description=PPR repeat
  Pfam annotation: Domain name=PPR; Domain location=529-563; Score =40.2; E_value=7.2e-09; Accession=PF01535.11; Description=PPR repeat
  Pfam annotation: Domain name=PPR; Domain location=564-598; Score =18.2; E_value=0.031; Accession=PF01535.11; Description=PPR repeat
  Pfam annotation: Domain name=PPR; Domain location=600-633; Score=3.2; E_value=3.1; Accession=PF01535.11; Description=PPR repeat
  Pfam annotation: Domain name=PPR; Domain location=666-700; Score=3.1; E_value=3.2; Accession=PF01535.11; Description=PPR repeat
  Pfam module annotation: Pfam domain module=ABC_tran::PPR::PPR::PPR::PP R::PPR::PPR::PPR::PPR::PPR::PPR; Domain location=940-1042::125 -159::224-258::259-293::325-359::427-461::463-497::529-563::564 -598::600-633::666-700
MELGRRPTFKRTERAKAKCEERRGGASQSTQPCIYHFFSSSLQHKISHDPDNKNNKNNNVVVDFNLVFRSCTNINVAKQLHALLLVLGKAQDVVLLTQLVTLYATLGDLSLSSTTFKHIQRKNIFSWNSMVSAYVRRGRYRDSMDCVTELLSLSGVRPDFYTFPPVLKACLSLADGEKMHCWVLKMGFEHDVYVAASLIHLYSRFGAVEVAHKVFVDMPVRDVGSWNAMISGFCQNGNVAEALRVLDRMKTEEVKMDTVTVSSMLPICAQSNDVVGGVLVHLYVIKHGLESDVFVSNALINMYSKFGRLQDAQRVFDGMEVRDLVSWNSIIAAYEQNDDPVTALGFFKEMLFVGMRPDLLTVVSLASIFGQLSDRRIGRAVHGFVVRCRWLEVDIVIGNALVNMYAKLGSIDCARAVFEQLPSRDVISWNTLITGYAQNGLASEAIDAYNMMEEGRTIVPNQGTWVSILPAYSHVGALQQGMKIHGRLIKNCLFLDVFVATCLIDMYGKCGRLEDAMSLFYEIPQETSVPWNAIISSLGIHGHGEKALQLFKDMRADGVKADHITFVSLLSACSHSGLVDEAQWCFDTMQKEYRIKPNLKHYGCMVDLFGRAGYLEKAYNLVSNMPIQADASIWGTLLAACRIHGNAELGTFASDRLLEVDSENVGYYVLLSNIYANVGKWEGAVKVRSLARDRGLRKTPGWSSVVVGSVVEVFYAGNQSHPQCAEIYEELRVLNAKMKSLGYVPDYSFVLQDVEEDEKEEILTSHSERLAIVFGIISTPPKSPIRIFKNLRVCGDCHNATKYISKITEREIIVRDSNRFHHFKDGICSCAQLPIVEVMCFMDYQKVYGVLPELQVIVGQPALSRTAYGQLPSIWVQLLGNIVVMSQAAWKRFISGIYRYTSKVIHLFHSELKATIIFSWLQVYPGFYMVYSPNEEVCDAAKTGIVGRTGSGKSTPVQTLSRLIEPVAGQILIDSVNISLMGIHDLWSRLNIIPQDPTMFEGTVRTNLDPLEEYTDEQICEVLDVCQLGDVGKKGKLDFSKL

SEQ ID NO: 178130 - protein, 206 aa, Glycine max
  Coding DNA Sequence Number=SeqID_61352
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q9SZY7; Match level="QueryCoverage=84%, HitCoverage=96%, E-value=1e-75, Identity=84%"; Hit description=H+ -transporting ATPase-like protein
  Pfam annotation: Domain name=ATP-synt_C; Domain location=104-169; Score=16.2; E_value=0.00041; Accession=PF00137.12; Description=ATP synthase subunit C
  Pfam annotation: Domain name=ATP-synt_C; Domain location=20-85; Score= 48.9; E_value=1.7e-11; Accession=PF00137.12; Description=ATP synthase subunit C
  Pfam module annotation: Pfam domain module=ATP-synt_C::ATP-synt_C; Domain location=104-169::20-85
MVAHSSSWGRALVAISPYTFSAIGIAVAIGVSVLGAAWGIYITGSSLIGAAIRAPRITSKNLISVIFCEAVAIYGVIVAIILQTKLESVPASNIYAPESLRAGYAIFASGLIVGFANLVCGLCVGIIGSSCALSDAQNSSLFVKILVIEIFGSALGLFGVIVGIIMSAQATWPTKRGVASVEVKVLWRFIDGDCCNGWFGIGCRSQ

SEQ ID NO: 178131 - protein, 88 aa, Glycine max
  Coding DNA Sequence Number=SeqID_61353
MGSFIVGARSSYLGQNKFVCQGVGLGPNFHIIPQGTRNNDGLETTCKIGHGHSQRFVSKRPFRGNTGPNRIEENHSKCINLTHLSVLS

SEQ ID NO: 178132 - protein, 63 aa, Glycine max
  Coding DNA Sequence Number=SeqID_61354
MLQPYEISIGLKEHSNPVTPKAYTLKSPSGPLPPDSEDTAHELYNTHDLHSCFKHVQHNCATI

SEQ ID NO: 178133 - protein, 439 aa, Glycine max
  Coding DNA Sequence Number=SeqID_61355
  Gene Ontology: Mol. function=acyl-CoA reductase activity; Biological process=bioluminescence
  Homolog annotation: Hit_ID=Q2KXJ3; Match level="QueryCoverage=99%, HitCoverage=90%, E-value=1e-132, Identity=54%"; Hit description =Putative acyl-CoA reductase
  Pfam annotation: Domain name=LuxC; Domain location=57-439; Score =266.6; E_value=5.1e-77; Accession=PF05893.4; Description=Acyl-CoA reductase (LuxC)
MKVYAGHLPGIRHSEVAWHSLHFGQQGSTLEVCVPVLSEAQIATLAASVRDNARRYLHTLSVARITALIDEAIARLLNRSHPLRQQAERLLPLVTGYDAGMLRLGLTGYLKTFREPQLRRFLAEDFGNVQMLDDFQPRPKGGFARAFGPQLLLQVWAGNVPGLPLWSLIAGLLVKAGSVGKVASAEPLMAGWFAQLLAEIDPQLGDCLAVVWWQGGDERTEQQWFREADVVMAYGGEAALTAMQRRLPPATRFLPHGHKISFGMVARSALDVRRGTALARQVAYDVMRYDQAGCYSPQALFIERGGRMSPQEFAAYLAHELAALAQRYPRATLTLGESQAVAAWRNAEEMRALSGDRTLYGDENDAWAVVYVDKPEPLQPGALGRTLKVIAVDTLEETVNWVAAQRAYLQSVGLAAAPEVLFRLAAQLGAAGVTRITAL

SEQ ID NO: 178134 - protein, 116 aa, Glycine max
  Coding DNA Sequence Number=SeqID_61356
MANYPEANLLKGAYFKNYLRNGVCFKRNNGGGLLLGVTRHCHWRQRWREESIATGSGEIGHVGGREESVANANGDTPPAGVASPAGEIGHVGLAHSAGETGQASREASGACRASAF

SEQ ID NO: 178135 - protein, 259 aa, Glycine max
  Coding DNA Sequence Number=SeqID_61357
MCFFKEMKWLRKSFPQRGLEKTPLEKAPVLPNQLTQTLTGTDSGVSSIRSASTPSRDGHSSEIRQDFARTAAKRRVRIMRTSMTTLTQIWMTLLLSNILPSDHNSDLPLLKCQLVDGSLEVFPGPGEVQQGPGASSSDYRSLPILQSACYPQPCHPASHHQSLHREVLHTQTATGRSAPAAGDRCTTTPSVVHLGQLTEYGTLLAACSLPAGSQPPGTSTIAGVLLLVHAQPAGSRLHSFHMPYSRAVWSNDRMASRLA

SEQ ID NO: 178136 - protein, 40 aa, Glycine max
  Coding DNA Sequence Number=SeqID_61358
MKDARGRALAAQQDWFRRSNKPSGNRLQATCSCVIDYTEW

SEQ ID NO: 178137 - protein, 80 aa, Glycine max
  Coding DNA Sequence Number=SeqID_61359
MVSELWSGAHKDDKLFDEEQALLLLTSLSKSFKALVQTLLMGRSTLNLDEKIAALRENERMMRIENFDNEHHAIAVVEFD

SEQ ID NO: 178138 - protein, 476 aa, Glycine max
  Coding DNA Sequence Number=SeqID_61360
  Gene Ontology: Mol. function=nucleic acid binding; Cellular component= intracellular
  Homolog annotation: Hit_ID=Q1STQ3; Match level="QueryCoverage=17%, HitCoverage=50%, E-value=8e-16, Identity=53%"; Hit description =Bromodomain
  Pfam annotation: Domain name=Bromodomain; Domain location=25-112; Score=58.9; E_value=1.6e-14; Accession=PF00439.15; Description =Bromodomain
MELGKHDKNASASRTNDSSQNCMPLKSILENIIDFLQRKDTSGLFAAPTNLDVVENYHKIVKQPMDFGTMRAKLHEDMYTNFNQFKRDIFLICSNAMHASPKTSKYHEVAKHINRYAKGIFEALNADLGLFHSELSLNKRGPSTKQQKEKLIRTPRRVATKCAGMDTCSSFNLHSLIQKVSRPYIKVVRWRNNATHSTVPETEKRDKYWPPSKPLVAEVLNAKKPIIQLNENVSKYKESLLRFVKDLGPTAQKVAAKRLEVVSLSPVENVSSFHGPIQEPTNQLHLGSSRTSNTRLWNTSAGIQNMLAAGISSNAFACVCPTSMISGPPQPRLSGNRNNLPGSSRNPNPCLLSQSMADYSVSCMPSNNLTELLPLMHQPRPRESMYAMPSNNLTGLSPFPHRANSASRLNPLRLSPHGPVSQQEQNSSFLQMLLGGETNNYGGGGAQIGQPEEAPPQLPLDNDNDHDEVPDLELHL

SEQ ID NO: 178139 - protein, 76 aa, Glycine max
  Coding DNA Sequence Number=SeqID_61361
  Subcellular localization annotation: CTP_CleavageSite=34; ConfidenceScore=5.13e-01
MIFHYTSLQTPTQTLTPSSPPPMTIGGHQKPSLVAARPPHGGEAFNQSGILRIHLKDSVEKQNSAFGPMNVYVRGL

SEQ ID NO: 178140 - protein, 153 aa, Glycine max
  Coding DNA Sequence Number=SeqID_61362
  Homolog annotation: Hit_ID=Q1T493; Match level="QueryCoverage=68%, HitCoverage=19%, E-value=1e-13, Identity=40%"; Hit description =Nucleic acid-binding, OB-fold, subgroup
MVLMDGRRDKIHAIVKKEDLESWEAELKEGKTYYMYKFKVVLNDDGQYKICAHPFKLYFTGGTTLRQVDLAEIPLQSYEFKIFEDIAYGNYDPTKLIDVIAVVEEVKFQLPNRNLAKVKPLQGAHGLTISDSLYGSKLFINYEVPNFCHLQRG

SEQ ID NO: 178141 - protein, 269 aa, Glycine max
  Coding DNA Sequence Number=SeqID_61363
  Gene Ontology: Mol. function=protein kinase activity; Cellular component=chloroplast; Biological process=protein amino acid phosphorylation
  Homolog annotation: Hit_ID=Q1T053; Match level="QueryCoverage=99%, HitCoverage=74%, E-value=1e-139, Identity=91%"; Hit description =Protein kinase
  Pfam annotation: Domain name=Pkinase; Domain location=5-250; Score =60.3; E_value=6.4e-15; Accession=PF00069.15; Description=Protein kinase domain
  Pfam annotation: Domain name=Pkinase_Tyr; Domain location=2-248; Score=52.3; E_value=1.1e-15; Accession=PF07714.7; Description =Protein tyrosine kinase
  Pfam module annotation: Pfam domain module=Pkinase::Pkinase_Tyr; Domain location=5-250::2-248
MELPAIKAAEGEREFRVEVDILSRLDHPNLVSLIGYCADGKHRFLVYDYMHNGNLQDHLNGIGERKMDWPLRLKVAFGAAKGLAYLHSSSCLGIPIVHRDFKSTNVLLDANFEAKISDFGLAKLMPEGQETHVTARVLGTFGYFDPEYTSTGKLTLQSDVYAFGVVLLELLTGRRAVDLNQGPNDQNLVLQVRHLLNDRKKLLKVIDPEMARNSYTMESIFTFANLASRCVRSESNERPSMVDCVKEIQMIMYTNSKGLGMVMHRLRLV

SEQ ID NO: 178142 - protein, 431 aa, Glycine max
  Coding DNA Sequence Number=SeqID_61364
  Gene Ontology: Mol. function=carboxypeptidase activity; Cellular component=proton-transporting two-sector ATPase complex; Biological process=ATP synthesis coupled proton transport
  Homolog annotation: Hit_ID=Q1S5R9; Match level="QueryCoverage=94%, HitCoverage=95%, E-value=1e-118, Identity=53%"; Hit description =Peptidase M14, carboxypeptidase A
  Pfam annotation: Domain name=DUF231; Domain location=242-420; Score =167.7; E_value=2.9e-47; Accession=PF03005.6; Description=Arabidopsis proteins of unknown function
MAATSTNQIKDQSLSLTKRLFPWTLYALIPIALLHFYLNPLSFPPSPESELPHSLTSHFSPPSEDEKAHDTPCDYFNGKWVSDKRGPLYNGTTCGTIKENQNCIKHGKLDMGYLYWRWKPNSECQLPRFDPHAFLNVVSNKHLAFVGDSMARNQLESLLCMLATASSSTLLFSNDSNKFRRWHFSSHNATVSVYWSPFLVKGVEKSSSGPDHNELYLDHVDEKWGGDMGQMDLIVLSIGHWFLHPAIYYEDGSVLGCHYCPGLNHSAIGFYGVLRKALRTTLNGIIDRRGGKGNDGVGVILTTFSPAHFEGEWDKAGACPKTRPYRNEEKKLEGMDAEMREIEMEEVETAKVKAKGIGGFRLEALDVTRLALLRPDGHPGPYMYPFPFANGVQERMQNDCVHWCLPGPIDTWNEIFLEILKKWEEQHKSEE

SEQ ID NO: 178143 - protein, 146 aa, Glycine max
  Coding DNA Sequence Number=SeqID_61365
MSLYQLSTLPSITTVSQITIWVIQAVIYPHLQLYHNLGLTTYKSLIDITKITLKQKRNLCSSIGAYDASSIGACRPRIFFINGFLCFLKDEWQRNGERERERRRHFKEKMSLEEAHHHRRPWIRAWRKKEMNEGRGREEHEILCSK

SEQ ID NO: 178144 - protein, 86 aa, Glycine max
  Coding DNA Sequence Number=SeqID_61366
MVLYVVAYEQQHKQTNSGCVQQHVSSHVQTTASVEISRRDAFKVCIDAILPRKGPITRTMSKRLQEDWARAAEEGPRVLMNLRVDF

SEQ ID NO: 178145 - protein, 91 aa, Glycine max
  Coding DNA Sequence Number=SeqID_61367
MDVITLSIIVCNACLPYAVITCNKYSIDEDMTKSKGKDPLEGLGRPMTRARARKTKEVLRQVLSILFEYKPKFQGKKSKVASCIMTQMEED

SEQ ID NO: 178146 - protein, 100 aa, Glycine max
  Coding DNA Sequence Number=SeqID_61368
MGEMLATQLAQASKVASFRSNRLLEESFGGPKWAWLLFAPPLLLNTPPAFFLNLTIGATMLPFEFRHVTELHELPNDGCQVPQNGQMKVACHQAKVPGRN

SEQ ID NO: 178147 - protein, 207 aa, Glycine max
  Coding DNA Sequence Number=SeqID_61369
MTSKSAIAADKDNVRDTDRKKAQAIQKQNTTPHVLPCGGYEYLENKLMEEKKKKQLEEAAQSGSTDTMIDPPSLINRHVKWKMARTKKSGQMMSEAAKEIAHKIDSLEEQASQEHLGRVHVVGAHVTIKQYFGPAPRTSRTSSSMAPEDLEQLKQKIRDQLEESITEKVTRQLMFSFSQIQSQFQSQMQSQGIALPPEHKIGPSAAH

SEQ ID NO: 178148 - protein, 395 aa, Glycine max
  Coding DNA Sequence Number=SeqID_61370
  Gene Ontology: Mol. function=transporter activity; Cellular component= membrane; Biological process=transport
  Homolog annotation: Hit_ID=Q2A0M6; Match level="QueryCoverage=97%, HitCoverage=71%, E-value=0.0, Identity=80%"; Hit description=Root uracil permease 1
  Pfam annotation: Domain name=Xan_ur_permease; Domain location=38-394; Score=56.0; E_value=1.3e-13; Accession=PF00860.11; Description =Permease family
MAGGGAAPQPKQDEHQPHPVKDQLPNVSFCITSPPPWPEAILLGFQHYLVMLGTTVLIPSSLVPQMGGGNEEKAKVIQTLLFVAGINTFFQTFFGTRLPAVIGGSYTFVPTTISIILAGRYSDVVNPQEKFERIMRGTQGALIVASTLQIVLGFSGLWRNVVRFLSPLSAVPLVALSGFGLYELGFPVLAKCVEIGLPEIIILVVFSQYIPHMMKGEKPIFDRFAVIFSVAIVWIYAHLLTVGGAYRNSAPKTQITCRTDRAGIIGGAPWIRIPYPFQWGAPTFEAGEAFAMMAASFVALVESTGAFIAVSRYASATPIPPSVLSRGVGWQGVGILLSGIFGTGNGSSVSVENAGLLALTRVGSRRVVQISAGFMIFFSILGKFGAVFAFQFQLQ

SEQ ID NO: 178149 - protein, 199 aa, Glycine max
  Coding DNA Sequence Number=SeqID_61371
  Homolog annotation: Hit_ID=Q1SGH7; Match level="QueryCoverage=35%, HitCoverage=18%, E-value=6e-18, Identity=68%"; Hit description=Zinc finger, RING-type; Thioredoxin-related
MDVVWAIWKHRNTIVFEEANYDGDIVVDGFKYFFVELVQFKYTGFNYSLHEGVDPTQYLRYTCFVLIHEQNNIVCWRCHDDFVEHVTSPNASTSDEENNFELNYDDFNSKGLCPLPSTMSKFLLGLVFDWLLEQVLQIEINGLGRAENPSTSKAVIESMPTVEITESHVVLHPPRLDLNSTTPLAQQRATQINNNLDLK

SEQ ID NO: 178150 - protein, 120 aa, Glycine max
  Coding DNA Sequence Number=SeqID_61372
MRITIRCLYMSSDLPSLDDKGADDDVNLCMSTGSLASSWQKVQITVRHLRMSLDLSSLDDKGEDDDVSFCVSTGSLASSRQKVRIIVRHLCMSSDLPSLDDKGVDDDVSLYLSTGSLASS

SEQ ID NO: 178151 - protein, 160 aa, Glycine max
  Coding DNA Sequence Number=SeqID_61373
MTKSKGKDPLEGLGGPMTRVRARKAKEAIQQVLSILFEYKPKFQREKSKVTILSQPLCNEGSYHLVIRASVLGSTLPLLEILGNNPNDGVGLSQVQMQALTQHLERLMKQRYQMKNRDHNEEERRRRGNDGVPRQNRIDGINLNIPPFKGKNDPEAYLEW

SEQ ID NO: 178152 - protein, 44 aa, Glycine max
  Coding DNA Sequence Number=SeqID_61374
MNDGYYGINHRLGARKAKTSNDVSKCDGSLGDACEFDARLDKFS

SEQ ID NO: 178153 - protein, 358 aa, Glycine max
  Coding DNA Sequence Number=SeqID_61375
  Gene Ontology: Mol. function=chitin binding; Cellular component =extracellular region; Biological process=chitin metabolic process
  Homolog annotation: Hit_ID=UPI000044A8F0; Match level="QueryCoverage =63%, HitCoverage=99%, E-value=3e-36, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
ALTFIGLHALTFRGLHVLAFIRLHAHTFRGLHVLAFKGLHVLTFRGLHALAFRWIHTFAFRGLHALAFKGIHSLAFRGLHAFAFKGLQVLTIRRLHVVAFRGLHVLTFRGLHVLTFRGLHVLTFGGLHVLALRGPHILTFRGLHVFTFRGLHTLTFRGLHSLAFIGLHALTFKGLHVLAFRGLQALALRGLRALAFRGLHALAFQGRPVLNFRGLHALAFSGLCILTFSGLHIRTLREFKVLCPLILEEGQLCEHNQRKRLLCSYYAYRGNISPVPLQRDECGSCAPTDRTHKTPSGPGEVQQGPGVSSFGYGPLSVLQGARPPQQGYTIVTNVVICTFPGDVSVFRPRLRKSLICYM

SEQ ID NO: 178154 - protein, 256 aa, Glycine max
  Coding DNA Sequence Number=SeqID_61376
  Gene Ontology: Mol. function=hydrolase activity, acting on ester bonds; Cellular component=nucleus; Biological process=biosynthetic process
  Homolog annotation: Hit_ID=Q8VUE5; Match level="QueryCoverage=99%, HitCoverage=60%, E-value=8e-73, Identity=47%"; Hit description =Synthetase CbsF
MRLVQRHTPFVVRYRRGRGGRAARQARGVVQAQYLRQIRHVGPRVTVGQQHHRPRVVAHQRQTFTRIVQIERHIGRAAGQHAEQRDQRVHRARNADGDHVFGADAAFDQHSPQLHHPFGELPVAEAHVAAGHRQRLGLTLNLALERIHDRNHARRRRQLSAAPPGRELSEFPLADQRQLTVRLVRLPRQLLQPMADALRVVLQGARRVFGRVGDQRQRQYAASKTDLELQVVDRPHRQRMGGGRLTVERQGAVVDR

SEQ ID NO: 178155 - protein, 106 aa, Glycine max
  Coding DNA Sequence Number=SeqID_61377
  Gene Ontology: Mol. function=DNA binding; Cellular component =cytoplasm; Biological process=DNA integration
  Homolog annotation: Hit_ID=Q1SS89; Match level="QueryCoverage=98%, HitCoverage=16%, E-value=5e-34, Identity=54%"; Hit description =Integrase, catalytic region
MEGSLLTIISKHTSSIMVSFTRPRAHKLHKRMVSPNEKNCHILETTHVLLLGTHVPTHHWDNAITTTVYLLNCIPCKVLHFKTPLCLFLGYGLHNKGYKCLDPTTN

SEQ ID NO: 178156 - protein, 187 aa, Glycine max
  Coding DNA Sequence Number=SeqID_61378
  Gene Ontology: Mol. function=DNA binding; Cellular component=beta -galactosidase complex; Biological process=DNA integration
  Homolog annotation: Hit_ID=Q1SS89; Match level="QueryCoverage=89%, HitCoverage=29%, E-value=1e-60, Identity=76%"; Hit description =Integrase, catalytic region
MEEALVDPKWAQAIQEEMEALQKNNTWRLIPLPKGKKTVGCKWVFSIKYKTERSIDRHKARLVAKGFTKIYAIDYTKTFSPMAKLNIVRVLLSLVANLDWPLFQLNVKNVFLHGDLEEYVYMDIPPEYMPSSGTKVARSQGGIFLSQRKYMLDLLTEVGLLDCKPADTLSYPNFVWGPSVYWDATFA

SEQ ID NO: 178157 - protein, 255 aa, Glycine max
  Coding DNA Sequence Number=SeqID_61379
  Gene Ontology: Mol. function=nucleic acid binding; Cellular component= beta-galactosidase complex; Biological process=DNA integration
  Homolog annotation: Hit_ID=Q1SCY9; Match level="QueryCoverage=87%, HitCoverage=18%, E-value=6e-28, Identity=28%"; Hit description =Integrase, catalytic region; Zinc finger, CCHC-type
MIEVLSKAQSTSQSSIFDSSMILINIKLDGSNYALWSQVAEMYISGKDKLGYIDGSFPPLSKTDSTFHKWQFENTIVKGWLINSMDPSLVGNFICFPTTKGVWNSIAMTYFDGSDTSQIYDLRRKERVYIFLDGLDDRLDNIQSDILQLKSFPTIKQAYTHVRREDTCQIVMTYGAKNTTSGAVMATKGSKFGQLLILVARKHNSVLKSKGPSNGGKYTHYGNVRHTNDTYFKLHGYPKWWHELQAKKKKRHHDT

SEQ ID NO: 178158 - protein, 39 aa, Glycine max
  Coding DNA Sequence Number=SeqID_61380
MRLHCYQASQRPSMTTNRLPLLMAHIDPGIGPNISTCVR

SEQ ID NO: 178159 - protein, 678 aa, Glycine max
  Coding DNA Sequence Number=SeqID_61381
  Gene Ontology: Mol. function=protein serine/threonine kinase activity; Cellular component=cell surface; Biological process =protein amino acid phosphorylation
  Homolog annotation: Hit_ID=Q1S9U2; Match level="QueryCoverage=97%, HitCoverage=97%, E-value=0.0, Identity=67%"; Hit description=Protein kinase; Concanavalin A-like lectin/glucanase
  Pfam annotation: Domain name=APH; Domain location=355-536; Score= -15.1; E_value=0.068; Accession=PF01636.13; Description =Phosphotransferase enzyme family
  Pfam annotation: Domain name=Lectin_legB; Domain location=36-271; Score=283.9; E_value=3e-82; Accession=PF00139.10; Description=Legume lectin domain
  Pfam annotation: Domain name=Pkinase; Domain location=352-621; Score =178.5; E_value=1.7e-50; Accession=PF00069.15; Description=Protein kinase domain
  Pfam annotation: Domain name=Pkinase_Tyr; Domain location=352-621; Score=122.1; E_value=1.6e-33; Accession=PF07714.7; Description =Protein tyrosine kinase
  Pfam module annotation: Pfam domain module=APH::Lectin_legB::Pkinase:: Pkinase_Tyr; Domain location=355-536::36-271::352-621::352-621
  Subcellular localization annotation: CTP_CleavageSite=38; ConfidenceScore=5.47e-01
MAFFTYASNSNQCPKQTLLFIFTIFTLFHTLFTTVECLSFNFSTFQPNSNNLIDFKGDAFSSRGVLQLTKNQIDDKITFSVGRASYNQQVRLWDRRTKKLTDFTTHFSFVMKAVDPKRFGDGLAFFIAPFDSVIPNNSAGGYLGLFSNESAFNMKKNQLVAVEFDSFENEWDPSSDHVGIDVNSIQSVTNVSWKSSIKNGSVANAWIWYNSTTKNLSVFLTYADNPTFNGNSSLSYVIDLRDVLPELVRIGFSAATGSWIEVHNILSWSFSSNLDGDNRKKVKVGLVVGLSVGLGCCLVCVVGLLWFTFWRRKNKGKEENLGVDASIDDEFERGTGPKRFTYRELSNATNNFAEEGKLGEGGFGGVYKGLVVNSNLEVAVKRVSKGSKQGKKEYVSEVRVISRLRHRNLVQLIGWCHEQGELLLVYEYMPNGSLDSHIFGNRVMLSWVVRHKVALGLASALLYLHEEWEQCVVHRDIKSSNVMLDANFNAKLGDFGLARLVDHELGSQTTVLAGTMGYLAPECVTTGKSSKESDVYSFGVVALEITCGRKPVEVREEPSKVRLVEWVWSLYGKGKLLEAADKKLNWEFEEQQMECLMIVGLWCCHPDHTMRPSIRQVISVLNLEAPLPSLPSKLPVPMYYAPPMDMCKFSYTSSGVTSTTKESSPYSSMSAGSGKSLL

SEQ ID NO: 178160 - protein, 81 aa, Glycine max
  Coding DNA Sequence Number=SeqID_61382
MAGVTGVVKISKRELDGIKQRRHEVDRQVDIETMKEQMTMMMEAMISIRKMMEVNAEQLLRPILLLRGTQLTRPVSIKRVV

SEQ ID NO: 178161 - protein, 414 aa, Glycine max
  Coding DNA Sequence Number=SeqID_61383
  Gene Ontology: Mol. function=signal transducer activity; Cellular component=integral to membrane
  Homolog annotation: Hit_ID=UPI0000D9DFFD; Match level="QueryCoverage =73%, HitCoverage=74%, E-value=4e-44, Identity=34%"; Hit description =PREDICTED: similar to Protein C9orf126 homolog, partial
ETTPLEGGKKMSSQQMQMQIQIQNSGGGSGNNNSSNIPVSEVFWTLVDKADKKFSKIRDLPFYQRSRHDTYFYKVFKVYTQLWKFQQENRQKLIEAGLKRWEIGEIASRIGQLYFGQYMRTSDANYLSESYIFYEAILTREYFKEGEMVQQLVNQLKVLVDECKRTFQESDFKEWKLVVQEILRFLKAETAFMNIRPLRYSLVLDSHPDTLPHVAAAITKRHLKLRDAVLSSFHPNEVKYSELTIDTFRMLQCLEWEPSGLFYQSSGSKLSQNGATGTSRISYIQDIADPTLPANPRKAVLYRPSLTHFIAVLATICEELPSDGILLVYLSASGYCGSAQNESGCIHFGPRGDRDKSLGLSWGQLIILVKPWTRLAEFSRNATGQTHIFGQNSTTEVMAVEQPKEGDGQNIEHD

SEQ ID NO: 178162 - protein, 48 aa, Glycine max
  Coding DNA Sequence Number=SeqID_61384
MVVSVADMDEDEWMYEIMSERADMDYENVESCGANEPHVDCSNAFKTS

SEQ ID NO: 178163 - protein, 605 aa, Glycine max
  Coding DNA Sequence Number=SeqID_61385
  Gene Ontology: Mol. function=RNA-directed DNA polymerase activity; Cellular component=chromatin; Biological process=chromatin assembly or disassembly
MDLYVLPISGANVVLGVQWFKILGPEDASYFHIAVLTEDPASTPAPDLPLEIQDLLAKFATLFQNPQGLPPARDIDHHIHLIPHFTLVNVRPYRYPHYQKHEIELQDGSWKFCMDFRALNAVIVRDRFLIPTIDELLEKLGGTKYFSKLDLLQGYYQIRMHVADIPKTAFRTHHGHYEFKVEYLGHMVSQKGVEPVASKVEAIHQWPVPQSIRAVQSFLGLVGFYRRFIRGYATIAASLIRITIVKPFKWTSQAQLAFEQLKAALSTTLILALPDFQLPFTIEMDASNMEIGGQKVAPVPPRSSFHHYHQPPKPQGITNSSNLDVGTTHVSVPSLSFLEELRCQLEDHPKYRRQHQEIIENLTKYPPFLLSQNLVRKYETQTMVGLLCPLSVPHQPWEDLSLDFIVGLPTYHGNTTILVVVDHFSKGIHLGMLPSAHTAHMPLLTRALPIQWNPIVNEFRIPSSEKWSNGGTGTAPYEVTFGWKPFNFPEYITGSSNIKVVESFLTDRDETFQAIRKKILKAQDGMKRQADSKCREGLSPNETSWEDWTQLQRDYHFEDKVILQGSKDDKNIEASSEIENAKEGVLKEEKPKGKIMKPPYLNDYV

SEQ ID NO: 178164 - protein, 83 aa, Glycine max
  Coding DNA Sequence Number=SeqID_61386
MANSACSTSTMDRIEVAIVELTAAQDAIATKLDKLLPLLALFETTQHSSFFPFGKSPPLAGTMPIPFPMVTSQHSLWDKGAWE

SEQ ID NO: 178165 - protein, 234 aa, Glycine max
  Coding DNA Sequence Number=SeqID_61387
DSLEDHASQGSFVAYGRQDVLTVAIGRPEHPGRVHVVGVGVTIKQYFGPAPRTSRTSSSMAPEDLDPNFNRRCNHKDSHCLLSQRLVLQLLVSIKESYVYPSSNDPYTGDSEKYGLYVEENLPRLVALGRLYEGSTTVHNMSLCHDQLKVGVEEVRDVDALIPIPTQKGVLGPTKPADRPDHDVDDPLYLMTLTIPQLFLKPLQVMWDAIVFGMFNDDFPLYIKHEDLFEIAHG

SEQ ID NO: 178166 - protein, 33 aa, Glycine max
  Coding DNA Sequence Number=SeqID_61388
KEHKLRLKSKPNTKNYHAALTNKSWTCYPWPYQ

SEQ ID NO: 178167 - protein, 128 aa, Glycine max
  Coding DNA Sequence Number=SeqID_61389
MSPPSSRRKRLSSVEGDCLVSKGDEFVERLSMDEYCPLSGVLVNPLSLDKYSLSCFCQVVREGHVFGVLGVCDTCAILLHMCQSRSGHLLESRFVHEWESMMVPNFRAPIQLRPVIEEFVSLLNGVNV

SEQ ID NO: 178168 - protein, 321 aa, Glycine max
  Coding DNA Sequence Number=SeqID_61390
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=9e-35, Identity=29%"; Hit description= UPI00006A17C9 related cluster
  Subcellular localization annotation: CTP_CleavageSite=26; ConfidenceScore=5.15e-01
MPSPLEDYMSFSSNGYTPLPSKDFTSSSSEGCTPSHLGGCMPLRFEDYTATRPRFRALHIIAFRGLHVLPLRRLHALTFRGLHVLAFRGLHALDFRGLHALTFRGLHVLAFRGLRVLAVRGLHGLAFRGLLALPFRGLHVLDRRVLHVLAFRRLRTLTLKGLHATLRGLHVLAFRGLHVLAFRGLHALTIRGLHLLALRGLHAHAFRRLHALTFRRLHALTFRGLHATFRGLHVLAFRGLHVLAFRGLHALAFRGLHVLLFKWLYTLAFKGLHVLLFRGLHALAFRRLHVLTFKGLHALTFRRLWALSFRGPHALTLRGLH

SEQ ID NO: 178169 - protein, 42 aa, Glycine max
  Coding DNA Sequence Number=SeqID_61391
MAASVQNNPIDVSEEKLEESQGIARDAAITVGRHVSPFRGKG

SEQ ID NO: 178170 - protein, 95 aa, Glycine max
  Coding DNA Sequence Number=SeqID_61392
MWVQAIGPFAQATCAPEFGLPRPFNQRLLILHVGGAAVKQRGQPFPCVQESPTTRDPRSLNPFSEIRRREEEISLKRDRLYSEDQSKFLIEYASG

SEQ ID NO: 178171 - protein, 614 aa, Glycine max
  Coding DNA Sequence Number=SeqID_61393
  Gene Ontology: Mol. function=transmembrane receptor activity; Cellular component=membrane; Biological process=defense response
  Homolog annotation: Hit_ID=Q1SI46; Match level="QueryCoverage=99%, HitCoverage=57%, E-value=0.0, Identity=56%"; Hit description=Leucine Rich Repeat, putative
  Pfam annotation: Domain name=LRR_1; Domain location=278-305; Score =3.8; E_value=55; Accession=PF00560.23; Description=Leucine Rich Repeat
  Pfam annotation: Domain name=LRR_1; Domain location=323-344; Score =7.1; E_value=13; Accession=PF00560.23; Description=Leucine Rich Repeat
  Pfam annotation: Domain name=LRR_1; Domain location=346-367; Score =6.2; E_value=20; Accession=PF00560.23; Description=Leucine Rich Repeat
  Pfam annotation: Domain name=LRR_1; Domain location=369-391; Score =9.6; E_value=4.6; Accession=PF00560.23; Description=Leucine Rich Repeat
  Pfam annotation: Domain name=LRR_1; Domain location=393-416; Score =10.7; E_value=2.8; Accession=PF00560.23; Description=Leucine Rich Repeat
  Pfam annotation: Domain name=LRR_1; Domain location=418-437; Score =3.5; E_value=63; Accession=PF00560.23; Description=Leucine Rich Repeat
  Pfam annotation: Domain name=LRR_1; Domain location=439-460; Score =7.7; E_value=10; Accession=PF00560.23; Description=Leucine Rich Repeat
  Pfam annotation: Domain name=LRR_1; Domain location=462-483; Score =4.0; E_value=51; Accession=PF00560.23; Description=Leucine Rich Repeat
  Pfam annotation: Domain name=LRR_1; Domain location=485-510; Score =11.8; E_value=1.8; Accession=PF00560.23; Description=Leucine Rich Repeat
  Pfam annotation: Domain name=LRR_3; Domain location=323-342; Score =26.6; E_value=8.6e-05; Accession=PF07725.3; Description=Leucine Rich Repeat
  Pfam annotation: Domain name=NB-ARC; Domain location=1-172; Score= -113.7; E_value=0.0049; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_3::NB-ARC; Domain location= 278-305::323-344::346-367::369-391::393-416::418-437::439-460::462 -483::485-510::323-342::1-172
MIGQKKVLIVLDDVNDSEQLEELFGTPDWYGSGSRIIITTRDIKVLIANKVPEIYHVGGLSSCEAFQLFKLNAFNQGDLEMEFYELSKRVVDYAKGIPLVLKILAHLLCGKDKEVWKSQLEKLKGIKSNNVHDFVKLSFDDLHHEEQEILLDLACFCRRANMTENFNMKVDSINILLGDCGSHNAVVVGLERLKEKSLITISEDNVVSMHDTVQEMAWEIVCQESNDLGNRSRLWDPIEIYDVLKNDKGTKAIRSITTPLSTLKNLKLRPDAFVRMSNLQFLDFGNNSPSLPQGLQSLPNELRYLHWMHYPLTCLPEQFSAEKLVILDLSCSRVEKLWHEVKNLVNLKNVKLRWCVLLNELPDFSKSTNLKVLDVSCSSGLTSVHPSIFSLHKLEKLDLSGCSSLIKFSSDDDGHLSSLLYLNLSDCEELREFSVTAENVVELDLTGILISSLPLSFGSLRKLEMLHLIRSDIESLPTCINNLTRLRYLDLSCCSNLCILPKLPPSLETLHADECESLETVLFPSTAVEQFEENRKRVEFWNCLKLDEFSLMAIELNAQINVMKFAYQHLSAPILDHVENYNDYKDLMILIKQCTCIQEAVFQSGWHIRLERIM

SEQ ID NO: 178172 - protein, 152 aa, Glycine max
  Coding DNA Sequence Number=SeqID_61394
  Homolog annotation: Hit_ID=Q4BBL8; Match level="QueryCoverage=32%, HitCoverage=31%, E-value=2e-12, Identity=66%"; Hit description=MaoC -like dehydratase
MGDAGEAGEGGHIALHRQREQQEAMCDGMPTRHLRLRPRWIDMDPVVVAGGVGKSIDARLVHAGHATQPLTGGPLLQRLQGGRQVAVRTHATRSSKVRIASRASGSDSIGACPTSGTSTRRALSEVAAICRATSAGRMSDSAPRTTSTGTRA

SEQ ID NO: 178173 - protein, 135 aa, Glycine max
  Coding DNA Sequence Number=SeqID_61395
MASRKYTDNVLGRNILPERKVELYHTELDDFKAKLERRNFHKRLNNLADGSIDLALVKEFYENLYSSEDCPPKQSRVRGHLVKMDADSLNAFLETPMLLAERNSTRILQILQVAYGLQRDRACLMHTWLRVHLEL

SEQ ID NO: 178174 - protein, 167 aa, Glycine max
  Coding DNA Sequence Number=SeqID_61396
MDNHSGISARQRGSNVSMTDLVSAEDDTEKKNVYTDYHSDISARQRDSNVSMTDLVSAEDDTAKKNVYTDNHSGISARQRGSNVSMTDLVSAEDDINLRTVKKNVYTDNHSGISSCQHDSNVSMTDLVSAEDDVNLRVSTGAEDDTAKKNVYTDNHSGISAGQRDSN

SEQ ID NO: 178175 - protein, 518 aa, Glycine max
  Coding DNA Sequence Number=SeqID_61397
  Homolog annotation: Hit_ID=Q016Y8; Match level="QueryCoverage=85%, HitCoverage=19%, E-value=1e-35, Identity=26%"; Hit description =Homology to unknown gene
MQGEYVLPGTRDDNPVDIKGDGFLKRFLSGHLGSVISSMGRWRMKLEVPRAEVAEMLPLARLLSRSMDPAVLSRSKDFFIQSLQSIGLYSMSTQQLIELIREHHVPSNDVLEDLSLPGLLELKGRWHGSLNASGGGNGDTLAEFDFHGEDWEWGEYKTQCVLAVGTYSNVDGLHLEKILIQKDNATIHADGTLLGPKSNLHFAVLNFPVSLIPTVVQIIDSTASNAVHSLWQLLAPIRGILHMEGDLRGSLAKPECDAQIRLLDGAIGGIVLERAEVVASLTSTNRFLFNAKFEPLIQNGHVLIQGAIPVTFFQSNMSQQDVELDKNRATWAPEWVKKKNMGATDDARDKKVSRRRNEEGWNTQLAESLKGLNWQILDVREVRVDVDIKDGGMMLVTALTPYANWLYGSADIMLEVRGTVDQPVLNGYASLCRASISSPVFRNSLTNFGGTVHMKSNRLSIPSLESRIGRKGKLLVKGNLPLRTKEAALNDKIEFKCEVLEVQAKNILRLAFYLAQGI

SEQ ID NO: 178176 - protein, 175 aa, Glycine max
  Coding DNA Sequence Number=SeqID_61398
  Homolog annotation: Hit_ID=Q016Y8; Match level="QueryCoverage=97%, HitCoverage=6%, E-value=2e-12, Identity=28%"; Hit description =Homology to unknown gene
MLEKGSAASLVGEVSISGLKLNQLMLAPQMSGSLSVSPDCIKLNASGRPDESLVMDFVGPLQLSGESGLKSGQLMSISLHKGQLRANVDFQPCHSASLEVWHFPLDELELASLKGTIQRSCLNDDLVKALFNGHAEIQLNLQKRRGHGIISVLQPKFNGVLGEALDVAARWSEML

SEQ ID NO: 178177 - protein, 1061 aa, Glycine max
  Coding DNA Sequence Number=SeqID_61399
  Homolog annotation: Hit_ID=Q016Y8; Match level="QueryCoverage=30%, HitCoverage=16%, E-value=2e-36, Identity=30%"; Hit description =Homology to unknown gene
  Subcellular localization annotation: CTP_CleavageSite=33; ConfidenceScore=5.28e-01
MDTLFFGIKLRAPLEVNNTIKRVFPRSKRCNVSAKHVRYPSRHAFRFCSQNVNLLRKPHVSASGSRLKCFKEKEPPFSLSVSYFTSLWKEGVLLMRASVFTVVISGLCLLVWFGRNKAKGFVETNILPSVCSVISEYVQRDVCFGKVVRISPLSVTLESCSFGPGEEEFSCGEAPTAKVRFRPLASLWRGKFVFDAVLSHPCVLVVQKKDYSWLGIPLSQGGIQRRLSTNEGLDHRTKVRRVAREEAAAKHVRDRDDAAREAAEMGYFVSEKNCGPSKGDDNLKEIATHSVGGTNSKGFFCMKKVEQHGHRCVDTGVDYDMKHADLEESFRVKFPEKGLKFWKRVIKGHRKHKFKQKAKRSDISASGIALRKRILERGAFAANAYFHSQSHGMFEHPLSSSGCFHSRDHDRQWVKSDFDKNAVSVASGDDNRNDDNRNGTQFRDLGVWSPSANENINGNSKDLNFFGDLSSQTRESKHENLQSSEDVAEHANANISTEKKEELRLHVAHNPIDVSATRGQRDLVSVKPRSVLATYFQVSFETLIMKFGLTSFFRNIEGLTSFFLAGPIEKLKSEMSLKVEGTVAENVDGVDVLQSEDLTKILPVTLDSVQFRGATVMLLTYGDREVRVMENANGHVKFHNHYYNRINVKLGGNCKTWRSDDICEGDGWLSVIVFVDTVEQKWHANLKIDHFFVPLFERILDIPITWSKGMASGQVHLCMSKGETFPNHHGQLDVTGLNFQILNAPSCFSDISGSLCFRGQSIFLHNACGWFGSIPLEASGDFGIHPEEGEFHLMCQVPSVEVNALMRTFNMRSLLFPLAGSITALFNCQGPLDTPIFVGTGTVSRTFSSLHVDTPTTVASEALAKSKEAGALAAFDRVPFSHVSANFTFNTDSCIADLYGIRASLVDGGEIRGAGTVWICSEAVNDETAIDANFSGSLAFEKIMLRYIPSYHHLVPLKFGVLSENTKLSGSLLRPRFDIKWTAPTAEGPFSDARGDIIISHDFITVNSASAALDLYMKVQTSFSDNFSSKREEFYAPRASLFTVGGVEFDLHMRGFEFFSL

SEQ ID NO: 178178 - protein, 321 aa, Glycine max
  Coding DNA Sequence Number=SeqID_61400
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q8RZF8; Match level="QueryCoverage=82%, HitCoverage=67%, E-value=5e-87, Identity=56%"; Hit description =Lustrin A-like
  Pfam annotation: Domain name=DUF231; Domain location=161-318; Score =259.1; E_value=8.8e-75; Accession=PF03005.6; Description=Arabidopsis proteins of unknown function
MLRNLMDCTTMLPFDFRHVTELHGLPNDGCQVPRSGQTRVASQQTDGPRTKLGFNGEDFLTRLRGKSIMFVGDSLGLNQWQSLTCMLHIAVPQAPYSLARNGDVSIFTFTTYDVKVMFSRNALLVDIVGESIGRVLKLDSIQAGQTWKDIDVMIFDSWHWWIHTGRKQPWDLIQVGNRTYRDMDRLVAYEIALNTWAKWVDYNIDPTRTRVFFQGVSPGHQNPAQWGEPRPNLCEGKTRPILGFRYPGGPLPAELVLEKVLRAMQKPVYLLDITTLSQLRIDGHPSVYGFGGHLDPDCSHWCLAGVPDTWNELLYAILVKN

SEQ ID NO: 178179 - protein, 60 aa, Glycine max
  Coding DNA Sequence Number=SeqID_61401
MLVATPRIFPPLESAPVSLAFARPQKGMLRQLATPLGIFLVHGNLRSGGESIIMLGLRLA

SEQ ID NO: 178180 - protein, 45 aa, Glycine max
  Coding DNA Sequence Number=SeqID_61402
EAWLCFPGIECGRGSSKKGGKGEPEKEASNVRLPRVRMINAAATG

SEQ ID NO: 178181 - protein, 94 aa, Glycine max
  Coding DNA Sequence Number=SeqID_61403
PPDSIPTVEQFNEWVAWPGTQPPPHRDDEDPAAQVPHQSSDESSESSTPEPLIRKRRIVVTQEAATTPEKSPEATPEPLTPMADTTSPQLAADP

SEQ ID NO: 178182 - protein, 140 aa, Glycine max
  Coding DNA Sequence Number=SeqID_61404
  Subcellular localization annotation: CTP_CleavageSite=34; ConfidenceScore=5.02e-01
MRGYLMVTRTFRPPRANEPVDAQRLTSSSATFVVLTREGNIMVTRTFRQLGENEPGDAQRLTSSSATFVVLTREGQTTLDAQRLTSSSAPFVVLTREVRLHAGLPYGYPHLSSTWGKRAFDVRRLTSSSIPFVVLTREVK

SEQ ID NO: 178183 - protein, 72 aa, Glycine max
  Coding DNA Sequence Number=SeqID_61405
MKIRFLYLNKNIPHRVQGLISSWVLKVEDKPLPTRFAILELRDQSPNLLLSLCLVVRKEREGMKVNEKRKEK

SEQ ID NO: 178184 - protein, 150 aa, Glycine max
  Coding DNA Sequence Number=SeqID_61406
MGLYIQDDQSTRLVALGKVYEGAPTIHHMPYANNVVKDSQIHPKKKVEHVHRSNPIGEINPLSYLIKNLYDLYKKSLELLWDGAIGDDDMFKSKGKDPLEGLGGPMTRARARKVKEALQQVLSILFEYKPKFQGEKSKVVSCIMAQMEED

SEQ ID NO: 178185 - protein, 142 aa, Glycine max
  Coding DNA Sequence Number=SeqID_61407
  Gene Ontology: Mol. function=nucleic acid binding
MAEDHPQRMTLEDYSSLATPQYFTSIARPDVQATNISYPHSLIQLIQGNLFHGLPSEDPYIRTPGHIHRDLQHGEDSRSEAKRWLHSFKGNSLRTWEEMVEKFLKKYFPKSKTAEWKVEISFNHVEENRNNNSSTLNKSVHK

SEQ ID NO: 178186 - protein, 151 aa, Glycine max
  Coding DNA Sequence Number=SeqID_61408
  Gene Ontology: Mol. function=transition metal ion binding; Cellular component=nucleus; Biological process=cytoskeleton organization and biogenesis
  Pfam annotation: Domain name=Transposase_21; Domain location=79-150; Score=-131.1; E_value=0.002; Accession=PF02992.5; Description =Transposase family tnp2
MVLDLVNLKARFGWSDKSFTELFIVLKKMLPKDNTLPKNHHKAKKILCPMGMEYQKYMHALMIAYYTKISFPKCASAPYMMQKTLDGMQMAEKVMDFFDIQLCMKHKYIMLCMMIAGPRQPRNDIDVYLCPLIDDLRRLWVYGVDVFDENL

SEQ ID NO: 178187 - protein, 80 aa, Glycine max
  Coding DNA Sequence Number=SeqID_61409
MEQEIINTACKTVVRKESFMQGFGAGLRSSSSSSEEERLKRKEIEADVAPCGASRPWIFFINGVLCFLKINGSGMKMEER

SEQ ID NO: 178188 - protein, 129 aa, Glycine max
  Coding DNA Sequence Number=SeqID_61410
MGVSVFFSLFMWGGISPVENDFEWQFKRKRHQKWVFLCRQSLILPKIYLVLAFYLLSLEEIPLSFSSGEMMRILLIGQGSKKSKVVFQWGLLSWEPNLDIWGKTNLGVKVSVSSRTPILLHKARVTMMI

SEQ ID NO: 178189 - protein, 78 aa, Glycine max
  Coding DNA Sequence Number=SeqID_61411
MAKRELADREIVECGVLLLLVTPLRVRVQHPTPLAHSYQPQLQLRVVSQVEYPSLVDLRGLLLDLVAINWFGSTIVKI

SEQ ID NO: 178190 - protein, 169 aa, Glycine max
  Coding DNA Sequence Number=SeqID_61412
  Homolog annotation: Hit_ID=Q1SAK3; Match level="QueryCoverage=36%, HitCoverage=4%, E-value=2e-12, Identity=49%"; Hit description =Integrase, catalytic region; Zinc finger, CCHC-type
MKLLMIFKNLPRTPQQNGILERKNRSLEEGVRALLNETKLPKYFWVDAVSTVCYTLNMKMLWKMKMEVFRIWILLLKMKPKLKSLNKEIKSLPHLLKTSLENGELKKTFPWITVGTCPFAGERGEAHGCVFQRRKMRGVATNVYLWKTSEKSKETGHKEYSKFGSCIYV

SEQ ID NO: 178191 - protein, 116 aa, Glycine max
  Coding DNA Sequence Number=SeqID_61413
  Gene Ontology: Cellular component=chloroplast
  Homolog annotation: Hit_ID=P03938; Match level="QueryCoverage=51%, HitCoverage=44%, E-value=6e-12, Identity=66%"; Hit description =Hypothetical 14 kDa protein ycf68
MSPHGGDMDGGEKRKERDGVSLAFGIAGPGGRPARRAISSVVERAPDNCVVVPGLYLSSTGLGLASMEKNGAPNNVSSQTKNYEDRPFHSGVTVGSYHSSLFFHAFPGGLEKIAIQ

SEQ ID NO: 178192 - protein, 135 aa, Glycine max
  Coding DNA Sequence Number=SeqID_61414
LYGVHFAPTKVIRPPTNQAFIKKYCAPRQAQGGTPQQPGDVRQRAIDASPPPPKAGALPTTRGRPAGDQFQSQSRTHLVVHDPRNLNKTSTSSEGSKIPWICMYIAKITHNICNKIPWIHMYIAKTPHKNIHMIR

SEQ ID NO: 178193 - protein, 351 aa, Glycine max
  Coding DNA Sequence Number=SeqID_61415
  Gene Ontology: Mol. function=transporter activity; Cellular component= membrane; Biological process=transport
  Homolog annotation: Hit_ID=UPI00005FAA06; Match level="QueryCoverage =53%, HitCoverage=27%, E-value=1e-29, Identity=41%"; Hit description =COG3188: P pilus assembly protein, porin PapC
MPRKPRPEKKCPSVKPSPNSISLRQGKIARCRVEIAGLPLSVTDVVLVEVVIDEGHRFAAVQAGGIDAAARPAVQQRLRNAQIQPQPRDIGVHRDVLQIPAGQQAFRFGGRRRIFQPEARQLRPIETGQHLFACAYEANLIAFEKLAIEVQIDLIAARSDGVLLVELAQGAVAQHAAAQQRGIEGIAVGGGAAQRQRQQRATPACGQRRRLASIEHEYLPVWFQRATFRIRLRDGDALRAAQDRGLADVGVVAGRVVDAQRVAGLAQAEPIDDVVGVAGQPGGAIEHLQPIGDHQQQFVLVAVRLAHGGHLQEVEIEQRFAIARQRLADERQPHHLPAVRIHAEDLRRGDE

SEQ ID NO: 178194 - protein, 172 aa, Glycine max
  Coding DNA Sequence Number=SeqID_61416
MDPKKLSAKRARKVAIGDGSSMAPPERQVQLAEGNWVRIMRTSMTTLTQIWTTFLLKNILPSDHNYDLTLPKCQLVYNIMTKISVHVAQLILDAIHQFVGIAPLRHPVDPEKSNRALGFLTLIPATVAWPRDKPNFQEEADPTDAQGAAQGNEGGAEDDGDMADLFDFFIGG

SEQ ID NO: 178195 - protein, 88 aa, Glycine max
  Coding DNA Sequence Number=SeqID_61417
MSSLNMRKGFEGQRIKREISTLKLLKHPNVRNLDQLEDLLNKVKLKTISTEPPSASIAGTSWCIFGVSVDSVVAALQFVAPSAKGFFL

SEQ ID NO: 178196 - protein, 60 aa, Glycine max
  Coding DNA Sequence Number=SeqID_61418
MTLWRQLCMDVQERFVKKQAANGVARELARMTSLFPSLYSINHVIPCIEHCRSKQNKKRS

SEQ ID NO: 178197 - protein, 199 aa, Glycine max
  Coding DNA Sequence Number=SeqID_61419
  Subcellular localization annotation: CTP_CleavageSite=33; ConfidenceScore=5.05e-01
MNNITNNLKLPKSNKYYLNNRIISTLKSKNYFRGQSRTVHNNKLNGQSIHLTKNQFCYCLLALQICYPSCALLKHLFQIVHNQIEDHDNVILPSLGLIPKDETVGGKVAVPDAGIAVAAEAAAGTAASAGDGGTAADEMEDMFAEILVPVAVAAVVVVLGVAVVAAVVVVGTVAAVAAAAAAVVAAPLAVEVFHPLVEH

SEQ ID NO: 178198 - protein, 43 aa, Glycine max
  Coding DNA Sequence Number=SeqID_61420
  Homolog annotation: Hit_ID=Q93YH8; Match level="QueryCoverage=99%, HitCoverage=13%, E-value=3e-07, Identity=81%"; Hit description=HMG I/Y like protein
GSTSASTTQNAANEDLRRKLEHFFLSLILTMKVQSLQLLPFKS

SEQ ID NO: 178199 - protein, 114 aa, Glycine max
  Coding DNA Sequence Number=SeqID_61421
  Homolog annotation: Hit_ID=Q1SKD7; Match level="QueryCoverage=93%, HitCoverage=33%, E-value=8e-10, Identity=30%"; Hit description =Ankyrin
MASRKHSTKKSRKDATAEGTSAAPEFDSHRFRSAEHQDDEYTDFQEEIARQRWTLLVTPMAKFDPDIVLEFYANAWPTEEGVRDMRSWVRGQWIPFDADPLSQFLGYPLVLEEG

SEQ ID NO: 178200 - protein, 116 aa, Glycine max
  Coding DNA Sequence Number=SeqID_61422
MVGCDPKGTFSVGAKLSRSRIFFGFLSDSPYEVASLLVDDSPPFMGIMVSVPYAFRLVKSSTQGPENDSISCLCMSISLRMFNRAPRAFGSSPSMSIPTWRKGKRHMAKDQGELRL

SEQ ID NO: 178201 - protein, 67 aa, Glycine max
  Coding DNA Sequence Number=SeqID_61423
VKKRLSHEVLKVTFELSSLVRLSAHPPLSAASAHLALSARLVLSLNPLTRAKREGGAKRNVAGSEPI

SEQ ID NO: 178202 - protein, 71 aa, Glycine max
  Coding DNA Sequence Number=SeqID_61424
GVTDRDPRGEGDILTTCIFAIFHLVLLFVVKKASWAELSCFNEELGCDKLVEYVRLNAVLVELSLLRGICG

SEQ ID NO: 178203 - protein, 121 aa, Glycine max
  Coding DNA Sequence Number=SeqID_61425
MSFICFFRSLIFLAVTDPFCYHRLLLIDAVLEGCSGYSNSSVVYKSKGETKDIELVEEEQAQIGADPSSETSNKSENYKEEARKKTQKHKPKRVESVNADAEAFVDDWKILIALCIVKLKQ

SEQ ID NO: 178204 - protein, 89 aa, Glycine max
  Coding DNA Sequence Number=SeqID_61426
  Subcellular localization annotation: CTP_CleavageSite=51; ConfidenceScore=5.30e-01
MSSAFTFQRLSQSFILQRQSSLPGRAVMTLNALFCYKYDVAPLELVGLGSSSSMDSFASLKMNGSGMEKEEREETPLQGEDESRRSLPP

SEQ ID NO: 178205 - protein, 139 aa, Glycine max
  Coding DNA Sequence Number=SeqID_61427
MTWGLFPRFCLLNPMPVLRMVDKVQGNAAHRMQAKSVAYHIVSSKEQGRTPYGKKVKGFPVWLYRRKIDFGYSCKSNHGIDIKEIALNMILVMKAILQEDWARAAKEGLGVLMNPWTKLSCSFFRNLLKEASQEGELSY

SEQ ID NO: 178206 - protein, 134 aa, Glycine max
  Coding DNA Sequence Number=SeqID_61428
  Gene Ontology: Mol. function=microtubule motor activity; Cellular component=microtubule associated complex; Biological process =microtubule-based movement
  Homolog annotation: Hit_ID=Q9SJU7; Match level="QueryCoverage=99%, HitCoverage=65%, E-value=2e-32, Identity=83%"; Hit description =Putative kinesin heavy chain
  Pfam annotation: Domain name=Kinesin; Domain location=30-116; Score= -166.4; E_value=0.00069; Accession=PF00225.13; Description=Kinesin motor domain
MGAIAGEELLKWEKMQGVSSRKEKILVSIRLRPLNEKEIAANESANWECINDTTIFCIKGRHGHINYRDSKLTRILQPCLGGNARTTIICTLSPARSHNEQTRNTLLFACCEKEVTTKAQVNVKMSDKALVKHL

SEQ ID NO: 178207 - protein, 221 aa, Glycine max
  Coding DNA Sequence Number=SeqID_61429
  Gene Ontology: Mol. function=nucleotide binding; Cellular component =membrane; Biological process=small GTPase mediated signal transduction
  Homolog annotation: Hit_ID=Q9LH50; Match level="QueryCoverage=98%, HitCoverage=98%, E-value=1e-102, Identity=85%"; Hit description=GTP -binding protein-like
  Pfam annotation: Domain name=Arf; Domain location=2-174; Score=-66.9; E_value=0.00013; Accession=PF00025.11; Description=ADP-ribosylation factor family
  Pfam annotation: Domain name=MMR_HSR1; Domain location=16-129; Score=- 10.5; E_value=0.0091; Accession=PF01926.13; Description=GTPase of unknown function
  Pfam annotation: Domain name=Miro; Domain location=17-129; Score =89.5; E_value=1e-23; Accession=PF08477.3; Description=Miro-like protein
  Pfam annotation: Domain name=Ras; Domain location=17-176; Score =295.7; E_value=8.9e-86; Accession=PF00071.12; Description=Ras family
  Pfam module annotation: Pfam domain module=Arf::MMR_HSR1::Miro::Ras; Domain location=2-174::16-129::17-129::17-176
MSNLYGDYNQKIDYVFKVVLIGDSAVGKTQLLARFARNEFSLDSKATIGVEFQTKTLIIDNKIIKAQIWDTAGQERAVTSAYYRGAVGAMLVYDMTKRQSFDHMVKWLEELRGHADQNIVIMLIGNKCDLGSLRAVPMEDAEELAQRENLFFMETSALESTNVETCFLTILTEIYRIHAKKSLTTSDDDIGGSGLLKGSRIIVPNQEIYNGGKKGGCCFAS

SEQ ID NO: 178208 - protein, 134 aa, Glycine max
  Coding DNA Sequence Number=SeqID_61430
MLPFEFRHVTELHELPNDGCQVPQNGQMKVACHQAKMFSIIHREKDIRELTKQRDLAQSKVEDLLHMVGKDQISGKVVSILKGKISRKMIVQYQSHPAFVVLIVLIHTLETSTILIIMVEIVILMLLDKWPQKY

SEQ ID NO: 178209 - protein, 536 aa, Glycine max
  Coding DNA Sequence Number=SeqID_61431
MEGRESKSSLTSQTEPRDNPHSRFSTPMQQHQSHHELPMWNSKSDWRRVQKEMVALKKAYADVILNTVKEAAGRVMVAERRALMFQQEHASSKEEALHMLMRLKQMMDAKTAEAEKASLEKQRKIDELEAQLNEAEDIITDLRAELKLVYLELEMARNNQVRPLSGQKSQNEKQAVTFQESAKPEISISSPHKELRCVTSCDVANKSLTMNVLDNKCCNAKQQTEQLRISNLEDSCGHDSDFASIITKSKEPELFRNGFTQRIHALEGNLLDEKLLKQDVHNQHYGKKLRIIAKDSNGQVAKYSALTEKMEIKKHIKHHKIPKRKIYSYFWSHFLSCKIHLNDNCKSSKVVCSLPSIKLSAISKWKRKRRRHPHLGMKSFAFRSCKPSFSLKQCPSVSDNKKCCEDEYDAKMKSVAPLTDVEPVLGTTGVTESVQAVNKFKLVEKAIEKDNELLNLEESAAQNLTGPSSDMKVEVFDVPSTNTDLEDAKAFEKNDRSASQVNDSRPLKYTFQRKRKKESLGNTDQNIDSEKRIVKR

SEQ ID NO: 178210 - protein, 271 aa, Glycine max
  Coding DNA Sequence Number=SeqID_61432
  Gene Ontology: Mol. function=RNA binding; Biological process=positive regulation of transcription, DNA-dependent
  Homolog annotation: Hit_ID=Q6D619; Match level="QueryCoverage=65%, HitCoverage=61%, E-value=6e-61, Identity=65%"; Hit description=Beta -glucoside operon antiterminator
  Pfam annotation: Domain name=CAT_RBD; Domain location=95-153; Score =95.6; E_value=1.5e-25; Accession=PF03123.6; Description=CAT RNA binding domain
  Pfam annotation: Domain name=PRD; Domain location=169-257; Score =58.5; E_value=2.2e-14; Accession=PF00874.10; Description=PRD domain
  Pfam module annotation: Pfam domain module=CAT_RBD::PRD; Domain location=95-153::169-257
LRHAGRRNPRYRAGRAGQPERLRQNHWRDQPRRGDERAYSGADQGEKGQRARRQPAGGALQAGMITPCAAQKCDRGGTPRHNRIVTDAETPGKTMKIAKILNNNVVITLDDRQEETVVMGKGIGFKKKPGDTLDESLIEKVFTHNGGEIAERYKELLSEIPLACVTTADRIITLARERLPGKLHNIVYITLTDHIHFALQRHAEGLDIKNALLWEIKKLYQAEFAVGLEALALIAERLNTALPEDEAGFIALHLVNAQLNDEMHNTLHITR

SEQ ID NO: 178211 - protein, 240 aa, Glycine max
  Coding DNA Sequence Number=SeqID_61433
  Gene Ontology: Mol. function=carboxylic ester hydrolase activity; Cellular component=mitochondrion; Biological process=lipid metabolic process
  Homolog annotation: Hit_ID=Q1XBG1; Match level="QueryCoverage=98%, HitCoverage=53%, E-value=3e-54, Identity=44%"; Hit description=Lipase
MALVAFYQGQVLNKFRSAALLSPIAHMNQMTSILTKIAAVAFLANEICWLGLREFVPNGDVAVKFAKDFCHILNLKCSNLMTLFAGPNCCLNSSTIDVFLDHEPQPTSTKNLVHLSQNYRYRFVVDVSCYGFGAVIRTGTIAKYDYGDQGQNMQHYGQPLPPLYDMTGIPNEFPLFLSYGGQDTLSDAKDVQVLLNDLKDHDRNKLVVMLNEDYAHVDFVMGVNANQMIYDPMMDFFKVN

SEQ ID NO: 178212 - protein, 104 aa, Glycine max
  Coding DNA Sequence Number=SeqID_61434
MRIEEWMHWRLIKNIKGGLAEVTDTVDDDDVLDVEPNTDLLTEYIVEEESEVPSSKDVTGLEEGNNEFPETKATLAAGLDFKMISRQHTPLHEMEGGVNTSSLG

SEQ ID NO: 178213 - protein, 376 aa, Glycine max
  Coding DNA Sequence Number=SeqID_61435
  Gene Ontology: Mol. function=RNA-directed DNA polymerase activity; Cellular component=chromatin; Biological process=RNA-dependent DNA replication
  Homolog annotation: Hit_ID=Q1T5Q8; Match level="QueryCoverage=80%, HitCoverage=52%, E-value=6e-39, Identity=28%"; Hit description=RNA -directed DNA polymerase
MDNVRAIKAILRAFELVSGLKINFAKSGFGVFGVSDQWRIVATDYLNCNLLSFPFTYLGIPIGANLRRYQTWDPIISKVPKKVVDKLVSLQRRFLWGGGHGQNKISWVKWETVCLSKEEGGLGVKDINSFNMSLLGKWIGNLFHQQAELWARVLESKYGGWRSLSEGPRANGDSIWWRDLKFVFQQPQHGAMMKNTTLWKVGCGDKFKFWEDGWIGGEDTLLSRYPRLRRRPLFDSEIDMAVSFLRDVEGHRIQPQKGDEWDGAFEELWKLKIPSKIAIFAWRLIRDRLPTRVNLGRRQIEENNFSLVGINVVGEFGECSSKPPKTSLPPTHCANGILDDAIFLLWTWLKNLEKDFDINYNQWASNIRDGLVITAG

SEQ ID NO: 178214 - protein, 125 aa, Glycine max
  Coding DNA Sequence Number=SeqID_61436
MRLMFGLNTERDNQLDAVCDKVVKEDEGMDANPTTSQAEKKTMKKMNAPSSKVVLAHQRPPPTLVAPKAIVVMAHVSRRATPKKQQPLSTIERLRALSETDSDDDQALVFRKRKVAPPSYETIKP

SEQ ID NO: 178215 - protein, 100 aa, Glycine max
  Coding DNA Sequence Number=SeqID_61437
MVLKEGVMWKMGSGANIHVWDEPWLRDKESAYIRTPTIKGCLDLRAYSASPRVGEIHQFCRVVLIIVLQHVFILAELATTAYGHASVEYLEETQPQGLGQ

SEQ ID NO: 178216 - protein, 165 aa, Glycine max
  Coding DNA Sequence Number=SeqID_61438
MDDEVQHEAPPSPSTLIASNIKNAYNIERRVDAKFQPPVDWMKFPLDIEEKKVTCPSSIHRDSQVASSTSTELEPPTKIEVLPPLPWKRLHPKVSKPSSIAAQHKSVYKIPSGTCKENMRYNKDIIRWFQKIDAQRIAHPLLISNHLFYVQSTSNYSLQHPSSFL

SEQ ID NO: 178217 - protein, 99 aa, Glycine max
  Coding DNA Sequence Number=SeqID_61439
MRRKRKSWTSKDETRDETCLEEKDETFETGPASFQWPEGSAWTSRTGNEALLWLRCWSHDLQGWVALLEAHPTLVLPENLTAAANRDSQNGIVPALIPC

SEQ ID NO: 178218 - protein, 172 aa, Glycine max
  Coding DNA Sequence Number=SeqID_61440
  Gene Ontology: Mol. function=RNA-directed DNA polymerase activity; Biological process=RNA-dependent DNA replication
  Pfam annotation: Domain name=AT_hook; Domain location=66-78; Score =14.9; E_value=0.061; Accession=PF02178.9; Description=AT hook motif
MRMLRWMCGKTRQDKIRNEAIRERVGVAPIVEKMVENRLRWFGHVERRPVDSVVRRVDQMERRQIIRGRGRPKKTIREVIKKDLELNDLDRSMNSKYGSKLLINEKILEIEDFKKRLKSDWSYEGYPNYKRKNDFAEAKYTCLGCGSLESKSKIHTKINIQISFYGIENVPT

SEQ ID NO: 178219 - protein, 147 aa, Glycine max
  Coding DNA Sequence Number=SeqID_61441
  Subcellular localization annotation: CTP_CleavageSite=70; ConfidenceScore=5.28e-01
MLIRGLLLALPSDMLGAPSNIAGAPSNSMKASSPTSFFPDKLLLRELLRQPLDPFAFEGFFRKFRKNVFRKVSGRSVLPEVTKRLPEEHFFRKTSGKRLPGTFRKKWFIRKNSGRLALPEEVSNFRKTFPEEPFFRSVSGRTTSSGS

SEQ ID NO: 178220 - protein, 201 aa, Glycine max
  Coding DNA Sequence Number=SeqID_61442
  Homolog annotation: Hit_ID=Q9LW80; Match level="QueryCoverage=91%, HitCoverage=98%, E-value=1e-14, Identity=30%"; Hit description =Arabidopsis thaliana genomic DNA, chromosome 3, P1 clone: MSL1
  Subcellular localization annotation: CTP_CleavageSite=61; ConfidenceScore=5.08e-01
MLLRETIRKTRVLFHKTLRSFKSVIFGGYQKLPRSLSFNPFVGRSGNARTYTSEQFYNEFYDMLQSDLNRIKRSDSNSMSRSREHAIGDAVNTEILRKQSSQKSIAEEGVVVEEKKNKGSCEMGKKECLNNSKSMNEGVHDLAEKMKELEMMDTGDVEHELDIEEALHYYSRLKSPVYLDIVDKFFMDMHSEFSVQESSIS

SEQ ID NO: 178221 - protein, 187 aa, Glycine max
  Coding DNA Sequence Number=SeqID_61443
  Gene Ontology: Mol. function=structural constituent of ribosome; Cellular component=ribonucleoprotein complex; Biological process =translation
  Homolog annotation: Hit_ID=Q6SPR2; Match level="QueryCoverage=49%, HitCoverage=98%, E-value=4e-48, Identity=95%"; Hit description =Ribosomal protein L37
  Pfam annotation: Domain name=Ribosomal_L37e; Domain location=94-147; Score=131.2; E_value=2.8e-36; Accession=PF01907.9; Description =Ribosomal protein L37e
  Subcellular localization annotation: CTP_CleavageSite=60; ConfidenceScore=5.26e-01
SVPEEGSSGNFRMTIFRTKFVSTSGIPKFFFRKKYFRKLFGTSFSGRFPEILLPEEELLKGNLATSLFAGCPSNNAGAGLAHSYLFPLLPLNMGKGTGSFGKRRNKTHTLCVRCGRRSFHLQKSRCAACAFPAARTRKYNWSVKAIRRKTTGTGRMRYLRNVPRRFKSGFREGTEAAPRKKGAATTA

SEQ ID NO: 178222 - protein, 203 aa, Glycine max
  Coding DNA Sequence Number=SeqID_61444
GETLPIYSRYCRLPTDYREIEVALCILGRGFILNTEGHPGKILKKDLNTLAQVWSVLSYSNLAPTSHTSNLKVDRARLIFGLISRLDMNIGALISCQMTFIAQFNTSRLGFPTLITALCRARGVVSESLTFERLSPVINLTYIRKNCWNLEDLIVSIRGARRARARPAELPSTSAASTPAAPCVPAQTDSQCFEAMLQSIHQG

SEQ ID NO: 178223 - protein, 163 aa, Glycine max
  Coding DNA Sequence Number=SeqID_61445
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=2e-23, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
WTLKGLHILAIRGLQALTFKGLHILTFRGIYVLTFKGLHFLTFRGLHVLAFKGLQVLAIRELQVLVFRGLHVLAIRGLHVLAFRGLHVLTFRGLHVLTFRGLHILTFRGLHVLAFRGLHVLAIRRLHALTSKGLHLLTFRGLHVLTFRWLHALAFRGLHALAY

SEQ ID NO: 178224 - protein, 290 aa, Glycine max
  Coding DNA Sequence Number=SeqID_61446
MERCFHDKFYRPQPEETIADLMNTKQMLPEVESAAMVTGNVLPQLKDKLVAHEYVNLDEENGESYEEEAKIMAALKPSKGKSVGDGKVEYDFDISKGRNTVSSIIPTTILRPIALSFDKLYKRTLKEGCFKLVDKGMAEMAVDGDPFPKRKMKYAWQPKIEVKQETTWTTRRTSVFERLQSSQLARGVCVPHQIRKRKGEFTKFDRIKRQIPAKRETVQVLQIDESPIPKNRRRWAKLNVVNKMKTLHITVDNKDNHQLKMIRPSTRTKEIAKGQGCKENETNIDNDGRS

SEQ ID NO: 178225 - protein, 358 aa, Glycine max
  Coding DNA Sequence Number=SeqID_61447
  Gene Ontology: Mol. function=RNA-directed DNA polymerase activity; Cellular component=chromatin; Biological process=RNA-dependent DNA replication
  Homolog annotation: Hit_ID=Q8LNE4; Match level="QueryCoverage=87%, HitCoverage=40%, E-value=3e-50, Identity=28%"; Hit description =Putative retroelement
MEESKPKSNEIDMILEAWLNDDDLLGHEVDAISLILKVDKRVNITFDKPTPEMTKHLESLYVKAQINGKTLAKIESFTGGVTAALGVLVAKITIGPKTMYLAFFIVDAKPTYSVLLGRDWIHASQFLPSTLHHFGRKIRMLEPLFYLPYLTPIQISNDYKEESPSFEAQDPLEEVNLGTETNVRMTKINDHKLPTKASFKPHQKPPKHCNPQVLPQIKAEIEKMLGVRDLNLVTPKDEYVMPIADMLVDVVAKHGALGIYEWLIMSFGLENARPTYQRDMILIFHYAIGKNMEKIRIHGLKMNLAKCALGVPTSNFSGFLVHQQGIKVDTNKAKDILEARPPQNKNELQSLIGKINFL

SEQ ID NO: 178226 - protein, 300 aa, Glycine max
  Coding DNA Sequence Number=SeqID_61448
  Gene Ontology: Mol. function=thiosulfate sulfurtransferase activity; Cellular component=mitochondrion; Biological process=sulfate transport
  Homolog annotation: Hit_ID=Q9ZPK0; Match level="QueryCoverage=87%, HitCoverage=69%, E-value=1e-102, Identity=69%"; Hit description =Thiosulfate sulfurtransferase
  Pfam annotation: Domain name=Rhodanese; Domain location=86-206; Score= 81.3; E_value=3.1e-21; Accession=PF00581.10; Description=Rhodanese -like domain
  Subcellular localization annotation: CTP_CleavageSite=60; ConfidenceScore=5.49e-01
MASTLFTKMLLGQRLIHPYSFLTHQPQILSSLFSKRLFCIRAVPVSASTSQNIKTTGWAPCMASSSVGRRATYSTQSVSTNEPVVSVDWLYDNLKEPDIKVLDASWYMPDEQRNPIQEYQVAHIPGALFFDVDGIADRTTKLPHMLPSAEAFAAAVSALGIENKDDLVVYDGKGLFSAARVWWMFRVFGHDRVWVLDGGLPRWRASGYDVESSASSDAILKASAATEAIEKVYKGQTVGPLTFQTKFQPHLVWNIDQENNTLEKWRLTMLVVVEVSKIFLLESIISYLKDEVRFEVAAAI

SEQ ID NO: 178227 - protein, 139 aa, Glycine max
  Coding DNA Sequence Number=SeqID_61449
  Gene Ontology: Mol. function=thiosulfate sulfurtransferase activity; Cellular component=mitochondrion; Biological process=sulfate transport
  Homolog annotation: Hit_ID=Q9ZPK0; Match level="QueryCoverage=72%, HitCoverage=27%, E-value=5e-47, Identity=87%"; Hit description =Thiosulfate sulfurtransferase
  Pfam annotation: Domain name=Rhodanese; Domain location=25-131; Score= 43.7; E_value=6.3e-10; Accession=PF00581.10; Description=Rhodanese -like domain
MQTVKSKQTTEICMKDLHDCGDQQTMPDLSKNVADEQFDGTVQEPRKGIRSGHVPGSKCIPFAQLLDSSQTLLPADELKKRFEQEGISLESPAVTSCGTGVTACILALGLHRLRKSDVAVYDGSWTEWGAQSNTPVDTL

SEQ ID NO: 178228 - protein, 71 aa, Glycine max
  Coding DNA Sequence Number=SeqID_61450
  Subcellular localization annotation: CTP_CleavageSite=20; ConfidenceScore=5.19e-01
MASEAFSMFVARNNPKRNLVAMAAFEHFSSRRFETIVSRRSLCFAFVTTEEEEDDDSNDFDLETSGMYFLA

SEQ ID NO: 178229 - protein, 44 aa, Glycine max
  Coding DNA Sequence Number=SeqID_61451
MKIFMSLFQRWNGCRQWKLRGGKVYVATDDTVQSCIAKTSSEIG

SEQ ID NO: 178230 - protein, 157 aa, Glycine max
  Coding DNA Sequence Number=SeqID_61452
MRLVGILLCASAMYLEIKGALIGIIFWIGTVNFHFMSDGKNFAMWTWWSDMFDMGWFIVCGNWMRGWNCEIMGYSVWSRTLHNNKDDDLKNQRMSSRCSRLNQEHFNVQRENLISRIKNQVSRFKFQESRSRFKTQDSRIKRRLNQDKYEKVFSKTE

SEQ ID NO: 178231 - protein, 189 aa, Glycine max
  Coding DNA Sequence Number=SeqID_61453
MSGHRVRHRGSCSFTSALDFYLALYSNSSILGQDVRTLYPTSWILQLHFCTCLLSCIVQQLQYSRAGCQDIVSDIVDPATSILHLTFYLAFFAHYHVHDRLLIQIPLNVLVSRQGYILCGTSRGYIYWVVVTENKRGYISCGLVQVEGTSTWLFKENKGGYIPCGSLLVKDFTRLKRNLNDCKSLGDWM

SEQ ID NO: 178232 - protein, 76 aa, Glycine max
  Coding DNA Sequence Number=SeqID_61454
MGDGNGHHGHGHGHNNFRNKVWRMSDGPYCRPKHWKHNTSIATVCIVLIYIPIVMKSAKLELNMSKIAEDNATISY

SEQ ID NO: 178233 - protein, 231 aa, Glycine max
  Coding DNA Sequence Number=SeqID_61455
  Homolog annotation: Hit_ID=Q8LKR1; Match level="QueryCoverage=29%, HitCoverage=49%, E-value=1e-16, Identity=59%"; Hit description=Actin- related protein 5
YLEHTLSHTYVVGAIDEMDIDGTADINDENSDKTKGKCKFYVGSQSLGYRRDHMEVLSPLKNGVVVDWNIVDNIWDHALSPIVNVTGHALDKDSSTFDSNIIIKKEEKELHGTSESSGSSKLLLELHEKRSDNPEKIEAEKALLLFLCGFVVIKDFPGSGSEVSAEMAAAALYVADKQRFAYTIRAVQGAFDHKFNFPCAYGIVGHLEVPKPTFYSTLCNVYWTLSSWIPN

SEQ ID NO: 178234 - protein, 479 aa, Glycine max
  Coding DNA Sequence Number=SeqID_61456
  Gene Ontology: Mol. function=peptidase activity; Cellular component =cellulose and pectin-containing cell wall; Biological process =proteolysis
  Homolog annotation: Hit_ID=Q6XBF8; Match level="QueryCoverage=91%, HitCoverage=100%, E-value=6e-82, Identity=41%"; Hit description=CDR1
  Pfam annotation: Domain name=Asp; Domain location=133-474; Score= -62.4; E_value=6.3e-10; Accession=PF00026.14; Description=Eukaryotic aspartyl protease
MVDLAPIRHEDITKCKTQRSIKDTVQRAPRLSFTSLNLHFLKMHPLVFMVFMLLALYSPSSISTREAGEGLRGFSIDLIHRDSPLSPFYDPSLTPSERITNAAFRSSSRLNRVSHFLDENNLPESLLIPENGEYLMTLYIGTPPVERLAIADTGSDLIWVQCSPCQNCFPQDTPLFEPLKSSTFKAATCDSQPCTSVPPSQRQCGKVGQCIYSYSYGDKSFTVGVVGTETLSFGSTGDAQTVSFPSSIFGCGVYNNFTFHTSDKVTGLVGLGGGPLSLVSQLGPQIGYKFSYCLLPFSSNSTSKLKFGSEAIVTTNGVVSTPLIIKPLFPSFYFLNLEAVTIGQKVVPTGRTDGNIIIDSGTVLTYLEQTFYNNFVASLQEVLSVESAQDLPFPFKFCFPYRDMTIPVIAFQFTGASVALQPKNLLIKLQDRNMLCLAVVPSSLSGISIFGNVAQFDFQVVYDLEGKKVSFAPTDCTKV

SEQ ID NO: 178235 - protein, 423 aa, Glycine max
  Coding DNA Sequence Number=SeqID_61457
  Gene Ontology: Mol. function=pepsin A activity; Cellular component =anchored to membrane; Biological process=proteolysis
  Homolog annotation: Hit_ID=Q6XBF8; Match level="QueryCoverage=98%, HitCoverage=95%, E-value=4e-79, Identity=40%"; Hit description=CDR1
  Pfam annotation: Domain name=Asp; Domain location=88-412; Score= -103.9; E_value=1.8e-07; Accession=PF00026.14; Description=Eukaryotic aspartyl protease
MHPWVFMILALFSLSTLSSREAREGLRGFSVDLIHRDSPSSPFYNPSLTPSERIINAALRSMSRLQRVSHFLDENKLPESLLIPDKGEYLMRFYIGSPPVERLAMVDTGSSLIWLQCSPCHNCFPQETPLFEPLKSSTYKYATCDSQPCTLLQPSQRDCGKLGQCIYGIMYGDKSFSVGILGTETLSFGSTGGAQTVSFPNTIFGCGVDNNFTIYTSNKVMGIAGLGAGPLSLVSQLGAQIGHKFSYCLLPYDSTSTSKLKFGSEAIITTNGVVSTPLIIKPSLPTYYFLNLEAVTIGQKVVSTGQTDGNIVIDSGTPLTYLENTFYNNFVASLQETLGVKLLQDLPSPLKTCFPNRANLAIPDIAFQFTGASVALRPKNVLIPLTDSNILCLAVVPSSGIGISLFGSIAQYDFQVEYDLEGK

SEQ ID NO: 178236 - protein, 71 aa, Glycine max
  Coding DNA Sequence Number=SeqID_61458
EYKAESHPENLHALVVSPFVQEKLYTEERCFVPKEIVTTLANHEDLQSRPTILEDLKQLIRTDIEKKAKKE

SEQ ID NO: 178237 - protein, 70 aa, Glycine max
  Coding DNA Sequence Number=SeqID_61459
MGAKYLELVKRGSHPNNGWSLDETRCFFVQLLLRWSAPCFLTQILQGMAPIFLSNSLYGNSQARKQTDKQ

SEQ ID NO: 178238 - protein, 109 aa, Glycine max
  Coding DNA Sequence Number=SeqID_61460
  Homolog annotation: Hit_ID=Q8S8I2; Match level="QueryCoverage=59%, HitCoverage=30%, E-value=8e-08, Identity=43%"; Hit description =Protein ULTRAPETALA2
KYNLHVLKRDVVTSEAFKKHALREGSGRWKTNIWVHCEDEDKVPLWKTPLIKITCDDDEERLSLKASRGCSCSSTCQGCSTCYCEGCIKCRFEDCNCQECRDFMLYAKP

SEQ ID NO: 178239 - protein, 45 aa, Glycine max
  Coding DNA Sequence Number=SeqID_61461
MMAHHRYNIETSNGENARNWVVNGVLKFHKDPTVNESEIVIFLRQ

SEQ ID NO: 178240 - protein, 107 aa, Glycine max
  Coding DNA Sequence Number=SeqID_61462
  Gene Ontology: Mol. function=choline kinase activity
  Homolog annotation: Hit_ID=Q42810; Match level="QueryCoverage=76%, HitCoverage=22%, E-value=9e-41, Identity=95%"; Hit description=GmCK2p
MKCNSSESHSCLKFIVATGNSLHTGNKPSNAKVNQLVKAAEKYTLANHLFWGLWGLISSYVNKIDFDYKEYGRQRFQQYWIRKPTLLDSPSIVSLDETVNGLLSSFT

SEQ ID NO: 178241 - protein, 219 aa, Glycine max
  Coding DNA Sequence Number=SeqID_61463
  Gene Ontology: Mol. function=boron transporter activity; Cellular component=integral to membrane; Biological process=response to boron
  Homolog annotation: Hit_ID=Q9SV84; Match level="QueryCoverage=99%, HitCoverage=71%, E-value=1e-92, Identity=76%"; Hit description =Probable aquaporin NIP5.1
  Pfam annotation: Domain name=MIP; Domain location=3-204; Score=147.8; E_value=2.8e-41; Accession=PF00230.10; Description=Major intrinsic protein
VGAEFVGTFILIFAATAGPIVNNKYNGVESLMGNAACAGLTVMFIILSIGHISGAHLNPSLTIAFAAFRHFPWTHVPAYIAAQVSASICACYALKGVYHPFLSGGVTVPTVSVAQAFATEFIITFILLFVVTAVATDTRAVGELAGIAVGATVLLNILISGPTSGGSMNPVRTLGPAVAAGNYKHIWIYLVAPTLGALAGAGVYTLVKLRDEEAEPPRQ

SEQ ID NO: 178242 - protein, 78 aa, Glycine max
  Coding DNA Sequence Number=SeqID_61464
MKQEGRSLTCADLNFNNDGMHQSQRIGNLSTDNLTCLYQMVKEKGQHEGGEDNKYEVVNDHKHQIRDEGNVEKERAWY

SEQ ID NO: 178243 - protein, 79 aa, Glycine max
  Coding DNA Sequence Number=SeqID_61465
MAFMMEAMLGMRQLMEKNMATAAAVSSTAEADPTLLASVHHPPPNTIGRMSQPPLRKTGKDVVYELYVKGLGVVFTHGE

SEQ ID NO: 178244 - protein, 93 aa, Glycine max
  Coding DNA Sequence Number=SeqID_61466
MGSCQCHKGNIVFSLNGNGYLKRENLWGRKKKKKKIGVFDEEPKTRIFAKNMKGCCEWLKKRTKASGTTSASLSDFQPEEYSEQKHLTGSLWN

SEQ ID NO: 178245 - protein, 460 aa, Glycine max
  Coding DNA Sequence Number=SeqID_61467
  Homolog annotation: Hit_ID=Q1SHI2; Match level="QueryCoverage=31%, HitCoverage=33%, E-value=3e-24, Identity=38%"; Hit description=AAA ATPase
  Pfam annotation: Domain name=Collagen; Domain location=77-134; Score=- 40.5; E_value=0.04; Accession=PF01391.8; Description=Collagen triple helix repeat (20 copies)
DGMRQAAKTDVATGEVTSLGLGKSLKCRGTSSVTVSGDDAIIGGPMSLRGMGGMIMGLGSMGGGTGGIIIGPSSVTVSGSMGGIIIGGPMGPMGPMGLVGLVGLGGIIIGGPMGPMGPMGLLGGMGMGSITGAGFMGGINTIEAPFTSCEVLGLVGVVLSGAAAPCSSKQLSIESKRQRANTFGRCNACSSLPLLHVSATCQVHCFTKFLNIGDSYASGWLLSIGLVASPILTTSSTGLVAALPTPASSAEFVTLSMPVLSAITAPKTIIGRSFSLSLSAGLALSIPSCEFPLKELHVHRHRVKARRMRERHQAPLTGVGVHVQLDILFSSLLDLVSDRENVLEDECVSRSVGPGEPGAEEGVMNGVVRVEVEEDVGGIGAGEEVRVIRIFNGGKRIEVGEDFSVETIVQRVKIIARDFEGLVKVETVFEAKEPLVKDVKCRVVVAGYKQAGERTLYEKE

SEQ ID NO: 178246 - protein, 195 aa, Glycine max
  Coding DNA Sequence Number=SeqID_61468
MVYFLSFAHYKGCITDRMQPSLATRRLSFTSASQVRALKEPKIEPPQCVKHIKHFAKNLSSLKQQTGKGEWRCVKTDRQLVGLPTGWSDVTKDVLYLTMFMCSMSSLGLLNPDPLCMFSLILIKHRSQIPLIGLNLTKTALRQTYQKLSYRTPISRALFTSNTPWEEPTEDLALHSREASFTTMEREDEKLKKYK

SEQ ID NO: 178247 - protein, 814 aa, Glycine max
  Coding DNA Sequence Number=SeqID_61469
  Gene Ontology: Mol. function=protein-tyrosine kinase activity; Biological process=protein amino acid phosphorylation
  Homolog annotation: Hit_ID=Q1RSI5; Match level="QueryCoverage=39%, HitCoverage=31%, E-value=6e-44, Identity=34%"; Hit description =Octicosapeptide/Phox/Bem1p; Protein kinase
  Pfam annotation: Domain name=PB1; Domain location=175-262; Score =104.1; E_value=4.2e-28; Accession=PF00564.15; Description=PB1 domain
MEARHDEYHQPGSQSVMQDHLDSTHSSRRPADLNTSEVKPVLNYSIQTGEEFALEFMRDRVNIRKPVLSNVSDSNYTPGYMELKGILGISHAGSESGSDISMLSIVDKYPKEFDRMNTSLPGDRSNYGSIQSMPRTSLNQDNRQFVPGYGSFGVYDRSMMMKFLCSFGGRILPRPCDGKLRYVGGQTRILRIRKDISWQELMQKALQIYNQVHAIKYQLPGEDLDALVSVSSDEDLQNMMEECNHLLDREGSQKLRMFLFSMSDLEDAQFGLSSIGDDSEIQYVAAVNGMDLESRKNTTMFGVSFSANDINELDRQSIDRETSRVGVESIAQSAPLTNNFDSSLATHSSPPVLPTSSNSYDAYPQFYGDQMMHHGEPSDQYTINHGLNPSHKPVIGETPIIMPPHMLFNQQGILGESLQPRGIQVQNSEIPGTLANNLVDSSIQQGSDPGKVLVSELPSTAPAQLLNNGYMKNNFPEASVVVTAPEGHSLHPTKMDKLQDYEVTSSTSSSAFGAAYVDSRSNAADLSSLHPPPLPKRVYYSERIPREQLELLNRSSKSDDTHSSQFHVSDLLSDINPPDSVTESGDKLHGGNLPNLSEELGIAENHLHADDYAVDNVAVNHQIYKQLPDASSQMKSKLTEHVNPELKQVLLDNGGCKDLLNKDDAVGLETEIYSKNNYIKPLVDETKASKPDLPNLRQVSSDKLLDDPASNLPEVDWGDTSVKESNEDINVQALPVSINGNTTTEDYSEEFPSNVVSKQVQADILIDINDRFPREFFTDMFSKAVLEEDPSSLHPLTSDGVGLSVNMENREPIR

SEQ ID NO: 178248 - protein, 239 aa, Glycine max
  Coding DNA Sequence Number=SeqID_61470
  Gene Ontology: Mol. function=protein-tyrosine kinase activity; Cellular component=membrane; Biological process=protein amino acid phosphorylation
  Homolog annotation: Hit_ID=Q5XTZ4; Match level="QueryCoverage=98%, HitCoverage=73%, E-value=1e-108, Identity=81%"; Hit description=Salt- inducible protein kinase
  Pfam annotation: Domain name=Pkinase; Domain location=20-239; Score =124.2; E_value=3.7e-34; Accession=PF00069.15; Description=Protein kinase domain
  Pfam annotation: Domain name=Pkinase_Tyr; Domain location=20-238; Score=133.7; E_value=5.2e-37; Accession=PF07714.7; Description =Protein tyrosine kinase
  Pfam module annotation: Pfam domain module=Pkinase::Pkinase_Tyr; Domain location=20-239::20-238
MHFMNNSISFLVVVIMNDDLEELKELGSGTFGTVYHGKWRGTDVAIKRIKKICFTGRSSEQERLTVEFWREAEILSKLHHPNVVAFYGVVQDGPGGTMATVAEYMVDGSLRHVLLRKDRYLDRRKRLIIAMDAAFGMEYLHSKNIVHFDLKCDNLLVNLKDPMRPICKVGDFGLSKIKRNTLVSGGVRGTLPWMAPELLNGSSNKVSEKVDVFSFGIVLWEILTGEEPYANMHYGAIIG

SEQ ID NO: 178249 - protein, 71 aa, Glycine max
  Coding DNA Sequence Number=SeqID_61471
  Gene Ontology: Mol. function=protein serine/threonine kinase activity; Cellular component=membrane; Biological process=protein amino acid phosphorylation
  Homolog annotation: Hit_ID=Q5XTZ4; Match level="QueryCoverage=81%, HitCoverage=18%, E-value=2e-13, Identity=59%"; Hit description=Salt -inducible protein kinase
MTRICQSKKGGIVNNTLRPTIPDHCDSEWRTLMEQCWAPNPAARPSFTEIASRLRLMSAAASQTKTLKPTK

SEQ ID NO: 178250 - protein, 120 aa, Glycine max
  Coding DNA Sequence Number=SeqID_61472
  Homolog annotation: Hit_ID=Q6L3I5; Match level="QueryCoverage=57%, HitCoverage=5%, E-value=2e-08, Identity=48%"; Hit description =Leucine Rich Repeat family protein
  Pfam annotation: Domain name=LRR_1; Domain location=60-85; Score=2.7; E_value=88; Accession=PF00560.23; Description=Leucine Rich Repeat
  Pfam annotation: Domain name=LRR_1; Domain location=87-109; Score =15.4; E_value=0.21; Accession=PF00560.23; Description=Leucine Rich Repeat
  Pfam module annotation: Pfam domain module=LRR_1::LRR_1; Domain location=60-85::87-109
MAILECSNSFHFLNGVYMVLLFCLGIVVLVNSHMLSGNSVKLYQLNLSGALAPSIYNLPKLLELNLSKYFISGPIPNVPEELGNLVSLEELVIYSNNLTGRIPSSIGKCSVSGKCTGSHK

SEQ ID NO: 178251 - protein, 1261 aa, Glycine max
  Coding DNA Sequence Number=SeqID_61473
  Gene Ontology: Mol. function=protein-tyrosine kinase activity; Biological process=protein amino acid phosphorylation
  Homolog annotation: Hit_ID=Q5XTZ4; Match level="QueryCoverage=22%, HitCoverage=87%, E-value=1e-131, Identity=81%"; Hit description=Salt- inducible protein kinase
  Pfam annotation: Domain name=PB1; Domain location=182-269; Score =100.1; E_value=6.4e-27; Accession=PF00564.15; Description=PB1 domain
  Pfam annotation: Domain name=Pkinase; Domain location=979-1242; Score= 195.2; E_value=1.6e-55; Accession=PF00069.15; Description=Protein kinase domain
  Pfam annotation: Domain name=Pkinase_Tyr; Domain location=979-1242; Score=249.6; E_value=6.3e-72; Accession=PF07714.7; Description =Protein tyrosine kinase
  Pfam module annotation: Pfam domain module=PB1::Pkinase::Pkinase_Tyr; Domain location=182-269::979-1242::979-1242
MQKHQYNSMEPNNEEFHSAPQLVPQDLRDGMHINARPPAFNMAENKPVLNYSIQTGEEFALEFMRDRVNLRKPAFPNVVGDPNYSTGYMELKGILGHPGSESGSDISVLTKVEKGPKEFDRRNSSQHQDRSNYGSARSIPRTSSNQDSYRVLHGTASSSVSESTPMKMKVLCSFGGRILPRPGDGKLRYVGGETRIISIRRDIRFHELMLKTLSIYNETHVIKYQLPGEDLDALVSVSSDEDLRNMMEECHDLQGGRGSNKLRIFLFSLNDLDDTQFGIGSMDGDSEIQYVVAVNGMDMGSRNNSILCGESGSTHNLHELNEQNNERETNRVLMDTFGVSGSSLTDNVKPSLTIQSSQPVLPISSNAYETHPLFYDDPVIRHGEASQYPLQHGLGPSNNSAHNIQEIPVSMPTHGHVDQGIMNDGQASSELQVQISAMPETLVKRKGDNFIHTDNDPGKVFPLEATYPIPSQPFEGNLHANLSEASATTAISEGLHPALPSKNKGKHQQSEDASSLFSSMNPTQTPKSVEDDFFTTSNDAFSRAHVDAESNVIDFSYLEPPPLPNRVYYSERIPREQADLLNRSTKSDDAHGSHLLMSDLLSDFSQKNSITESSDILHSGNMSNLNMMSSSAAKPLQADGHTINDVLPQTYKQLPDTTSKVNSKLLQHVNSESKQVLEDNKVSRNEDQVLSSENRTKGAEHLAFHRVPSVEHNQNLTSKLPDLNLSEVSTRESDNDTKVQSQTFPLTGNTGQDVSQEFPPEAKSRPTQGDILIDIEDRFPRDFLYDMFSKAIISEDSSSIGPLPTDRAGLSLNMGNHEPKRWSYFQNLAKEGFDNVSLIDQDNLGFSSAVRKVQEGDSKSQPSAPLPAAGVLAGHTESHLNVGEESQKNVPVATKTEATIFHQKYEHSQLKGNENKNMDAVMENIQPQESEYQDGKDEPRNVVVAGEFDTSTVQVKVFSGRILILPCLTTLMFIKNEDLEELRELGSGTFGTVYHGKWRGSDVAIKRIKKSCFAGRSSEQERLTIEFWREADILSKLHHPNVVAFYGVVQDGPGATLATVAEYMVDGSLRNVLLRKDRYLDRRKRLIIAMDAAFGMEYLHSKNIVHFDLKCDNLLVNLKDPMRPICKVGDFGLSKIKRNTLVSGGVRGTLPWMAPELLNGSSNKVSEKVDVFSFGIVLWEILTGDEPYANMHYGAIIGGIVNNTLRPTIPSYCDLDWKTLMEQCWAPNPAVRPSFTEIARRLRVMSAAASQIKGQGHKASK

SEQ ID NO: 178252 - protein, 73 aa, Glycine max
  Coding DNA Sequence Number=SeqID_61474
MREFRFKFPIFKSAKLQVGIEQENKVKIKLRVENKDHLPKLDGRRAREHLVKLERRRKIWSPLSPKSSAKWKN

SEQ ID NO: 178253 - protein, 159 aa, Glycine max
  Coding DNA Sequence Number=SeqID_61475
MELPQERASVVRLKLSISPSKIIPLESYTTTKACRCRKFVDGLRFKVQREIVPMAIREFPTLVKKVKIVEHLECSNWVVKTRGDGSSGSKKGNHQKKPYSRPQQHHGGSTVPQVGKQGEVLRLWWTTLCLSMYSKGGQSAKSSNTLPSFYEDYTFWGCS

SEQ ID NO: 178254 - protein, 99 aa, Glycine max
  Coding DNA Sequence Number=SeqID_61476
MDRDTLGCIGWRGSKNLGELASGDYPIFVEFDERRTHPCNHHVEASFMMMNQEILIMPKAQVIDSRLIQDFKIKHQESNPRYKIQEKESRSNKSRLHIG

SEQ ID NO: 178255 - protein, 74 aa, Glycine max
  Coding DNA Sequence Number=SeqID_61477
  Gene Ontology: Mol. function=boron transporter activity; Cellular component=integral to membrane; Biological process=response to boron
  Homolog annotation: Hit_ID=Q9SV84; Match level="QueryCoverage=98%, HitCoverage=25%, E-value=6e-10, Identity=46%"; Hit description =Probable aquaporin NIP5.1
MPESEIGTPTAASVPATPDTPGGPLFTSLRVDSLSHERESFSMAGCKCLPTKGHSCFTDFSVGVPLPNVSLTQK

SEQ ID NO: 178256 - protein, 108 aa, Glycine max
  Coding DNA Sequence Number=SeqID_61478
MKRLMGDDDDRSGWGVSVVVEVGMESEKTCDKGCDATWKLEKREKLAWVEGGGRRKTKVAGNGNGGEVRMDYNNNEVVLIREKVKDDVGRGRDDEVVVVGNCDTVDEK

SEQ ID NO: 178257 - protein, 240 aa, Glycine max
  Coding DNA Sequence Number=SeqID_61479
  Subcellular localization annotation: CTP_CleavageSite=31; ConfidenceScore=5.66e-01
MALPNVFPNLQISPHFLAPPPFSLGFSRTFPAATRVRRRAFREWREYEEAVKRKDLAGALRFLKSLESEQPLVNGGSPSSESTRLRFGELERFGPQRDWEVLDTCLNADDMKLVANAYRFLRDRGFLPNFGKCRNIVLEGPRKVTPDVLSSSTGLEVTKLAPKKWGLSDGSSIVLVAFLGGVSFLISQGIDLRPNLAVILGLAAADAILLGGTCLAQISSYWPPYRRRILVHEAGHLLTG

SEQ ID NO: 178258 - protein, 96 aa, Glycine max
  Coding DNA Sequence Number=SeqID_61480
  Homolog annotation: Hit_ID=Q4C9W0; Match level="QueryCoverage=90%, HitCoverage=38%, E-value=5e-07, Identity=37%"; Hit description =Hypothetical protein precursor
MVLFAGIAAEALVYGEAEGGENDENLFRGICLLLDPPLSTAEMSNQARWAVLQSYNLLKWHRAAHRAAVKALESGDSLSVVIRSIEETMVLAMYLK

SEQ ID NO: 178259 - protein, 183 aa, Glycine max
  Coding DNA Sequence Number=SeqID_61481
  Gene Ontology: Mol. function=ligase activity; Cellular component=cell cortex; Biological process=ubiquitin-dependent protein catabolic process
  Homolog annotation: Hit_ID=Q1SNR8; Match level="QueryCoverage=84%, HitCoverage=83%, E-value=2e-30, Identity=44%"; Hit description=SKP1 component
  Pfam annotation: Domain name=Skp1; Domain location=99-177; Score =104.2; E_value=3.9e-28; Accession=PF01466.9; Description=Skp1 family, dimerisation domain
  Pfam annotation: Domain name=Skp1_POZ; Domain location=41-99; Score =36.1; E_value=1.3e-07; Accession=PF03931.5; Description=Skp1 family, tetramerisation domain
  Pfam module annotation: Pfam domain module=Skp1::Skp1_POZ; Domain location=99-177::41-99
MGEKGESSKSAMLKHAEEEELNTKRLKTVEGEESNMVEETENIKLKTSDEIIFEVEPSIVKEMVTIQTFIEDNNNETSIPIPLPNVTSNTLRRILEFKARGFDEEFVKTLGMDEVFELILAANYLNMKTLLDILTKIIADFIKNKSVEFVRKFFNIVNDFTPEEEAKIREENAWAFEGFECDD

SEQ ID NO: 178260 - protein, 591 aa, Glycine max
  Coding DNA Sequence Number=SeqID_61482
  Gene Ontology: Mol. function=ATP-dependent helicase activity; Cellular component=nucleolus; Biological process=rRNA processing
  Homolog annotation: Hit_ID=Q1SNS2; Match level="QueryCoverage=88%, HitCoverage=98%, E-value=0.0, Identity=68%"; Hit description =Helicase, C-terminal
  Pfam annotation: Domain name=DEAD; Domain location=93-262; Score =213.2; E_value=5.9e-61; Accession=PF00270.19; Description=DEADDEAH box helicase
  Pfam annotation: Domain name=Helicase_C; Domain location=332-408; Score=115.6; E_value=1.4e-31; Accession=PF00271.21; Description =Helicase conserved C-terminal domain
  Pfam annotation: Domain name=ResIII; Domain location=89-257; Score= -20.5; E_value=0.0024; Accession=PF04851.6; Description=Type III restriction enzyme, res subunit
  Pfam module annotation: Pfam domain module=DEAD::Helicase_C::ResIII; Domain location=93-262::332-408::89-257
  Subcellular localization annotation: CTP_CleavageSite=59; ConfidenceScore=5.47e-01
MDQSQLLHDPNFPLFKTPRKTPSSPAVTTTATSKPPSTAANPTSDGERIEDHPDETATVADTDTDADAETFGDLGLAEWAVKTCRELGMRRPRGVQRRCIPRVLEGRHVLGVDETGSGKTAAFALPILHRLAEHPFGVFALVVTPTRELAFQLAEQFRALGSAVHLRITVVVGGMDMLRQAKELAARPHLVIATPGRIHALLRNNPDIPPVFSRTKFLVLDEADRVLDVGFQEELRFIFQCLPENRQNLFFSATTTSNLQKLRGRYQDKMYVYEAYEGFKTVETLKQQAIFIPKKVKDVYLMHILDKMEDMGIRSAIVFISTCRDCHRLSLMLEVLDQEAAALYSFKSQAQRLEALHQFKSGKVSILLATDVASRGLDIPTVDLVINYDVPRFPRDYIHRVGRTARAGRGGLALSLVTQNDVDLIHEIEALIEKQLEMIEYKENDALSLMKKVFSAKNVAEMKMIDDGFEEKAKERKKQKLKMLEEKGLLTKRSKKRKRNKEFAEEGKEQKKEVLTARNVAEMKMMDEGGIEEKAEEGGKQKLRTEKGLSKKKKSKERRKESAEEGKKQRKEEVEPLADIATPKKRSKKRQ

SEQ ID NO: 178261 - protein, 102 aa, Glycine max
  Coding DNA Sequence Number=SeqID_61483
MLEPRGTVREMIPGFNGKEGYWWLVNAEQYFENRLPEEMELSLVCAFAIRGKALKWWVSWKESNHNATRWTFEKAVLKQIQPELGHFSRPTTTNGLILGHFS

SEQ ID NO: 178262 - protein, 108 aa, Glycine max
  Coding DNA Sequence Number=SeqID_61484
  Gene Ontology: Mol. function=metal ion binding; Biological process =electron transport
  Homolog annotation: Hit_ID=Q8H016; Match level="QueryCoverage=77%, HitCoverage=9%, E-value=8e-26, Identity=65%"; Hit description =Probable lipoxygenase 6
MAELGVEKLLDIFPDTLQLIRISVYLPCETPIGVKELREKELKQLRGDGWGLRVSSDRIYDYDVYNDLGDSDKGDRFARPTLGGQHNPYPTRCRTGRPPSTVGQFHSS

SEQ ID NO: 178263 - protein, 336 aa, Glycine max
  Coding DNA Sequence Number=SeqID_61485
MAVVMRTSKSTMTQSTTSHAPGRLLLRRKQGLEDPYHGVTTIHIDYEPSIHVEHFSDINELEKVGLKLNETLLFYGVRLFFNEPQTIYPELIRMFWRNAEFLIIKATVSKVLGVQAYDSYVTRALYKENAEKDQGDYHVFDKMDEDSKHIITIKGFVVAKQQKFSKTNLKAMKEAINRRKPKRLVKAIANEDKNLRSFGIPRKVEVNKTTQKLRDLSETEDEGDDTPVALRKMKSTIKKKPSPTPKRDKVTRQPIIPFEVPKRVKIRVTKANPKIVEKEWIPPSPPSSSSNENNDDPISQVQTSPPTTTKQHLPLYPIHLERFTLYWKKKTPLANA

SEQ ID NO: 178264 - protein, 134 aa, Glycine max
  Coding DNA Sequence Number=SeqID_61486
MACCRLRHRALARSHHHRHNKGKEEENEQVTSELGLFSECTKGNVRVVNTKSNNRGQWPQIISCNLPFLVLMEYWQVVSDGIPVGEANMTMTDAQKTEIEGLRLKDLKVKNYLFQVIDRPIFETILCKDTSKDI

SEQ ID NO: 178265 - protein, 336 aa, Glycine max
  Coding DNA Sequence Number=SeqID_61487
  Gene Ontology: Mol. function=nucleic acid binding; Cellular component= beta-galactosidase complex; Biological process=DNA integration
  Homolog annotation: Hit_ID=Q1T693; Match level="QueryCoverage=79%, HitCoverage=19%, E-value=1e-92, Identity=59%"; Hit description =Integrase, catalytic region; Zinc finger, CCHC-type; Peptidase aspartic, catalytic
MDAEIAAIKKNNTWELMELPKGQKTIGVKWIYKTKLKENGEVEKFKARLVAKGYKQEFGIDYKEVFASVARHNTIRLVIALAAQKSWPIFQLDGKSAFLHENLEEQVFVDQPLGYIKIRNDHKVYKLRKFLYGLKQAPQAWYSHIEAYFLREGFLKCPYEHTLFVKITNGGKMLIVCVYVDDLIFTGNDVAMFDKFKKSMMIKFDMTDLGMLHYFLGIEVVQSADGIFISQKKYVQEILDRFQMTNCNSVNTPVEYGLKLTKDHGGKKVKVWCQVLLCGGSWSTGVNLPNVYSPRISPNNWYQNRWFYLDWLRRRGRPLNLTMWKRLTLEGEIVGV

SEQ ID NO: 178266 - protein, 294 aa, Glycine max
  Coding DNA Sequence Number=SeqID_61488
  Gene Ontology: Mol. function=DNA binding; Biological process=DNA integration
MTIVNKMQIHGDNTEDTIVVEKILRSLTTKFNFVACAIEEAHDIEELSLDQLQSSLLVQEKKINQQETKEKALKVSIKNHPTSKGKRGYGHYQSECWTNMNKDNGERTNFAEKEKEQEVSFLMVCHVKEETQQNLWYLDTGCSNHMCGDKEVFSELDETFRNTVKFGNNSTISVLGKGMVTLHAKENSTHNISNVLFVPDLKTILLSVGQLQEKGYEISMKDDVCQIRDEKLDLIAQVNMTPNRMFPLYLHSTSHSCFSTKLKDYAWLWHFRYGHLNFGGLKTLWQKNMVTGLP

SEQ ID NO: 178267 - protein, 180 aa, Glycine max
  Coding DNA Sequence Number=SeqID_61489
MGENEDDFIINGILDIYNIDMWNIKVDEVKRLEFAYLETAYTYFIVDGDVAMKNVIRRACRDCLTIRLRLQAKVDRDVQMLTKWKLAKVVSDLDRNHNQPHSVVTWEALELDAYKCNVDATFWSQGGGGGYIGGGEDSGRGVGSIEARIKDKRGGSMAGGGGWTIVGATTTPDINKGSFI

SEQ ID NO: 178268 - protein, 133 aa, Glycine max
  Coding DNA Sequence Number=SeqID_61490
  Gene Ontology: Mol. function=phosphoglycerate kinase activity; Biological process=glycolysis
  Homolog annotation: Hit_ID=Q9LKJ2; Match level="QueryCoverage=47%, HitCoverage=15%, E-value=5e-28, Identity=95%"; Hit description =Cytosolic phosphoglycerate kinase
MARKDHFSTITSQVLDGGNSSTDSSVIGDVKVVIQRHVQIDPHEYPLPLQITLLQRSHAPLSRHLFANLRKPKSKNEKGIRTQMRKRRKDSNFGGDTHNNANGFGGNIGVVWQLARDQVRGVKKRSRKIYRER

SEQ ID NO: 178269 - protein, 57 aa, Glycine max
  Coding DNA Sequence Number=SeqID_61491
MNNKHSLDELRRWQFMRLQEWHASHRGDGRITERLVLMGCVIRDLILAVVVQREAFC

SEQ ID NO: 178270 - protein, 381 aa, Glycine max
  Coding DNA Sequence Number=SeqID_61492
  Gene Ontology: Mol. function=DNA binding; Cellular component=nucleus; Biological process=regulation of transcription, DNA-dependent
  Homolog annotation: Hit_ID=Q6R0A6; Match level="QueryCoverage=87%, HitCoverage=98%, E-value=1e-66, Identity=45%"; Hit description=MYB transcription factor
  Pfam annotation: Domain name=Myb_DNA-binding; Domain location=16-63; Score=49.9; E_value=8.5e-12; Accession=PF00249.21; Description=Myb -like DNA-binding domain
  Pfam annotation: Domain name=Myb_DNA-binding; Domain location=69-114; Score=45.2; E_value=2.2e-10; Accession=PF00249.21; Description=Myb -like DNA-binding domain
  Pfam module annotation: Pfam domain module=Myb_DNA-binding::Myb_DNA -binding; Domain location=16-63::69-114
MGKGRAPCCDKTQVKRGPWSPAEDLKLIAFIQKYGHENWRALPKQAGLLRCGKSCRLRWINYLRPDVKRGNFTPEEEETIIRLHKALGNKWSKIASGLPGRTDNEIKNVWNTHLKKRLAPKKVSESSADESKPESSITSSSSSSSESFFSNERPNSPKTTTPSNNEFNDQAEKLSVEDKMDKDSEKQLSNELVNITEDPKESSVSLSSVESNIVNTSQIVEHKPEEEQLASPLPYLGHYDVGSILEEVDKPNHLIEIPWEPDYDFWKLLDDDNSLGSFQSNEVQLGEFPAIQNIILGEEGVHDAEAKKWSHDFENEFGVVGGIKESSKDHFLPKNYAVEPEMDHTQAFDFDDIDMARPESELDFGYIQLWPSCPQNNNTSL

SEQ ID NO: 178271 - protein, 266 aa, Glycine max
  Coding DNA Sequence Number=SeqID_61493
  Homolog annotation: Hit_ID=Q1SKA6; Match level="QueryCoverage=11%, HitCoverage=3%, E-value=3e-07, Identity=83%"; Hit description =Rad21/Rec8 like protein, C-terminal; Rad21/Rec8 like protein, N- terminal
  Pfam annotation: Domain name=Rad21_Rec8; Domain location=177-213; Score=5.6; E_value=0.011; Accession=PF04824.7; Description=Conserved region of Rad21  Rec8 like protein
LLNLHASVIPKHKATVSQILPSSPHENIEIESLETNERLQNMFKYPLEAESQMGTDKNDENVAGYSVGAGHSVPVVVGLQNMFKYPLEAESQMGTDKNDENVAGYSVGAGHSVPVVVGLQNMFKYLLEVESQMGTDKNDENVSGYSVGVGHSVPVAAGVGDTNICGCIVQLYLDNILDRCLDFSEQVLKTTGYVDVEQNEAYGDIAISKLPKLDQTFLFDGRTILHVSVYGCIATTLFSKVLRIKDVNSVLKHIKAILWSWICIKG

SEQ ID NO: 178272 - protein, 180 aa, Glycine max
  Coding DNA Sequence Number=SeqID_61494
  Gene Ontology: Mol. function=molecular_function; Cellular component =cellular_component; Biological process=biological_process
  Homolog annotation: Hit_ID=Q09K05; Match level="QueryCoverage=98%, HitCoverage=59%, E-value=2e-57, Identity=64%"; Hit description=SM10
MHKLGRGHRDKLQQFITITGARYPLSCVVCVEFGWGWGGGRELGSIEKIALQALKASDWHLEGAFDFFYNQPQLKTFTDSRHLEELYNRYKDAYVDMILADGITVLCNDIQVDPQDIVMLVLSWHMKAGTMCEFSKKEFIEGLQSLGIDSLDKFREKIPYMRSELKDERMGNSIQTAAQN

SEQ ID NO: 178273 - protein, 57 aa, Glycine max
  Coding DNA Sequence Number=SeqID_61495
MTERHQILILFHPPKTFDFLALYKGADVTTIQYNTDKKEERNDEDYRGAMQNSYVNH

SEQ ID NO: 178274 - protein, 100 aa, Glycine max
  Coding DNA Sequence Number=SeqID_61496
VFGKPLVEILPPGQLRGFCPLLAWLGSAVLGYGPVLSFGLVGPLLPPVISFVARILPTLACAPLAKSVPRWWIIMDESKRQGLNLSGSCSRPLCHLQYPV

SEQ ID NO: 178275 - protein, 253 aa, Glycine max
  Coding DNA Sequence Number=SeqID_61497
MECLAFSNLIPTSHTSNVTLDRARLIYGIIMKMDMNVGYLISHQISLTAQHDTSRLGFPALITALCKARGVQSDSRSLESLSPAINLAYIKKNCWNLDEPTVTFRGPRKARDKRFEAFSTTPSEIGGPSSSTLPTSSYTEIPVIPPAPTQIPLPAPLSIGPTDFIFTPQMLHSMLQSIHRGQSIIMQSLQGLGLPSIMSMEEFDTRVAWPGDQPSSSGGGGASTAQEPVSEEPPAPAPSPTAAEEETTPAQTP

SEQ ID NO: 178276 - protein, 171 aa, Glycine max
  Coding DNA Sequence Number=SeqID_61498
  Gene Ontology: Mol. function=chitin binding; Cellular component =extracellular region; Biological process=chitin metabolic process
  Homolog annotation: Hit_ID=UPI000044A8F0; Match level="QueryCoverage =53%, HitCoverage=100%, E-value=2e-10, Identity=29%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVRTFRGLHVLAFRGLHVVTFRGLHVLPFRGIHALTFVGLHTLTLRGLRVLAFRGLHVLTFRGLHALAFIGLHALAFIGLHICAFKELKGSPPQDTQWTRRSPTGPWGFQLWLWASVSPTGCSSPQQGITPARHPVDPEKSNRGVPVAPNKVIRPPINRAFIKKYCTPQ

SEQ ID NO: 178277 - protein, 105 aa, Glycine max
  Coding DNA Sequence Number=SeqID_61499
LRIANETFSQSWPEDADIFREDAGISGEAADDDINADISGKGGVLRIANETFSQSLPKDADISWKDAGRLRVPTDSQVTIAKVGAVDKSEAFAPTYPQFVMRNSD

SEQ ID NO: 178278 - protein, 64 aa, Glycine max
  Coding DNA Sequence Number=SeqID_61500
MALARDFCIRNTKMCMYAIFDSQSALSMHHFLVKTNFPNVCLRKNGPEEACLKEVQEGQGGRRN

SEQ ID NO: 178279 - protein, 85 aa, Glycine max
  Coding DNA Sequence Number=SeqID_61501
DFYKVEKKSQGSQVAWGLDVGTSCCRTSIKTLGKLPGSHIINRTSKKVELRPQKETTPEYLAFHRFNKSRKVNETKSKNINEEET

SEQ ID NO: 178280 - protein, 115 aa, Glycine max
  Coding DNA Sequence Number=SeqID_61502
MSVPHSRSSATEKKLIVASFGIKNYDKGGASPIDSFTNYNVNMNNPQEQENFSIYANRTVGPPPILLTKALLKAHVQNAEAHFSHIHPDTSIWMPSELSSPRRAGYFTSKFPNGP

SEQ ID NO: 178281 - protein, 148 aa, Glycine max
  Coding DNA Sequence Number=SeqID_61503
  Subcellular localization annotation: CTP_CleavageSite=80; ConfidenceScore=5.25e-01
MTFQAADTSRLEESSKSKTGKSSTTTTACPAFQNGVGPSKPYVPPPMQQQQQQQQRQQATKAPSQPSLEELTVKNSKNVSAITMRSGKQIEVPPLAAAPAPAPEPVKLHSAPEKEDAIVAQKRKLPDQKGANKNFHASGPYSNNSDLQ

SEQ ID NO: 178282 - protein, 67 aa, Glycine max
  Coding DNA Sequence Number=SeqID_61504
MKANKTRNELKVSDSKTYRLKNEERTKNGEERQKIFTKLLTKTSRKRYGSTLAWIFFTETHFFTQNN

SEQ ID NO: 178283 - protein, 89 aa, Glycine max
  Coding DNA Sequence Number=SeqID_61505
MNENAIHGAPKKGREWRIALSNHYAWLQTRGWRMHERKRNSWGSEKRGREWRIALSNHYAWLQIRGWRTHERKCNSWGSEKGLENGELH

SEQ ID NO: 178284 - protein, 164 aa, Glycine max
  Coding DNA Sequence Number=SeqID_61506
  Gene Ontology: Mol. function=isomerase activity; Cellular component =intracellular; Biological process=proteolysis
  Homolog annotation: Hit_ID=Q1RTJ9; Match level="QueryCoverage=89%, HitCoverage=45%, E-value=1e-17, Identity=38%"; Hit description =Cyclin-like F-box; F-box protein interaction domain
MPGYHLVGSCNGLHCGVSEIPEGYRVCFWNKATRVISRESPTLSFSPGIGRRTMFGFGYDPSSDKYKVVAIALTMLSLDVSQKTEMKVYSAGDSSWRNLKGFPVLWTLPKVGGVYLSGTLNWVVIKGKETIHSEIVIIFVDLEKEACRSLFLPDDFCFVDTNQF

SEQ ID NO: 178285 - protein, 107 aa, Glycine max
  Coding DNA Sequence Number=SeqID_61507
MEKTQEERGEFRLLSEIKWGVKIRQSRSDIYSKLHLQRDMWRGQQKKGVPNNIVCAHNNFSEAFYILPLQRSFLLCLCVIVVTSSPSQSPLAPFRSSAPQQWFSAVK

SEQ ID NO: 178286 - protein, 56 aa, Glycine max
  Coding DNA Sequence Number=SeqID_61508
MAVQIDTRPTWALQNIPPEAEALPKRFRNVYREEFAKVSTVLRRTSFVLHRSSIFN

SEQ ID NO: 178287 - protein, 123 aa, Glycine max
  Coding DNA Sequence Number=SeqID_61509
  Subcellular localization annotation: CTP_CleavageSite=38; ConfidenceScore=5.06e-01
MPISPCGSISWIAPTRHPVVPEKSNRALGFLALVTGLCQSYRVPVPPARIAPARHPMDPEKSNRILGFSALITSLCQFYRVLVTPSKVIRPPINRAFIEKYCTPRQVQGEASQSGQRAHSHHL

SEQ ID NO: 178288 - protein, 165 aa, Glycine max
  Coding DNA Sequence Number=SeqID_61510
MLQSIHQGQIILLQSLQVVATPGSNPLVEQFREMIAWPRTQPSLHREDKGPTAQVPKHMEDESSEATILEPFVLGEEEGETQVRQVVAVTPERSLEATSEPPAPLVDLPSPQRTTNPSTPILEMPEDQTTLVLTMDTSPPATPVLHLTNEEDVQTQDTQDQSQEF

SEQ ID NO: 178289 - protein, 144 aa, Glycine max
  Coding DNA Sequence Number=SeqID_61511
MIYHTEFDEFKAELERRNWHKELTNFMDGSIDVAIVKEFYTNLYDLEDKSPKQVRVRGHLIKFDEDTLNTFLRTPMIIEKGENLPTYSRFYRLRQDPQELAARLCIPGKGFELNADGLPLKILQKNLTMLAQTWSVLSFSNLAP

SEQ ID NO: 178290 - protein, 106 aa, Glycine max
  Coding DNA Sequence Number=SeqID_61512
  Gene Ontology: Mol. function=RNA-directed DNA polymerase activity; Cellular component=intracellular; Biological process=RNA-dependent DNA replication
  Homolog annotation: Hit_ID=Q1SYR3; Match level="QueryCoverage=80%, HitCoverage=4%, E-value=3e-22, Identity=58%"; Hit description=RNase H, putative
MNLGVGEEKKEVKVGTGMTTLIRDELVALLRDYQDIFALSYQDMPSLNPNIVQHKLPLNPVAPRRRSKSNLTSASWQPLDIQNGLPTLSQFPRRMGKYEYAWTIRI

SEQ ID NO: 178291 - protein, 277 aa, Glycine max
  Coding DNA Sequence Number=SeqID_61513
MARREKYGHLSPLVKDSMSFDRDYCSLPLPTRDKRVHWHAETNYGHLPPLLSRDNKVRWHVEIIMRQTSPIARGEKLWSSATLSIQRQGSPIAREDKLWSSATLDIQRQVTPIACRDKLWSSATLAIQRQASPIACEDKLWSSATFANQRQVSPLACGDHHGHSFLIDFKTIEVSLAIQRQASQLARGDHHGHPVSLIELVAGRVERGILQPLGPPGPIRKLQSKATSSPGRAVLQPLMQSYPARALDRRLQVDWAKDAREDPRVLMSLKVDFGPMG

SEQ ID NO: 178292 - protein, 134 aa, Glycine max
  Coding DNA Sequence Number=SeqID_61514
MDKSLKVGEDEWMERETEEQNFEREKRDNELWFSPLIQDSPQSVFRCHEASSKCSLSQPTLRREGDAGLMGASSKGGRRAESPLMFIRGKRHKNQMCGLRTLSVKGSGVVFTHGEGCFPRSYVFLNYDEEIKLM

SEQ ID NO: 178293 - protein, 165 aa, Glycine max
  Coding DNA Sequence Number=SeqID_61515
  Gene Ontology: Mol. function=RNA-directed DNA polymerase activity; Biological process=RNA-dependent DNA replication
MGETHEIPYHNLADFEPCLGYATEGQVVGVPNVVTPPKFKVLDFDKYKGTTCPKNHLKMYCRKMGAYARDEKLLIHFFQESLTGAAATWYTNLEPSQVHSRKDLMVAFVRQYQYNSDVAPDRMQLHNMGKKGHESFKGYGSPTGAPNDGKGDDNSDSGHVTNVLL

SEQ ID NO: 178294 - protein, 84 aa, Glycine max
  Coding DNA Sequence Number=SeqID_61516
MMQFSQGGDPSPESWLEDSVDEEDPKAYKLYIEPHYVGGDDVILPRKGPITRVMARRLQEDWVRDSREDPRVLMSLMVDFRPMG

SEQ ID NO: 178295 - protein, 223 aa, Glycine max
  Coding DNA Sequence Number=SeqID_61517
  Gene Ontology: Mol. function=protein kinase activity; Cellular component=integral to membrane; Biological process=protein amino acid phosphorylation
  Homolog annotation: Hit_ID=Q69TY6; Match level="QueryCoverage=56%, HitCoverage=18%, E-value=4e-20, Identity=44%"; Hit description =Putative receptor protein kinase PERK1
MLQNCIDERNLLKGQKKPPRTSQSILEANELSATSVIFYFTPISVPLKTEPPVGIQRAATPPEDSPSPPPPPAPVEDGDSDSFKKLVIVGIVVGVTIPTTHSWSVSSEGVRYAIESLSVFKFEELQKATAFFGEENKIKGSVYRASFKGDYAAVKVLKGGVSGEINLLKRINHFNSIRLSGFCVYKGDTYLLYELAENDSLEDWLHSVNKKYENSVPLSWVQR

SEQ ID NO: 178296 - protein, 60 aa, Glycine max
  Coding DNA Sequence Number=SeqID_61518
MSHAVKDNRGKWAPNYEGPFVVKRAFFGGALGQDHLQLPSGVETEHEQQKPIKVHRNGCK

SEQ ID NO: 178297 - protein, 81 aa, Glycine max
  Coding DNA Sequence Number=SeqID_61519
MEILILGQGLWWFEVLAQKACRTAGHDVFQGVGLASGSGIKGMSHIYFHDTHTTMMIWKFYAKLIMHAPMWTLKHQVFMLM

SEQ ID NO: 178298 - protein, 197 aa, Glycine max
  Coding DNA Sequence Number=SeqID_61520
  Gene Ontology: Mol. function=N-acetyltransferase activity; Biological process=metabolic process
  Homolog annotation: Hit_ID=UPI00005F86ED; Match level="QueryCoverage =81%, HitCoverage=85%, E-value=1e-38, Identity=49%"; Hit description =COG1670: Acetyltransferases, including N-acetylases of ribosomal proteins
  Pfam annotation: Domain name=Acetyltransf_1; Domain location=66-146; Score=37.4; E_value=5e-08; Accession=PF00583.14; Description =Acetyltransferase (GNAT) family
MQLLTPRLSLSRLQPEDWQIFKAVHEDAATMTWVSEIPDENDIRQRFNERLAPWQPSSFHMLCLVARLRDSGEAIGLFGCSAEWHPYRQAEVGYMLRHACTGQGYGSEALQALCTFLLQADFHKLKALVIEGNWPSRRILEKNGFALEGTLRDNYRLNGQWAKKICRPPSTILLSARYVLVSVTAVTSVARTVRALT

SEQ ID NO: 178299 - protein, 114 aa, Glycine max
  Coding DNA Sequence Number=SeqID_61521
MENNGEGSDDGWVWTSLILMDFFAKAWVWLAPLTSGEMTLQTQDPKAIPVFTKVSPFNQVTPNDGYIEEASTPVVGNLLITSIWARLSIEEHIYDFLGCPFSQSLIIVRLQERI

SEQ ID NO: 178300 - protein, 210 aa, Glycine max
  Coding DNA Sequence Number=SeqID_61522
MIQSIIEVSLQGSDSIVNANTIEIDPGVAPIQPHPVTTKDEVDVDALLAQPISEVDIQRIKIIYGATEFVPLDAMKVRLEFKKRIDVVFAPQPPSNIFKVASTISEGQTCNQALKEKIDFGTQHLDPEMQKIELENLNMVKFWKEGMSGIDSFSYPTQEIFEKEEDRSKSRESFHTEDIYLEDPEESPNFVDWKFYDYGPHMQEKALGFS

SEQ ID NO: 178301 - protein, 148 aa, Glycine max
  Coding DNA Sequence Number=SeqID_61523
  Gene Ontology: Mol. function=dihydroneopterin triphosphate pyrophosphohydrolase activity; Cellular component=cytosol
  Homolog annotation: Hit_ID=Q9CA40; Match level="QueryCoverage=84%, HitCoverage=86%, E-value=2e-20, Identity=47%"; Hit description=Nudix hydrolase 1
  Pfam annotation: Domain name=NUDIX; Domain location=15-141; Score =0.3; E_value=0.091; Accession=PF00293.18; Description=NUDIX domain
MENKNNKSNDLKSEPWVVVIIFLLKIDRSSSVVAAMPSAMPPSPFKAARYMFYAITRLQFITYGESFEECAAREVKEETGLDIGNSVFESNKQCDVGAAKKSLKEQVPQNLEPTKCDDWDWYEWDHLSHPLFGPLEKMVKGAFDPFLI

SEQ ID NO: 178302 - protein, 124 aa, Glycine max
  Coding DNA Sequence Number=SeqID_61524
MEALGIPWIDVLQGSDNPKGAKHLSQGIGIKDHNHPRSKRFLKNHACDEFLGILRVYEVHFQNREHLQKKNYTAPSLKRKASKEKKVKTCLRLLNCRCENLLDQTTLMDPKMRRSLSCPESSNR

SEQ ID NO: 178303 - protein, 178 aa, Glycine max
  Coding DNA Sequence Number=SeqID_61525
MEEEKKEKMVKDDKQELVIEPTPEPVQPFCELIEEEEEDKKDEQRRETPINLTEKEINEKEKKEKEKEKDNEKNEKEKERKEETKKSTSELVREKRKEVASDEGKEVPYHLVPSKKDKERHLMRFLDIFRKLEINMPFGEALQQMPLYCKFQKDMLTRKNKYIHSENIVVEGNCSAVI

SEQ ID NO: 178304 - protein, 69 aa, Glycine max
  Coding DNA Sequence Number=SeqID_61526
MTLRLAHQWAKRTSTAKCNFGMLNALEESGKASISRSCAKHEISALSAVVVFSQAQCMIGAKLKSTYSC

SEQ ID NO: 178305 - protein, 121 aa, Glycine max
  Coding DNA Sequence Number=SeqID_61527
MGHRKRSSSMLVWFNVYFLMNKFKQLHKGYDLVDHEIFCVVTNEGGALISVVDFTIVCIQCGLLQLKNFFLALQTNMVHQTVVKEAKYDATEFGISKSTPNKLVIHSWLVALNDSPVWPKV

SEQ ID NO: 178306 - protein, 122 aa, Glycine max
  Coding DNA Sequence Number=SeqID_61528
MGSKKRKSIGTRPTLQYDTRRFHSFEAWTRYTDNVLGRHILPERKVEIYHTEQDEFKAELERRNFHKCLTNLVDNNIDLALVKEFYANLYSSEGPSPNQVRVRGHVVKIDADSLNTFLETPM

SEQ ID NO: 178307 - protein, 67 aa, Glycine max
  Coding DNA Sequence Number=SeqID_61529
MKPLSRSCRSCRASLAKLSNLSGIFEELVPLSVTFKSLVHILAANVQLSGRCPAKPILQKLNFCNFH

SEQ ID NO: 178308 - protein, 177 aa, Glycine max
  Coding DNA Sequence Number=SeqID_61530
  Gene Ontology: Mol. function=chitin binding; Cellular component =extracellular region; Biological process=chitin metabolic process
  Homolog annotation: Hit_ID=UPI000044A8F0; Match level="QueryCoverage =92%, HitCoverage=99%, E-value=6e-18, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MPSPSEDYMPSPSEGYTPSPLEDYTSLLSEDCKSSLLEDYTSSPSEDHTFSLSEGYTPSPSEDYTSSSLEDCMSSRAEGYTPSLLEDYTSSPSEDYRGPHILAFRGLHALTLRGLHILAFRGLQVLAFRGLHVFTYRGPQVFAFRGLYALTFRGPYALTFKGLHLLAFRGLHAITFR

SEQ ID NO: 178309 - protein, 56 aa, Glycine max
  Coding DNA Sequence Number=SeqID_61531
  Homolog annotation: Hit_ID=Q1SG79; Match level="QueryCoverage=71%, HitCoverage=10%, E-value=5e-07, Identity=53%"; Hit description=Zinc finger, CCHC-type; Peptidase aspartic, active site
MGRYDKWLGIQRMERYNLDGAKNWIREIEKIFGVIGCSKGQKVAFSTYILVEEAEY

SEQ ID NO: 178310 - protein, 76 aa, Glycine max
  Coding DNA Sequence Number=SeqID_61532
MSDELFVGGVESRKLKRKIEEASSTDVVDSEFVLSLGLGNNKMTGESSSNFLCKSLKGHKESPCFASKLVENTNNQ

SEQ ID NO: 178311 - protein, 71 aa, Glycine max
  Coding DNA Sequence Number=SeqID_61533
MKELINKTQLSPKIIPTSSRRLGGSTKESHFSYSTAVILLPRTKVRDHHSMMHAPDLNSQLQCSIIPKEIA

SEQ ID NO: 178312 - protein, 33 aa, Glycine max
  Coding DNA Sequence Number=SeqID_61534
MATDEAPRDAHADLEQPRHAMEACQAIAERLER

SEQ ID NO: 178313 - protein, 145 aa, Glycine max
  Coding DNA Sequence Number=SeqID_61535
MTNANCPLELLHSVSNGNLRGSFKACKKLIASPKDRLYDLEGKSVELVPVIYFSEYPYGANGVVIEIGCWIDHTGVCVCVCEEHKVDFKDNRSVDPEKYTFSLTGRKPISLEEKRKLGERYIPLLQTSIPEKKETLTSHFRVRVG

SEQ ID NO: 178314 - protein, 71 aa, Glycine max
  Coding DNA Sequence Number=SeqID_61536
MESNQASSKTSPLTPQTGSVDISGSLFLNRREDEGLGGEDTRPSRATLVALFSCGGFKVQAIGCHRFIVGV

SEQ ID NO: 178315 - protein, 38 aa, Glycine max
  Coding DNA Sequence Number=SeqID_61537
LRLKEPSILDEAAEPEVELEIDDLIPDRQPVLTEDRPN

SEQ ID NO: 178316 - protein, 410 aa, Glycine max
  Coding DNA Sequence Number=SeqID_61538
MGGTCKKDFDEQVSGALRCLCIYVWNDKNVPDRAMSATPTNCSKCHGELRATTIQPMTLPFRLCAECRSAREENCHMDVEAMPSKIILMMPKNQKLSKVSSKDSRLKNQDSRIIKIKIQDSRFKNQEEDSGTSFVVQVEGTSTWVVVTENKRGYISCGSVQVEGTSTWLFKENKGGYIPCGSLLVKVFTRLKEISRTAGCLGTGCRHGKHNGASLTTRPSKEFVVSRSATRHIPLFFASCIMSSSATEDGSPIRGTSLVGKEVRGIWEFGNEEELSISSLSSVYDSERTKDFLVSAGERVGVQEEMTKMEELKRKIDMMTLDDVELLIVEPCSAKERVFMRVSKDVLKGYDYKNLKSLVVDDQTQVEKMKKRKRVKESSKTEKKVVKSAEEQKEVDRAEVEIVNLDRPEV

SEQ ID NO: 178317 - protein, 50 aa, Glycine max
  Coding DNA Sequence Number=SeqID_61539
MEKSLKVGEDEWKERERGGHEIYASNELWFSPLFQDSPQSVLRCHEECKA

SEQ ID NO: 178318 - protein, 61 aa, Glycine max
  Coding DNA Sequence Number=SeqID_61540
MEEGHHRLLCHFMLEESVRPCLYLACFNKAHQSASQFLNSSIRCPIKALSMEINKELKMKC

SEQ ID NO: 178319 - protein, 57 aa, Glycine max
  Coding DNA Sequence Number=SeqID_61541
MAFMISRAELEAEKSSLKHMEDKDSNTLDGVSSQLQLKSSLSSKASSQTLNRQQVKV

SEQ ID NO: 178320 - protein, 281 aa, Glycine max
  Coding DNA Sequence Number=SeqID_61542
  Gene Ontology: Mol. function=cation transporter activity; Cellular component=membrane; Biological process=cation transport
  Homolog annotation: Hit_ID=Q84ND4; Match level="QueryCoverage=98%, HitCoverage=73%, E-value=1e-139, Identity=81%"; Hit description =Cation diffusion facilitator 10
  Pfam annotation: Domain name=Cation_efflux; Domain location=22-274; Score=178.2; E_value=2e-50; Accession=PF01545.11; Description=Cation efflux family
MYMLNVSQDEMKQLAKSERMAVHVSNMCNLVLFAAKVYASIASRSLAVIASTMDSLLDLLSGFILWFTAHAMKNPNQYHYPIGKKRMQPVSKPDMDPTKLHWMIGIMVCVTVVKFILMVYCRRFKNEIVRAYAQDHFFDVITNSVGLAAAVLAVKFYWWIDPTGAIIIALYTINTWAKTVIENVWSLIGRTAPPDFLAKLTFLIWNHHEQIKHIDTVRAYTFGAHYFVEVDIVLPEDMLLHQAHNIGETLQEKLEQLPEVERAFVHIDFEFTHRPEHKTMV

SEQ ID NO: 178321 - protein, 201 aa, Glycine max
  Coding DNA Sequence Number=SeqID_61543
  Gene Ontology: Mol. function=translation initiation factor activity; Biological process=translational initiation
  Homolog annotation: Hit_ID=Q10L33; Match level="QueryCoverage=82%, HitCoverage=55%, E-value=9e-43, Identity=49%"; Hit description=MTERF family protein, expressed
  Pfam annotation: Domain name=mTERF; Domain location=1-197; Score =22.6; E_value=1.4e-09; Accession=PF02536.5; Description=mTERF
STVEYITSLDFTAIEFRRMVGMCPEILTTQVSDLIPVFTFLHREVHVPGSDIKRVINRRPRLLVSSVSKRLRPTLYFLQSIGIEEVNKHTDLLSCSVEEKFMPRIDYFENIGFSRRDATSMFRRFPQLFCYSIKNNLEPKYSYFVVEMGRDLKELKEFPQYFSFSLENRIKPRHKQCVEMGYNIDGAVPGSPSHATCGGFY

SEQ ID NO: 178322 - protein, 132 aa, Glycine max
  Coding DNA Sequence Number=SeqID_61544
  Homolog annotation: Hit_ID=Q2HRF3; Match level="QueryCoverage=47%, HitCoverage=14%, E-value=3e-07, Identity=63%"; Hit description=SDL-1 protein
MEEERVVILSKNCEEVTLDKIKGDATDKYDLGGEVRGEIKGPVTEVREGRVMGLEERVIAAIRVVTKGGSGGGGGHRVMRLVMSLRHWRTNARVASVKGRTMKSKRRRGDGYWWWMVLWQMLLARNPSSAKT

SEQ ID NO: 178323 - protein, 58 aa, Glycine max
  Coding DNA Sequence Number=SeqID_61545
MALERTLRIPMQILEGISFREPALVPWNQNQIRIHGGRENKFRLPFKCLPNLPHEPAN

SEQ ID NO: 178324 - protein, 384 aa, Glycine max
  Coding DNA Sequence Number=SeqID_61546
  Gene Ontology: Mol. function=oxidoreductase activity; Cellular component=vacuole; Biological process=response to oxidative stress
  Homolog annotation: Hit_ID=Q5U1S5; Match level="QueryCoverage=82%, HitCoverage=82%, E-value=3e-78, Identity=49%"; Hit description=Class III peroxidase 18 precursor
  Pfam annotation: Domain name=peroxidase; Domain location=80-345; Score=340.1; E_value=3.8e-99; Accession=PF00141.13; Description =Peroxidase
  Subcellular localization annotation: CTP_CleavageSite=75; ConfidenceScore=5.51e-01
MRSCINLWIVAALVIPVLLTLRSPRGETQTQTQTTSSFSDSSTFSVKLANSFPFNQRIRDGSNLEYDFYMDTCPQAEGVVRSALTRIYFDHRDVAPALLRLFFHDCFIEGCDASLLLDENNGDRNLSVEKQAVPNQTLRGFDKIDLIKEEVEQACPGVVSCADILALAARDSIVLAGGPFYPVLTGRRDSHQSFFEEATDQIPRPDDNVTRTLNLFNLRGFNARETVSLLGGHNIGKIGCDFIQQRLYNFQGTGQPDPSIPLDFLRQMRLNCPDSKNSSTSVDEFTISKMGMSYMQALSSSVSSGASFDTHYYQSLLRGRGLLFADQQLMAEEKTARLVSAYASDDGSTFRMDFARVMLKMSNLDVLTGLQGQVRVNCSLPVSS

SEQ ID NO: 178325 - protein, 79 aa, Glycine max
  Coding DNA Sequence Number=SeqID_61547
MREGNVFALKNFPPHSKRARLSGLTVFAPPSHLWLHFAFIFGTPTHSNKPMLYSEAMGHATLPPLSCYSCLNMRPPSAR

SEQ ID NO: 178326 - protein, 34 aa, Glycine max
  Coding DNA Sequence Number=SeqID_61548
MAPYSDIFRLSSAGKGRQSVGRDPILYLHPSLST

SEQ ID NO: 178327 - protein, 47 aa, Glycine max
  Coding DNA Sequence Number=SeqID_61549
MKAVMIQGTSPLAFIYMQIWVMVGGWSKENGWCCKVVDGGQGHWRNG

SEQ ID NO: 178328 - protein, 90 aa, Glycine max
  Coding DNA Sequence Number=SeqID_61550
MKLIFSSTRKIFCHTCSYNSFYERGGNRGGKGGKIGFGGGGGGGDGVKPGITIGGKGGNKDGGGLGGGWNGLGISGGGLGGGWKGLGKRV

SEQ ID NO: 178329 - protein, 86 aa, Glycine max
  Coding DNA Sequence Number=SeqID_61551
MGAKYLEVVKRGSHPNNGWSPDKIRAQNDHNLSPCVFGRDRAWAARRRMTITCLCVPPDTIASGWRKGVRNDHNLSPPPSRLTVTE

SEQ ID NO: 178330 - protein, 223 aa, Glycine max
  Coding DNA Sequence Number=SeqID_61552
  Gene Ontology: Mol. function=chitin binding; Cellular component =extracellular region; Biological process=chitin metabolic process
  Homolog annotation: Hit_ID=UPI000044A8F0; Match level="QueryCoverage =79%, HitCoverage=99%, E-value=5e-27, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
RTDVLSFKGLHVLAFRGLHVLTFRGLHALAFIGLHTFTFRGLRIFAFIGLHALAFRGLHVFTFTRLHVLAFRGLPALAFRGVHALAFKGLHILVLRGPHAITFRGPHVLTFQGLHILAFKGLNDLAFRGLHVLTCERLHILAFRGLHILTFRGPHVLAFRGLHVLAFRGLHAIAFKGLHALDFRGLHILPFIGLPILGFGDYMLSISEDYTSSPLEAYASLPS

SEQ ID NO: 178331 - protein, 193 aa, Glycine max
  Coding DNA Sequence Number=SeqID_61553
  Gene Ontology: Mol. function=nucleic acid binding; Cellular component= mitochondrion; Biological process=DNA integration
ADPFLFIYHHNTVSLYLLVYVDDIILTGSNHFAIQTILAKIRVDFAIKDLGRLSYFLGLETPGLDYDHTFSPMVKASIVHVILTLAVMQHWPLHQPDVNNAFLNGLLANPVYMEQPPGFIDPRFPHHADPFLLIYHHNTTTLCLLVYVDDIILTGSNHFAIQTILAKIRVDFAIKDLGRLIEAVPESNKHENA

SEQ ID NO: 178332 - protein, 78 aa, Glycine max
  Coding DNA Sequence Number=SeqID_61554
  Subcellular localization annotation: CTP_CleavageSite=33; ConfidenceScore=5.28e-01
MALSTPSRTRSPFFKLDLWRMKVGKKYTRRSSRQSLKSEIQRQRTEQKAKGFSIERCIVSLELDRVGLGYRMSGHGVW

SEQ ID NO: 178333 - protein, 87 aa, Glycine max
  Coding DNA Sequence Number=SeqID_61555
ITLVRHPVDPEKSNRVLGFPTLITGLCQFYGVPVAPQQGRDTIASWGWPTADNRRTATISRALQLIYKSWSVAYDPWPTSRRPSQSQ

SEQ ID NO: 178334 - protein, 212 aa, Glycine max
  Coding DNA Sequence Number=SeqID_61556
  Gene Ontology: Mol. function=nucleoside-triphosphatase activity; Cellular component=chloroplast
  Homolog annotation: Hit_ID=Q2PMM5; Match level="QueryCoverage=99%, HitCoverage=16%, E-value=3e-44, Identity=70%"; Hit description =Protein ycf2
MIELRKLLDRYPTSELNSFWLKNLFLVALEQLGDSLEEIRSFAFGGNMLWGGGPTYGVKSIRSKKKYLNLIDLISIIPNPINRIAFFEKYETSKSSNFHFPSHGKPFSLRLALPPPSRVFLNKFLDNKPKGFLIDDSDDIDDSYDSDDIDRDLDMELELLTMMNTLTMDMMPEIDRFYITFQFELAKAMSPCIIWIPNIHDLDVNESNYLSL

SEQ ID NO: 178335 - protein, 114 aa, Glycine max
  Coding DNA Sequence Number=SeqID_61557
  Gene Ontology: Mol. function=NADH dehydrogenase (ubiquinone) activity; Cellular component=mitochondrial membrane; Biological process=photorespiration
  Homolog annotation: Hit_ID=Q10QL6; Match level="QueryCoverage=60%, HitCoverage=48%, E-value=2e-29, Identity=89%"; Hit description=GRIM -19 protein, expressed
MPHEKVKTRSKAFLKMEPEKKRRDSGEERKMTEAYIRKKPGMASVKDMPVLQDGPPPGGFAPVRFARRIPNKGPQRRCHLPHCFRRFLLGHVPGRPGQQDPKKDWACATARPDS

SEQ ID NO: 178336 - protein, 147 aa, Glycine max
  Coding DNA Sequence Number=SeqID_61558
  Homolog annotation: Hit_ID=Q10QL6; Match level="QueryCoverage=37%, HitCoverage=38%, E-value=1e-22, Identity=90%"; Hit description=GRIM -19 protein, expressed
MKKKRRRYLPSDLVALADLVHAPRESAESSEEDGNGAGALCWGCAGRTGPERTRLVVDRPGEPASTLSAAVKVKFPASSFVVVGGGKQGTQMVFVRHRRTDDFRIKLIHEWMYEIMSERADMDYENAESCGANELHVDCSDAFKTSQ

SEQ ID NO: 178337 - protein, 45 aa, Glycine max
  Coding DNA Sequence Number=SeqID_61559
MEESHLLHQIPKGVLRGTPMESISTLWKAWESFIESAWSCYRAIS

SEQ ID NO: 178338 - protein, 72 aa, Glycine max
  Coding DNA Sequence Number=SeqID_61560
MCTYVVVLTQIWDIESGDVGYDGGALISVGNLAVVVNTNICIWVTHSVTCTGKWHLSLCSTWPRDAIRVFTV

SEQ ID NO: 178339 - protein, 106 aa, Glycine max
  Coding DNA Sequence Number=SeqID_61561
MQKESKNAGCTNLGERENAGYALRIFGKLLSEPERLLCRSKLHDESRLIQRSFDDDKGNDKKLKDQEHFMITKMKISKNQESRFKVQVPRIKIKIQDSRFKNQEKT

SEQ ID NO: 178340 - protein, 65 aa, Glycine max
  Coding DNA Sequence Number=SeqID_61562
MNHDTVNHAIDTHFIQHLQHPSANSATPFIIVVVVLETVKLEVSELKRYRDVNIDSFKEKYSRRT

SEQ ID NO: 178341 - protein, 191 aa, Glycine max
  Coding DNA Sequence Number=SeqID_61563
MYRVRLGVDVGSWILPLMHQQLEQKWSDLNWQDKAKTNANNRDSSDDGSLDTRGSIPTSEHFKRLRETHTRYLRMMCLVVKSNDNVFYDVGGMDRKGRVFGLGSEIGKYKPSSSILFDGFSSHVYEKMKSQLSNLTKENKNMKEVFLASQEESCLFREQMTRFMESFSLGQTFQPVQCDPQPPIGDRQDDE

SEQ ID NO: 178342 - protein, 140 aa, Glycine max
  Coding DNA Sequence Number=SeqID_61564
MENDYYGVLIDNVEVEYTAQQAEQVYFTSFSEGQQDWLGVVKIKACSIIQSFENNKPEVAYQDDDEHQIVPIVVANGDFAESLVDTHGIGQKVPIDWEEEEDIEFMWSSEEEFIDKDIEEERLQEEEDDNYEAYQDRDSN

SEQ ID NO: 178343 - protein, 146 aa, Glycine max
  Coding DNA Sequence Number=SeqID_61565
MANNQNMSGRGRGTGRGISRGRGRGRGRGTILPQPSTSQLTHPIGQPIPPTLEHCSTSQTPAAPQLNRSTCSSHFQATHPSISQTPTAPQINLSTSNPLSQPTYPTGQPMNFSTTSTQLPSHAQVDVASADSPHVASSHVDPPPQI

SEQ ID NO: 178344 - protein, 128 aa, Glycine max
  Coding DNA Sequence Number=SeqID_61566
MAVTPCQVCIASDNGETVHVSLSHQWQWQFEARDYNVVPTTTVFTGPNVVEVMFLKFKDRIEDSQENPSRILESDGNAIIMDMTANVVIDVGGGKFKLIVQDEDMTFNVFDVMNPKGLRLTTTIHLND

SEQ ID NO: 178345 - protein, 181 aa, Glycine max
  Coding DNA Sequence Number=SeqID_61567
  Homolog annotation: Hit_ID=Q9LYG5; Match level="QueryCoverage=42%, HitCoverage=21%, E-value=4e-31, Identity=80%"; Hit description =Lysophospholipase-like protein
MARHAPCVNTLLSKENLLGKLFVKVTLVNFPNSPFLNHRDSFVIFNLVVKALEREFLSDSVAVKLPWHLKQNIIDEILQRLRSLNSSRTDIAKERGHGGSDGLHGYVPSLDHVVVDTIRSDNPGIPCFLFGHSTGGAVVLKAASHPHIEVMVEGIILTSPALRVKPAHPIVGVNFAFVSCA

SEQ ID NO: 178346 - protein, 302 aa, Glycine max
  Coding DNA Sequence Number=SeqID_61568
  Gene Ontology: Mol. function=nucleotidyltransferase activity
MGWNGIIPTYTKWTWHGELPDNPSVSHTKSVKADRGCRIEDMIRDLGQDGFQEAHAPLYEKMENDSKIPLYSGCTTFTRLSTVLALKLLPEDNMLPKNQYEAKKILYPVGMEYQKIHACPNDCILYRNEFAETSDVVTAENNRPTKVEKLMDCYDIPLIVRNGRHSILCILMNRLLLVRHPLLALSKLPPLSPFSQTYYYSYTPTRINSQIYKIKDPPRTSATFCSTNKELSSKKCVPCNTKDLQLMTEDAARTLLPQGFDWHKKEAAFHLQVQKLTERNTYLEQLLLDMQNRESASINSNF

SEQ ID NO: 178347 - protein, 215 aa, Glycine max
  Coding DNA Sequence Number=SeqID_61569
  Homolog annotation: Hit_ID=Q6H7E3; Match level="QueryCoverage=21%, HitCoverage=32%, E-value=1e-08, Identity=61%"; Hit description =Putative elicitor-responsive gene-3
MYVVFNIKVEAHSSSFYTKDSFDDIIFFLGNEVPNIINVEPVFTVGSIPETSYNVVKDQKYCGEIKVALTFNPEEEHWKGCAESRESTGAPSRKVSAEYDHEIEDDEGVTMIEEGRVRKIYEGANMDGPAISNGDTSWRGVCFAWKPQLALAIWCDPPLPIAIQALTWTVPLAIQVLTWTVPPLAMVIQADVKYLARSIGNIGCRLGQEVAQRSE

SEQ ID NO: 178348 - protein, 95 aa, Glycine max
  Coding DNA Sequence Number=SeqID_61570
  Gene Ontology: Mol. function=RNA-directed DNA polymerase activity; Biological process=RNA-dependent DNA replication
MPGPIVLLDQKNRGRERADAWTDKPFLQHVLNLAFNFLFLKVRVSIWSNIHRVRVGLKVDVVVCGMRWRKLCGCDCNMEISARAILPEKTMNLGR

SEQ ID NO: 178349 - protein, 132 aa, Glycine max
  Coding DNA Sequence Number=SeqID_61571
MAKRPPNVARPIGFHQCTLPKYVESTLELQVPNFATFSRKDGMSAMEHNDFYWYSNQPPNFISNWIDMGDCIHDKLYSPQPNVSMVDLINTKQPDNEFVANFLEKLRQIKSKCNVQFPKVKYGNITDSNMSS

SEQ ID NO: 178350 - protein, 441 aa, Glycine max
  Coding DNA Sequence Number=SeqID_61572
  Homolog annotation: Hit_ID=Q680Q1; Match level="QueryCoverage=22%, HitCoverage=24%, E-value=2e-26, Identity=62%"; Hit description=MRNA, complete cds, clone: RAFL22-41-F10
  Pfam annotation: Domain name=ENT; Domain location=59-134; Score =101.5; E_value=2.4e-27; Accession=PF03735.5; Description=ENT domain
LDLVVMSLDLVVMITRTDDDLPPTHQNRISRGGRGHLAGNERSVVGSIPYPRMYSEIDRETQIHLLEQEAYSSVLRAFKAQADAITWEKESLITRLRKELRLSNEEHKELPGRVNVDVVPPCCAPRESSYVSVGTCKDCTTCFGHSDLHNDHPSTTQFRKKLPWFLSSLPSADCAKGGHGAYTSSVELKVVWTPNTTLAPLRGRRGVMAWEDMPNNLASGSLIKLWVLPPSTKITTGCAKWPEREWKLIWVGVGFGSSGGSANSIGERRFRGTGVGEGDFKGVGSNKGLIKDEMGKGFRKVIDEGFGEAIDEGLIGQGQGLESLHFAVYLQRQPRNEATQKERGRQTNDTIRQILELREKNWPRGSHDFKELVDLKDPTKRVCTIKPRDIELHAMMNELIDFVSEVLDSVTEGKLVTGELAQFLVSRVQFLQEAKDKSKKE

SEQ ID NO: 178351 - protein, 116 aa, Glycine max
  Coding DNA Sequence Number=SeqID_61573
  Gene Ontology: Mol. function=dihydroxy-acid dehydratase activity; Cellular component=mitochondrion; Biological process=branched chain family amino acid biosynthetic process
  Homolog annotation: Hit_ID=Q6YZH8; Match level="QueryCoverage=90%, HitCoverage=17%, E-value=2e-31, Identity=69%"; Hit description =Putative dihydroxy-acid dehydratase
METPTEVLVNLNKYNSPIMEPKSQVTSQVVLYGVGLFEDDMAKPQVGVSSVWYKGNTYNMHLLRLYASLRPFVTASPPPAWFPSTSTLSASATPSLLAPKACATTCSPRTSSLTTS

SEQ ID NO: 178352 - protein, 216 aa, Glycine max
  Coding DNA Sequence Number=SeqID_61574
  Homolog annotation: Hit_ID=Q1SIY6; Match level="QueryCoverage=39%, HitCoverage=7%, E-value=7e-18, Identity=50%"; Hit description =Integrase, catalytic region; Zinc finger, CCHC-type
  Pfam annotation: Domain name=LRR_1; Domain location=166-188; Score =12.6; E_value=1.3; Accession=PF00560.23; Description=Leucine Rich Repeat
  Pfam annotation: Domain name=LRR_1; Domain location=190-213; Score =5.7; E_value=25; Accession=PF00560.23; Description=Leucine Rich Repeat
  Pfam module annotation: Pfam domain module=LRR_1::LRR_1; Domain location=166-188::190-213
MEGEISYTTCPPPIFDGEEFELWDARMTAHLEALDLWGTIEENYDLPELPLNPTAAQMKNHKERKTKKGTDKCSTDTEVEKNDDTRGGGTRIRVPYPFQWGAPTFDASEAFAMMMASFVALVEIPYGRGHIPGFISQHNLRVGDIIIKDQVSIMSLISIVIGELQSLSKINLSSNALSGSIPDFIGDFPSICFVDLSKNGFTVEIPSALFTYCYKT

SEQ ID NO: 178353 - protein, 220 aa, Glycine max
  Coding DNA Sequence Number=SeqID_61575
MPRQLAHLGELIPSGLSISSPRGSKEEGRKAKPRRYQIVIVIIPYIVLLFYVPRATVGLSPKEFGNFGGEWIATPRDCVEGGLLGGRVRSNRQLSTKVSGVLANLLCTRLDGDELFICYKDLQAEKMDLGGNVESLAAEKDRLAKLILYKKEVVEQHEKGFQKVVRQTDFLVKDLDLDIFDPFKDVKDGVQLDEEDIVVAEEEAADEGQGAAEHGDDTCD

SEQ ID NO: 178354 - protein, 66 aa, Glycine max
  Coding DNA Sequence Number=SeqID_61576
MTKDAIHSHNSIAPDSTFSHFLPYSELPLNLSHEVQTKLAQVICLPNAQGTHSLKQAIASPGELFA

SEQ ID NO: 178355 - protein, 409 aa, Glycine max
  Coding DNA Sequence Number=SeqID_61577
  Gene Ontology: Mol. function=RNA-directed DNA polymerase activity; Cellular component=mitochondrion; Biological process=RNA-dependent DNA replication
MKFPTLIEEIVTVKDDQKQAQQCYVESLKVTPYPPIGEPIMPLSIMAKGTQVITVDKRPQIRALTIHQFSLDYEFDIDSRDKTSDRGLKPIEELVQLQLEPKPGVVQEEVDKLLHANFIKEVKFSTWLTNIVMVKKAYCKWRMCTDYTDLNMAYPKDIIPQHVVDLEEVFGKLRNYNMHLNPEKSFLAFKKTIATPAVLNQPRPGAPLLLYLSVADEAISSALVQEEGKHQLPIYFTSHMLHDAKKCYQMIEKVALALITSARLLRPYFQSHQVVIKTNYPIMHVLRKLEPTGRMVARSIKLSEFDIQYEPRDPMKTQFMANILAEFAGNGTTNPDWWTLYIDGASNVKGSEAGIILKGPDNITLRASPQAQLQSLKQPGKVRGAHCRSKTSKRSRSQEATMLHRLAAS

SEQ ID NO: 178356 - protein, 104 aa, Glycine max
  Coding DNA Sequence Number=SeqID_61578
MSFWVIFCSFRVQNTSICLNLRPKSKNSTYLDDHGIDVWPLLGHLMQKTIGNIGRVESKIAGHNTKGCTTLKEKIEKLIKKRELQRFIKDKEPSREQERECNKS

SEQ ID NO: 178357 - protein, 343 aa, Glycine max
  Coding DNA Sequence Number=SeqID_61579
MGRGDSASNLLECLFVDKGKISDGEALGELSLNEGGHQVHAASGLDSLTCKSEEWTNMRTNSVGNLQDSGTLKRVAWGLDVGTRATCLTHYDDGDNHEVVLVKGVDAFKVPICKGLAGLSSIGKTNSNGVDYTSDVLGGFLCPLGLAPAWWLSVILQYLGTSWLNASLRIIVQLVVRDCQGGQGHAMRPAGGVLHTESFNEGVEDVYGPRWKSTILDIQMLVWICCPIVPVEVEWFPPKGVSASIMRSIKGCRRTVCVAGRCMWARLKLSKVLPVRRGCDSPWVHLGKSVCVCHSCQTRMRVCEGSLTSEARREKIDERPRGPELHMSARRGVFDRRGNMQNK

SEQ ID NO: 178358 - protein, 90 aa, Glycine max
  Coding DNA Sequence Number=SeqID_61580
MGHVNLLTTFKDEKGSKTIMIRIYQRSAICHMVNECGNALSKFISRALDMDKTFFKLLKKHEGTKWNEKCEANFQKLKEFLTLPPILISL

SEQ ID NO: 178359 - protein, 183 aa, Glycine max
  Coding DNA Sequence Number=SeqID_61581
MVQGLFVAHQLFMYGWSRTSLVMKVDSSIPCKVTAYALRKGRPIGSNSWLVWWGHPLIGSPDERKEEPRFYPYSAVQRKDKELRGSNNRIIGGYHKWLKALMQELDWLPKLKSSSEEEAETTEESEEVQALKVELERAQAVKEKFKTTTIKVQKECDKLRDVNVATSDALEWETKRARKEEWG

SEQ ID NO: 178360 - protein, 486 aa, Glycine max
  Coding DNA Sequence Number=SeqID_61582
  Gene Ontology: Mol. function=signal transducer activity; Cellular component=membrane; Biological process=signal transduction
  Homolog annotation: Hit_ID=Q5PFG0; Match level="QueryCoverage=70%, HitCoverage=84%, E-value=1e-132, Identity=67%"; Hit description =Putative membrane protein
  Pfam annotation: Domain name=GGDEF; Domain location=186-345; Score =148.8; E_value=1.4e-41; Accession=PF00990.12; Description=GGDEF domain
  Pfam annotation: Domain name=HAMP; Domain location=104-174; Score =23.5; E_value=0.00077; Accession=PF00672.15; Description=HAMP domain
  Pfam annotation: Domain name=OmpA; Domain location=381-477; Score =134.6; E_value=2.7e-37; Accession=PF00691.11; Description=OmpA family
  Pfam module annotation: Pfam domain module=GGDEF::HAMP::OmpA; Domain location=186-345::104-174::381-477
MSHSLEASLVFNDSLAANETLAALGKQGQFAMAEVVNAHKKRFAYWSWNPEDNNDTLGALVSRWLFPVPVAQPIMHNGAMVGEIRLTARDSLISHFIWMSFAVLTGCILFATVVALTITQSLHHGMVTALQNITDVVHDVRTNRNFSRRVKDGRIEEFHQFGEDFNSLLDEMEEWQLKLQAKNAQLLRTAMHDPLTGLANRAAFRNSIAALMNDPSARTNSALLFLDGDNFKFINDTWGHAAGDCVLIEVASRMMEFGDKRHQSYRLGGDEFAMVLYGVHSELEVQHICAALSQQFIRPFDLHNGQKASMSLSIGFALAWENASVEALLERADRNMYQVKNQRCQSPPEGKFTPEQIAAMKSYGFNELNGDWSLGLSDTILFDKNDARLRPESETQIKSMASRLAETGLNHARMDGHTDNYGEENYNNALSLKRANAVADAWAKGANIPRSNLTTQGLGQKYPVASNSTPQGRAENRRVAVVISTP

SEQ ID NO: 178361 - protein, 106 aa, Glycine max
  Coding DNA Sequence Number=SeqID_61583
MMTKGWSFFGASMVEEEEENGNMREREKASEILGLTTGSEKNLTFETLKSCLGLRAVSLVPVPRVSLHLSGPVFESRQYIYQNAQNETPSVVQRLVLLNFKSHVKR

SEQ ID NO: 178362 - protein, 45 aa, Glycine max
  Coding DNA Sequence Number=SeqID_61584
VDSPEDVMSAYEADSTRIVALERWRSVEALHHSRQLIGLVLYTFE

SEQ ID NO: 178363 - protein, 83 aa, Glycine max
  Coding DNA Sequence Number=SeqID_61585
  Homolog annotation: Hit_ID=Q1SYZ2; Match level="QueryCoverage=80%, HitCoverage=13%, E-value=4e-08, Identity=39%"; Hit description =Transposase
MGSERWMVKLICGSDNHELDKSLVRHPYVGRLTKDEKIIIADMTKSMMKPRNILLMLKEHNANNYTTIKQGCSVDECNENCIP

SEQ ID NO: 178364 - protein, 87 aa, Glycine max
  Coding DNA Sequence Number=SeqID_61586
  Subcellular localization annotation: CTP_CleavageSite=48; ConfidenceScore=5.33e-01
MKTSFYRNSYFKAKFDIAEATKVKTKVMSTVATRWRQFKSTLTSKFVFAKSEGQQTQDVVTKYGLDPEAWKQFEENRLTPNWEGIRK

SEQ ID NO: 178365 - protein, 296 aa, Glycine max
  Coding DNA Sequence Number=SeqID_61587
  Gene Ontology: Mol. function=catalytic activity; Biological process =metabolic process
  Homolog annotation: Hit_ID=Q08QZ3; Match level="QueryCoverage=58%, HitCoverage=36%, E-value=8e-31, Identity=43%"; Hit description =Coronafacic acid synthetase, ligase component
SLTPVLLRQLNAWETTLPPGLKKLTIGGDLAAPKEVEAFLLRQPWLELYLTYGISEAGPRVSTCPAHLLGRGYYASAGRPIDQTEVRILPGADGQDGQGELLICSDTLLVKRIGRGNRQTFIELDGKRWLRTGDIFFQDADGFLFFKGRISDFIVIRDEKVNIGAVKQLCREIKGESDVFETWPADIVRLKFPEEHWDYYISRYEHFRDEVIRNLTPQDYLREMLKQTQRLPCFCSEMADVAAILYSQIINKPNERIRYFDISAYAQVLDRKRRKVVKPAELDGFDATDITFDFIE

SEQ ID NO: 178366 - protein, 178 aa, Glycine max
  Coding DNA Sequence Number=SeqID_61588
MSYPVIITPTFLCQSVSWCMPPTRHPLDPDKSNRALGFPVLITGLCQSFEVPITPSKVIRPPITRAFIEKYCMPRQAQGDAPQATDAPLPPHQADPTGSLGMERYLQHLLSLSQQGQGFAPFACPTPNQFRAEVAWPGDWPEDQTEEAPTGAPDDAEDARMDEEMTDLLGFMGGSTAT

SEQ ID NO: 178367 - protein, 81 aa, Glycine max
  Coding DNA Sequence Number=SeqID_61589
MYVVIQEKEKLSAERQKNHDLFTAQPHYKPSKKELFRRSAKGVVALSELNALSAHQQLSLALVCLASKGESGKASAMQARA

SEQ ID NO: 178368 - protein, 202 aa, Glycine max
  Coding DNA Sequence Number=SeqID_61590
  Homolog annotation: Hit_ID=Q09JM0; Match level="QueryCoverage=28%, HitCoverage=98%, E-value=2e-10, Identity=63%"; Hit description=10 kDa putative secreted protein
LVPSEVSLRIAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGSSKYSNENFEGRRGERFHGIGLKFLNRDVAADGNVRESGDVGGGPGKSYLFCLTACPPWKRLSRRTECLPRPVVLITASGLQGEHPLVDGTM

SEQ ID NO: 178369 - protein, 215 aa, Glycine max
  Coding DNA Sequence Number=SeqID_61591
  Homolog annotation: Hit_ID=Q6CQE6; Match level="QueryCoverage=43%, HitCoverage=68%, E-value=4e-21, Identity=57%"; Hit description =Kluyveromyces lactis strain NRRL Y-1140 chromosome D of strain NRRL Y- 1140 of Kluyveromyces lactis
MCPVVGFGPWLGLGKPLVEILPPGQLLGFCPLLAWLGSAVLGYGPVLSFGLAQGGGGAWSSVRPDTHLVSTIEAKRERADERYPLLAKHREGPSPDRHAETRSRRGSRSSCPPTADGFGTGTPVPFPPSQSFSLGYGSILPTSLAYIVPSTRGCSPWRPDAVMSTTGRGRHSVLRIFKGRRGRTGHHATCGALPAAGPYLRLSRFQGGQAVKQKR

SEQ ID NO: 178370 - protein, 168 aa, Glycine max
  Coding DNA Sequence Number=SeqID_61592
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=98%, HitCoverage=33%, E-value=2e-56, Identity=82%"; Hit description=NADH -plastoquinone oxidoreductase subunit 2
  Pfam annotation: Domain name=Oxidored_q1; Domain location=1-114; Score=-71.0; E_value=0.00069; Accession=PF00361.10; Description=NADH- Ubiquinoneplastoquinone (comple
MILGNLIAITQTSMKRMLAYSSIGQIGYVIIGIIVGDSNGGYASMITYMLFYISMNLGTFACIVSFGLRTGTDNIRDYAGLYTKDPYLALSLALCLLSLGGLPPLSGRLIFLSFNRTPYECCFYLLLFTNNQVINDWTKPRNNSSRAKLSKAPFKIKQFHRITSDRIV

SEQ ID NO: 178371 - protein, 166 aa, Glycine max
  Coding DNA Sequence Number=SeqID_61593
  Gene Ontology: Mol. function=zinc ion binding
  Homolog annotation: Hit_ID=Q1RX12; Match level="QueryCoverage=56%, HitCoverage=10%, E-value=4e-31, Identity=63%"; Hit description=Zinc finger, RING-type; Transcription factor jumonji, jmjC; Cupin region; Zinc finger, FYVE/PHD-type
MCHVWSTIDTWKSKCTRAALKKLNLVEDRSIPRVQAHFFPKNINTDVSYSNMRKAASWEDLTDNYLFCSKAVDPQYKDLRHFQWHWEKGEPVIVSNVLECTSGLSWEPLVMWRALRHVTNTKHGQYLAEKTIDCLDWTAVCLISQSLTLLTMESFLHKFHSSPSFS

SEQ ID NO: 178372 - protein, 69 aa, Glycine max
  Coding DNA Sequence Number=SeqID_61594
MRASAKRNTPGLSTRKNPEEDELYRFTKRTASVHPLSEKGALSQKSLTCAKRSIHALSTRARTRPPIEA

SEQ ID NO: 178373 - protein, 92 aa, Glycine max
  Coding DNA Sequence Number=SeqID_61595
MSQEEAHHHRKPWIRAQRKEKMSGGRWREGARNFVPQMRIASQIHPGLEWILGLVECLAFHDHHWWKSHGTCARKRKNRSEKRKKNEKHLRE

SEQ ID NO: 178374 - protein, 143 aa, Glycine max
  Coding DNA Sequence Number=SeqID_61596
MECSEFKSMGSAVVDVINRFFITAQAGNLLLGQQIEHYEHNRTIEAKLLHIYDPPVGRSPKLFTNINNKLISRDTNNVGGYGPVSELDYHRDDFEASEIGLFGCEEDDNLAEVDTTIKGRREDDGIFMTLRIADKEVFLILAT

SEQ ID NO: 178375 - protein, 122 aa, Glycine max
  Coding DNA Sequence Number=SeqID_61597
  Gene Ontology: Cellular component=extracellular region; Biological process=sexual reproduction
  Homolog annotation: Hit_ID=Q39802; Match level="QueryCoverage=84%, HitCoverage=37%, E-value=2e-30, Identity=62%"; Hit description =Cytokinin induced message
MAPTLQHALSHLLTLVVSLSILLVVPSSCFNPKKIVNASYASCSYGSDWSPAIATWYGLAKGDSSEGGACGYGSAVGEPPFSLLISVGSPLLFESGKGCGSCYENVSETKTVTCNRLRLSDS

SEQ ID NO: 178376 - protein, 166 aa, Glycine max
  Coding DNA Sequence Number=SeqID_61598
MEWWYLGQINVEEEGLLGVRDLNAILLIRIKDVDVVHSLCYVKSCTNLKYGKFRNIKLKLAYQMMRSKMLHATDKGNEGRTETHKEKLWNEEVSATNEGSAENIMKSNYNEVNKFEDKDKEQTIQNSKMKTEGGSENNVKNKDVEDGVCDVDRSCNFGKIFLPNFK

SEQ ID NO: 178377 - protein, 185 aa, Glycine max
  Coding DNA Sequence Number=SeqID_61599
MPRLLTNYKEIEAALCIPGRGFVLNSEGHPGKILRNDLMTLAQVWSVLSYSNLAPTSHTSDLIVDRARMIFGLVSQMDMNVGALISGQITSIAQSNSSRLGFPALITVLCKDRGVTSDSLVFERLSPVINLAYIKKNNWNPDDLTVSIRGARQARMRPAEPPSTSTTPIPARTSVAHFVLAYADF

SEQ ID NO: 178378 - protein, 263 aa, Glycine max
  Coding DNA Sequence Number=SeqID_61600
  Subcellular localization annotation: CTP_CleavageSite=59; ConfidenceScore=5.40e-01
HIATPLSSLPPPLESSAPSSSTSQKIRKKTWLRSLATRLIGAKKPVVHVDPATGKTNVPAAQKDLILEGIQKHLIKGRRNNPSDRKRAMEAFKSDLTSKWALANSKESEDDKDVLIVAIAQPEHLGGVCVVGVGVTIKQYFGPDSRSFHSLGLALAHEPEVSLSAARVRTKGSFVDPSRQDLDTGDSEKCGLVYEGLTTVHTVPLDNDQLKVGVEELRDAIACIPIPIQEVSWDATVFGVYNDNFSLCIKHGDFSEIAHGGQL

SEQ ID NO: 178379 - protein, 113 aa, Glycine max
  Coding DNA Sequence Number=SeqID_61601
  Gene Ontology: Mol. function=zinc ion binding
  Homolog annotation: Hit_ID=Q2HT04; Match level="QueryCoverage=57%, HitCoverage=17%, E-value=4e-22, Identity=74%"; Hit description=Zinc finger, RING-type
  Pfam annotation: Domain name=zf-C3HC4; Domain location=51-83; Score =9.5; E_value=0.016; Accession=PF00097.15; Description=Zinc finger, C3HC4 type (RING finger)
MEIKSKSKLTRGGAGMEENNIINDDNKLEAHLTSTAAFVEGGIHDACDDACSICLEAFYDSDPSTVTSCKHEFHIQCIMECLCDVSWSPKWFSQVKSLYGCIFFLILVEERDP

SEQ ID NO: 178380 - protein, 68 aa, Glycine max
  Coding DNA Sequence Number=SeqID_61602
MISCLARPHYKPIKVLSDPPNGLDARERCLFLCMRGRTAAGDLAPVNLEIEAAYRHNNAARKRREQEA

SEQ ID NO: 178381 - protein, 89 aa, Glycine max
  Coding DNA Sequence Number=SeqID_61603
MVPKDRLRMFIILRRSRVNAGFQAIAFDFIGVATCPFAGERRRGSRVRFPKEERCAESPPTFICGKHRENRRKPVEMKILSSGVVFTLE

SEQ ID NO: 178382 - protein, 69 aa, Glycine max; identical to SEQ ID NO: 165587
  Coding DNA Sequence Number=SeqID_61604
  Subcellular localization annotation: CTP_CleavageSite=54; ConfidenceScore=5.44e-01

SEQ ID NO: 178383 - protein, 340 aa, Glycine max
  Coding DNA Sequence Number=SeqID_61605
  Gene Ontology: Mol. function=hydrolase activity; Cellular component =integral to membrane; Biological process=aromatic compound metabolic process
  Homolog annotation: Hit_ID=Q4ZRT9; Match level="QueryCoverage=96%, HitCoverage=96%, E-value=1e-136, Identity=71%"; Hit description =Alpha/beta hydrolase fold precursor
  Pfam annotation: Domain name=Abhydrolase_1; Domain location=101-336; Score=80.4; E_value=5.6e-21; Accession=PF00561.10; Description =alphabeta hydrolase fold
  Pfam annotation: Domain name=Ndr; Domain location=65-322; Score= -120.2; E_value=0.077; Accession=PF03096.5; Description=Ndr family
  Pfam module annotation: Pfam domain module=Abhydrolase_1::Ndr; Domain location=101-336::65-322
MTFRFRLKPLLSVALASAMLCGTLSAQAAEAVYGEQLEGFHYPYPLQHFTFSSQQQSLSMGYMDVKPAQQANGQTVVLMHGKNFCAATWEDTINALSQQGYRVIAPDQIGFCTSTKPARYQYSFQQLAQNTHQLLAQLGVEKAVIVGHSTGGMLATRYALMYPQQTQKLVLVNPIGLEDWKAKGAPWRSVDQWYQRELKLDAAGIKKYEQHTYYSGQWKPEYDKWVQMLAGLNKGPGHEKVAWNSALIYDMIFTQPVYYEFKDLKVPTTLMIGTADTTAIGSDIASPAVKAQLGHYNVLGKQVAQLIPGARLIEFPGMGHAPQMEAPAKFNQTLIDDLAH

SEQ ID NO: 178384 - protein, 164 aa, Glycine max
  Coding DNA Sequence Number=SeqID_61606
  Gene Ontology: Mol. function=sequence-specific DNA binding; Cellular component=intracellular; Biological process=regulation of transcription, DNA-dependent
  Pfam annotation: Domain name=HTH_AraC; Domain location=13-59; Score =40.8; E_value=4.8e-09; Accession=PF00165.13; Description=Bacterial regulatory helix-turn-helix proteins, araC family
  Pfam annotation: Domain name=HTH_AraC; Domain location=66-109; Score =21.5; E_value=0.0031; Accession=PF00165.13; Description=Bacterial regulatory helix-turn-helix proteins, araC family
  Pfam module annotation: Pfam domain module=HTH_AraC::HTH_AraC; Domain location=13-59::66-109
MMQQKYNQGVIDSVTEWIMANLDQRLSIDDIALKSGYSKWYLQKLFARYHNETLARYIRKKKLICCVNELKFSRTPIISLAVKYHFESQQSFTRSFKQVMGCTPLFCRKRQLSDAAEALLRSSDDPCALCRKVGFNRSEQEKPVVNPVSENNGKFPARISCAVR

SEQ ID NO: 178385 - protein, 153 aa, Glycine max
  Coding DNA Sequence Number=SeqID_61607
  Gene Ontology: Mol. function=RNA-directed DNA polymerase activity; Biological process=RNA-dependent DNA replication
MKVEQHFACQHTSGERKVPLATLNFQGERRIHGDPLVEYWDDLKSALRKRHIPSYYERELMDKLLRLRQGSMISVEEYRQQMELLLLRAGLREEERTSIARFLCGLNMDVRDKVELLPYRDLDDLVQLCIRVEQQLKRKSYFKILWPSRRPIL

SEQ ID NO: 178386 - protein, 221 aa, Glycine max
  Coding DNA Sequence Number=SeqID_61608
MATRLGELMLTPEVTGSPRRAGYFTLKSFGGAGEPKASLGELGSSLHRLETSLVHICQSKHKASNDDSWWPPVVMGGGGGVSRVECTFGAKHNFLRLAQFLWAQHFTLSAIPSRVGIALSTLLALCEMSKIANFQIPTLKTITWRIVTDGVVDGAALLCMEMDVAPMMGGKVQLMKPIVDGLTKKEKNHTVTPENLTVAIIIGLEYDEECGVWMNDSGEGK

SEQ ID NO: 178387 - protein, 67 aa, Glycine max
  Coding DNA Sequence Number=SeqID_61609
MGLRLQSSLCALNHNRLRQWSNVGIGLKAKTNQGKTERAQVEARVTIDRSSSHAQHWTNRKRSWGTA

SEQ ID NO: 178388 - protein, 90 aa, Glycine max
  Coding DNA Sequence Number=SeqID_61610
MPARHPVDPKKPNRFLELPALITGICQFYEVPVASSKVIRPPTNRAFIKKYCAPRQAQGETPQQPGDGRQRETDAPPPPLEFTSAHPQKG

SEQ ID NO: 178389 - protein, 75 aa, Glycine max
  Coding DNA Sequence Number=SeqID_61611
MENDCCIHLSLALQWAKRASTTKHSFSVLSTTEESGRASISRLRAKGEISVLCAAVVFSQAQCKTGAKLKSTYSR

SEQ ID NO: 178390 - protein, 69 aa, Glycine max
  Coding DNA Sequence Number=SeqID_61612
MSSGLRVQPQLLFLLLLLLLLSSWLSSLDTHELDGDVGGAIGNRVGESGLKDQALPKGKPRYEREKKVG

SEQ ID NO: 178391 - protein, 82 aa, Glycine max
  Coding DNA Sequence Number=SeqID_61613
MEVAVAVPMVVVEIAIAVPMIMLVVVEVSVVVWRGFACSLLPPLSPEKGNLNAGLFLFAKELYERRCRLGVKISGVEGRLFY

SEQ ID NO: 178392 - protein, 309 aa, Glycine max
  Coding DNA Sequence Number=SeqID_61614
  Pfam annotation: Domain name=Transposase_23; Domain location=45-115; Score=18.3; E_value=1.1e-05; Accession=PF03017.5; Description =TNP1ENSPM transposase
MQSQFQSQMHSQGLALPPEPLVGPSGPQVSTKESCVDPSGNDPKTGDSERCDLYIEANPARLVALGRFYEGSTVVHNIPLLPGQVKVVVEEVKDSDAPVPIPTDEISLVGQAIHTFLAWPTHLVKSLSQQPDPEVDDPLYLMALTILELFLRPYQVTWDATVFGVFNPDFPLYINHEDLSEIAHGGQFLCISMLQLWILYIKSWMQSSKCDVYLGAFLNGGHWQMVVIMPKEHLVVWFCSLYNRPDNYLKGIINSALKVLDDASQPQSKAPARWIVVKYFNDPRPLELERLKALRIQWAQYYLRVRAQS

SEQ ID NO: 178393 - protein, 117 aa, Glycine max
  Coding DNA Sequence Number=SeqID_61615
DGSRCIGGDRGSSVGAYGYGGGGSGAGGGGGNSDSDADDNVGGDRGADGGGDCKKNEKCQMWRYSRYRVRRWWHGAVGSGGGFRWRRGGGEEGKYVAVTRLDDVTLCLPFHHLTERD

SEQ ID NO: 178394 - protein, 212 aa, Glycine max
  Coding DNA Sequence Number=SeqID_61616
  Subcellular localization annotation: CTP_CleavageSite=87; ConfidenceScore=5.63e-01
MSDKKGSTSNHGLNLNIPPPRVANQIPDSPTRLPIAPPTSPTSSCVSSELSLDDNSSSSSNNNNNRGCTRSPEDISMVLVGCSRCLMYMMVNEGEPNGGVNIDDNCGFGEDGSRCIGGDCGSSVSAYGYGGGGSGADGGGGNSDSGADDNGFACSLLPPLSPEKGNINAGLFLFAYEVYERRCRGGIRGGAFDGGGVVRSAVVVVFVGEGEE

SEQ ID NO: 178395 - protein, 332 aa, Glycine max
  Coding DNA Sequence Number=SeqID_61617
MASFSHIQSQLQSQMQSQGLVVPPEPLVGPSENDPEMGDSDRCDLYIEADPARLVAMGRVYEESTVVHNTPLLPGQVKVSTSHLPCLADISGQVFITAVVVSLAKPPPKPDPEVNDPLYLMTLTIPELFLRPYQVRWDATVFRVFNPDFPFYIKREDLSEIAHGGQCLSISVLHLWILHLTETCMRVGNSDIYGFLEPQSIQRSGQSQFESKSYIKSWMQSSQRNVYLGAYLNGGHRQMVVILPKEHLVVWFCSLHNRPDNYLKGIINSLNQRLLLGGLSSRQKGSTECGYYVMHRMSTIILGTFRNNWEATIGAREIKGIADLVGTVLSPS

SEQ ID NO: 178396 - protein, 119 aa, Glycine max
  Coding DNA Sequence Number=SeqID_61618
  Gene Ontology: Mol. function=DNA binding; Cellular component=nucleus; Biological process=regulation of transcription
  Homolog annotation: Hit_ID=Q1SZA2; Match level="QueryCoverage=99%, HitCoverage=41%, E-value=2e-50, Identity=72%"; Hit description=No apical meristem (NAM) protein
  Pfam annotation: Domain name=NAM; Domain location=11-119; Score =182.7; E_value=8.7e-52; Accession=PF02365.6; Description=No apical meristem (NAM) protein
MDKDANSVIQLPPGFRFHLSHEELIVHYLRNKVTSSPIPASFIAEIDLYNYNPWELPNRKYPNGVRPNREATSGYWKATGTNKPIFTSCGMKSITVKKALVFYKGRPSKGSKTNWIMHE

SEQ ID NO: 178397 - protein, 127 aa, Glycine max
  Coding DNA Sequence Number=SeqID_61619
  Subcellular localization annotation: CTP_CleavageSite=87; ConfidenceScore=5.54e-01
MSDKKGSTSNHGLNLNIPPPRVANHIPDSPTRLPIAPPTSPSSSCVSSELSQDDNSSSSSNKINNCGCTQSPEDISMVLVGCSRCIMYMMVNEGDYNTVMVVQMSTVAVVVAILMTIVVLGRMVVVA

SEQ ID NO: 178398 - protein, 70 aa, Glycine max
  Coding DNA Sequence Number=SeqID_61620
  Gene Ontology: Mol. function=protein binding; Cellular component =anaphase-promoting complex; Biological process=regulation of mitotic metaphase/anaphase transition
  Homolog annotation: Hit_ID=Q9ZPW2; Match level="QueryCoverage=78%, HitCoverage=29%, E-value=2e-17, Identity=78%"; Hit description =Anaphase-promoting complex subunit 10
MGAQSSKLSTLPVNKLIVLYVVFKLDESYMPSKVSILARDGFHNLKEIKTVELEKPTGWVYLSLSGAYPR

SEQ ID NO: 178399 - protein, 69 aa, Glycine max
  Coding DNA Sequence Number=SeqID_61621
MSSGLRVQPRLLFFLLLLLLLSSWLSSLDTHELVGDVGGAIGNRVGESGLKDQALPKGKPSCERKKKVG

SEQ ID NO: 178400 - protein, 171 aa, Glycine max
  Coding DNA Sequence Number=SeqID_61622
MGPVLIDPSRSLVGGCAEESTGYLEAKHRPHVLSRGGYGYLEQKLMAKKTKKKLEEAAQFGSTEGVINPSSPVRRHVKWKMARTKKTRQMTSEATKEITENIEQASQGSFVPHGRQDVLTAALGRPEHLGRARAAGASVTTKLHEAPTVPPPSLPKNSSSSLNKSRTSWRS

SEQ ID NO: 178401 - protein, 47 aa, Glycine max
  Coding DNA Sequence Number=SeqID_61623
MPRPDKPNWPTMHSRSAPHLALSAFRSRAGRAMHAELVLLLDRALGA

SEQ ID NO: 178402 - protein, 543 aa, Glycine max
  Coding DNA Sequence Number=SeqID_61624
  Gene Ontology: Mol. function=DNA binding; Cellular component=nucleus
  Homolog annotation: Hit_ID=Q2HRE9; Match level="QueryCoverage=99%, HitCoverage=99%, E-value=1e-107, Identity=46%"; Hit description=IMP dehydrogenase/GMP reductase
  Subcellular localization annotation: CTP_CleavageSite=52; ConfidenceScore=5.68e-01
MPARNFSVHTPRRSPRFLPQQNHDTPNPKSAKLSVSANKSEKCAVGSRRSPRLNNVEEQSPPLRRSPMLNNEPVGKQLKGTRVKKGGVTATKENRVVSDEGFGGGRKKERNRKRVEVETQESVVSDEGFGGGIKKERNRKRVEVGTQENGVVSDEGFGGGRKKERNWKRVKVKTKENRVVLDEGIGGGAKKEENGKRVKTKANRVVSDEGFGGGRKKGENGEKRKRGGEEISKGWTKEQELALQRAYFAAKPSPHFWKNVSKLMLENRFDTLACYLIAKDCGWHRWFPAKNIQNNGMVPGKSQQDCFDRIHCDYMTPPQTQPHSRAKTLKSSPIHQFSISASKLLKPIDKTVRKSNVLKPKNIITQKSIEKLLQHHLKVDLDREVDIFSVLEPNTDFSTNALQPSEALSTPKQQKENKGFLQNCTETSSSSHKKPLSRFSGSCVTELVSPPVLKKVKNRVMHEKYINQLRCRESRRRAAATKIIGEGTSIQKRDVVKGAKVALVSEARDAINKFQQSQVNLMDNTCSSDEDNGDGVEFEDESQ

SEQ ID NO: 178403 - protein, 211 aa, Glycine max
  Coding DNA Sequence Number=SeqID_61625
MSVIRGGGEVVDNDNSGLDVGEVAGAEHEAKEGGSVERVVDHGDGDSEEDEALGVEAVKLAFIAEAHDDGLGARERRECIMVRELKDQATEAGGVKEVRGVGVGEPSFFSFAVVKEGEKLVIVGSEEVVAVARWMGESGGCKRVIFMMSLPISLLSRDYSSSPLLSRDSASSCTAAFFFIPCAPVCPYIVLWSFALMALRTCIGLCSTVDR

SEQ ID NO: 178404 - protein, 133 aa, Glycine max
  Coding DNA Sequence Number=SeqID_61626
MARERITRHSHFGSSRATNPLSYPHHTLVWADARCTRLTAGAPSIFKKYQKCLSFIFFIKKIGVQCFLFRALPITLPKAQPKPLVLINMYSVYSLWEFVKDIGEKKDSGLLNARILNQFSSSFSRLRKRKVAL

SEQ ID NO: 178405 - protein, 410 aa, Glycine max
  Coding DNA Sequence Number=SeqID_61627
  Gene Ontology: Mol. function=RNA-directed DNA polymerase activity; Biological process=RNA-dependent DNA replication
MVNVDEKMCRALWGDDHVEWKQSRANHLLLVISMPLEGGRKGREEEGDANKDLFKLLKKDIKKWSVEKFGGHQAIVEALSIIKWLREGDANASFFHGMVNWRRRSNGIKGIKMEHIWSEESVKVKKEERFRDIKCVVWECDDNKIFGSDGLNFNFIKACWEVVKEDIIIAIQEYHRFGRWPKGVNASFLALIPKKHDLQDLGEYRPISLIGTDFEKSSSIFVLVNGSPTKEFFPKKGFRQGDPWVPFLFLMVAGGFSGVGGSKEYFNIANDHKQDAKRGWQLGEENICHLEGEIQRNFLSWVKWDAVCSPIENGGLGKWLGLEREYGVGGVGMAWGVWDWNLSWRKGRFQWESELIQQLMEDLQGRSPILNKGDGWEWRSGKQKEYVVKEVYELLHEEGSLEDAGFFRKI

SEQ ID NO: 178406 - protein, 120 aa, Glycine max
  Coding DNA Sequence Number=SeqID_61628
  Homolog annotation: Hit_ID=Q9LSK9; Match level="QueryCoverage=76%, HitCoverage=89%, E-value=1e-22, Identity=56%"; Hit description =Arabidopsis thaliana genomic DNA, chromosome 5, TAC clone:K21L13
MIPGPLGNTTTTTATSVHNGGPRSLATSHGHISTVPRLPLGHCPPLDHHLQPQRHLLLLLPLGQEVKQSKGESLPVLMPGDEVPKFIAMPCPCQPSRLETIVVTVEKPPHKPPLVVAPLC

SEQ ID NO: 178407 - protein, 112 aa, Glycine max
  Coding DNA Sequence Number=SeqID_61629
  Homolog annotation: Hit_ID=Q1T4M8; Match level="QueryCoverage=39%, HitCoverage=6%, E-value=7e-14, Identity=72%"; Hit description =Protein kinase-like
MGVSAGVLEAIATVFHEFITRGGKVALKFEHKSNMSSNYGPPYEGKVYNTLGGFHGVPRVHYKGRQGLNSPKPAFGSPGPPNNFKAKGLGRLGELTASGLSFSSPGRAPTAP

SEQ ID NO: 178408 - protein, 199 aa, Glycine max
  Coding DNA Sequence Number=SeqID_61630
MHKALRANAPLPYPQLVTLFLRHFQIPLDDEPFVQVKRSFAIGPGAVTSFGYRKDRNGQWLKKDALPPQDERTPSPPPQRDDSSAFMTEVLSELRGLRTYVGERFDSLDGHFEGTDTRITQLEEGELNCHHQKGGDCRSKDFAFDVLMMPYDRDVLMPYENALLKFNSRQKSKNTRYNIKKISSVLGREFQIETAKRLA

SEQ ID NO: 178409 - protein, 82 aa, Glycine max
  Coding DNA Sequence Number=SeqID_61631
MKIAGVPKNAIRLNLFSFSPVGEAKEMVAMFQGERLEDMGVSGRGIFEETPTHGFIEPNHLNIFIDGLRPHSKELLDASAEG

SEQ ID NO: 178410 - protein, 338 aa, Glycine max
  Coding DNA Sequence Number=SeqID_61632
  Homolog annotation: Hit_ID=Q8TGM6; Match level="QueryCoverage=35%, HitCoverage=97%, E-value=3e-09, Identity=43%"; Hit description =Protein TAR1
VGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGLVGSVRARKGSSMGPELTGLARDWSRAWLIHHFITAKSAMNPDFNQPRGGRALGLMASGATCVQRLDGSRDSAIHTKYRISLRSSSMQEPRYPLPRVIDEEAGRTGRRGHPLPPD

SEQ ID NO: 178411 - protein, 281 aa, Glycine max
  Coding DNA Sequence Number=SeqID_61633
  Gene Ontology: Mol. function=chitin binding; Cellular component =extracellular region; Biological process=chitin metabolic process
  Homolog annotation: Hit_ID=UPI000044A8F0; Match level="QueryCoverage =90%, HitCoverage=99%, E-value=4e-42, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=72; ConfidenceScore=5.60e-01
ERTYSPLKVRTCSPLKARARSPLKKVRACSPLKARTSSPSKVMACSPLKAMTCSPLKARACSPLRVRMCIPLKARAWSPLKVRTCSPRKARTCSPLKARACSPSKVRACSPLKAGACSPLKARANRPLKMRACRPLKARACSLLKARMCSPLNARTCSPLKARTCSPQKARARSPQMARTCSPLNRRTCSPMKATACSPLKAETCIPLKERAYSPLEARACSPLKERTCIPLNMRTCSPLKARACSPLKARTNSPQKLRACSPLKAMTCSPLRAKTCSPLK

SEQ ID NO: 178412 - protein, 166 aa, Glycine max
  Coding DNA Sequence Number=SeqID_61634
MAKARITMRYLRMLSDPRVTIADLCVWITIRPEDVDISRKGAEDHIGADNHKVSSYTTRPSSHDIKGETFSQSRPEDADIFGKDNHKVSPHATGPSSHDSKGETFSWSRPEDADIFGKGADDHIDTLKGEDGHSHPGSRFMVSWDFGSRLVERLDMIYVRALVWPA

SEQ ID NO: 178413 - protein, 127 aa, Glycine max
  Coding DNA Sequence Number=SeqID_61635
MAIQFYHFQGYEVSLVELLVGQHWDHLEHSGEGALIKLGGALRKASSLSNLEGGELIKLGVHSGNFIQNILEGGELIKLGVCSRNFLRKPLERGVNLSIMGALRKTSSLSNLEGVHSSNWGCAQETS

SEQ ID NO: 178414 - protein, 680 aa, Glycine max
  Coding DNA Sequence Number=SeqID_61636
  Gene Ontology: Mol. function=metal ion binding
  Homolog annotation: Hit_ID=UPI0000196F38; Match level="QueryCoverage =99%, HitCoverage=100%, E-value=1e-124, Identity=40%"; Hit description=protein binding / ubiquitin-protein ligase/ zinc ion binding
  Pfam annotation: Domain name=PHD; Domain location=125-170; Score=2.2; E_value=0.035; Accession=PF00628.19; Description=PHD-finger
  Pfam annotation: Domain name=VWA; Domain location=292-466; Score =24.0; E_value=6.3e-05; Accession=PF00092.18; Description=von Willebrand factor type A domain
  Pfam annotation: Domain name=zf-C3HC4; Domain location=126-167; Score= 15.4; E_value=0.0041; Accession=PF00097.15; Description=Zinc finger, C3HC4 type (RING finger)
  Pfam module annotation: Pfam domain module=PHD::VWA::zf-C3HC4; Domain location=125-170::292-466::126-167
MVTGWRRAFCTSIPKDREPKVLTEKQQQQPQQQHCENTTTTTNNNNNNHSSKFGFFSNPSRPRCESQPSSTPSLRCQTTCSVPNSPKLQCKTKTPRLFHNSNPSSPKSPSSFSLLKSTLRISKSRCGICMQSVRSGQGTAIFTAECSHTFHFPCIVKKHPIVTCPVCNTSWKELPVLSINHNNDKCDKRGFKVYNDDEPLMSPTSLSRFNPIPESENEDEDEDDNIKTEFKGFNVNPLSNLPSSPAIRRNLELSLMPEVAIVAANRNYESYVVVLKLKPPHLTKPARRAPIDLVAVLDVGGAMSGNKLRLMKNSMRQVISSLRPTDRLSIVAFSAGSKRLLPLRRMTGGGQRSARRIVDALAAIDRTREGTPVKNDAVKKAAKVLEDRREKNVVASIVVLSDIKDSHAGISIHKPSLVSTTRLTHLEVPVHAVRLGESPHALSDDALAKFVGGLLNVVAQDVRIQLEVVSRSRAVEIAGVYSFSGRPVPLGSSGWIRLGDLYVEEEIELLVELKVPAASAGSHHVLTVRSSYRDPLTREPLNPVEQAMLVPRPHAVRSSCARIERLRNFHVTARAVAESSRLAEHNDLTGAHQLLSSARALLLQSSEPDEEFLRWLEAEQAELQRRRQRQTLRNSRVEEKAEPLTPTSAWRAAERLAKVAIMRKSMNRVSDLHGFENARF

SEQ ID NO: 178415 - protein, 136 aa, Glycine max
  Coding DNA Sequence Number=SeqID_61637
MTGRLLAGSLTIDCRIIHYIIVRILLPRSSNLAQASEEDLILMWAFLSGCQIDWAHLVRYRMHKALRANAPLPLSSIELRGLRTYVGERFDSLDGRFEGMDTRITQLEEDVNYIRQSFDLPPPPPPPSQFLDYYYC

SEQ ID NO: 178416 - protein, 60 aa, Glycine max
  Coding DNA Sequence Number=SeqID_61638
MVWRLQSPFLLLFSATIDLQEAKDSSDEEDSRHTSSTWSYIMRLRFRHKSHHLPFLNLHP

SEQ ID NO: 178417 - protein, 208 aa, Glycine max
  Coding DNA Sequence Number=SeqID_61639
  Homolog annotation: Hit_ID=Q9FGQ4; Match level="QueryCoverage=42%, HitCoverage=52%, E-value=9e-23, Identity=59%"; Hit description =Arabidopsis thaliana genomic DNA, chromosome 3, TAC clone:K5K13
MALCSVFLNLHLWLFVCLTIEALGVPKPSVASYLSQELLAEQEVDRVHGLLAQPPVKLNNMLVISLSMKLKEEICSIGFSRPPINRNKNPFSYGSMENHKPEGQEVSAAGVNIDNHMNEEGNAGALINFEVLDFLRAKGASQDPTRVIAKLPQFEYKVYDYLVDTVASVQTRESINEFLTSVKQYDLAKAEALNILNIGPAAYFELYP

SEQ ID NO: 178418 - protein, 46 aa, Glycine max
  Coding DNA Sequence Number=SeqID_61640
MVILTQPMVNHLSLVKFYTFPHFRSSNLRINLSELISWKYGENLFM

SEQ ID NO: 178419 - protein, 102 aa, Glycine max
  Coding DNA Sequence Number=SeqID_61641
  Gene Ontology: Mol. function=transferase activity, transferring glycosyl groups; Cellular component=integral to membrane; Biological process=glucan biosynthetic process
  Homolog annotation: Hit_ID=Q1KVP6; Match level="QueryCoverage=99%, HitCoverage=11%, E-value=9e-22, Identity=47%"; Hit description =Starch synthase IV
  Pfam annotation: Domain name=Glyco_transf_5; Domain location=1-102; Score=-113.8; E_value=0.0028; Accession=PF08323.2; Description =Starch synthase catalytic domain
MTPLVPRGSVASYVTGISRALQRKGHLVEVILPKYASLNLDEVQGLHEVNVEVTSYFNGQLHGNRIWTGVVFGIGVTLIEPKYYSSFFSHEMIYGYPDDFER

SEQ ID NO: 178420 - protein, 138 aa, Glycine max
  Coding DNA Sequence Number=SeqID_61642
MSQSMCDDDQNVKQDNIWQLFKEAQQNILYLNKQRLGAIEKLDKTNREKQSLLSKIKKLEAEKQAGAGKDNLSTCSELLLRIDAMVLSSMISAGEASELRSLVMNHKVSLADVFNIISHKKDPELLGELRRFSDGHKK

SEQ ID NO: 178421 - protein, 297 aa, Glycine max
  Coding DNA Sequence Number=SeqID_61643
  Gene Ontology: Mol. function=binding; Cellular component=integral to membrane; Biological process=transport
  Homolog annotation: Hit_ID=Q9AYL3; Match level="QueryCoverage=99%, HitCoverage=100%, E-value=1e-129, Identity=75%"; Hit description =Putative carnitine/acylcarnitine translocase
  Pfam annotation: Domain name=Mito_carr; Domain location=103-203; Score=94.3; E_value=3.7e-25; Accession=PF00153.17; Description =Mitochondrial carrier protein
  Pfam annotation: Domain name=Mito_carr; Domain location=211-297; Score=95.8; E_value=1.3e-25; Accession=PF00153.17; Description =Mitochondrial carrier protein
  Pfam annotation: Domain name=Mito_carr; Domain location=3-98; Score =95.0; E_value=2.3e-25; Accession=PF00153.17; Description =Mitochondrial carrier protein
  Pfam module annotation: Pfam domain module=Mito_carr::Mito_carr::Mito_ carr; Domain location=103-203::211-297::3-98
MGDVAKDLTAGTVGGAAQLIVGHPFDTIKVKLQSQPTPLPGQLPKYSGAIDAVKQTVAAEGPRGLYKGMGAPLATVAAFNAVLFTVRGQMEALLRSHPGATLTINQQVVCGAGAGVAVSFLACPTELIKCRLQAQSVLAGTGTAAVAVKYGGPMDVARQVLRSEGGVKGLFKGLVPTMAREVPGNAAMFGVYEALKRLLAGGTDTSGLGRGSLMLAGGVAGAAFWLMVYPTDVVKSVIQVDDYKNPKFSGSIDAFRRISASEGIKGLYKGFGPAMARSVPANAACFLAYEMTRSALG

SEQ ID NO: 178422 - protein, 176 aa, Glycine max
  Coding DNA Sequence Number=SeqID_61644
  Gene Ontology: Biological process=response to biotic stimulus
  Homolog annotation: Hit_ID=Q25BJ6; Match level="QueryCoverage=76%, HitCoverage=47%, E-value=9e-44, Identity=74%"; Hit description =Streptomyces cyclase/dehydrase family protein
MEKAESSASTSEPDSDENHHRHPTNHHINPPSGLTPLDPKPTSTSSRAAPSKSPFTWPSAVTRDVNVISGLPAATSTERLDLLDDIRCVTGFSIIGGEHRLRNYRSVTTVHSFEDDADDGKIYTVVLESYVVDVPDGNTEEDTRLFADTVVKLNLQKLASVTEGTNRDGDGKSHSR

SEQ ID NO: 178423 - protein, 68 aa, Glycine max
  Coding DNA Sequence Number=SeqID_61645
MRKGKESDLGPFEIIQLDTSCQLDTKERGKLGDRERQGGIEATKTSFFRRGKCSNADAPVRNLEKAFV

SEQ ID NO: 178424 - protein, 119 aa, Glycine max
  Coding DNA Sequence Number=SeqID_61646
MASYGAKESIDEEDPRPTSSNGAYINLCKSYCHLNLLGSSVFSFEQLDISWETIGHPSIPHDVAPCGACRPWMFFINEVLCFLKMNGSRMEKEDGWRCHFKEKMSQEEANDHRKPWIRS

SEQ ID NO: 178425 - protein, 86 aa, Glycine max
  Coding DNA Sequence Number=SeqID_61647
MEKEMITMIVDTLSMFYYEKMVGYMPSSFADLAFADRRIEVGLKRGKFDYPALMNEKTGANREDAKEEGTHVVIVVPTWSNFPPAQ

SEQ ID NO: 178426 - protein, 67 aa, Glycine max
  Coding DNA Sequence Number=SeqID_61648
MKNDEKRRKEGSGCCPARPRELGCFHQKAPPSVGTPLKAQNFTDCATMLAFDFQNVAELHELPNDGS

SEQ ID NO: 178427 - protein, 93 aa, Glycine max
  Coding DNA Sequence Number=SeqID_61649
  Gene Ontology: Mol. function=transition metal ion binding; Cellular component=cytoplasm; Biological process=cytoskeleton organization and biogenesis
CGVSRYKVKDDDECSTDENSKGPPAKVLWYLPIISRFKRMFANGDDTKYLTWHANGRNCDGMLHHPTNSSQWKKIDHLYSDFGKEARNIRTSH

SEQ ID NO: 178428 - protein, 335 aa, Glycine max
  Coding DNA Sequence Number=SeqID_61650
  Homolog annotation: Hit_ID=Q8P8A3; Match level="QueryCoverage=23%, HitCoverage=19%, E-value=3e-17, Identity=61%"; Hit description=ATP -binding component of putrescine transport system
RVQALAIEGDAALGGRLEAAQAAQQGRFATAGATEQGKDLALAHVQVDVVDGDETVEFLAQVTNGEIAGRTGRVDDGGYRLGFNGHGGSGSGRWTAAAILTAGGRRGYDGGRWQRPLAGLGVPRGVGFPPPWWPVRSKAWAPLDDPAAIPARRHGRWPDLQRFSEPDVLKARDIPRAMPRIKALHGPTLVISADSPSPFPPRLPGSLPARLPLVIIGAGQAGLSLSALLQEAGVAHRVLEAETVGASWQRRWESFQTNTANATMALHGHAYAGDDPEGFMGAPEVIRHLREYAHERSLPISEGCVVHRVGPESGGYCHRQQPGADPCPRSGGRHR

SEQ ID NO: 178429 - protein, 79 aa, Glycine max
  Coding DNA Sequence Number=SeqID_61651
  Subcellular localization annotation: CTP_CleavageSite=35; ConfidenceScore=5.29e-01
MAQPGILGPGPQPPPSPGLMFPLSPSGFFPISSPSCFLLTGEILGLLVEYLVPMQTHEHVHAIQNMSLLMYYSDLHAMP

SEQ ID NO: 178430 - protein, 157 aa, Glycine max
  Coding DNA Sequence Number=SeqID_61652
  Pfam annotation: Domain name=VQ; Domain location=38-68; Score=45.0; E_ value=2.5e-10; Accession=PF05678.4; Description=VQ motif
MDNSKNRHNDSLGVNKLGKNIRKSPLHQPNFANNAARQQPQPQVYNISKNDFRDIVQQLTGSPSQDPPPRPPHNPPKPQSMRLQKIRPPPLTPINRPRMPPPMPMPAAPPSVPYNNAIPRPAQFGQPPTPPGDIWSNTTESPISAYMRYLQNSLLDP

SEQ ID NO: 178431 - protein, 179 aa, Glycine max
  Coding DNA Sequence Number=SeqID_61653
MPKYSNQVVLISSIFKSSLATHHHHHVFIPLHSLWPNLYKLIPSPPHSTNLPTNIRKSWFWLLETQEINNTMSLNCLTCSQLLQRTDSYGELFAEKEYTKICKQVDRSLSSNMSSSTSKCELPKGGAVAKVKAGHRRNYSTGDVPYPPGSPGPTLVRSSGMRRNWSFEDVAEKKDQGVS

SEQ ID NO: 178432 - protein, 82 aa, Glycine max
  Coding DNA Sequence Number=SeqID_61654
MTFLGETSSQTIVNSRLSFIFPNGSIIHNDTGVYFQTSTPVPIQVPNSYDFASLKTRIHNTFQLSDKQFLDEIHYRKPFTDT

SEQ ID NO: 178433 - protein, 116 aa, Glycine max
  Coding DNA Sequence Number=SeqID_61655
  Gene Ontology: Cellular component=membrane
  Homolog annotation: Hit_ID=Q9SUD5; Match level="QueryCoverage=86%, HitCoverage=29%, E-value=1e-12, Identity=38%"; Hit description =Medicago nodulin N21-like protein
MAGLASNLPLIVMIGLQIHYAALAIFTRAALLDGLSTTVFVVYRQGIATLALAPIFFSPKRRQSVKDSLGFRSFFLMFVTALVGYTTLPNSLSHGKSECILQRIILCIFYCSYRYE

SEQ ID NO: 178434 - protein, 161 aa, Glycine max
  Coding DNA Sequence Number=SeqID_61656
  Gene Ontology: Mol. function=molecular_function; Cellular component =membrane; Biological process=auxin mediated signaling pathway
  Homolog annotation: Hit_ID=Q3LSN0; Match level="QueryCoverage=88%, HitCoverage=69%, E-value=2e-56, Identity=77%"; Hit description =Nodulin-like protein
  Pfam annotation: Domain name=DUF6; Domain location=4-111; Score=-1.4; E_value=0.08; Accession=PF00892.11; Description=Integral membrane protein DUF6
MIPFSMSGSDTSSTQQAALFALLSESDLQAWILQSPLQISCSLYAGIGIAVSFFIQSWCISERGPLYCAMFNPLATVITALISATFLEEEVYVGSLVGAVGVIAGLYVVLWGKAKEFAEIKPEAPQSSNLLDDEISSRIDLEQPLLSEKLSEHATEADSKV

SEQ ID NO: 178435 - protein, 40 aa, Glycine max
  Coding DNA Sequence Number=SeqID_61657
MEIIWDIPFIPEPNQTLTYVMSSRSTSLEPKSQLTINLDP

SEQ ID NO: 178436 - protein, 216 aa, Glycine max
  Coding DNA Sequence Number=SeqID_61658
MSSRKRKSIGARPTAQYDTRRFHSFEAWTIYTDNVLGRHILAERKVEIYHMELDEFKAELERCNFHKRFTNLADSSIDLALVKEFYANLHSPEGPSPKQVRIRGHLIKIDADSLNTFLETLVVLAKGESLPAYSRYCRMPTDIREIEDALCILGRGFVLNAEGHPGKILRKDLTTLAQVWSVLSYSNLAPTSHTSDLTLDRARLIFGLVSQLDMNV

SEQ ID NO: 178437 - protein, 38 aa, Glycine max
  Coding DNA Sequence Number=SeqID_61659
MESPPLCSVIITKKLCPLLAMNPKAENYKQLDLDPELG

SEQ ID NO: 178438 - protein, 131 aa, Glycine max
  Coding DNA Sequence Number=SeqID_61660
MRGVPTNGTPMLKREPWVLDYRGCYNSITTLLITCNNLINGDLQLRESFVVSYRPCIRQIGQVSTKIQKTKRRYEQGTHNLQWILAMHKNERYGKWKNGLKARIVKALDLEGSLDLGKERIVKVLDLQMIS

SEQ ID NO: 178439 - protein, 196 aa, Glycine max
  Coding DNA Sequence Number=SeqID_61661
MGVILLDGVDAFEISVGEHYRRKASRVRLLAFVGDGVHTFVGPIVFSIVVMVAMVSIVLSSIQSRSGRRVYNAHTLVPSTKADTYPICVACSACVNRSLYYFFLSHTFVKPGIVCLTGMRIILGALVDHVSGVFVPLEFLRVVAFHLYNAGLKLVENIIVYHGRWRGIGIFWEWLSPETRSCADHKCVLKKDDGTQ

SEQ ID NO: 178440 - protein, 61 aa, Glycine max
  Coding DNA Sequence Number=SeqID_61662
PGDQPSSFGGGGAIAAQKPVTEEPPASAPVEEETTAEETQPSTPVAEPEQPRIHQQLQHWI

SEQ ID NO: 178441 - protein, 81 aa, Glycine max; identical to SEQ ID NO: 134209
  Coding DNA Sequence Number=SeqID_61663
  Subcellular localization annotation: CTP_CleavageSite=39; ConfidenceScore=5.04e-01

SEQ ID NO: 178442 - protein, 69 aa, Glycine max
  Coding DNA Sequence Number=SeqID_61664
  Subcellular localization annotation: CTP_CleavageSite=34; ConfidenceScore=5.37e-01
MRVYLMVTRTFGQPGANEPVGARRLTSSSAPFVVLTRETNIVFCTFFRPDPCSQVTCGVSLWLPAPFVK

SEQ ID NO: 178443 - protein, 88 aa, Glycine max
  Coding DNA Sequence Number=SeqID_61665
SIVERYITEEAIEFCLEYIEKAKPVGLPESRHDKIVGDPCDERWLVVLHKKTIGVNVEDDDSYIDTYVSPLSIQMSPNVIVEEEEVDD

SEQ ID NO: 178444 - protein, 54 aa, Glycine max
  Coding DNA Sequence Number=SeqID_61666
MLNVFGCMTYYHDLGKAEDVTKQVEFESSTIRNISDKKQFEALDEIDQDLQMHT

SEQ ID NO: 178445 - protein, 139 aa, Glycine max
  Coding DNA Sequence Number=SeqID_61667
  Gene Ontology: Mol. function=DNA binding
  Homolog annotation: Hit_ID=Q1RY71; Match level="QueryCoverage=44%, HitCoverage=13%, E-value=2e-16, Identity=62%"; Hit description=Bromo adjacent region; Transcription elongation factor S-II, central region
  Subcellular localization annotation: CTP_CleavageSite=64; ConfidenceScore=5.18e-01
GRSLWKNASNAAFLRFLAFCWPFAHMFFPALSPDSVDNRITAFEKRKSAQYANRLSPRVGRFINAAGTTGFPTGKRALECTACGHSWFASRDEVSELTIDASDSKRSVGTAPWATAKFEDVEKKLSRKDGNIQASKLAD

SEQ ID NO: 178446 - protein, 102 aa, Glycine max
  Coding DNA Sequence Number=SeqID_61668
MDNHLGISACPLTSLVSIDRNFLCMDNTWGISVRHLTSRVRMTESAEDDVNLRVSTGSLAAIDKGCRRRRYLRTSPDFTGQDDRKCGRRRKSPRVNGLVGRD

SEQ ID NO: 178447 - protein, 128 aa, Glycine max
  Coding DNA Sequence Number=SeqID_61669
  Gene Ontology: Cellular component=integral to membrane
  Homolog annotation: Hit_ID=Q02LX6; Match level="QueryCoverage=93%, HitCoverage=89%, E-value=8e-29, Identity=51%"; Hit description =Putative small intergral membrane protein
  Pfam annotation: Domain name=DUF1452; Domain location=1-110; Score =154.1; E_value=3.8e-43; Accession=PF07300.2; Description=Protein of unknown function (DUF1452)
MARLSGSLGAFVAALGVIITWAASGPAFHFNDTWQLVVNTGTTIVTFLMVFLIQHTQNADTAALHIKLDELIRVSKDANQELLNLESMEPAHLEEIRQRYEALAKTAADIKSKKERCMPCDADAAAEA

SEQ ID NO: 178448 - protein, 255 aa, Glycine max
  Coding DNA Sequence Number=SeqID_61670
  Gene Ontology: Mol. function=thiamin pyrophosphate binding; Cellular component=cytoplasm; Biological process=branched chain family amino acid catabolic process
  Homolog annotation: Hit_ID=P71323; Match level="QueryCoverage=100%, HitCoverage=46%, E-value=9e-88, Identity=65%"; Hit description =Indolepyruvate decarboxylase
  Pfam annotation: Domain name=TPP_enzyme_N; Domain location=4-179; Score=226.0; E_value=8.4e-65; Accession=PF02776.8; Description =Thiamine pyrophosphate enzyme, N-term
MNTLNVGDYLLHRLHQAGIRHLFGVPGDYNLQFLDSVIDHPGITWVGCANELNAAYAADGYGRCNGAAALLTTFGVGELSAINGIAGSYAEYVPVIHIVGAPASHAQQQGDCVHHSLGDGDFGHFLRMAQEVSAASAVLSADNAVAEIDRVIASALQQHRPGYLLLAVDVAAATVTLPSASASPAPAENRDVAQAFAAAAERLLAPAQRVALLADFLAARWQLQAPLAELRALRAIPAATLLMGKGVLDEQQPGF

SEQ ID NO: 178449 - protein, 66 aa, Glycine max
  Coding DNA Sequence Number=SeqID_61671
MALDLVAYWSATCRRQHSSLCRRADVDSGGGGAASVARCWPSPGCCGASSYACLGAWISTSLLAVV

SEQ ID NO: 178450 - protein, 101 aa, Glycine max
  Coding DNA Sequence Number=SeqID_61672
MTKGAEDDVSLCASTGSFPLIDKRASPRANGLLGHVQGEKVTDAQDFGWQSKGEDHFRRGWAFSPWVKVYGELGFWLKACRTAGHDICQSVGLASDSGIKG

SEQ ID NO: 178451 - protein, 97 aa, Glycine max
  Coding DNA Sequence Number=SeqID_61673
  Subcellular localization annotation: CTP_CleavageSite=37; ConfidenceScore=5.44e-01
MSNSLFVFSNILRNSLTRMTLSSWKNKLNRYFMFKTLVMKGGRWFYTGKQLVLMLKMMIRSLILMLVLCPHKSRLPSSEKKKMMTFMQIVMIMMKEN

SEQ ID NO: 178452 - protein, 83 aa, Glycine max
  Coding DNA Sequence Number=SeqID_61674
  Gene Ontology: Mol. function=DNA binding; Cellular component=nucleus; Biological process=regulation of transcription, DNA-dependent
  Homolog annotation: Hit_ID=Q6R074; Match level="QueryCoverage=48%, HitCoverage=15%, E-value=4e-12, Identity=73%"; Hit description=MYB transcription factor
MAGHMGRGVIEEQVWRKGPWTAEGDKLLVEYVRLHGEGRWNSVARLATNKNSEYFDILTLTVARSRHHSKEHDFGYGGGGNNR

SEQ ID NO: 178453 - protein, 549 aa, Glycine max
  Coding DNA Sequence Number=SeqID_61675
  Gene Ontology: Mol. function=two-component response regulator activity; Cellular component=nucleus; Biological process=two -component signal transduction system (phosphorelay)
  Homolog annotation: Hit_ID=Q1SGC3; Match level="QueryCoverage=99%, HitCoverage=96%, E-value=1e-158, Identity=56%"; Hit description =Response regulator, RegA/PrrA/ActR type
  Pfam annotation: Domain name=Myb_DNA-binding; Domain location=312 -362; Score=48.7; E_value=1.9e-11; Accession=PF00249.21; Description =Myb-like DNA-binding domain
MDYLAVGDRNLLLKTEVSMNTISTFCEENEALSAISSGLESFHIAIVEVSSSSGQGGFKFLENAKDLPTIMTSNNHCLNTMMKCIALGAVEFLRKPLSEDKLRNIWQHVVHKAFNARASILSESLKPVKESVVSMLQLQTDDEQHESRVSRDIEKVSRFVDNDHELSSGNDKYPAPSTPQLRQGTRLLDDGDCQEQTNCSTGKESGEHEGESKSVETTCGNLNAESTPQQRKSEITLVREEVESTPQQRKSEITLVKEEVDIVDASKGESVASPHTQKRKVLSNTDRNTKALIKVGVHSDSCEIRGNQKKIKVDWTPELHKTFVKAVEQLGIDQAIPSRILELMKVEGLTRHNVASHLQKYRMHKRQILPKEERKWLNLRERSYCVKRPIMAFPPYHSNHTLPLPPVYPMWGQSGSPTAGMQIWGSPGYPFWHTTAENWHWKPFPGMHADAWGCPVLPLPPPQTPGFPYSQNMPSLLNADAVDHTFTMPQSSFEHYPAEEVVDKVVKEAISKPWLPLPLGLKPPSPDSVLAELSRQGISNIPPKGSNSC

SEQ ID NO: 178454 - protein, 148 aa, Glycine max
  Coding DNA Sequence Number=SeqID_61676
  Homolog annotation: Hit_ID=Q1SGC3; Match level="QueryCoverage=25%, HitCoverage=6%, E-value=4e-09, Identity=76%"; Hit description =Response regulator, RegA/PrrA/ActR type
MGPTLPTMGQKWELLDVDKEVRHANTKRRNPKSQTIVVHGFKLCPYLGSRNVVSLKEKNLEPFGKIFPFLSTPKTRFRSKQPCPFITNETAGKSQKTYIPTNFSGNIFYTIQNQKPPLLYFKDLISMADATFTKQQTDNYPIPVIEIS

SEQ ID NO: 178455 - protein, 84 aa, Glycine max
  Coding DNA Sequence Number=SeqID_61677
  Gene Ontology: Mol. function=RNA-directed DNA polymerase activity; Biological process=RNA-dependent DNA replication
  Homolog annotation: Hit_ID=Q1SYP9; Match level="QueryCoverage=97%, HitCoverage=8%, E-value=2e-16, Identity=53%"; Hit description=Myb, DNA-binding
MVEDPLNLGKFRPISLVNSLDKILAKILAKRWSRVLPKIIYERQSAFLGGRSLLHSELVANEVVDETKRKKKKWLVFKENYEKA

SEQ ID NO: 178456 - protein, 78 aa, Glycine max
  Coding DNA Sequence Number=SeqID_61678
MAVSAIDDNNGGRRSNAKEKTNVKKNHTHSPTQKREEEMRRTMKELKRQEAETPRAVKKMESRRRTRRRLKKQMIEED

SEQ ID NO: 178457 - protein, 113 aa, Glycine max
  Coding DNA Sequence Number=SeqID_61679
MELANIQQDEYESLRDFMERQPVQEITYNIGRVESKDCQIHPDGRDDQIQRESMWLIIKETNGVRDQDLECNTPDCQLLGGSHITTLHMMTLHSTCLLVRTLHKLEPFVGSPF

SEQ ID NO: 178458 - protein, 158 aa, Glycine max
  Coding DNA Sequence Number=SeqID_61680
  Homolog annotation: Hit_ID=Q2HRX8; Match level="QueryCoverage=57%, HitCoverage=11%, E-value=1e-08, Identity=37%"; Hit description=IMP dehydrogenase/GMP reductase
MTRRRPLHGSWACWIYEHFPTVHTSVVHDAYDEGSPRACRWLTSKAHMTGIKGAPYRRRLDALSVTDVCWMPNGEHRGVRAFDLISSYTGQLRWGQIVHPFVTRTEETVAPRHLPPPHHEEFVEPPIPEVSVATDLPMHSVVHYERIVRDGSGFRSDC

SEQ ID NO: 178459 - protein, 69 aa, Glycine max
  Coding DNA Sequence Number=SeqID_61681
  Subcellular localization annotation: CTP_CleavageSite=63; ConfidenceScore=5.24e-01
MESSRLMAEEFKFIQFSTKFSRKITKKQQNMVCGRSFACSSVRRIGSLRKKVPQVLLRPGNVVCGTFFR

SEQ ID NO: 178460 - protein, 144 aa, Glycine max
  Coding DNA Sequence Number=SeqID_61682
AKRMWDTLAITNEGSFELKHNKLSLLTRKYELFGMEDGEDIQTIPQVTTLRAIKNLDSMTLEELVRILKVHELELAQDKEIKKGKSLALTEDLDDSSSDNDSEEEANLCLMVDASTSKAESELDASSDDEDSQPEDVVNSNGKE

SEQ ID NO: 178461 - protein, 141 aa, Glycine max
  Coding DNA Sequence Number=SeqID_61683
  Gene Ontology: Mol. function=nucleic acid binding
MWGGGGGPCTFDKQLFLININGSEVPSQVPMQEIPIWIEVHNIPLGLTTIAVGNFLDQFVDYDDKHNSSPLMSYMRIKVMIDVNKPLKCTKKIKKEGHNDDLCGKLFKVENDNGLSSWGPELRADARVLRPWKEALVILGK

SEQ ID NO: 178462 - protein, 56 aa, Glycine max
  Coding DNA Sequence Number=SeqID_61684
MGSSLAMRCSFRFDVCVCGCCEGDINWDEGWFCWSKEGVVVIVDMTIVETMAMVEE

SEQ ID NO: 178463 - protein, 328 aa, Glycine max
  Coding DNA Sequence Number=SeqID_61685
MGSNQAHPFKKRVSSSQGQAWKKQHALWCPYGTHARARVRSEIEEVQEQMKVDMEAMKEKMTTMMEAMMSMRRMMEVNAATVVATSTTIEVDPTHPPGFNEVNHLASDIVGQGGKALGSTGGPYFVQNVDNSAPIPIKSQQPQSDHAYVSQPMGETHEAPQDHNLADLKPHLRYATEGQAVGGVPLPNTLGGPQFRPQPQPLHFAVEKLLPSMVEWEKFDHIEERLRAIEGGRDYAFADMAKLCLMPNVVIPPKFKVPDFDKYKRTTCPKNNLKMYCRKMGAYAKDEKLLMHFFKESLTREAFTWYTNLESSRVHSWKDLMVSFIRQY

SEQ ID NO: 178464 - protein, 76 aa, Glycine max
  Coding DNA Sequence Number=SeqID_61686
  Subcellular localization annotation: CTP_CleavageSite=39; ConfidenceScore=5.06e-01
PSSFQDLLVLPLFGGAPPSENTGSRALLLQRGHPLFRLLQSIGENKTSPLSRTGIKALPPLTRLSEKQMVKSRPTK

SEQ ID NO: 178465 - protein, 119 aa, Glycine max
  Coding DNA Sequence Number=SeqID_61687
  Subcellular localization annotation: CTP_CleavageSite=70; ConfidenceScore=5.39e-01
MKKIQVEVLPYRFRDVFVSKSVKIFHRSSPLFVHSSFVLRSSAVPSPSEGYTPSPSEGYTSSPSEGCTPSPSEGSTSSPSKDYMSSPSEDYTSSPSENYTSSPLKDYTPSPSEGYTPSP

SEQ ID NO: 178466 - protein, 100 aa, Glycine max
  Coding DNA Sequence Number=SeqID_61688
  Gene Ontology: Mol. function=transporter activity; Cellular component= membrane; Biological process=oligopeptide transport
  Homolog annotation: Hit_ID=Q9CAS0; Match level="QueryCoverage=84%, HitCoverage=13%, E-value=9e-17, Identity=45%"; Hit description =Putative peptide transporter; 37139-33250
MFYNTESLDKMKSIGNSLQYLVVAFSIYIGTLLVNVVHQLTRKHGGIDWLNDDINAGRLDYYYFLMAGLALINLIYILFCVKHYRYKVNVEEKVVEKLEP

SEQ ID NO: 178467 - protein, 74 aa, Glycine max
  Coding DNA Sequence Number=SeqID_61689
MSASSGQDCEKVSISQLGPVSPIACGDTLWLSAPRHLETPSPIDKQRPMWSSAPFPEMSASSSRDREKVSILLS

SEQ ID NO: 178468 - protein, 332 aa, Glycine max
  Coding DNA Sequence Number=SeqID_61690
  Homolog annotation: Hit_ID=UPI000044A8F0; Match level="QueryCoverage =40%, HitCoverage=100%, E-value=1e-18, Identity=31%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LTFRGLQVLAFRELHALAFRGLHTLAFRRLHALTFRGLHALAFRGLHALAFRGLHALAFRGLHVLAFRGLPTLAFRGLHALAFRGLHALAFRGLHAFAFRGLHVLTFRGLHVVAFRGLNVLAFRGLNICAFRELKGDECGSCVPPQLRSPPTEESASLCHHDIGIVPTRHSVGPDKSKRVLGFPALITCLCQFYRVPIAPSRVIRPLLTGLSSRSTTPLGRHRARHHSSGQQMHHHHLQSPPQLIYKGWSITYDTWPTSRRPTTRAGTSRYCVRDRQIVIMHLAQDVKEALLGGNLELATKKLPTKQSRKGTIEEDFSVAPQADTSFDKHQF

SEQ ID NO: 178469 - protein, 125 aa, Glycine max
  Coding DNA Sequence Number=SeqID_61691
MSHAVKDNRGKWAPNYEGPFVVKRAFSGGALVLTNMDGEELPSPGQDHLELPFGVGTKHEQQKPIKVLWNGCKWGMGSQPTGRCPFSALNKQRTSLQGSPVSFVFTVFFYYLFVLKISNQRLILT

SEQ ID NO: 178470 - protein, 294 aa, Glycine max
  Coding DNA Sequence Number=SeqID_61692
TNIRGDDFDTLRKDTDLDKSLSIDSSIEDSKPLGIVDEKEVSEPKSSASLDSSLPVCSDNSNDNMQMEMKNHSNKICPEKQELTKPDYQGSNLDRDLVAISSPDMVACKKIESESKDFSTKESSNGLIKNPVSMRNRKFASDVKFDSKCQQATKVVDQECTLGSSEDPSNLASSKVVGDTKINLESQLRMKLSHGKTSNASSSKLPLALPSPKAPSESWLKRTLPTVPSKSISLRSNLATYFHAPVKTSEVNHGHLQFAQGPKNFFFWGLKLMPNLSCILQGRDLELLPPIPEA

SEQ ID NO: 178471 - protein, 82 aa, Glycine max
  Coding DNA Sequence Number=SeqID_61693
  Pfam annotation: Domain name=SWIM; Domain location=35-67; Score=16.1; E_value=0.0081; Accession=PF04434.8; Description=SWIM zinc finger
MYVIKAGHRYSEEETGEFQVQEIANTQLRRQAMTCTVKLNQWLCDCEEFQALQIPSSHSIAACASCNLNYDDFVDLRVGKYL

SEQ ID NO: 178472 - protein, 134 aa, Glycine max
  Coding DNA Sequence Number=SeqID_61694
MTGEEPIIRDHVSNFSDEDWEHDVHESGEPSNQKNKSEKYVVKCIQYGNGCHWRERASFSKIRRRWEMKKINGTTIRYKTSTSIEDGEDEFSKDMMQSYPSRALDRRLQEDWARDAREGPKILMSPMVDFGPMD

SEQ ID NO: 178473 - protein, 91 aa, Glycine max
  Coding DNA Sequence Number=SeqID_61695
EQNCPSPRSKVKPSQWQKSTKGWKRMKDRTATAQAPTIPDAKQAENVAARLKLGKTLTHEEGGDMGMALSLGCILKQWGMPHCPHSLAIHA

SEQ ID NO: 178474 - protein, 406 aa, Glycine max
  Coding DNA Sequence Number=SeqID_61696
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=100%, E-value=1e-35, Identity=31%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=34; ConfidenceScore=5.07e-01
SRATRPCLQRATRPCLQRTTRPPLQRNTCPRLKRATILGFRRLHALAIKRLNALAFRGPHILAFRGLHVLAFRRLHVLAFRAPQRATRPHNQKATRPSLAFRGRHILAVRGLHVLAFRGLHAFAFRGLNVLPFRGLHILAFRGLHVLAIRGLHVLAFIGQHVLALRGLHALTFVGRLVLTFRGVHSLAFRGLHILAFRGLHVVPFIGLDVLAFRGLHALTIRGLHALDFRGLHGVTFRGLQVLAIRGLQALTFRGQHVLTFRRLDVRTFRGLHALASIIEDSTSSPTEDYTSWPSQGYTPSPLKEYTSSASEDYNLRLKRTTCPHLQRDTRLGLPRTTRPHVKRATRPRLQRTTRPRLQRTTRPHLQRTTRLLLQMVTIPRHQISTRPRLRRTTRPRPQRATGPHL

SEQ ID NO: 178475 - protein, 34 aa, Glycine max
  Coding DNA Sequence Number=SeqID_61697
MGTRNEPNYLSEIGTCAPNFHEVDYFTWANSYYT

SEQ ID NO: 178476 - protein, 251 aa, Glycine max
  Coding DNA Sequence Number=SeqID_61698
  Gene Ontology: Mol. function=chromatin binding; Cellular component =chromatin; Biological process=chromatin assembly or disassembly
  Homolog annotation: Hit_ID=Q1SAV4; Match level="QueryCoverage=98%, HitCoverage=62%, E-value=3e-66, Identity=49%"; Hit description =Integrase, catalytic region
  Pfam annotation: Domain name=Chromo; Domain location=195-243; Score =12.4; E_value=0.034; Accession=PF00385.14; Description='chromo' (CHRromatin Organisation MOdifier
MNRVLEQYLRCFVHSQPTTWFRYLALAEWSYNTSLHSSSGLTPFEITYGKPPPTVLDYIPGTTNNEAVHSLLETRQTMHSKLQRRLKQAQERMKAHADARREDISFEEGQWVYVKLRPGRQSSIIGRPYQKLSKRFFGPFQVLERIGAVAYRLQLPSESRIHPVFHCSLLRLHHGPPPDEHTPCPLLFRDQRPLRKPLCFLDMKIDPSSTTPTPLVLTQWVGEPLKDTSWEPWPELRDTYHLEDKVVLGGE

SEQ ID NO: 178477 - protein, 71 aa, Glycine max
  Coding DNA Sequence Number=SeqID_61699
  Pfam annotation: Domain name=GRP; Domain location=19-69; Score=-24.6; E_value=0.025; Accession=PF07172.2; Description=Glycine rich protein family
MARHFLDAHANEAGLVLHSSPMFLFLMIVASLSIISMIIFACGDDNKRTNKGGGGGGGGCGGGGCGGGCGG

SEQ ID NO: 178478 - protein, 91 aa, Glycine max
  Coding DNA Sequence Number=SeqID_61700
  Pfam annotation: Domain name=GRP; Domain location=21-91; Score=-3.0; E_value=0.00014; Accession=PF07172.2; Description=Glycine rich protein family
MARDFLDAHANEAGLVLHSGPIFLFLMIVASLSIISMIIFACSDDNKGKKKVGGGGGCGGGGGGGCGGGGGCGGGGGGGGCGGGGGGGGGC

SEQ ID NO: 178479 - protein, 112 aa, Glycine max
  Coding DNA Sequence Number=SeqID_61701
  Gene Ontology: Mol. function=RNA-directed DNA polymerase activity; Biological process=RNA-dependent DNA replication
MAFKALQLTQKRHKPSCFLTNNTGDENGLVLGRIMPLLSKTDLSFDFLHLIIRVPVGSNVDGFRIGYQVYDVVGGAGWWKGRWCVEQGCELGEEIGDFWVVNSLASVPNHYK

SEQ ID NO: 178480 - protein, 146 aa, Glycine max
  Coding DNA Sequence Number=SeqID_61702
MALMMDFIEVSLLSFERTFSKLDSECTGTLKPWTFQLQLANPVTITSIISDHTDKENVPPITCNNSTNKDKSKTLIPHIMAKSFKNMKCTKRMRKRVPLADITNLFNNFVTSITFTLSHQQQQFGVSSALPRRAPRTSKTLRMGFR

SEQ ID NO: 178481 - protein, 719 aa, Glycine max
  Coding DNA Sequence Number=SeqID_61703
  Gene Ontology: Mol. function=RNA-directed DNA polymerase activity; Cellular component=chromatin; Biological process=chromatin assembly or disassembly
  Pfam annotation: Domain name=Chromo; Domain location=613-663; Score =20.2; E_value=0.004; Accession=PF00385.14; Description='chromo' (CHRromatin Organisation MOdifier
  Pfam annotation: Domain name=rve; Domain location=321-464; Score =33.3; E_value=8.8e-07; Accession=PF00665.16; Description=Integrase core domain
  Pfam module annotation: Pfam domain module=Chromo::rve; Domain location=613-663::321-464
MAFRTHHDHYEFCVMFIIVFFDDILIYNKTFTDNLEHLNTAFTVLLERHFFLKLTKCSFAQQQVEYLGHIVSQRGVELVPTKVEVIQVWPVPWTTRALHGFLGLSGFYCRFIKGYASIVAPLTHLLVKDQFQWSLKAQLAFDKLKEAICTTLVLSLSDLSQPFIVEMDAFDVDMGAVLNQPHHPIAFFSKPLYPKLLRSSTYVRELETITTTLKQQLYLAHLLGYDYSIQYCSGKANSVADALSRIHETPDLKEELQNYAKYRELRQNIVDDPQAHPTYTVTQDFIFQQNRIWLPQGCSFYSSIVERVSFNSDSGTHGTHQDPEPHRAELHLARNEDGCAKLYAIMPSVPANETASTVATLFMEIVGKLHGMPRSLVSDSDPLFVSHFRQELFKLSGTKLRMSFAYHPQSDEQTEVMNRVIEQYLRAFVHHHPSSWGKFIIWAEWLYNTYVHVATGLTPFEITCGKKPLNIPDYLAGTSNIDAMDDFLVNRDAVFAIVRKKLLKAQQAMKKFTDGNRRDVHFQEGDWVLVKLRPRRQVFVTRQGRPKLSKRYYSPFQISKTIGPVAYELALPPESRIHPVFHCSLLKPFHQSDQLTTQAVDLPLQLEDNDPIVTPLTILNTKWVTLDTGPELMVLIQWKGLLPEDTSWESWAQLKEIYHLEDKVLSDGHRDVMKQTIQGTNQNQGTSDKAESTIHSWSKRQITKPHYLRDFVTNPDKGC

SEQ ID NO: 178482 - protein, 64 aa, Glycine max
  Coding DNA Sequence Number=SeqID_61704
MAFMCNENSLASMIFIARYFPSCSPMFTRNFDQHPIVQGLGGGGESMQEYSVGHAELEDEMRGG

SEQ ID NO: 178483 - protein, 286 aa, Glycine max
  Coding DNA Sequence Number=SeqID_61705
  Gene Ontology: Mol. function=RNA-directed DNA polymerase activity; Cellular component=chromatin; Biological process=chromatin assembly or disassembly
  Pfam annotation: Domain name=RVP_2; Domain location=135-263; Score= -61.9; E_value=0.066; Accession=PF08284.2; Description=Retroviral aspartyl protease
MLTNRIIGLPAPFLLSCFVSGLAPEIRREVQALHPLTLVQAAGLARIQEEKLVDKHRGAFDCPHSCQPHPISTLLPPPPLTSLLLPSSAKPPPLHIHQKESTCANPNIDLSTQVPDPPAQDPTQAQISFYTLLSHLAPETLHLVGRVSQQSVIILIDGGSTHNFMHERLVRSLGLKAQLTHPLQVVVGNGNELACHQLCSGVMINIQGPPPVVRAWFSAFSIDLHVLPLYCADMVLSVQWLKSLGPILIDYNDLTLKFIHDGKMIELKGNVAGALQPVTPTQLRRM

SEQ ID NO: 178484 - protein, 88 aa, Glycine max
  Coding DNA Sequence Number=SeqID_61706
MENCTKQSLRMAPKKWGGCMNKNVIHGAPKKGREWRIALSNHYAWLQLVGGGRMNENAIHGAPKKGREWRIALSNHYAWLQTCRWEDA

SEQ ID NO: 178485 - protein, 48 aa, Glycine max
  Coding DNA Sequence Number=SeqID_61707
  Subcellular localization annotation: CTP_CleavageSite=6; ConfidenceScore=5.12e-01
MNDRIAGSAPGSSDLRPAFVSMSFYIGPSTVVVKCGFSMTPATTTAHN

SEQ ID NO: 178486 - protein, 92 aa, Glycine max
  Coding DNA Sequence Number=SeqID_61708
MLRNLTHHVIIPFFGFRDVTELYGSRNHPLFWLPRCYGTLRIVQQCFLLTSDMSWSFTNRLTMGSKYLEVVKRGSHPNNGWSPDEIRVWHMP

SEQ ID NO: 178487 - protein, 105 aa, Glycine max
  Coding DNA Sequence Number=SeqID_61709
  Homolog annotation: Hit_ID=Q1SDS1; Match level="QueryCoverage=66%, HitCoverage=13%, E-value=3e-08, Identity=40%"; Hit description=IMP dehydrogenase/GMP reductase
MANQEEWVPFADVLALLIFGVVLFPNVDGLVDLAAIDAFLAYHHSKESPMVAILGDLFDTFDRRCEKSSAQIICCLPALYEAEQSTGFLDGRKERREFSSHVGTT

SEQ ID NO: 178488 - protein, 303 aa, Glycine max
  Coding DNA Sequence Number=SeqID_61710
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q5K6L5; Match level="QueryCoverage=97%, HitCoverage=61%, E-value=2e-76, Identity=47%"; Hit description=Endo -1,4-beta-glucanase isoform 01
  Pfam annotation: Domain name=Glyco_hydro_9; Domain location=1-302; Score=165.6; E_value=1.3e-46; Accession=PF00759.9; Description =Glycosyl hydrolase family 9
MGPDLKHALDAIRWAREYFLKATSIHGFVFAQVGDPYAHHNCWERPEDMDTPRTAFAVSRDFPGSEVSVASSIVYSKYHLGYSTRLLQRAIKVFDFADKYRGSYNDSLGAWVCPFYCDFSGYQDELVWGAAWLFKATKRPNYVDYIDKNIHNLKNFAEFGWDSKDVGINVLVSKLLINSSSNSKPFILNNADKFVCSVLPESPSVLVSYSSGGLLFKPGGSNLQHATTISFLFLVYAGYLKQTNKEINCGGKVFASPKRLKQIERGQVDYILGSNPANMSYMVGYGAKYPERIHHCERRIILF

SEQ ID NO: 178489 - protein, 731 aa, Glycine max
  Coding DNA Sequence Number=SeqID_61711
  Gene Ontology: Biological process=multicellular organismal development
  Homolog annotation: Hit_ID=Q208P4; Match level="QueryCoverage=97%, HitCoverage=99%, E-value=0.0, Identity=73%"; Hit description=RAMOSUS4
  Subcellular localization annotation: CTP_CleavageSite=30; ConfidenceScore=5.10e-01
MRGWELGNILPENGATAASWAISRRRFCLNVFAAVSDTRTRNALSLVSWSFYRLERKTRTSLTLRGNARDLHLIPTSFKHVTHLDLSFLSPWGHALFCSSSSSAAAAAVDHQRHLAQHLRAAFPRVTSLAVYARDPDTLRLLLLSPWPELSAVKLVRWHQRPPTSANEADFAELFKKCRSLASLDLSSYYHWTEDIPTVLAANPISAAFLRRLNLLTTSLTEGFKSHEIESITASCPNLEHFLAVCNFDRRYIGSVSDDTLVSIASNCPKLSLLHLADTSSFSSRREEDEGFDGEDASISRAALMTLFSGLPLLEELVLDVCKNVRESSFAFEVVGSKCPNLRVLKLGQFQGICLAFESRLDGIALCHGLQSLSVGNCADLDDMGLIEIARGCSRLVRFELQGCRLVTERGLRTMACLLGRTLIDVRVSCCVNLDTAATLRALEPIREQIERLHVDCVWNGLKESDGLGHGFLSFDLNGLDEQDDVGKLMDYYFGGGECENTSKRKRQRCEYQMRVHDSFLESNGNGFYGKSWDKLQYLSLWIKVGDLLTPLPVAGLEDCPVLEEIRIKVEGDCRGQPKPAESEFGLSILACYPQLLKMQLDCGDTKGYALTAPSGQMDLSLWERFLLNGIGSLSLSELHYWPPQDEDVNQRSVSLPAAGLLQECYTLRKLFIHGTAHEHFMNFFLKIQNLRDVQLREDYYPAPENDMSTEMRVGSCSRFEDALNRRRICD

SEQ ID NO: 178490 - protein, 417 aa, Glycine max
  Coding DNA Sequence Number=SeqID_61712
  Gene Ontology: Mol. function=protein serine/threonine kinase activity; Cellular component=membrane; Biological process=protein amino acid phosphorylation
  Homolog annotation: Hit_ID=Q6ER39; Match level="QueryCoverage=91%, HitCoverage=49%, E-value=1e-141, Identity=64%"; Hit description=CTR1- like kinase kinase kinase-like
  Pfam annotation: Domain name=Pkinase; Domain location=177-409; Score =176.0; E_value=9.6e-50; Accession=PF00069.15; Description=Protein kinase domain
  Pfam annotation: Domain name=Pkinase_Tyr; Domain location=177-409; Score=182.4; E_value=1.1e-51; Accession=PF07714.7; Description =Protein tyrosine kinase
  Pfam module annotation: Pfam domain module=Pkinase::Pkinase_Tyr; Domain location=177-409::177-409
MMLASWISSEELSDPATSQMVLPHQKLVGYEEVSALHQRLVMILLGSNLCRAVRAMNETLKQNRLLREQGGDSSLSHSPIDRTSSADLQKNVSNFHLDNHHERSPLYLRDPVTSQKAMSLPSSPHDYRGQASERSKASEYILNDELEFTWNKILESPMFSNRPLLPYEEWNIDFTELTVGTRVGIGFFGEVFRGIWNGTDVAIKVFLEQDLTTENMEDFCNEISILRPPRLSMVTEYMEMGSLFYLIHVSGQKKKLSWRRRLKMLQDICRGLMHIHRMKIIHRDVKSANCLVDKHWIVKICDFGLSRIVTESPTRDSSSAGTPEWMAPELIRNEPFTEKCDIFSFGVIIWELCTLNRPWEGVPPERVVYTVANEGARLDIPDGPLGRLISECWAEPHERPSCEEILSRLVDIEYSMC

SEQ ID NO: 178491 - protein, 307 aa, Glycine max
  Coding DNA Sequence Number=SeqID_61713
  Gene Ontology: Mol. function=protein serine/threonine kinase activity; Cellular component=membrane; Biological process=protein amino acid phosphorylation
  Homolog annotation: Hit_ID=Q6ER39; Match level="QueryCoverage=94%, HitCoverage=36%, E-value=2e-91, Identity=59%"; Hit description=CTR1 -like kinase kinase kinase-like
MEETREDAGQPERRPSNMSWWPSDFVDKFESVSLSAQDETLNNKESPRHSNQDVMSPQKASQILWRTGMLSEPIPNGFYSVIPEKRLKKLFDSIPTLDELQAMGGEGFRADVIVVDAEKDRRLSMLKQLIVALVRGLNSNPPAMIKKIAGLVSDFYKPPNVESPAKAALEESCNMFENRGVQMLGQIRHGSCCPRAILFKVLADSVGLESRLMMGFPNDGAAECVDSYKHMSVIVVLNTVELLVDLMRFPGQLLPRSTKSILMTHISAAGESDSAENDSCDSPLEPNSPLYGVSESFLNHAIKSLLK

SEQ ID NO: 178492 - protein, 93 aa, Glycine max
  Coding DNA Sequence Number=SeqID_61714
  Subcellular localization annotation: CTP_CleavageSite=46; ConfidenceScore=5.38e-01
MTLSLRKTRQQVSRSPCRAQTTPLPHGDQPKSQGSSKPSDMPPSTTCTSIKKNMMQSYPARAFDRTLQEDWAKDAREGPGVLMSLRVDFGLMG

SEQ ID NO: 178493 - protein, 52 aa, Glycine max
  Coding DNA Sequence Number=SeqID_61715
MFAYSPFAKRKPHAKRIFVHALSHESQALSDQPLHLGLIWSAKLAKDKLSQL

SEQ ID NO: 178494 - protein, 150 aa, Glycine max
  Coding DNA Sequence Number=SeqID_61716
MTTITQIWMTLLLSNILPSDRNADLPLRKGRAHKTPSGPKEVQQVSGVSSSGYGPLSDLQGASIAPTKTPSRPREVQQGPGISSSGYGPLDRAHKTPSGPGEVQQGPGVSSSDYEPLQAEGETPQQPGDGQQQATNAPPPPPEPLISFTK

SEQ ID NO: 178495 - protein, 293 aa, Glycine max
  Coding DNA Sequence Number=SeqID_61717
  Gene Ontology: Mol. function=protein-tyrosine kinase activity; Biological process=protein amino acid phosphorylation
  Homolog annotation: Hit_ID=Q1RSI5; Match level="QueryCoverage=80%, HitCoverage=23%, E-value=1e-37, Identity=38%"; Hit description =Octicosapeptide/Phox/Bem1p; Protein kinase
  Pfam annotation: Domain name=PB1; Domain location=177-264; Score =97.4; E_value=4.2e-26; Accession=PF00564.15; Description=PB1 domain
MEPRNEEFQSGSQSVIQDHMDGMHTIRRPPDYSMSDFKPVLNYSIQTGEEFALEFMRDRVNLRKPVFSNVSDSHSNYATGCMELKGVLGISQAPSESGSDISMLSKAEKGSTEFNRQSTSLHGDRSNYGSIRSIPRTSLNQENSRFVRGYGSSVGSDSSSTMMKCLCSFGGRILPRPSDGKLRYVGGQTRIIRLRKDISWQELMQKALPIYNLVHVLKYQLPGEDLDALVSVSSEEDLQNMMEECNLLEDRERSQKLRLFLFSLSDLEDAQFALGSIGGDSQLNPTRCQFFSR

SEQ ID NO: 178496 - protein, 50 aa, Glycine max
  Coding DNA Sequence Number=SeqID_61718
MSATDGGDDVDKSGLRIGRKLSDEEDDPCTWNYFENLQTLARDWIRFQVE

SEQ ID NO: 178497 - protein, 93 aa, Glycine max
  Coding DNA Sequence Number=SeqID_61719
MEFLGSTSKRRHFAGIALSELVLLSKLFPLDGIALNELVSCKKHAKHDSNLRGNCAECELSRLAQEELHSARIVVLNANSNPRGIALSVKIRA

SEQ ID NO: 178498 - protein, 92 aa, Glycine max
  Coding DNA Sequence Number=SeqID_61720
MQQGKTYIAIVKIHDPNYGERIRSQDYLREAMKERIEGLFSTESLRLILRIPLRLKCSSQCGGSTATNGGPWWLLVVVGVGGGISRVAWTEF

SEQ ID NO: 178499 - protein, 133 aa, Glycine max
  Coding DNA Sequence Number=SeqID_61721
MKKKALSPFEDIVVFKKHCRLLKTLSSSEYSKKGADDQWSSHAIELDCLWMAKIKARTLSPIKARTLSPMKKEDFKSYKGEDFESYEKRVRTLSPMKARTLSPMKASLIPMKARTLSPMKASLIPIKARPQNN

SEQ ID NO: 178500 - protein, 192 aa, Glycine max
  Coding DNA Sequence Number=SeqID_61722
MLIYGLVMQRDMNLGPLMSGQISLIAQHDSSRLCFPALITALCKARGVSSDSLTFESLSPAINLALLKRITGTWMALCTSISSSYRFSCSELRAFLVYAAEPASIEAKLHGESRMITKDDDKNLKGLSKNEFKIFKIESRTLQDSRGKLISRIKIQEIKISRIKIQEIKIQDSRIKSRLNQDKYEKVFLKIE

SEQ ID NO: 178501 - protein, 103 aa, Glycine max
  Coding DNA Sequence Number=SeqID_61723
GSIVVAIVKEFYANLYDLEEKSPKQVRVRGHLIKFDVDALNTFLKTPVVIEEGESLPSYSSFANLRPVSQKLAAHLCIPGRGFKLNADGLPLKILRKNLTTLA

SEQ ID NO: 178502 - protein, 499 aa, Glycine max
  Coding DNA Sequence Number=SeqID_61724
  Gene Ontology: Mol. function=protein kinase activity; Cellular component=integral to membrane; Biological process=protein amino acid phosphorylation
  Homolog annotation: Hit_ID=Q2QWU6; Match level="QueryCoverage=90%, HitCoverage=68%, E-value=7e-84, Identity=38%"; Hit description =Leucine Rich Repeat family protein, expressed
  Pfam annotation: Domain name=LRR_1; Domain location=123-145; Score =9.9; E_value=4; Accession=PF00560.23; Description=Leucine Rich Repeat
  Pfam annotation: Domain name=LRR_1; Domain location=147-169; Score =8.7; E_value=6.7; Accession=PF00560.23; Description=Leucine Rich Repeat
  Pfam annotation: Domain name=LRR_1; Domain location=171-193; Score =0.9; E_value=1.9e+02; Accession=PF00560.23; Description=Leucine Rich Repeat
  Pfam annotation: Domain name=LRR_1; Domain location=195-217; Score =14.3; E_value=0.46; Accession=PF00560.23; Description=Leucine Rich Repeat
  Pfam annotation: Domain name=LRR_1; Domain location=219-240; Score =5.9; E_value=23; Accession=PF00560.23; Description=Leucine Rich Repeat
  Pfam annotation: Domain name=LRR_1; Domain location=265-287; Score =12.0; E_value=1.6; Accession=PF00560.23; Description=Leucine Rich Repeat
  Pfam annotation: Domain name=LRR_1; Domain location=74-97; Score =11.2; E_value=2.3; Accession=PF00560.23; Description=Leucine Rich Repeat
  Pfam annotation: Domain name=LRR_1; Domain location=99-121; Score =18.1; E_value=0.032; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=123-145::147-169::171- 193::195-217::219-240::265-287::74-97::99-121
MGHRRTYIGAMPGRMVQCLKNVGTANPLVLTDEIDKLGRGHAGDPASALLELLDPEQNANFLDHYLDVTIDLSKLFRLRFRGNHLSGNIPSGSFAAIPNLTYLELDNNDLTRSIPVELESCRKMTMLNLAQNHLTGVLPSLLGNITNLQVLRLQMNKLNGAIPIEIGQLHKLSILNLSWNSQGGSIPFEITKLRNITFLNLQTNNLSGSIPTSIDNLKFLFELQLRENKLSGVIPSMPGSLQVSLNLSSNHFSGNTPNNFGNLDSLQVLDLSNNKFPGPIPNQLTGTSTLTQLLHANNALLSGEIPKFSQHLKVVSSGTGLINNTSPDHTIANRPNIVSKKGISVHVTILIAIVPASFLVGIVIQLVVSRKSCWQPQFIVSNLLTPNAIHKSRINFGKAMEVVADTSNVTLKTRFQTYYIAIMPFGSIYFIKNLNCSNKILPLGSHDKFGKELEVFAKLNNSNVMTPLSYVLSIDTAYILYEYISNGSLYDFLHGSMLD

SEQ ID NO: 178503 - protein, 161 aa, Glycine max
  Coding DNA Sequence Number=SeqID_61725
  Gene Ontology: Mol. function=motor activity; Cellular component =myosin complex
  Homolog annotation: Hit_ID=Q1SXC2; Match level="QueryCoverage=87%, HitCoverage=9%, E-value=7e-53, Identity=76%"; Hit description=IQ calmodulin-binding region; Myosin head, motor region; Dilute; AAA ATPase; Myosin, N-terminal, SH3-like
MSHQFPLVCKISQQNLLIYMNLAARETGALQAAKNKLEKQVEDLTLRLQLEKRLRINIEESKTQENEKLQSALQAMQLQFKETKLLVQKEREAAKREAERAPVIQEVPVVDHALLEKLTSENEKLKTLVSSLEKKIDETEKRYEEANKISEERLKQALDAE

SEQ ID NO: 178504 - protein, 245 aa, Glycine max
  Coding DNA Sequence Number=SeqID_61726
  Gene Ontology: Mol. function=RNA-directed DNA polymerase activity; Cellular component=mitochondrion; Biological process=RNA-dependent DNA replication
  Homolog annotation: Hit_ID=Q1S0N5; Match level="QueryCoverage=90%, HitCoverage=19%, E-value=1e-120, Identity=98%"; Hit description =Peptidase S16, lon protease
MYWRALRLGVCYPSASYSFYRPKHIGDFTYPRLADFGAAISGANKLQCQQVLEELDVYKRLKLTLELVKKEMEISKIQESIAKAIEEKISGEQRRYLLNEQLKAIKKELGLETDDKTALTGKFRERIEPKREKCPPHILQVIDEELAKLQLLEASSSEFSVTRNYLDWLTALPWGEYSDENFDVTRAQKILDEDHYGLTDVKERILEFIAVGKLRGTSQGKIICLSGPPGVGKTSIGRSIARALN

SEQ ID NO: 178505 - protein, 40 aa, Glycine max
  Coding DNA Sequence Number=SeqID_61727
MIYVMVIHQKYRISYDEIINDLCPLVLRMVGRILGDLGPV

SEQ ID NO: 178506 - protein, 111 aa, Glycine max
  Coding DNA Sequence Number=SeqID_61728
  Gene Ontology: Mol. function=DNA binding; Biological process=DNA integration
METMLLKYYHIVKSLINNFKCFEMYYIPRENNTRADLLSKLVSTKKVGHLRIIIQEILQTPPIDAEEIMVGEEGKQNWMTPYKNIIIWRVLPPNKDEARRLKRKASYYSNA

SEQ ID NO: 178507 - protein, 99 aa, Glycine max
  Coding DNA Sequence Number=SeqID_61729
WATGDGVLMPGLVEMRCLFCTIARSPPSTTYDGVVPGDMSRGSGDLGDARWGAIAQNQAWPIPTQPRHSQSVRTCDVPKQASSRQSTNKRTKVHEAKRL

SEQ ID NO: 178508 - protein, 66 aa, Glycine max
  Coding DNA Sequence Number=SeqID_61730
REFAKRNLQRLSARKNPEEDELSSSLSAPLQICAKHTSMNKATYLSLKSDLQREFDTFLEKLYMHE

SEQ ID NO: 178509 - protein, 74 aa, Glycine max
  Coding DNA Sequence Number=SeqID_61731
MVIFLIYITIIPINCTPDDNLLDLLSTPIVEGELVSMAKITFLKEFVPRESDILITDAFVEHNYIPLQGEVRIF

SEQ ID NO: 178510 - protein, 383 aa, Glycine max
  Coding DNA Sequence Number=SeqID_61732
  Gene Ontology: Mol. function=DNA binding; Cellular component=nucleus; Biological process=DNA integration
  Homolog annotation: Hit_ID=Q0BXC8; Match level="QueryCoverage=99%, HitCoverage=97%, E-value=4e-67, Identity=40%"; Hit description =ISHne2, transposase
  Pfam annotation: Domain name=rve; Domain location=138-303; Score =99.1; E_value=1.3e-26; Accession=PF00665.16; Description=Integrase core domain
MPWTETVTMQRLEFILACQAGGESMTQLCHRHGISRKTGYKWLSRFNPGELSSLENLSRARHLQPDKIAPDIAVRLVQFRQQHPDWGPKKIRHWFLSNGADFIVPAASTIGDLLKAAGMVQPRTPRKRTPGNLRSLTTPVRNNHVWSADFKGRFRLKDGSWCRPFTLTDNHSRYLLSCEPGTSETTVFVRGCMEKAFLEGGLPDVIRTDNGSPFVAPGILALTQLSVWLIKLGIQPERTAPGCPGQNARHERMHRSLKVAMSHHDVFGSLPEQQAWCRGWRNEFNQEKPHEAHGQQPPAKIWTPSPRRWDGKVPEVGYPEGAKLYKVGKKGDLRLNGRTFLSAALRGEYVRFLEVDDGIDVILFDRLILAYYDRAEKRIIRID

SEQ ID NO: 178511 - protein, 145 aa, Glycine max
  Coding DNA Sequence Number=SeqID_61733
  Gene Ontology: Mol. function=RNA-directed DNA polymerase activity; Biological process=RNA-dependent DNA replication
  Homolog annotation: Hit_ID=Q1SAS4; Match level="QueryCoverage=97%, HitCoverage=6%, E-value=3e-35, Identity=49%"; Hit description=RNase H, putative
SDNESCEGNDAEDTDVNFEQLINQAEEGEDEDWGLPPELKRTVEQEDREVKPHQKETKIINLGVGEERKEVKVGAGMSTRIRDELVALLQDYQDIFAWSYQDMPGLSPNIVQHRLPLNPKCSLVKQKLQRIKPEMSLKIKEEVKK

SEQ ID NO: 178512 - protein, 323 aa, Glycine max
  Coding DNA Sequence Number=SeqID_61734
  Homolog annotation: Hit_ID=Q33BI2; Match level="QueryCoverage=95%, HitCoverage=25%, E-value=3e-91, Identity=55%"; Hit description =Expressed protein
MPALPHGNHQFGSGNGFWSKNRDDVGYNQLHKLSPQARQELLRIDKQTLFEHARKNMYCSRCNGLLLEGFLQIVTYGKSLQQEGAGVHFPCSKPGSLKNQNNGGSSICNMVQDEMQDPTVHPWGGLTTTREGSLTLLDCYLYSKSLKGLQIVFDGARARERERELLYPDACGGGGRGWISQGIVSYGRGHGTRETCALHTARLSCDTLVDFWSALGDETRQSLLRMKEEDFIERLMYRNVIREFKELKELKRMRREPCCTSWFCVADTAFQYEVSDDSIQADWRQTFADTVGLYDHFEWAVGTTEGKSDILEFENVGMNGCVQ

SEQ ID NO: 178513 - protein, 309 aa, Glycine max
  Coding DNA Sequence Number=SeqID_61735
  Homolog annotation: Hit_ID=Q5PH52; Match level="QueryCoverage=93%, HitCoverage=88%, E-value=2e-60, Identity=42%"; Hit description =Tetrathionate reductase subunit C
MTPSSRRCRGGRRSLYGGRDDEPPTDDRRGFEPAAGGELAAVGRAIFLLYWHCRLRRVAGLRVALARWRQRRTFGARGAVYRADVRHHRAAGVDRRSASNRPFLAFLRLPDALVVDAVGRAVLAAVYLADRPVTGCAAAWDRARLRAGGYRPAVVHRARGFRRARAPNLVQLRISDRDVPQRAAGALGSVAVGDAQTARPAGAAGARDAADAAAARRGDPAVGMRRYANRRGGTPLAADAGDGASVCCRLDRAVGVGAGVRRLGGLSTFAARRRTAAGGRRAGAELADALDAVDRSANHPEIQRVLFPL

SEQ ID NO: 178514 - protein, 470 aa, Glycine max
  Coding DNA Sequence Number=SeqID_61736
MEEPKAESSQGTIPAGICLNQRKFGSLWSHTSHGFQFNTVRFSVDEVGGSGEIDEGDSNLKRSGMGEGCQNDLDAEVGGSCSSTEIASEAGMCVMGGSALNNSSDPNQGNTSSSDNCSSCLSEGDNNTTSSNRENTESSTSDSEDTSQQSEVRDSSTCIDNGLSGSHGAEMKKIHNANDEGLTSRSPFGPSLDVARGDVSGNPVVKIAHKFDNGFSSISMCSQPQSMLPPVPNQNIQFPVFRTSSAMGYYHQNPVSLPAAPTNGLMPFPHTNPYLYAGPFGYSLNEDPRFCLQYGGLQQPTPLFNPVAFPVYQPIARAKGLNTEESTLMSKPTSMLPEHLNRSSVEKVSLTGANSQKAALNGEVGHGNSAKSKDSGFSLFHFGGPVDLSTGHKSATASSNGDNVGDFNLKSSVDQVDDDHECNKKEATVIEEYNLFAAKKDCECSYLEGFFSPCLLHVIPNVHVSLDLAI

SEQ ID NO: 178515 - protein, 348 aa, Glycine max
  Coding DNA Sequence Number=SeqID_61737
  Gene Ontology: Mol. function=RNA-directed DNA polymerase activity; Biological process=RNA-dependent DNA replication
MSEIEEAQERMKVNMEAMKEQMATMMEAIMSMKKMMEVNVPVVATTSAVTEVDPTPPSGLNQISHPISDMNKHAFSPYGLPPNYTPPNMVHTPNENVNNSTPILIESQQPQSDDAHVSQPMREAHEIPHHNLVDFEPCLGYATKGQAVGGVPLPNTFEGPQLRAIERDGDYAFADMEDLCLVPDVVIPPKFKVPDFDQYKGTTCPNNHLKVYCRKMGAYVKDEKLLMHFFQESLTGEAVTWMQLQNMCKKEHESFKEYAQRWRNLAAQVAPPMTEKEMIAMIVDTLPVIEVGLIRGKFDHPALTNKKPGENREDKKEEGTHAMIVVPTWPNFPPTQQCHYSANISPSH

SEQ ID NO: 178516 - protein, 104 aa, Glycine max
  Coding DNA Sequence Number=SeqID_61738
MSYPNFVRGPLFGGMQPSLDRLKGVPTEGGAFWWKYPARLDLSMSDFVKILHRSSSVLRCSSTGSSSSMDSFASWKINGSGNEKEEREETPLQGEDESRRSSPP

SEQ ID NO: 178517 - protein, 69 aa, Glycine max
  Coding DNA Sequence Number=SeqID_61739
  Gene Ontology: Mol. function=nucleic acid binding; Biological process= RNA-dependent DNA replication
MACSKEQKVAFGTYTLVEEAKYWWENTRQYLEAKGQALIWENFKRVFLEKYFPEDVRNKKKMEFLEPIS

SEQ ID NO: 178518 - protein, 67 aa, Glycine max
  Coding DNA Sequence Number=SeqID_61740
MTKGAEDDVSLCVLSGVESYRQQKRADDHDLSPRAIRPDCLWIVQKGRGTIRFPRMSSDPPSLDDKR

SEQ ID NO: 178519 - protein, 133 aa, Glycine max
  Coding DNA Sequence Number=SeqID_61741
  Subcellular localization annotation: CTP_CleavageSite=36; ConfidenceScore=5.28e-01
MPSSLRRWKNLSLAKGLVKISASYKSVSTNYITITLVNMNPNEMMPCPNKSQVPLVLFLSSLHLAKLESEYPTRDISTPLGNHKSTSKDSPLQPPFQGEVMEHPRRMLTVGPCGLNNLKRDRLRMQKKQQQSI

SEQ ID NO: 178520 - protein, 254 aa, Glycine max
  Coding DNA Sequence Number=SeqID_61742
MAEKKNKRIKSIGHRPTTPKMKKEKELTKGVPSVKGKWVHVLLHLLLHQSLAWLRNKGFAFPKLIEYHELKKLVEMKGTYYTDLVKVFYTTTHIDRDIGFLCAEVKGQQIVMTLEVWFDIVGLSSKGVMVNKYKSMMKNPSTYVDVVTKAKGNECFGTGLLMPKHKLLAYVVAWIITPRGRSHAQLKLKINWEVFGFFEAKFEVKTKVLKQMGYIKSEEVGIWWIEKRREHQIEQKEAEEKTMSLLCNSNLQDS

SEQ ID NO: 178521 - protein, 125 aa, Glycine max
  Coding DNA Sequence Number=SeqID_61743
MDITFHTDVRFRRIIHRDALNGTTEAIKKFKWSKLFTRMSYSGASHIETLEIEQRKLSRYSNGHNFSHGGAIQAHNISRRSKLNNESSQEIQMVETIHSDVPIQRITYRDARNRTMEALDIFQWS

SEQ ID NO: 178522 - protein, 169 aa, Glycine max
  Coding DNA Sequence Number=SeqID_61744
  Gene Ontology: Mol. function=GTP binding; Cellular component=nucleus; Biological process=small GTPase mediated signal transduction
  Homolog annotation: Hit_ID=Q8LIM1; Match level="QueryCoverage=90%, HitCoverage=23%, E-value=8e-59, Identity=75%"; Hit description =Putative GTP binding protein
  Pfam annotation: Domain name=MMR_HSR1; Domain location=12-133; Score =25.0; E_value=5.1e-06; Accession=PF01926.13; Description=GTPase of unknown function
  Pfam annotation: Domain name=NOG1; Domain location=76-133; Score =106.6; E_value=7.1e-29; Accession=PF06858.4; Description=Nucleolar GTP-binding protein 1 (NOG1)
  Pfam module annotation: Pfam domain module=MMR_HSR1::NOG1; Domain location=12-133::76-133
MARLPSIDPNTSTVLIYGYPNVGESLFINKIMRANVDVQPYAFTTKSLFVGHIDYKYLRYQVIDRDFGQAFEDFNIIEMCSITALAHLRAAMLFILDVSGSYGYSIAQQVALFHSIKSLFMNKSLIIVCNKTNLQPLEGIPKEVIGMEKEEREETPLQGEDESRRSSPA

SEQ ID NO: 178523 - protein, 74 aa, Glycine max
  Coding DNA Sequence Number=SeqID_61745
MEEKNKRIMREKREFPKEEFSGFGGLGLAYLHLARSARLAQVPVFVCSALCSLNASTSFRAQRALRAEPVLGWA

SEQ ID NO: 178524 - protein, 55 aa, Glycine max
  Coding DNA Sequence Number=SeqID_61746
MKKSKGALNAKAHTKCESQCEKWKSPAVPPPSLPKKSSSSLNKSGISWRSRSQKK

SEQ ID NO: 178525 - protein, 43 aa, Glycine max
  Coding DNA Sequence Number=SeqID_61747
KLKKAETLIWVDFVECPKVEVVYGSSWKSGDLKMEDLDIDLME

SEQ ID NO: 178526 - protein, 179 aa, Glycine max
  Coding DNA Sequence Number=SeqID_61748
  Gene Ontology: Mol. function=protein binding; Cellular component =integral to membrane; Biological process=defense response to fungus
  Homolog annotation: Hit_ID=Q1SWI6; Match level="QueryCoverage=82%, HitCoverage=65%, E-value=5e-40, Identity=56%"; Hit description =Leucine-rich repeat, plant specific
  Pfam annotation: Domain name=LRRNT_2; Domain location=21-61; Score =50.1; E_value=7.2e-12; Accession=PF08263.3; Description=Leucine rich repeat N-terminal domain
  Pfam annotation: Domain name=LRR_1; Domain location=114-139; Score =10.8; E_value=2.7; Accession=PF00560.23; Description=Leucine Rich Repeat
  Pfam annotation: Domain name=LRR_1; Domain location=141-163; Score =14.9; E_value=0.29; Accession=PF00560.23; Description=Leucine Rich Repeat
  Pfam module annotation: Pfam domain module=LRRNT_2::LRR_1::LRR_1; Domain location=21-61::114-139::141-163
MAPNFHLSSSIGLPCRESVCIPSERETLMKFKNNLNDPSNRLWSWNHNNTNCCHWYGVLCHNLTSHLLQLHLNTSRSAFEYDYYNGFYRRFDEEAYRRWSFGGEISPCLADLKHLNYLDLSGNRFLGEGMSIPSFLGTMTSLTHLNLSHTGFMGKIPPQIGNLSNLVYLDLSSGSANGT

SEQ ID NO: 178527 - protein, 1012 aa, Glycine max
  Coding DNA Sequence Number=SeqID_61749
  Gene Ontology: Mol. function=protein binding; Cellular component =integral to membrane; Biological process=defense response to fungus
  Homolog annotation: Hit_ID=Q1SWI7; Match level="QueryCoverage=85%, HitCoverage=97%, E-value=1e-157, Identity=33%"; Hit description =Leucine-rich repeat
  Pfam annotation: Domain name=LRRNT_2; Domain location=1-38; Score =36.2; E_value=1.1e-07; Accession=PF08263.3; Description=Leucine rich repeat N-terminal domain
  Pfam annotation: Domain name=LRR_1; Domain location=116-138; Score =14.4; E_value=0.42; Accession=PF00560.23; Description=Leucine Rich Repeat
  Pfam annotation: Domain name=LRR_1; Domain location=164-187; Score =13.7; E_value=0.68; Accession=PF00560.23; Description=Leucine Rich Repeat
  Pfam annotation: Domain name=LRR_1; Domain location=189-210; Score =9.3; E_value=5.2; Accession=PF00560.23; Description=Leucine Rich Repeat
  Pfam annotation: Domain name=LRR_1; Domain location=212-234; Score =4.4; E_value=44; Accession=PF00560.23; Description=Leucine Rich Repeat
  Pfam annotation: Domain name=LRR_1; Domain location=236-252; Score =7.5; E_value=11; Accession=PF00560.23; Description=Leucine Rich Repeat
  Pfam annotation: Domain name=LRR_1; Domain location=261-283; Score =7.3; E_value=12; Accession=PF00560.23; Description=Leucine Rich Repeat
  Pfam annotation: Domain name=LRR_1; Domain location=285-310; Score =3.4; E_value=65; Accession=PF00560.23; Description=Leucine Rich Repeat
  Pfam annotation: Domain name=LRR_1; Domain location=312-334; Score =14.8; E_value=0.32; Accession=PF00560.23; Description=Leucine Rich Repeat
  Pfam annotation: Domain name=LRR_1; Domain location=336-358; Score =10.0; E_value=3.8; Accession=PF00560.23; Description=Leucine Rich Repeat
  Pfam annotation: Domain name=LRR_1; Domain location=360-382; Score =13.4; E_value=0.84; Accession=PF00560.23; Description=Leucine Rich Repeat
  Pfam annotation: Domain name=LRR_1; Domain location=384-406; Score =20.8; E_value=0.005; Accession=PF00560.23; Description=Leucine Rich Repeat
  Pfam annotation: Domain name=LRR_1; Domain location=408-433; Score =1.1; E_value=1.7e+02; Accession=PF00560.23; Description=Leucine Rich Repeat
  Pfam annotation: Domain name=LRR_1; Domain location=487-510; Score =7.5; E_value=11; Accession=PF00560.23; Description=Leucine Rich Repeat
  Pfam annotation: Domain name=LRR_1; Domain location=512-535; Score =4.9; E_value=34; Accession=PF00560.23; Description=Leucine Rich Repeat
  Pfam annotation: Domain name=LRR_1; Domain location=560-583; Score =5.6; E_value=25; Accession=PF00560.23; Description=Leucine Rich Repeat
  Pfam annotation: Domain name=LRR_1; Domain location=585-607; Score =6.8; E_value=15; Accession=PF00560.23; Description=Leucine Rich Repeat
  Pfam annotation: Domain name=LRR_1; Domain location=609-632; Score =3.3; E_value=68; Accession=PF00560.23; Description=Leucine Rich Repeat
  Pfam annotation: Domain name=LRR_1; Domain location=658-679; Score =12.8; E_value=1.2; Accession=PF00560.23; Description=Leucine Rich Repeat
  Pfam annotation: Domain name=LRR_1; Domain location=682-704; Score =5.7; E_value=24; Accession=PF00560.23; Description=Leucine Rich Repeat
  Pfam annotation: Domain name=LRR_1; Domain location=706-728; Score =11.5; E_value=2; Accession=PF00560.23; Description=Leucine Rich Repeat
  Pfam annotation: Domain name=LRR_1; Domain location=730-753; Score =12.7; E_value=1.2; Accession=PF00560.23; Description=Leucine Rich Repeat
  Pfam annotation: Domain name=LRR_1; Domain location=755-777; Score =10.0; E_value=3.9; Accession=PF00560.23; Description=Leucine Rich Repeat
  Pfam annotation: Domain name=LRR_1; Domain location=779-801; Score =17.3; E_value=0.057; Accession=PF00560.23; Description=Leucine Rich Repeat
  Pfam annotation: Domain name=LRR_1; Domain location=89-114; Score =10.8; E_value=2.7; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1; ...
  Pfam module annotation: Pfam domain module=Domain location=1-38::116 -138::164-187::189-210::212-234::236-252::261-283::285-310::312 -334::336-358::360-382::384-406::408-433::487-510::512-535::560 -583::585-607::609-632::...
  Pfam module annotation: =658-679::682-704::706-728::730-753::755 -777::779-801::89-114
ERETLMKFKNNLIDPSNRLWSWNHNNTNCCHWYGVLCHNLTSHLLQLHLHTSPSVFYHYYDGNYHFDWEAYRRWSFGGEISPCLADLKHLNYLDLSGNRFLGEGMSIPSFLGTMTSLTHLNLSHTGFRGKIPPQIGNLSNLVYLDLSYVFANGTVPSQIGNLSKLRYLDLSDNDFEGMAIPSFLCAMTSLTHLDLSSGFMGKIPSQIGNLSNLIYLDLGGNYLLAENVEWVSSMWKLEYLDLSYANLSLLNFTVTLQPLPSLTHLYLSDCTLPHYNEPSLLNFSSLQTLHLSFTSYSPAISFVPKWIFKLKKLVSLQLQGNEIQGPIPGGIRNLTLLQNLDLSFNSFSSSIPDCLYGLHRLKFLNLGDNNFHGTISDALGNLTSLVELDLSYNQLEGTIPTSLGNLCNLRVIRLSYLKLNQQSWITLDSSGNSTASQEEDATVATTGVHKANNEVQIESRTKRKIVRPTSWYPRNQYSKFCTYQLSKLSSLHIDGNLFHGVVKEDDLANLTSLTEFGASGNNFTLKVGPNWIPNFQLTYLEVTSWQLGPSFPLWIQSQNQLHYVGLSNTGIFDSIPTQMWEALSQVLYLNLSRNHIHGEIGTTLKNPISIPTIDLSSNHLCGKLPYLSSGVFRLDLSSNSFFESMNDFLCNDQEQPTHLEFLNLASNNLSGEIPDCWMNWTFLVDVNLQSNHFVGNLPQSMGSLADLQSLQIRNNTLSGIFPSSLKKNNQLISLDLGENNLSGSIPTWVGEKLLNVKILRLRSNRFGSHIPNEICQMSHLQVLDLAQNNLSGNIPSCFSNLSAMTLMNQSTDPRIYSIARYGRSYSSMQSIVSVLLWLKGRGDEYKNILGLGNIPTGTQLQTFDASSFIGNNLCGPPLPINCSSNGKTHSYEGSDGHGVNWFFVSMTIGFIVGFWIVIAPLLICRSWRSWGSLDFAAMVAEEITFVGFYDEVACPMVQVEEQVGGHSHEIGGVTYGICIKLKKSGTLIWLDYVECPKVQDEKMEDLDMDFME

SEQ ID NO: 178528 - protein, 335 aa, Glycine max
  Coding DNA Sequence Number=SeqID_61750
  Gene Ontology: Mol. function=protein binding; Cellular component =integral to membrane; Biological process=xylan catabolic process
  Homolog annotation: Hit_ID=Q1T435; Match level="QueryCoverage=94%, HitCoverage=83%, E-value=5e-76, Identity=39%"; Hit description =Leucine-rich repeat; Leucine-rich repeat, cysteine-containing type
  Pfam annotation: Domain name=LRR_1; Domain location=153-175; Score =13.0; E_value=1.1; Accession=PF00560.23; Description=Leucine Rich Repeat
  Pfam annotation: Domain name=LRR_1; Domain location=177-199; Score =15.6; E_value=0.18; Accession=PF00560.23; Description=Leucine Rich Repeat
  Pfam annotation: Domain name=LRR_1; Domain location=201-223; Score =18.0; E_value=0.035; Accession=PF00560.23; Description=Leucine Rich Repeat
  Pfam annotation: Domain name=LRR_1; Domain location=225-246; Score =7.8; E_value=9.9; Accession=PF00560.23; Description=Leucine Rich Repeat
  Pfam annotation: Domain name=LRR_1; Domain location=30-53; Score =12.7; E_value=1.2; Accession=PF00560.23; Description=Leucine Rich Repeat
  Pfam annotation: Domain name=LRR_1; Domain location=55-77; Score=9.4; E_value=5; Accession=PF00560.23; Description=Leucine Rich Repeat
  Pfam annotation: Domain name=LRR_1; Domain location=6-28; Score=14.2; E_value=0.49; Accession=PF00560.23; Description=Leucine Rich Repeat
  Pfam annotation: Domain name=LRR_1; Domain location=79-101; Score =6.2; E_value=20; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=153-175::177-199::201- 223::225-246::30-53::55-77::6-28::79-101
MGSLLHLQALLLRNNNLTDEIPFSLRSCTNLVMLDISENRLSGLIPSWIGSELQELQFLSLGRNNFHGSLPLQICYLSDIQLLDVSLNSMSGQIPKCIKNFTSMTQKTSSRDYQGHSYLVNTMGISLNSTYDLNALLMWKGSEQMFKNNVLLLLKSIDLSSNHFSGEIPLEIEDLFGLVLLNLSRNHLTGKIPSNIGKLTSLEYLDLSRNQFVGSIPPSLTQIYWLSVLDLSHNHLTGKIPTSTQLQSFNASSYEDNLDLCGPPLEKFCIDERPTQKPNVEVQEDEYSLLSREFYMSMTFGFVISFWVVFGSILFKRSWRHAYFKFLNNLSNNIY

SEQ ID NO: 178529 - protein, 267 aa, Glycine max
  Coding DNA Sequence Number=SeqID_61751
  Gene Ontology: Mol. function=receptor activity
  Homolog annotation: Hit_ID=Q1SBD8; Match level="QueryCoverage=95%, HitCoverage=83%, E-value=2e-44, Identity=37%"; Hit description =Unnamed protein product; contains similarity to elicitor-inducible receptor EIR gene_id:T5M7.12
  Pfam annotation: Domain name=LRR_1; Domain location=141-163; Score =12.0; E_value=1.6; Accession=PF00560.23; Description=Leucine Rich Repeat
  Pfam annotation: Domain name=LRR_1; Domain location=165-187; Score =8.2; E_value=8.3; Accession=PF00560.23; Description=Leucine Rich Repeat
  Pfam annotation: Domain name=LRR_1; Domain location=189-210; Score =0.2; E_value=2.6e+02; Accession=PF00560.23; Description=Leucine Rich Repeat
  Pfam annotation: Domain name=LRR_1; Domain location=224-246; Score =7.1; E_value=13; Accession=PF00560.23; Description=Leucine Rich Repeat
  Pfam module annotation: Pfam domain module=LRR_1::LRR_1::LRR_1::LRR _1; Domain location=141-163::165-187::189-210::224-246
MKRIKTISHAIFVMFILSLSATCGQEDLDILTPMEKVELEALYSTIESFLGDSWNSSDLYPDPCGWTPIQGVSCDLFDGFWYVTTLNIGPVHDNSLSCAQDLEFRPHLFKLKHLKSLSFFNCFPSQDMFPEIPSSIGNVIKLKKLVLVGNYLTSRIPDVFDRLNELLIFDLCSNSLSGSLPLTLGSLTSALKLDVNNNHLMDLMNNSRNNLTGNLSLKLETLPYLNALYLSGNNLIRQSLASLKTFLEKWEGVLGIGTTQNFANKLD

SEQ ID NO: 178530 - protein, 71 aa, Glycine max
  Coding DNA Sequence Number=SeqID_61752
MEHAGIACVMKDGKLQFGKLQDEGIDHWKDLKVSIIMRIGEMCLMDHMHDMDDANLDDLEETEANHGKDFL

SEQ ID NO: 178531 - protein, 81 aa, Glycine max
  Coding DNA Sequence Number=SeqID_61753
MKGLWSKARRFPQLQQQLSLQENPAHLKPTKNLDSKPKTKLFPWDLHGCFREEKEENKEQTRKRVNLPLYRTTKEHPNKEK

SEQ ID NO: 178532 - protein, 165 aa, Glycine max
  Coding DNA Sequence Number=SeqID_61754
NSLIDEEHSVIVAEREPLHVRLIAIHGTRIADHSPPRNECEGVGGGGGVPEVDVGEMAGPRGGGGGHGEEEVADEGRVDEAGNYEREAYKGEVFSRRELRGTKLISREHEFNSYGMNYENANHEHSKTVINDRLSIYVVESKFPQLNYKFATASHSKTVADNRLK

SEQ ID NO: 178533 - protein, 784 aa, Glycine max
  Coding DNA Sequence Number=SeqID_61755
  Gene Ontology: Mol. function=electron carrier activity; Cellular component=integral to membrane; Biological process=cytochrome complex assembly
  Homolog annotation: Hit_ID=Q46UB7; Match level="QueryCoverage=46%, HitCoverage=88%, E-value=1e-85, Identity=49%"; Hit description=ATP -binding region, ATPase-like:Histidine kinase, HAMP region:Histidine kinase A, N-terminal
  Pfam annotation: Domain name=AhpC-TSA; Domain location=604-729; Score= 26.6; E_value=3e-06; Accession=PF00578.11; Description=AhpCTSA family
  Pfam annotation: Domain name=HAMP; Domain location=90-160; Score =41.7; E_value=2.5e-09; Accession=PF00672.15; Description=HAMP domain
  Pfam annotation: Domain name=HATPase_c; Domain location=263-372; Score=109.8; E_value=7.8e-30; Accession=PF02518.16; Description =Histidine kinase-, DNA gyrase B-, and HSP90-like ATPase
  Pfam annotation: Domain name=HisKA; Domain location=164-222; Score =35.6; E_value=1.7e-07; Accession=PF00512.15; Description=His Kinase A (phosphoacceptor) domain
  Pfam annotation: Domain name=Redoxin; Domain location=603-747; Score =11.9; E_value=0.00053; Accession=PF08534.1; Description=Redoxin
  Pfam module annotation: Pfam domain module=AhpC-TSA::HAMP::HATPase _c::HisKA::Redoxin; Domain location=604-729::90-160::263-372::164 -222::603-747
MSSAKSVMLGNLEYDVATSVAILDRLPADERPGWLAKLARGNYRYSLSPGEAGPYPSGWRTRDAVHLTLHDGAPLTLDLWPRMPAIARWLPLVLMGQLLLLLCCAWLAVRQVVRPFVRFTHAVDALKPAASHAQLMAENGPDEVQQAARAFNAMQLRIQDHLKARAQILAAISHDLQTPITRMKLRVEMAEQPELRDKLLSDLDNMSRLVREGIAYARSSEVLEEKRQSVSLNALLDSVVCDYQDVGKAVNFVPCTGHDTFAVRPQALRRIMTNLIDNALKFGGEAEVELCSPQGDSVEIRVRDNGTGIPEEALQAVLEPFYRVESSRNRHTGGTGLGLAIATQLVSQMAGSLQLRNRAAGGLEACIILQQQDVRTAGRADVYPPYEVPYDTAYRFSRRDADAAQPLYLTDYSFCICQRTRPSRTAAGAAERHGPDVHAGGAAGIAYQPLGQSGHQHWSRPGAVVPGDSRTDVNLDAHRPMRYPARGARRAAGGPGNRSAVVALCRTGAGRDPQPGRRGRSSPVGWRVAAGVWQRCRADAGAALFRRTIAGGATASGAGDECAAASGGGRADARLGGRDCYRLTEPAAGSARFCPEAGAAAEPVADHAGTQSAPGAAWLNGAPVTPATLKGKVVLVDFWTWDCINCQHTLPYVRDWASKYQRDGLVVVGVHTPEYPWERDEKALKRAITRWQLPYTVVADNHYSIWNRFGNQYWPAHYIFDAHGQLRYTAFGEGNYEEQERVWRPARAATASHLGCDSRGMPLKAGVTQGLSGKQRAALPGPPS

SEQ ID NO: 178534 - protein, 225 aa, Glycine max
  Coding DNA Sequence Number=SeqID_61756
MGYSPSPLEDCTPSPLEGCTPSPSKVVSLVHPPDLGGGPTVQAQPEEEAIAQLLCIPGQDFTHAATKRRVRIMHTNMTTLTQIWMTLLLSNILPNNHNADLPLQKDRAHKTPSGPGGVQQGPGVSSSGYRPLSVLQSARPPPARSRHHHIGITPARHPVGPKKSNSVMGFPTLITSLCQFYGVPISPGKVIRPPINRTFIEKYCAPGRRRARHHSSGQQAHHHHF

SEQ ID NO: 178535 - protein, 620 aa, Glycine max
  Coding DNA Sequence Number=SeqID_61757
  Gene Ontology: Mol. function=CDP-glycerol glycerophosphotransferase activity; Cellular component=membrane; Biological process=teichoic acid biosynthetic process
  Homolog annotation: Hit_ID=Q5DY22; Match level="QueryCoverage=85%, HitCoverage=57%, E-value=5e-33, Identity=26%"; Hit description =Putative glysosyltransferase
  Pfam annotation: Domain name=Glyco_transf_25; Domain location=13-161; Score=-22.7; E_value=4.5e-05; Accession=PF01755.8; Description =Glycosyltransferase family 25 (LPS biosynthesis protein)
  Pfam annotation: Domain name=Glyphos_transf; Domain location=408-608; Score=-61.2; E_value=0.016; Accession=PF04464.5; Description=CDP -Glycerol:Poly(glycerophosphate) gl
  Pfam module annotation: Pfam domain module=Glyco_transf_25::Glyphos _transf; Domain location=13-161::408-608
MGVEMMAVNWQTIDKVVYINLNKRKDRRVRIARQLKAIGVPREKIVRFEAIEETPGYIGCIKSHILVLQMAQQNGWKNVLILEDDMVFHDDIQTKQRIDLFLSSLQQINWHVALLAANYDNVVPLKSVDYIVKPQYAWCACAYIVNGDYYSTLIDNYAESLQGLLAGGVPQCWALDVRWNSLIKRDRWLGIFPNAGYQAADKSDIENQPVDYRAHFAKKLEEIVWPAYQPGEEKIKVDIFFQWAPGWTNFESVYRAMQAKPHFDCQIILAPYFSRGTKAPDYTAQRDLLNDKGIRYTEYHEYEITARKPHVVFLQNPYDDARPNELQSLTLNRRNISIAYIPYGLDMGDGERNRVYQYNLPCQNVARWVFVRSQRHKDEFAKYCGNGNHHVYVSGHPKLDNYPSRFGVQTDGKVNKGKPTLLWAPHFVMPDDEKMWSTFNLYTQAMLDIIKRDDVNLIIRPHPLFKQFLDIRKERGTHSETAQNWQMLREYSHLKSHVEWDFSADYRYAFSQSDALMADAGSFLLEYLPSRKPILFLTHENCLGINSSAEFIYDAYDVANESADIKTFVDNLVSGKDPMRDKRLQVLRDELHMPEQGAGSEIVKIIEKTLMPAGVHHNVF

SEQ ID NO: 178536 - protein, 417 aa, Glycine max
  Coding DNA Sequence Number=SeqID_61758
  Gene Ontology: Mol. function=drug transporter activity; Cellular component=membrane; Biological process=multidrug transport
  Homolog annotation: Hit_ID=Q57MY4; Match level="QueryCoverage=97%, HitCoverage=80%, E-value=1e-128, Identity=58%"; Hit description =Putative MATE family transport protein
  Pfam annotation: Domain name=MatE; Domain location=1-136; Score=62.2; E_value=1.7e-15; Accession=PF01554.9; Description=MatE
  Pfam annotation: Domain name=MatE; Domain location=204-365; Score =147.2; E_value=4.4e-41; Accession=PF01554.9; Description=MatE
  Pfam module annotation: Pfam domain module=MatE::MatE; Domain location=1-136::204-365
  Subcellular localization annotation: CTP_CleavageSite=42; ConfidenceScore=5.26e-01
MAGVGLADSFNMVIISFFAAIDLGTTVVVAFSLAKRNGKRARAATRQSLGLMTVLAFVLVIAIEFWGHLIVDVIAGNAEPQVKELALSYLQTSAWSYPAAAIALIGSGALRGAGNTKIPMLINGGMNILNIIISSVLIYGALGWEGMGFVGAGLGLTISRYIGAAAAIYVLYRGISPALKITLASYFRRWDRNILMEVLGIGVPASIESVLFNGGKLLTQIFVAGMGTNEIAGNFIAFSIATLINLPGNALGSASTIITGRRLGKNQVMQAERQIKHVFWLAMIGLCTLAFITVPLAGTLARFYTRDPQVIEVTKHLIWLNAAFMPIWTASWVLPAGLKGARDARYTMYVSMFSMWGARVVAGYLLGIVLGMGVIGVWLGMFLDWTMRGICFWWRLTSGKWLNNYRKMLAKSSGPQG

SEQ ID NO: 178537 - protein, 374 aa, Glycine max
  Coding DNA Sequence Number=SeqID_61759
  Gene Ontology: Mol. function=transporter activity; Cellular component= membrane; Biological process=transport
  Homolog annotation: Hit_ID=Q9HUQ1; Match level="QueryCoverage=81%, HitCoverage=100%, E-value=1e-125, Identity=74%"; Hit description =Probable permease of ABC branched chain amino acid transporter
  Pfam annotation: Domain name=BPD_transp_2; Domain location=8-288; Score=175.0; E_value=1.9e-49; Accession=PF02653.6; Description =Branched-chain amino acid transport system  permease component
MDAFFIQQLINGLTLGAVYGLIAIGYTMVYGIIGMINFAHGEVYMISAYLCAIGLALLSYFGIHSFPLLIFGTLLFTIVVTAAYGWAIERIAYRPLRNSTRLAPLISAIGMSLILQNYVQLSQGPNQQGIPTLLSGVLRMEIDGGVVQITWTKVFILVAALCGMALLTWIIQYTKLGRICRAVQQDRRMASILGINTDRVISLVFVIGAAMAGLAGVLVTMNYGTFDFYAGFIIGIKAFTAAVLGGIGSLPGAMLGGLLLGVAEAQFAGLVNSDYKDVFSFSLLVVILIFRPQGLLGRPLVAKVRHPSGAARHAAGRCRRAGGVRPGSGRGTQRLQFYAVAAARGAAGGGGDGRTFVAGAVSAYRRGAPFSAQV

SEQ ID NO: 178538 - protein, 193 aa, Glycine max
  Coding DNA Sequence Number=SeqID_61760
  Gene Ontology: Mol. function=amino acid-polyamine transporter activity; Cellular component=outer membrane-bounded periplasmic space; Biological process=amino acid transport
  Homolog annotation: Hit_ID=Q9HUQ0; Match level="QueryCoverage=99%, HitCoverage=51%, E-value=5e-69, Identity=68%"; Hit description =Probable binding protein component of ABC transporter
GLADATKAALEKRGVKEVLYEGLSRGEKDFNALVTKIGAVKPDVVYFGGCHPEAGPLVRQMREQGVNAAFFSGDCIVTEELVTAAGGPQFTKGVYMTFGNDPRTIADGKAVIEKFRASGFEPEGYTLYAYASIQALAAAYKAAGKDNAKASDWLKANSVDTVMGKKAWDEKGDLKVSDYVVYQWDDKGKYHQL

SEQ ID NO: 178539 - protein, 45 aa, Glycine max
  Coding DNA Sequence Number=SeqID_61761
MGQATLPLFPSYWHPKGQHVEVKISAQIKDLDLGIQAFGFECKKA

SEQ ID NO: 178540 - protein, 82 aa, Glycine max
  Coding DNA Sequence Number=SeqID_61762
MGEVDEVQERMKDDMEAMKEKMATMMEAMISMKKIMEVNVVVVVVTSTVAEVDPTPPSGFNQINHPTSDMVGKELGSTSVIP

SEQ ID NO: 178541 - protein, 226 aa, Glycine max
  Coding DNA Sequence Number=SeqID_61763
  Gene Ontology: Mol. function=transporter activity; Cellular component= membrane; Biological process=transport
  Homolog annotation: Hit_ID=Q2NTW5; Match level="QueryCoverage=99%, HitCoverage=52%, E-value=8e-82, Identity=69%"; Hit description =Putative transport protein
  Pfam annotation: Domain name=Xan_ur_permease; Domain location=1-188; Score=-145.6; E_value=0.011; Accession=PF00860.11; Description =Permease family
  Subcellular localization annotation: CTP_CleavageSite=40; ConfidenceScore=5.07e-01
MGIGLTPFAGVFSAPPSIAPTFMQLDIAGAFNVGLVSVIFAFLFVDVFDNTGTLLGVTKRAGLADEQGNVPKMGRALIADSAAALFGSLLGTSTTTSYVESAAGVSAGGRTGLTAIVVAILFLLSLFFSPLAGSVPVYATAPALLFVAVLMASGLAEIDWKDVTTAAPVTVTALTMPLTYSIANGIAFGFITWTVVKLLSGRTKEVNAALVILSILFVIKLGWLSA

SEQ ID NO: 178542 - protein, 157 aa, Glycine max
  Coding DNA Sequence Number=SeqID_61764
  Gene Ontology: Mol. function=transporter activity; Cellular component= membrane; Biological process=transport
  Homolog annotation: Hit_ID=Q2NTW5; Match level="QueryCoverage=98%, HitCoverage=42%, E-value=2e-51, Identity=73%"; Hit description =Putative transport protein
  Subcellular localization annotation: CTP_CleavageSite=65; ConfidenceScore=5.94e-01
MPISTAPVTRRASSTTMIKKPSSASSGPGLVRSPRPTSVAGLSTTMPAPSSAISARNRPMPAAIPARSGSGMLAIIHSRILKIDSAKKITAERNTAPSAICQAHQNRTDGRGQTGGNKHRAFIHTGRPEDAGIHKQDVGHCQKGRDTGNDFGAHRGV

SEQ ID NO: 178543 - protein, 574 aa, Glycine max
  Coding DNA Sequence Number=SeqID_61765
  Gene Ontology: Mol. function=hydrolase activity, acting on glycosyl bonds; Biological process=nucleoside metabolic process
  Homolog annotation: Hit_ID=Q6D6Y2; Match level="QueryCoverage=82%, HitCoverage=98%, E-value=0.0, Identity=80%"; Hit description=AMP nucleosidase
  Pfam annotation: Domain name=PNP_UDP_1; Domain location=322-550; Score=262.4; E_value=9e-76; Accession=PF01048.10; Description =Phosphorylase family
MLSILNGSGTEPYHGLGEINLKHFESSVRHRSRAENVRCGLPAPDKHSQPFAAYQHRDGAECVRSQILHRDERFIRYALVKSVQIAEGESMNTQRNGLTTEQALDQLERLYDDAVEALRNAIRTFTASGTLPDAGLRQQGLFVYPELRITWQGEGPQQNRTRAWGRFTHTGRYSTTITRPALLRHYLSEQLQMIEKEYDVLIEVGPSQQEIPYPYVIDGSDLSLDRSMSASIARHFPTTELSQIGDETADGLFNADALFPLSHFDALRTDFSLARLRHYTGTAVEHFQPFVLFTNYTRYVDEFVRWAIEQVQDPSTPYDSLACAGDVVITAETQDPTAMMSDLAWKKHQMPAWHLTSPNRRGITLVNIGVGPSNAKTICDHLAVVRPHAWLMIGHCGGLRESQSIGDYVLAHAYLRDDHVLDSVLPPDIPIPSIAEVQRALYDATKAVSGMPGEEVKQRLRTGTVVTTDDRNWELRYSASALRFNLSRAVAVDMESATIAAQGYRFRVPYGTLLCVSDKPLHGEIKLPGQANRFYEGAISEHLQIGICAVELLRAEGDKLHSRKLRTFNEPPFR

SEQ ID NO: 178544 - protein, 106 aa, Glycine max
  Coding DNA Sequence Number=SeqID_61766
  Gene Ontology: Mol. function=amino acid-polyamine transporter activity; Cellular component=outer membrane-bounded periplasmic space; Biological process=amino acid transport
  Homolog annotation: Hit_ID=Q2X942; Match level="QueryCoverage=93%, HitCoverage=26%, E-value=4e-32, Identity=69%"; Hit description =Branched-chain amino acid ABC transporter, periplasmic amino acid- binding protein precursor
MAFYAQADIKIGVAGPFTGPNATYGTQYWKGASQAAADINAAGGINGEKIVLVQGDDACEPKQAVAVANRLVDQDKVMAVVGHFCSSSTMPASEVYDEAGVLADYA

SEQ ID NO: 178545 - protein, 79 aa, Glycine max
  Coding DNA Sequence Number=SeqID_61767
  Gene Ontology: Mol. function=translation initiation factor activity; Biological process=translational initiation
  Homolog annotation: Hit_ID=Q1SQK2; Match level="QueryCoverage=81%, HitCoverage=8%, E-value=4e-18, Identity=72%"; Hit description =Translation initiation factor eIF-3b
MADVMVMKEIEDTALHLDVDLSILDLDAIRLPPDEDCGIVSDDEVVYQEENLEFESGFGNIIVVEENLEFESGLPGGES

SEQ ID NO: 178546 - protein, 144 aa, Glycine max
  Coding DNA Sequence Number=SeqID_61768
  Gene Ontology: Mol. function=protein serine/threonine kinase activity; Cellular component=membrane; Biological process=protein amino acid phosphorylation
  Homolog annotation: Hit_ID=Q2MHE4; Match level="QueryCoverage=93%, HitCoverage=34%, E-value=7e-65, Identity=88%"; Hit description =Serine/threonine-protein kinase HT1
  Pfam annotation: Domain name=Pkinase; Domain location=1-143; Score= -16.9; E_value=1.5e-07; Accession=PF00069.15; Description=Protein kinase domain
  Pfam annotation: Domain name=Pkinase_Tyr; Domain location=1-141; Score=-65.3; E_value=1.8e-08; Accession=PF07714.7; Description =Protein tyrosine kinase
  Pfam module annotation: Pfam domain module=Pkinase::Pkinase_Tyr; Domain location=1-143::1-141
MSQGTLRMYLNKKEPYSLSMETILRLALDISRGMEYLHSQGVIHRDLKSSNFLLDDDMRVKVADFGTSFLETRCQKSKGNSGTYHWMAPEMVKEKPYTRKVDVYNFGIVLWELTTALLPFQGMTPVQAAFAVAEKVAWLCLNSK

SEQ ID NO: 178547 - protein, 452 aa, Glycine max
  Coding DNA Sequence Number=SeqID_61769
  Gene Ontology: Mol. function=fructose-bisphosphate aldolase activity; Cellular component=integral to membrane; Biological process=metabolic process
  Homolog annotation: Hit_ID=Q8CZK5; Match level="QueryCoverage=62%, HitCoverage=90%, E-value=1e-117, Identity=74%"; Hit description =Biphosphate aldolase
  Pfam annotation: Domain name=DUF1498; Domain location=1-176; Score =264.9; E_value=1.6e-76; Accession=PF07385.2; Description=Protein of unknown function (DUF1498)
  Pfam annotation: Domain name=F_bP_aldolase; Domain location=168-452; Score=276.0; E_value=7.1e-80; Accession=PF01116.10; Description =Fructose-bisphosphate aldolase class-II
  Pfam module annotation: Pfam domain module=DUF1498::F_bP_aldolase; Domain location=1-176::168-452
QWRALDTSAAAELLALHLGWDVTSFGADDFSQTGLTLFTLSNGSRGGQPWGKPYAEKIMHVREGQVTPMHYHPQKMEDIINRGGGNLIVTLHNRDGDRLADSPVQVTLDGICQTHAAGSQLRLSPGESVTLLPGVWHSFWGETGYGDVLVGEVSMPNDDEHDNECSMALISLAQGLAHAQQHGYALGAFNVLDTHFLRALFHAAEQQRSPFIINIAEVHFKYVSLEPLIAAIRAEAALHAIPVVLNLDHGLHFDAVMQAIRLGFTSVMFDGSTLSYDENIRQTREVVKMCHALGISVEAELGAVGGDEGGALFGEADSNKFTDPALAAEFVQATGIDCLAVAIGNAHGKYKGEPKLDFDRLAAIRAAACIPLVLHGGSGISDADFRRAISLGIHKINFYTGMSQAALAAIETQITQRDARYDSFAELLMAVERDIASVVAQQMQVFGSAGRA

SEQ ID NO: 178548 - protein, 57 aa, Glycine max
  Coding DNA Sequence Number=SeqID_61770
MLVEKTTSSSIRLSLLEKTTVLDKVRPDTWMGCRGSILARRGLSSIGEGEEREEEGV

SEQ ID NO: 178549 - protein, 234 aa, Glycine max
  Coding DNA Sequence Number=SeqID_61771
  Gene Ontology: Mol. function=nucleic acid binding; Biological process= RNA-dependent DNA replication
MEPFQTIPKPTPKSNAERRSCRSSEGKEKEITCKTSRQKSVVNGVEPKKTKNQLVREENKVSKPIPPQALPYPLVPTRKDKEKQFACFLGIFKRLQINIPFSEVVGKMTIYAKFMKELLNKKNNYMEEDTIQLEARSITVIQKSFYYKHKDPRSITIPSSIGNLFVGKALLHLGASINLMALSMLNKVEDVEIDVAPCGACRPWIFFINGFLCFLRSDCSGMEKEKDEWRRHFK

SEQ ID NO: 178550 - protein, 339 aa, Glycine max
  Coding DNA Sequence Number=SeqID_61772
  Gene Ontology: Mol. function=RNA-directed DNA polymerase activity; Biological process=RNA-dependent DNA replication
  Homolog annotation: Hit_ID=Q1SDI2; Match level="QueryCoverage=40%, HitCoverage=19%, E-value=1e-20, Identity=38%"; Hit description=RNA -directed DNA polymerase
MRGKIREVALKVDIRKAYSRVDWGFLLALMGKWGLLGSSGSRLIMCLKSCHTITSTMGVLEWIGTRKYLGAPSMVGTNKWVVFGYIRDRVWKKIQSWEGRWLSKAGKELGERSKEGFSLVLLGEIGHEEGSRRNGELKAFNIALLRKPESLVARLIKARYFPRIEFLNSIGNGASIQVLSSPWLRDAKNAFVKQVPVMENSDLMVKDLINEVRGTWRCEVLLPSRQALLVKGVTCYGLCPFSDAPLETSWHTLENHVVYRARDYLANRREVRVLKKNNSVPTVNNQAALQWLKDLDIEDIIVESDCLQVGPVTRVMSKMFQEDCARAAEEGPRILMNLR

SEQ ID NO: 178551 - protein, 212 aa, Glycine max
  Coding DNA Sequence Number=SeqID_61773
  Gene Ontology: Mol. function=RNA-directed DNA polymerase activity; Biological process=RNA-dependent DNA replication
  Homolog annotation: Hit_ID=Q1SQ35; Match level="QueryCoverage=39%, HitCoverage=80%, E-value=1e-24, Identity=60%"; Hit description=Pol -related
MALVTSPFLGRIALEIKPTRMTLQLTDRSIKVSFGVVEDVLVKVDKFIFPTDFVIMDMEKDVEVPIILGILFMRTDHALINMNKGKLKLRGGYCGKICSTSKKSLTHATCFKKNIKAHHNKTLAKRNVKPNQKVPVCNKRFKLFPGKLKSKWFGPFVIKEVKPYGAITLEDPSTSKNWTINGQRLKPYLGVKLKGSTPSFTFVILKDQSMSS

SEQ ID NO: 178552 - protein, 199 aa, Glycine max
  Coding DNA Sequence Number=SeqID_61774
  Gene Ontology: Mol. function=identical protein binding; Cellular component=cytoplasm; Biological process=negative regulation of enzyme activity
  Homolog annotation: Hit_ID=Q9ZUF6; Match level="QueryCoverage=98%, HitCoverage=28%, E-value=5e-72, Identity=62%"; Hit description =Subtilisin-like serine protease, putative
MSCPHISGLVALLKAAHPGWSPSAIKSALMTTAYVHDNTKFPLRDAAGGAFSNPWAHGACHMNPHKALSPGLVYDATAWDYVKFLCSFGKFSDPGQLNYPSFSILFGGKRVVRYTRVLINVGETGSIYNVTVDAPSTMTIKIKPTRLVFEKVGERQRYTVTFVSKRGVGDSTRYGFGSIMWSNAQHQVRSPVAFSWTLL

SEQ ID NO: 178553 - protein, 137 aa, Glycine max
  Coding DNA Sequence Number=SeqID_61775
MGALNIKTCQVAVPTANHATAVLVVFHLPIALAALMEDHIAAKIAVVAKIVALSQVAILGGLFPLAASANALALALAQNVPSPSDLRAIDSDNKVFDFPEISYSNLVKEIALPRKNLILPKMTSGFTQNKKQLEVAN

SEQ ID NO: 178554 - protein, 237 aa, Glycine max
  Coding DNA Sequence Number=SeqID_61776
  Gene Ontology: Mol. function=transcription factor activity; Cellular component=nucleus; Biological process=regulation of transcription, DNA-dependent
  Homolog annotation: Hit_ID=Q9LYD3; Match level="QueryCoverage=72%, HitCoverage=72%, E-value=9e-41, Identity=54%"; Hit description =Transcription factor like protein
  Pfam annotation: Domain name=AP2; Domain location=39-103; Score =151.2; E_value=2.7e-42; Accession=PF00847.10; Description=AP2 domain
  Subcellular localization annotation: CTP_CleavageSite=58; ConfidenceScore=5.64e-01
MRVSAQNSTSFLPSSPSSSSPPLSSESKTEKRNRESNNHPVYRGVRMRNWGKWVSEIREPRKKSRIWLGTFPTPEMAARAHDVAALGIKGNNAILNFPELAALLPRPVSLASRDVQAAAAKAAHMDLPSSSSSISLSLGSTTPSSSSSSLSSLASTADLLLLSTASEELSEIIELPRLETTSYELGNEFVFMDSQDTWMYQPPIPWLHTTYDGSDANEFAVPESRVVTNFEGFLWDY

SEQ ID NO: 178555 - protein, 188 aa, Glycine max
  Coding DNA Sequence Number=SeqID_61777
MDNMSMRRQGVFRLIWGCIGSGAIAIGVGGVLGIEGRVVAIDLSPLVVVVVAAYNDKMTQEMSQSDNFIEISTNDSVGKVLGKDHTGCMHCLGLGGLHSVAFWSTTSFSGLGSSFSNFDSTESSRLKEELVGLGYSSSMDSFASWKMNSREMEKEVREETPLQGEDESRRSSPPYEAMDKSLEEEGDE

SEQ ID NO: 178556 - protein, 41 aa, Glycine max
  Coding DNA Sequence Number=SeqID_61778
MPLRDVICNQLQRQSGVRLANNPSKSNLIFHKLLEVACKIS

SEQ ID NO: 178557 - protein, 465 aa, Glycine max
  Coding DNA Sequence Number=SeqID_61779
  Gene Ontology: Mol. function=identical protein binding; Cellular component=cellulose and pectin-containing cell wall; Biological process=negative regulation of enzyme activity
  Homolog annotation: Hit_ID=Q9ZUF6; Match level="QueryCoverage=94%, HitCoverage=56%, E-value=1e-156, Identity=63%"; Hit description =Subtilisin-like serine protease, putative
  Pfam annotation: Domain name=PA; Domain location=374-465; Score=49.0; E_value=1.6e-11; Accession=PF02225.12; Description=PA domain
  Pfam annotation: Domain name=Peptidase_S8; Domain location=130-424; Score=-29.6; E_value=3.4e-05; Accession=PF00082.12; Description =Subtilase family
  Pfam annotation: Domain name=Subtilisin_N; Domain location=28-113; Score=93.6; E_value=6.1e-25; Accession=PF05922.7; Description =Subtilisin N-terminal Region
  Pfam module annotation: Pfam domain module=PA::Peptidase _S8::Subtilisin_N; Domain location=374-465::130-424::28-113
  Subcellular localization annotation: CTP_CleavageSite=64; ConfidenceScore=5.01e-01
MASLSTFIFFFFFFFLTQCCFLTSSAKKTYIVHMKHHKKSSVYPTHSDWYNTTLLQSLTLTTTDSDSKSNPLLYSYTTAYKGFAASLNDEQVEELLKSEDVLKVYEDTVYQLHTTRTPEFLGLEKETKLWEGHTAQDLNQASHDVIIGVLDTGVWPESSSFDDAGMPEILARWRGECETGPDFSTKMCNKKLIGARSFSRGFHMASGIEVREKEPVSARDRDGHETYTSSTTAGSHVTNASLLGYASGTARGMAPTAHVAAYKVCWTDGCFASDILAEMDRAIEDGVDVLSLSLGDGSAPYFRDTIIVGAFAAVERGIFVSCSAGNSGPQKASLANMAPWIMTVGAGTLDRDFLAYASLGNKKRFFGVSLYNGKGMGNEPVGLVYNKGLNQSSSICLPGSLEPGLVRGKVVVCDRGINAHMGKGKVVCDAGGVGMILANTTTSGEELVADSHLLPAVAVGRIVGD

SEQ ID NO: 178558 - protein, 52 aa, Glycine max
  Coding DNA Sequence Number=SeqID_61780
MEFFLKIKWIKGCLESSWDLVLVNDSSSQEFKCCKGLRPANPLAPFLFFGDG

SEQ ID NO: 178559 - protein, 313 aa, Glycine max
  Coding DNA Sequence Number=SeqID_61781
  Homolog annotation: Hit_ID=Q00M66; Match level="QueryCoverage=99%, HitCoverage=76%, E-value=1e-50, Identity=68%"; Hit description =Remorin
MAELGFQERSSWRKREKKAKVQDDEDRDADIQEPVELDSARNSFSLALKECQDKRSKFEALLKKAASLDLNNDFGSGSSRRLQTLKKSSISSRRSGTATFPIPGTPNFHIAMYKGWSSEQVPLYAGATQKHVFPFNNGKTLPSKWEDAERWIISPVSADTESVIINAPPRLFFYELKKCLDKFGGFKDVGTNVSRAALRRDMVTQMIPQGSSCSSPNLRPSFSASTLSTLPVTELQTVGSSIRDMQGPIHWKRLRASQSWKKGELSTQSSTWDVSETSKPASKTRGEEPKISAWENLQKAKAEAAIRKLEVTS

SEQ ID NO: 178560 - protein, 170 aa, Glycine max
  Coding DNA Sequence Number=SeqID_61782
  Gene Ontology: Mol. function=calcium ion binding
MPLLVFNSFALYTGKEWRQRQIRKITDRVFDKVKNQIETDNLSFEDLYIAVLLVYNDINKYIPGPHFDPPSKDKVREVKQSCDINLDGDIDRDEFYDFILIMTADTFTIVSQKLILTLVVAPTVAVATKKATEGVPGVGRLVQKIPNSVYASLVTIAAVWFQKKAQSSPL

SEQ ID NO: 178561 - protein, 206 aa, Glycine max
  Coding DNA Sequence Number=SeqID_61783
MEYSLSYYHFQNQLISPASHLPFYIDVIETKWEHDDMLHMDHFSEFLCCCRILDVQELGFVSFTFSFHGTRLRCPIVASRCPCLRTIQGGRAWLEWLNMDGPITRARSKRFQKEFDATPPSPKTARLMVEMIKLGDQMRRMSYEDEERIERMRKKNKESLGRIHSSSEALSVRIENTEQRRKDKSSNSSHREDKGYEEDGGGRRNE

SEQ ID NO: 178562 - protein, 107 aa, Glycine max
  Coding DNA Sequence Number=SeqID_61784
MTIRGTCKTEDFDAQAKEIIQCQRRLPRVKGDCLMSRFVEPPSMDKCCPMSRVVAPTSVKIISLSSFSSPSGWTGVVGATSVKLSEVDMLLVLQARPDFLVEGSLSI

SEQ ID NO: 178563 - protein, 331 aa, Glycine max
  Coding DNA Sequence Number=SeqID_61785
  Homolog annotation: Hit_ID=Q8H812; Match level="QueryCoverage=16%, HitCoverage=10%, E-value=2e-19, Identity=72%"; Hit description =Putative DNAJ protein
GLWGWSCKSTMIARENCALRCLSPACYELIYESDPLEEGEKDFIRSQEYKYCMHKKLDDKNFLLWRQEIEPAIIALGLNHFVAKTRSVSPCLASVYAFELNACLSSWIETLVSELRHTMLDYRPVSDFLSWIKALIDALASVVIYHTSPLKKLKDRFLSGSYVFANTPDLNLEVTSSRQHILQIREVLVAIMAVAEAVSTVVVVVAVGAQSCVKLVNHNHTALTCYNRFNPQYQAANGGNNSNYGNNNNGNYGNNENHNNWSHNQNQNQNWGQNLNQNNWSNSSASNWNSQKNQNHNFRTLILGLLKLWVRKSDFEVEMNLKREEDEKETQ

SEQ ID NO: 178564 - protein, 109 aa, Glycine max
  Coding DNA Sequence Number=SeqID_61786
MGFRKDFLGILTRPLPLIESRLPHITIEEAKGYILAQELRLRKYTRLESSSNCFMPTVNLTQYSSDSRGSGGRSGGGFMLELGLSLLSHASLPLSFWDHAFQIVVYLIN

SEQ ID NO: 178565 - protein, 312 aa, Glycine max
  Coding DNA Sequence Number=SeqID_61787
  Gene Ontology: Mol. function=peptidyl-prolyl cis-trans isomerase activity; Cellular component=nucleus; Biological process=protein folding
  Homolog annotation: Hit_ID=Q43207; Match level="QueryCoverage=99%, HitCoverage=72%, E-value=1e-111, Identity=47%"; Hit description=70 kDa peptidyl-prolyl isomerase
  Pfam annotation: Domain name=FKBP_C; Domain location=182-277; Score =85.3; E_value=1.8e-22; Accession=PF00254.18; Description=FKBP-type peptidyl-prolyl cis-trans i
  Pfam annotation: Domain name=FKBP_C; Domain location=39-160; Score =177.9; E_value=2.6e-50; Accession=PF00254.18; Description=FKBP-type peptidyl-prolyl cis-trans i
  Pfam module annotation: Pfam domain module=FKBP_C::FKBP_C; Domain location=182-277::39-160
MEEDFDIPGGEEMDLGEDEVGEEREIGSGGLKKKLLKEGQGWETPEVGDEVQVHYTGTLLDGTKFDSSRDRDSPFSFTLGQGNAENTFFLLSSFPVQSIESRKLSENCGQVIKGWDEGIKTMKKGENAIFTIPPELAYGESGSPPTIPPNATLQFDVELLSWTSVKDICKDGGIFKKIITEGEKWENPKDPDEVLVKYEVHLENGKLLAKSDGEEFTVREGHYCPALSKAVKTMKKGEKVLLTVKPQYGFGEKGKPEQGDEGAVPPNATLQITLELVSWKTVSEVTDDKKVIKKILKEGEGYERPNEGAIVK

SEQ ID NO: 178566 - protein, 405 aa, Glycine max
  Coding DNA Sequence Number=SeqID_61788
MMNLTSKIGWVSLNNMSKKLFKFDMNVFHRFKDRLFKVLDTDVGADDLPLMFNQPWTTKCLTLSSFVSKVGIIGDFPWRPLMKQAEPVGGTVPPSVVAPVLSLRELRKSSRLTPSSGRPSSLQDVPLVPSAIEASALVVTVPLPLPIVPVQEATLVVGVDVLATLVGLVMTPSSIIVAPLLSPSVATMSAPHLSPPPALAPRIPPSIVLTSASPFSSSHPLVSLDHIYTSSDVDPHGALRKVASLEAEVAKWRATARTVWRVECPKVANATVSFAEAVKSNHQLLSKVGSVLASLDSDELFECCKDLKKKKKKDLVGKVEGIVAEKNELAKMVGDLEAKLKELESRLEEFELRATRKREAKKELLQKGGRGDVKDNVLLDKEDIVAKGEAGEEQDAKEQDDDANV

SEQ ID NO: 178567 - protein, 467 aa, Glycine max
  Coding DNA Sequence Number=SeqID_61789
  Gene Ontology: Mol. function=hydrolase activity, hydrolyzing O -glycosyl compounds; Cellular component=membrane; Biological process =carbohydrate metabolic process
  Homolog annotation: Hit_ID=Q8LB06; Match level="QueryCoverage=94%, HitCoverage=95%, E-value=1e-161, Identity=61%"; Hit description =Putative glucan endo-1-3-beta-glucosidase
  Pfam annotation: Domain name=Glyco_hydro_17; Domain location=29-352; Score=453.9; E_value=2e-133; Accession=PF00332.9; Description =Glycosyl hydrolases family 17
  Pfam annotation: Domain name=X8; Domain location=377-462; Score =135.7; E_value=1.3e-37; Accession=PF07983.3; Description=X8 domain
  Pfam module annotation: Pfam domain module=Glyco_hydro_17::X8; Domain location=29-352::377-462
MAMLLLIPLFLSSILLFPISSATTFSPQPGICYGQLGDNLPPPRESVSLITSVHAKRVKLYDANPSILHALQDTRLQVSIMVPNDLILNISTNQTLSDQWVSDNVVPYHPRTLIRYLLVGNEVTSTTAATATWPHLVPAMRRIKRSLKSHGIRKIKVGTSSAMDVLQTSFPPSNGAFRKDLTAPVMKPMLKFLNRTKSFFFLDVYPFFTWSADPLNINLDYALFESKTVTVKDPVSGLVYTNLFDQMVDAVYFAMKRLGFPGVRIFIAETGWPNGGDLDQIGANTYNAATYNRNFIKKVTKKPRVGTPARPGSALPSFLFALFNENQKPGPSTERHFGLLHPNGSRVYDVDLSGETPEAEFRPLPVPENNEKFKGRIWCVAARRDNATALTAALAYACSQGNGTCDPIQSKGKCFKPDSVFWHASYAFSAYWAQFRKVGGTCYFNGLATQTAKDPSYGSCKFPSVTL

SEQ ID NO: 178568 - protein, 146 aa, Glycine max
  Coding DNA Sequence Number=SeqID_61790
MLQPYGISIGLKEHSNPVTPKAYTRRVRQGLSLLIQDSSISSDSLIFLRFFPLTAPIEFSNIRETNKGLKPPLVLSGYNSFFSLREYYLTNTNGEDHFGFLWERKRLRCKRYFSQLKDPIKVSNGDNSWNWVANGVLKFHDDPTVN

SEQ ID NO: 178569 - protein, 69 aa, Glycine max
  Coding DNA Sequence Number=SeqID_61791
MGFAKYTGKRVKEVTQRWRKRHEDEGGLRKAAIALLWFQITECKIQMPTTTLAQKGSLVYIKTDPSAKH

SEQ ID NO: 178570 - protein, 158 aa, Glycine max
  Coding DNA Sequence Number=SeqID_61792
  Homolog annotation: Hit_ID=Q9SH74; Match level="QueryCoverage=73%, HitCoverage=25%, E-value=7e-07, Identity=28%"; Hit description =Putative replication protein A1
MWTIPRSPRFTIDQILIDNEGDKILAQMKNVDLEIGNINFQVGQTYIIQSFEVEINSDAIGEVVEIGQWNLHGKPKKMVFTMKDECGSVISCTLWETLVMELKDCLDKHVTGPVMLLLSMAKIKEATAIYNSMYSSQISVNSDFKEIVELKDWLAASY

SEQ ID NO: 178571 - protein, 180 aa, Glycine max
  Coding DNA Sequence Number=SeqID_61793
  Homolog annotation: Hit_ID=Q2R037; Match level="QueryCoverage=33%, HitCoverage=18%, E-value=2e-09, Identity=54%"; Hit description =Expressed protein
  Subcellular localization annotation: CTP_CleavageSite=57; ConfidenceScore=5.73e-01
MASVSSLWPPTPSASSPPPPPLITSFASSMSIPTPPLPPSRLLPLKLKFGKCTSIPRKTYFWHCIESFWHPSCSLSLPLERNNSARSESGFVGVLVKFLLKQANVDKRTCDLFGNRDLMNIAHNVARSLKVSYKNSATALVKEVRAMESSYPPKEPKCILFPSQMLSSEVKLVLSTMELL

SEQ ID NO: 178572 - protein, 164 aa, Glycine max
  Coding DNA Sequence Number=SeqID_61794
  Gene Ontology: Mol. function=sequence-specific DNA binding; Cellular component=nucleus; Biological process=regulation of transcription, DNA-dependent
  Homolog annotation: Hit_ID=Q1S8N0; Match level="QueryCoverage=78%, HitCoverage=52%, E-value=2e-13, Identity=40%"; Hit description =Leucine zipper, homeobox-associated; Homeodomain-related
MFIGNIKVIGHQKMFLFNIACHMQIYSGMEAKQQALAERSSPMEKMNYRNQEKKKQLTSDQLKARKQFVNQMRLQLALNSFTCCCSLIFREQHKKLFILEMKLATTRQGRCGRWKNKQLEHLYDSLQQEFNVISKEKQKLKQEDGFYETAVESENFLDVGYNDG

SEQ ID NO: 178573 - protein, 183 aa, Glycine max
  Coding DNA Sequence Number=SeqID_61795
MELSKGKEVLLCLASEGYKWKVDSGFSQKLRERKAQACSSERDGNKVGSFVGWRLVSQICHLMTSIPRIRLVLIFREGNGCADVLADYASFIVVVFSRPSCPRRSLNSSTTLLSSLEVIVGVDDIAFEVWQKEHWGLGCGLGHGGGALGMSWFYFSSLYLVVDFSRYKHEVEVSGQLGQKSGV

SEQ ID NO: 178574 - protein, 189 aa, Glycine max
  Coding DNA Sequence Number=SeqID_61796
MDADGNCKAIRVIFFISLRIVVILDMLDASYAYSFTADIELMGSLFSMANTKANQSESSATSPNETYKRQRMSPASVEECPTLIPNIPDELYPFRLLLDFLEFVTTMVCSLGSHTWKNIKTAYMNRKLAYNILTTNPNAPPPWPRPQPKPQCSFCHTSNAMSSTPTITPTPTEFNKRHQNARDRGVHTF

SEQ ID NO: 178575 - protein, 122 aa, Glycine max
  Coding DNA Sequence Number=SeqID_61797
  Gene Ontology: Mol. function=nucleic acid binding; Biological process= DNA integration
MEHWKTKKVLIYLHRIKDHMLTYRRFDHIEVIGYSDSNSAGCVVTRKSTLGYVFLLAGGVVLWKNAKQSVVDTSTMEDEFVAWLGIVDSIARPLKVYFDNSARVFFSKNNKYSMGAKHMELK

SEQ ID NO: 178576 - protein, 127 aa, Glycine max
  Coding DNA Sequence Number=SeqID_61798
  Homolog annotation: Hit_ID=Q9LU17; Match level="QueryCoverage=33%, HitCoverage=4%, E-value=4e-11, Identity=76%"; Hit description=Cell division protein FtsH-like
MRNKIKNPNVMDYMAVASMTDGMVGAELANIIEVAAINMMRDSRTEVIAYTILPDSYCSVSTIRSPLKNAMLQDSKYRARRIKKEQNENVEILKLVYKWRNNSDSGIPTIRTMAYSREVNAKPKEAS

SEQ ID NO: 178577 - protein, 85 aa, Glycine max
  Coding DNA Sequence Number=SeqID_61799
MSRNLTDYAIIPSLASGMLRNFMYCTLTLPFNSRHVAELHGLPNDGCQVPRSGQARVASQQTDDPWTKLGIVINYNKGIVNFLQG

SEQ ID NO: 178578 - protein, 192 aa, Glycine max
  Coding DNA Sequence Number=SeqID_61800
  Gene Ontology: Mol. function=RNA-directed DNA polymerase activity; Biological process=RNA-dependent DNA replication
  Pfam annotation: Domain name=AT_hook; Domain location=136-148; Score =14.9; E_value=0.061; Accession=PF02178.9; Description=AT hook motif
DDGEIEGDVNHRIQAGWMKWRKASGVLCDAKVPIKLKGKFYRTAVRPAILYGTECWAVKSQHENKVGVAEMRMLRWMCGKTRQDKIRNEAIRERVGVAPIVEKMVENRLRWFGHVERRPVDSVVRRVDQMERRQTIRGRGRPKKTIREVIKKDLKINGLDRKAPLATHVINVVEVCYILHVWAIHVTLSSKR

SEQ ID NO: 178579 - protein, 88 aa, Glycine max
  Coding DNA Sequence Number=SeqID_61801
MAILEAALSVTLEQAHMITEFAEATWWHNGEAIEQKEVLFQEDRKKADHKDIQVESLSCSKHFTEIQAQNAQTQQGIQMQKTFQRPSL

SEQ ID NO: 178580 - protein, 89 aa, Glycine max
  Coding DNA Sequence Number=SeqID_61802
MALSVLTVKLMEHGLLSPERAKRAFEKKQRKQKQLRTGTPVKPSKPATKTETSQKQQQTSKNGDIKAKKRIVESDDDDDFILSHKRRKG

SEQ ID NO: 178581 - protein, 117 aa, Glycine max
  Coding DNA Sequence Number=SeqID_61803
MALLLWKNCGNVATKRSVRSCEEKQGLEGTQRGKELEEFNLFIEEMEFMDIPMRYLGSLPLTSEKQPCGLGPKPFGVLNCWFQDSRFFEVMKDAWRKQDVVGCGGAYGGKGGSKEVL

SEQ ID NO: 178582 - protein, 98 aa, Glycine max
  Coding DNA Sequence Number=SeqID_61804
  Homolog annotation: Hit_ID=Q10P22; Match level="QueryCoverage=46%, HitCoverage=14%, E-value=1e-13, Identity=67%"; Hit description=Rap8, putative, expressed
  Subcellular localization annotation: CTP_CleavageSite=36; ConfidenceScore=5.42e-01
MVVSNWYFFVDTHLKVKSKSTSSSSKTVTKTTTKVREKKVYSLPGQKHDPPEQKEPLRVFYESLSKQIPTSEMAEFWLVSFQSYSCLPTIFTPMNEHW

SEQ ID NO: 178583 - protein, 108 aa, Glycine max
  Coding DNA Sequence Number=SeqID_61805
  Gene Ontology: Mol. function=3-deoxy-8-phosphooctulonate synthase activity; Cellular component=cytoplasm; Biological process =biosynthetic process
  Homolog annotation: Hit_ID=O50044; Match level="QueryCoverage=60%, HitCoverage=22%, E-value=6e-14, Identity=61%"; Hit description=2 -dehydro-3-deoxyphosphooctonate aldolase
MFLLPICKASRCRWYQNLASKIKEAKDKRGHAVKNSQGNDLIVDPRNLEWMREANCPIVADITHSLQQPAGKKTYTGNILIAVNPIQRLPHLSATSTIAKYKGVAFGE

SEQ ID NO: 178584 - protein, 80 aa, Glycine max
  Coding DNA Sequence Number=SeqID_61806
MHGNIANRRWQWRFADHLPRGKENASGDGEFLTSANRLSFWRVRAQGVATAIGNLRASCNSHQRFREEEIASAGSDLSAI

SEQ ID NO: 178585 - protein, 559 aa, Glycine max
  Coding DNA Sequence Number=SeqID_61807
  Gene Ontology: Mol. function=RNA-directed DNA polymerase activity; Cellular component=intracellular; Biological process=RNA-dependent DNA replication
MDEESPIKTLTIYETTRGNQDDVFYVDPRDDTIDKSPKPIKELINLQHGPKPRQNIQLNKDLTSIICHKLVICPQAKQSKECRFIRMATIGYVRVCPKDAYPLPSIDRLVDGESSFQLLSFLDAYSGYNQIRMHPHDEEKTAFITEDANFCYRVMPFGLKNAGATYQRLMDRVFKKQIGWNVKVYVDDMVIKSHSMAQHVADLEEVFREIQKYDMRLNPKKGTFSPTNVREVQKLNGRLASLSRFLPKLVEKVRPFNKLLWKTKLFQWDKACEKAFIAFKPYFLSHQVTVKTNHPIRQVLQKPELAGRMMTWSIELLEFDLQYEHCDSMKTHFMADFLVEFTSNVQPTHEWWNLYVDGVSNVKGTGAAGKRSGARKLRCYSDSQLVQGQFAKSYQAKETVLLIYYHDVKTLVDEFDCFKIYHIPRESNARADLLSKLASTKKIGHLKTIIQETLQPPTVDTKEVMIRKEKEPDWMNPYKNFLTQGVLPPNESEAQRLKRKASYYIILDGELFRRGLTTPFLKCLNNLQADYIMRDFTASIWGALPGNQCSAHWILLAET

SEQ ID NO: 178586 - protein, 48 aa, Glycine max
  Coding DNA Sequence Number=SeqID_61808
MGWRIVGRDILAMTGERCALGNGSLVFKSVRPLNCSNQYLMLGVGGNN

SEQ ID NO: 178587 - protein, 316 aa, Glycine max
  Coding DNA Sequence Number=SeqID_61809
MFEFNSNMFHKFKDHFFKMHDGNGEPRIPFYGQSGPMRVNPPRVSEASEDKVVEVKPDVLPPVATKRKHNEGAEGSGQCKKSKAPFSLQTLKQAIGMMFGSSRPFPANSQGPPLAPLVVQVVIVVAAVSDPPCSTVSAYSSNSCSFFLYTGYVSPFGNSYFFSSFFYYDAIVKCWCDNNKRLGEPASSFLGLAILSFDCFAFSNAFLLSRSPTNFVSPFDQNLIRSVGALNKITSLKAEVAKWRAIAQTVWRMERLKVVDDVFAKLVSTRLDGDKEFELEAIKEKEANKELEEELLIFKKEVVEQHQERIFQYRQA

SEQ ID NO: 178588 - protein, 79 aa, Glycine max
  Coding DNA Sequence Number=SeqID_61810
MKLGKDHVQVPQYGNLEGVQQKGQVQDLEHAVIDVEEGWITWISAHEWELVLPASLDSHLAGVAWLGQLKLVLQSLDTH

SEQ ID NO: 178589 - protein, 226 aa, Glycine max
  Coding DNA Sequence Number=SeqID_61811
  Gene Ontology: Mol. function=ATP-dependent helicase activity; Biological process=DNA recombination
  Homolog annotation: Hit_ID=Q1RTN4; Match level="QueryCoverage=89%, HitCoverage=49%, E-value=6e-67, Identity=67%"; Hit description=ATP -dependent DNA helicase RecQ
MVRSLNIVKGLDVAGKGFSRVLQNRHPNLVARCLEDFTTACALRQKNGSSRIFRTSSTDAIDREQLSEFWNQDEEANGSEEDIPDSDGSVVIRLYIHVDEFSLVDGNEFVNNLTRSKLQSKLGVNEKLAMLQRAEENFYRNNNAYKQSNKVDKNAISDPMRGASRQRLQNALKQVQQRLDNFKVEMETSASLLKDECYKKYGKAAEQPLTPAEESLTSLPEPQIPS

SEQ ID NO: 178590 - protein, 91 aa, Glycine max
  Coding DNA Sequence Number=SeqID_61812
MAANMKSFMPKTNNAREFMKLVRDCSQSNIIDKPITGSLSKMANLAANLNFIGILEERILKKMKDNSIHLMTHDGASTSKSKPDKKDKGKS

SEQ ID NO: 178591 - protein, 414 aa, Glycine max
  Coding DNA Sequence Number=SeqID_61813
  Pfam annotation: Domain name=Transposase_23; Domain location=264-334; Score=-1.4; E_value=0.0016; Accession=PF03017.5; Description =TNP1ENSPM transposase
MATPAASPLPPPPADASASPSTLKRTLVHVDPTTDKVDGPHKKKLRTYLGIVARDKVDVAYENWKEVPAAQKDLIWEDIQPTRKLALAADKDSVDDTVCEKYDISKEKWAQFCQTCRDPRGRLDEVAQSGSTKGVIDRPSPIRRHVKWKMARTKKSGQTTSEAAKKIAEKIDVLTAALGRPEHPGRVHAAGVGVTIKQYFGSAPRTSRSSSSLPPEDLHMQSQFQSQMQSQELALPLEPEVGPSDARVSTKESCVDPLGNNPETGKSNKCGLYIEENPSRMVSLGRLYEGSTAVHNIPLLHDQVKVGVEEVKDEEARIPVPTDKVTLVGQTLNTLLAWPTHHVKRLSEQVMWDATMFGVFNQNFPLYIKHEDLFEIAYDYLLYSCGFCKYASGEFRCVWIPQATVHLEIWAIAI

SEQ ID NO: 178592 - protein, 311 aa, Glycine max
  Coding DNA Sequence Number=SeqID_61814
  Gene Ontology: Mol. function=translation initiation factor activity; Cellular component=eukaryotic translation initiation factor 2B complex; Biological process=cellular biosynthetic process
  Homolog annotation: Hit_ID=Q1RTN1; Match level="QueryCoverage=70%, HitCoverage=66%, E-value=3e-86, Identity=69%"; Hit description =Initiation factor 2B related
  Pfam annotation: Domain name=IF-2B; Domain location=59-294; Score =178.4; E_value=1.8e-50; Accession=PF01008.8; Description=Initiation factor 2 subunit family
  Pfam module annotation: Pfam domain module=IF-2B::RVT_2; Domain location=59-294::12-144
MESGNSEKLLNVMKEELKSMDDNKFWDLVKFLEGFTQKDGINYKETISPISKKEFFRIVLALVAHYDLELHQMNVKITFLNGDLEEEVYMDQPKGDWEMYIDAAEVMLEDDVASNRAIGSYGASIIQHQTEKQKFSVLTHCNTGSLATAGYGTALGVIRALHSAGVLERVYCTETRPFNQGSRLTAFELVHEKLSGTLISNSAAAALMKAGHVDAVVVGADRVASNGDTANKIGTDSVALSAKFHNVSKELLNTHGGLGEQIAASGISVWNPAFDVTPANLISGIITEKGVVTKTTAGGAFDIKAFVQKTG

SEQ ID NO: 178593 - protein, 1053 aa, Glycine max
  Coding DNA Sequence Number=SeqID_61815
  Gene Ontology: Mol. function=sucrose-phosphate synthase activity; Biological process=sucrose metabolic process
  Homolog annotation: Hit_ID=Q1RTA0; Match level="QueryCoverage=99%, HitCoverage=99%, E-value=0.0, Identity=81%"; Hit description =Glycosyl transferase, group 1
  Pfam annotation: Domain name=Glycos_transf_1; Domain location=467 -650; Score=79.3; E_value=1.2e-20; Accession=PF00534.10; Description =Glycosyl transferases group 1
  Pfam annotation: Domain name=S6PP; Domain location=763-1018; Score= -68.4; E_value=8.6e-06; Accession=PF05116.4; Description=Sucrose-6F -phosphate phosphohydrolase
  Pfam module annotation: Pfam domain module=Glycos_transf_1::S6PP; Domain location=467-650::763-1018
MAGNEWIDGYLEAILSTGASTIEEQKPAPVTLKDGGHFNPTKYFVEEVVASVDESDLYRTWIKVVATRNTRERSSRLENMCWRIWHLTRKKKQLEWEEVQRVTSRRWEREQGLREAAEDMSEDLSEGEKGDSVVEMVQSDTPKKKFQRQTSNLEVWSDDKKEKKLYVVLLSLHGLVRGENMELGRDSDTGGQIKYVVELARALAKMPGVYRVDLFTRQISSPEIDWSYGEPTEMLTAGDDDDDNLGESSGAYIIRIPFGPRNKYLRKELLWPYIQEFVDGALAHILNMSKVLGEQVGGGQPVWPYVIHGHYADAGDTAAILSGALNVPMVLTGHSLGRNKLEQLLKQGRQSKEDINSTYKMMRRIEAEELSLDAAELVITSTRQEIDEQWGLYDGFDVKLEKVLRARARRGVNCHGRYMPRMAVIPPGMDFSNVVRQEDGPEIDGELAQLTASVEGSSPKAMPSIWSDVMRFFRNPHKPVILALSRPDTKKNLTTLLKAFGESRPLRELANLTLIMGNRDDIDEMSSGNASVLTTVLKMIDKYDLYGQVAYPKHHKQSDVPEIYRYAAKTKGVFINPALVEPFGLTLIEAAAHGLPMVATKNGGPVDIHRALNNGLLVDPHDQQAITDALIKLLSDKNLWHDCRKNGWKNIHLFSWPEHCRTYLTRVAACRMRHPQWQTNTPGNDIAGEESFNDSLKDVQDMSLRLSIDADLAGLSSGSDMQDQVKRLLSRMKKPDAGGSNDSDGGNKMSDNVTGKYPLLWRRRRLIVIALDFYDNNGAPDKKMIQIVQRIIKASQLDPQNARVSGFALSTAMPMQETVEFFKSGNIQVNDFDVLICSSGSEVYYPGTYMEDGKLLPDPDYEVHIDYRWGCEGLKKTIWNLMNTAEGEEKQSSSPIVEDSKSSNAHCISYKIKDLSKAKRVDDLRQKLRMRGLRCHPMYCRGSSCVQVIPLLASRAQALRYLFVRWGLNVANMYVFLGETGDTDYEELISGTHKTIILKGVVSKGSEGILRGPGSYHREDVVPNESPLVACISETTEDKIANTLKELSKSGAM

SEQ ID NO: 178594 - protein, 46 aa, Glycine max
  Coding DNA Sequence Number=SeqID_61816
DVKTSHATSAFCSPCLHAPTVVKQFTAAFCKLQIYKSFPGCQDISW

SEQ ID NO: 178595 - protein, 73 aa, Glycine max
  Coding DNA Sequence Number=SeqID_61817
MKVVFVIMEAGPCRYHNTNETLDCYCSIMPCIVMIIHLEKGMNFWGMEWSGAIVKEGDGVRCDPQPSGVRKSN

SEQ ID NO: 178596 - protein, 273 aa, Glycine max
  Coding DNA Sequence Number=SeqID_61818
  Gene Ontology: Mol. function=helicase activity; Biological process =viral genome replication
  Homolog annotation: Hit_ID=Q9LTU4; Match level="QueryCoverage=98%, HitCoverage=24%, E-value=3e-51, Identity=50%"; Hit description =Helicase-like protein
MEAQTILHSRRLFQQFIVDGYTVVESERLSFIRRNQSKLRVNKYCDMHETSNHGAIQGSNRGKWVILPSTFVGSRRYMDQLYFDDTYTIEFQKSGLPHAHLLLFLHPSSKYPTPKDIDNIICAEMPSKNEQNELYQLVQTHMIHGPCGIANRSSPCMKDGKCSIFYPKKFQTCTVVDSDGYPIYRRKDTSNTILKSGVILDNYSVVPYNPTLLLRYQAYINIEWCNQSTSIKYLFKYINKGYDKITATIENKEDVHKNLDEIKHFLDCRSITN

SEQ ID NO: 178597 - protein, 119 aa, Glycine max
  Coding DNA Sequence Number=SeqID_61819
  Homolog annotation: Hit_ID=Q9FHV5; Match level="QueryCoverage=97%, HitCoverage=7%, E-value=2e-18, Identity=41%"; Hit description =Helicase
MLDHCNSHAKCFRMARDILKDKVVPDVKLKLISNREKDGRIDNIPTVSEVATLITGDAEVGLTQDIILETQTGQLQRINELHTSYLALQYPLLFPYGEDGYRHDVLHRNTSMNQSQKRV

SEQ ID NO: 178598 - protein, 65 aa, Glycine max
  Coding DNA Sequence Number=SeqID_61820
MTELFAVVKTNTLFAVYRPLFRRETLEGRISSANREMKQLNRKGGGPPWGLRTATKQNKLATLEE

SEQ ID NO: 178599 - protein, 334 aa, Glycine max
  Coding DNA Sequence Number=SeqID_61821
  Gene Ontology: Mol. function=RNA-directed DNA polymerase activity; Cellular component=chromatin; Biological process=chromatin assembly or disassembly
  Pfam annotation: Domain name=rve; Domain location=132-285; Score= -14.1; E_value=0.09; Accession=PF00665.16; Description=Integrase core domain
MVGNGNEIECHQLCTGVVIHVQVQAFTVDLHVLPLCGADLMLEVQWLKSLGPVFTNYNDLTMKFMHSGRMEQVVFLTFVSYPSSPLNPNQQLTSPLPKNIDPNSQIHHPFPSSDDLTTEIKNQVRSMLQNGIIRQSMSLFSSPVLLVKKRDSSWRFSVDYRALNAIMPHYTAHTVALLFMDIVGKLHGMPRSLVSDRDLLFISRFVQELFKLSGTKLGVSSAYHSQFDGQIEAEWSYNTSRYSTGVSLFEITFDKKPPSFPQYLVGTSNIEVVDDFLTNREVVFASLKKKLMKAQKRMKQFADNHTREADWASLEVSYHLKDKVFLDGIRDDRK

SEQ ID NO: 178600 - protein, 59 aa, Glycine max
  Coding DNA Sequence Number=SeqID_61822
MTPNGLIQQKYGNKNKGTRIGRGHNPRIDKSMNATRISTLDKFRVSKKEPKRTSLTNNG

SEQ ID NO: 178601 - protein, 117 aa, Glycine max
  Coding DNA Sequence Number=SeqID_61823
  Homolog annotation: Hit_ID=Q1T3X4; Match level="QueryCoverage=72%, HitCoverage=5%, E-value=1e-14, Identity=50%"; Hit description =Prefoldin; t-snare; Protein kinase PKN/PRK1, effector
MPAATSTLNQLLWGFAERERRGAERGGVGEEILSQAKPDEPEMFDVVNDRNTLKEPFLGLCKLKQALSLVDLPEMKWLTDSLLRAQDNMHTLQEEISTIKESSRNYIDQLSFSLLLA

SEQ ID NO: 178602 - protein, 268 aa, Glycine max
  Coding DNA Sequence Number=SeqID_61824
  Pfam annotation: Domain name=zf-CCHC; Domain location=92-109; Score =22.8; E_value=0.00017; Accession=PF00098.13; Description=Zinc knuckle
RENERKPQEANINLPYFHGKDNVEANLDWEIRVEQQLKRKSTSKSYGSHSYPKKDQGQGILGMTPSKPKDDKGKTIEKQPLKASMQEKTSSIKCFKCLGRGHITSQCPTKKTMIMRGQDIYSSQDEATTSPSSSESEEAKGEEYSEEIYPQEEGQPLMVKEECKEVSVSSKRLAKKESHFEIKTNIKEISPLRQPPHLLLCKKTLVSTSTPLRLEVIPQVKELLDEGLVCKSLNPCALLVPKIVVKGVPIDPKRIKVIPDWPTPPSIK

SEQ ID NO: 178603 - protein, 58 aa, Glycine max
  Coding DNA Sequence Number=SeqID_61825
MRKKKIASYGSRFDEEMSKIGRFEGLGMEGRRKEEGVAQGFLENVLFIDQDAWPSVLV

SEQ ID NO: 178604 - protein, 120 aa, Glycine max
  Coding DNA Sequence Number=SeqID_61826
  Subcellular localization annotation: CTP_CleavageSite=14; ConfidenceScore=5.57e-01
MAESSKKRKGSSASASASRAHHSGATNASTAPIPPSISSSTLFSSEEQQKRYSKLFSSRTIIDPKFIDMEFFSAESFDCIQAFQNLGLIPFMSLQLLVYPELVKAFYCNLEIQDNTLISE

SEQ ID NO: 178605 - protein, 311 aa, Glycine max
  Coding DNA Sequence Number=SeqID_61827
  Gene Ontology: Mol. function=glutamate-tRNA ligase activity; Cellular component=aminoacyl-tRNA synthetase multienzyme complex; Biological process=tRNA aminoacylation for protein translation
  Homolog annotation: Hit_ID=Q9FEA2; Match level="QueryCoverage=97%, HitCoverage=50%, E-value=1e-118, Identity=68%"; Hit description =Glutamyl-tRNA synthetase
  Pfam annotation: Domain name=tRNA-synt_1c; Domain location=1-105; Score=-185.2; E_value=0.021; Accession=PF00749.11; Description=tRNA synthetases class I (E and Q), catalytic domain
  Subcellular localization annotation: CTP_CleavageSite=44; ConfidenceScore=5.08e-01
MCLQALGFPMPYFAHVSLILAPDRSKLSKRHGATSVGQFQTLITAQSQFREMGYLPEAMVNYLALLGWGDGTENEFFTLDQLVEKFTIERVNKSGAIFDSTKLRWMNGQHLRARPSEELTKLIAEYWKTSGLLTVSDGPFIDEAVHLLKDGIDLINDADKALANLLSYPVHSTLQSYNFLHVDGSDEAESVLLDNLSEFAASLLAAYDSGDLVAALEEGHTGWQKWVKGFGKSLKRKGKSLFMPLRLLLTGKLHGPDMGASVALLYRAGTSNVVAPESGFVTLDERFKMLRQIDWEALSKDQPVKETAAPV

SEQ ID NO: 178606 - protein, 111 aa, Glycine max
  Coding DNA Sequence Number=SeqID_61828
  Gene Ontology: Mol. function=protein kinase activity; Biological process=protein amino acid phosphorylation
  Homolog annotation: Hit_ID=Q2R017; Match level="QueryCoverage=97%, HitCoverage=6%, E-value=3e-36, Identity=62%"; Hit description =Helicase, putative
MEAVNNNEGRMFFLYGYGGTGKTYIWRTLANSLKAKNQIVIMVASSGIASLLLPGGRTAHSKFKIPVPIFEDSTCNILQGSQLAELLNQTNLIIWDEAPMAHKFCFQALDQ

SEQ ID NO: 178607 - protein, 150 aa, Glycine max
  Coding DNA Sequence Number=SeqID_61829
MLVLLLKSVTFVVVTLWSLLTRLIFNTIAYTIVLLLQGLKGSGEGSLGIFQQVADGIRGCFEFILQITISSINSIISNVFDILKESITGSVAASGSVAAELAEKLKTSLKESLKQVPQLFEELSNMMSEMVKELWDNYKGAVGYVTENVA

SEQ ID NO: 178608 - protein, 89 aa, Glycine max
  Coding DNA Sequence Number=SeqID_61830
MAIYRKRPFSAGEAHPGEMELAQASWSSPRGRVLGVGKLRKEGQNVEKGKEEKKKKKQSRGAADSNCGSFLTSFLLLALYPVQQSISFS

SEQ ID NO: 178609 - protein, 78 aa, Glycine max
  Coding DNA Sequence Number=SeqID_61831
MSHPTQSSELNSLRHYDVDMARTKGKESLEGIGGHMTRARTKKAKEALQQVLTMLFEFRPKLQVEKFRIVNCTMFQEE

SEQ ID NO: 178610 - protein, 115 aa, Glycine max
  Coding DNA Sequence Number=SeqID_61832
  Homolog annotation: Hit_ID=Q69KL6; Match level="QueryCoverage=38%, HitCoverage=14%, E-value=4e-09, Identity=71%"; Hit description =Putative UDP-glucuronic acid/UDP-N-acetylgalactosamine dual transporter
MKDENGLPTTTTTAATKKESMDSSLFRKGRKEEEALHASGLPYTVALSVILTAAGVLIATLGDFSFDLFGYSMAFVSIFFLGNNMLNGIKVENSVAPSLRANVSIVGTLGCFTQP

SEQ ID NO: 178611 - protein, 49 aa, Glycine max
  Coding DNA Sequence Number=SeqID_61833
  Gene Ontology: Mol. function=actin binding; Cellular component=actin cytoskeleton; Biological process=actin cytoskeleton organization and biogenesis
  Homolog annotation: Hit_ID=O65809; Match level="QueryCoverage=74%, HitCoverage=28%, E-value=2e-11, Identity=89%"; Hit description =Profilin-1
MDDFNEPGSLAPIGLYLGGTKYMVIQAESGAVIRGKKILVNHEIKSQST

SEQ ID NO: 178612 - protein, 148 aa, Glycine max
  Coding DNA Sequence Number=SeqID_61834
MLKFTAVQLVDDEAVKDSQAFDATEDQTHPYLSTLTVEPTSSIQPNELEFTIDPGLPNKGLSPYSEDEDKVLHNQLQEEDDKEEVEPVSPITTIPPYYIPPHMQNFEESNFQDFAYDQSLDCEKVQHPMGTLFEGMCFLTKQEVQHAL

SEQ ID NO: 178613 - protein, 315 aa, Glycine max
  Coding DNA Sequence Number=SeqID_61835
  Gene Ontology: Mol. function=protein serine/threonine kinase activity; Biological process=protein amino acid phosphorylation
MAKSSAEAEYTTSAEGVSVVKATELESISSHMGSLALTDEASIGFNQHVKHQNTQQAESETSLVYEGGNSSPLPKRTIVTQDHLQQFKNFLRQPATQSWIVGLSCPTTTSIHSTSAPMLNSITHCSNSCIDSGSHVAAEPYGNLNVNPHPITQRDVKSPNNSLKDTNTMSIDQVAREVQDCNSLIDAELTLKQSDPSKEQQGCMLKDISISKCTSCCDEMLSKGEESTTVTNIQPQAFLTIAYDPELFFKVNGKLYQWLGKIGSGGSNEVSQCALLRASEGEAHGCAFQRRKDARSRHQHLFVENVGKTEGNQSK

SEQ ID NO: 178614 - protein, 123 aa, Glycine max
  Coding DNA Sequence Number=SeqID_61836
MRGLNQLGVVVETIYEEECEFSSSKSSPSSPSPSFSSSSASLHSRVKAWSLKISHETNVLIRVQGICFHLRKVKWLWPVSVKQQREWERVAYTSHPPPLHKRPRIPFFADSTSIPLTPHRFSL

SEQ ID NO: 178615 - protein, 58 aa, Glycine max
  Coding DNA Sequence Number=SeqID_61837
  Homolog annotation: Hit_ID=Q1SCN3; Match level="QueryCoverage=56%, HitCoverage=18%, E-value=2e-07, Identity=97%"; Hit description=MatE, putative
MISAGGFIGIWVALTIYMGLRAFAGFLRTLGVPKELMTAHGRHRSYSFILGLGFSGVC

SEQ ID NO: 178616 - protein, 88 aa, Glycine max
  Coding DNA Sequence Number=SeqID_61838
  Homolog annotation: Hit_ID=Q651X9; Match level="QueryCoverage=42%, HitCoverage=6%, E-value=5e-09, Identity=68%"; Hit description=SunL protein-like
MKVVVGKYYSSTTTHSRCQRHARDPRIGSGPIVWEGDRQLCHTSLIASLVVSIVDPQPGQAIIDCCVVPGRKSIYMASHLSGQGLRTH

SEQ ID NO: 178617 - protein, 59 aa, Glycine max
  Coding DNA Sequence Number=SeqID_61839
  Gene Ontology: Mol. function=RNA binding; Biological process =regulation of transcription, DNA-dependent
  Homolog annotation: Hit_ID=Q9LK54; Match level="QueryCoverage=93%, HitCoverage=10%, E-value=1e-16, Identity=76%"; Hit description =Similarity to SUN and FMU proteins
MKLAKVALRPGVGIMVNGILRKVVVLKEKESLPFPKVKGDDCAQARALATLYSHPVVSV

SEQ ID NO: 178618 - protein, 108 aa, Glycine max
  Coding DNA Sequence Number=SeqID_61840
VKGKEKEEKDSSKKIVKKENHFATKDDIKKALLLKQSFYLPLSRETSLSTAIPLELEVIPHVKELLDEGLELIWDTIGLSYFLVGIMNMKIQKKVLMEEAQSFKNLWI

SEQ ID NO: 178619 - protein, 107 aa, Glycine max
  Coding DNA Sequence Number=SeqID_61841
MVKTRRRWRRLAKWRRQTQTAIAQRCRTEIRENVKAFQGLLTRSIWSSIVSSIPCMRQIGQVDDSILADVQQKFGLNTRQDDQLDAIWEKAAKEERVDAEAKVSQAE

SEQ ID NO: 178620 - protein, 95 aa, Glycine max
  Coding DNA Sequence Number=SeqID_61842
  Subcellular localization annotation: CTP_CleavageSite=62; ConfidenceScore=5.76e-01
MQQQQGLLRFLPQFSSSSSSSSFSPSAPRKHHRVNFANAKYLTGMRCIRVAPPIGYTQGNASCTKKTPEKKVSIKVTSLATGHSRRRLLHPTWQK

SEQ ID NO: 178621 - protein, 392 aa, Glycine max
  Coding DNA Sequence Number=SeqID_61843
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=UPI000034F02F; Match level="QueryCoverage =95%, HitCoverage=20%, E-value=3e-97, Identity=48%"; Hit description =ATGSL11 (GLUCAN SYNTHASE-LIKE 11); 1,3-beta-glucan synthase/ transferase, transferring glycosyl groups
  Subcellular localization annotation: CTP_CleavageSite=41; ConfidenceScore=5.04e-01
MNISKTIQNKALLQNITLNPDSACKIVTLIAKSNSKSTSKREMKQQNGTEAFLQHVNGRFHAFEKAHTMDPTSSGRGVRQFKTYLLHKLEKEGELTEKLVQRSDARELQTYYQHFYEKKIRDGEFNQRPEEMAKNVQIATVLYEVLKTMVSPQNIEEKTRRYAEDVEHKRGQYEHYNILPLYAVGVKPAIMEIPEIKAAIAALCRVDNLPMPIIRARPDASHDDSTMPTDRLKKVNDILDWIASVFGFQLHVETVEKLMAKVFKNYESWCHYVRCESNLRFLEDYDLKQIELIYIALYLLIWGEASNIRFMPECLCYIFHHMCHEVYKILDKNPARVTGSKDLVEGRDDEYFLREVITPIYQVLMKEAKRNNKGKASHSNWRNYDDLNEYFW

SEQ ID NO: 178622 - protein, 75 aa, Glycine max
  Coding DNA Sequence Number=SeqID_61844
  Subcellular localization annotation: CTP_CleavageSite=50; ConfidenceScore=5.18e-01
MSLKSSAPFPFLLSLPFAHALSVSYVAFSHTDPTPPQVREATDLTKKVVDLASKVADPLSPPTSLTMGIVNVVAM

SEQ ID NO: 178623 - protein, 179 aa, Glycine max
  Coding DNA Sequence Number=SeqID_61845
  Homolog annotation: Hit_ID=Q2HRX8; Match level="QueryCoverage=98%, HitCoverage=26%, E-value=2e-19, Identity=33%"; Hit description=IMP dehydrogenase/GMP reductase
  Pfam annotation: Domain name=DUF1723; Domain location=95-144; Score =50.7; E_value=4.8e-12; Accession=PF08330.1; Description=Protein of unknown function (DUF1723)
MDHAADEVHEQPEEAATDDVVPDAEVFPGGPHDKSILIDYAHHVAMNVWNGEERPELKLSSHGKKVEKFGRPAPEIEGLVVATGLSPPITCSLDTGKRGLILAFAERWHKETSSFHLPVGEVTITLNDVASLLHLPITCTFHSFEALHMDEAMLLLVELLEVSADEARVETVQCHGAYI

SEQ ID NO: 178624 - protein, 401 aa, Glycine max
  Coding DNA Sequence Number=SeqID_61846
METISFHKSVTCDDIGRLTNSLTVTKRLALKKQTQKPSSITERLRALSETESEDDKPFVFRKRKVAPRSNETYAPQVKKRWKISQGRRYKGYLDKSEIGSTRNPERGSHKKHMYFLKMPKVYFLENEFNTYSIVEQQSRFLVVTLGLHPSSLEPYQGEQSSIPDDASNNPFPVDIPQTSIADMDDVVRFEARLSLIHLDRFNHQGSHAVDPNLTVEDIASLCFPMQLHPMVSKPSFITDLCKNVYKIPSRAYREKVSNDKDIIGWFRKIDAQHINPSSDDFLPPFRVKAAPLGLKKEERYLTRDVVTKIIALNSGVEFDQSDAMLFYFKDMQEGDNEFYQRLIHDTPHFHSLFVFDLPKYSEVVMRRAIVTTWARIPTLKERSFSTDQNPWVLGQGMVAKL

SEQ ID NO: 178625 - protein, 80 aa, Glycine max
  Coding DNA Sequence Number=SeqID_61847
  Gene Ontology: Mol. function=transferase activity
  Homolog annotation: Hit_ID=Q9LXT9; Match level="QueryCoverage=87%, HitCoverage=3%, E-value=1e-10, Identity=47%"; Hit description =Callose synthase catalytic subunit-like protein
  Subcellular localization annotation: CTP_CleavageSite=24; ConfidenceScore=5.03e-01
MASTSGTKGGPFEMGRQPSKRMVRAPTRNVDLGNEGGVVDSEIVPSSLAVLVPILRAALEIDEENPRVAYLCEYFFIGLF

SEQ ID NO: 178626 - protein, 1134 aa, Glycine max
  Coding DNA Sequence Number=SeqID_61848
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=UPI000034F02F; Match level="QueryCoverage =99%, HitCoverage=62%, E-value=0.0, Identity=61%"; Hit description =ATGSL11 (GLUCAN SYNTHASE-LIKE 11); 1,3-beta-glucan synthase/ transferase, transferring glycosyl groups
  Pfam annotation: Domain name=DUF1462; Domain location=102-170; Score=- 37.6; E_value=0.1; Accession=PF07315.2; Description=Protein of unknown function (DUF1462)
  Pfam annotation: Domain name=Glucan_synthase; Domain location=299 -1041; Score=750.8; E_value=8.7e-223; Accession=PF02364.6; Description=1,3-beta-glucan synthase component
  Pfam module annotation: Pfam domain module=DUF1462::Glucan_synthase; Domain location=102-170::299-1041
MGMSIDNYQWHEFFPENETHNICIVIAIWAPIILVYFMDAQIWYAIYATLFGGIIGAFSHLGEDETYERQNIAYFSQVWNEFINSMREEDLISDRDRDLLLVPYSSSDVSVIQWPPFLLASKIPIAVDMAKDYKKETDDDLVRKIKSDGYMYSAVVECYETLKDIIMSLLLDEDDRRVVRRICGKVKECIHEEKFVKEFNLSGLPSLSEKLEKFLTLLRSEDGKLESQIVNVLQDIVEIIIQDVMFDGHLLLQTPHQYHVERGQKFVNIDTSFTHNRSVMEKVIRLHLLLTVKESAINVPQNIEARRRITFFANSLFMNMPKAPKVRDMLSFSVLTPYFKEDVLYSDEELNKENEDGISILFYLTKIYPDEWANFDERLKSEDLEEDKEEFTRRWASYRGQTLYRTGMMYYWQALILQYFIESAGDNALSEGFRTMDSYDKKKKLLEEAQAMADLKFTYVVSCQVYGSQKKSKNTRDRNCYTNILNLMLTHSALRVAYIDETEETKDGKSQKVYYSVLVKGGDKYDEEIYRIKLPGPPTEIGEGKPENQNHAIVFTRGEALQTIDMNQDNYYEEAFKMRNVLEEFRRGRSGQRKPSILGIREHIFTGSVSSLAWFMSNQETSFVTIGQRILANPLRVRFHYGHPDIFDRLFHITRGGISKASKVINLSEDIFAGKGRDVGMNQISLFEAKVANGNGEQTLSRDVYRLGRRFDFYRMLSFYFTTVGFYFSSMITVLTVYVFLYGRLYMVLSGVEREILQSPNIHQSKALEEALATQSVVQLGLLLVLPMVMEIGLEKGFRTALGDFIIMQLQLASVFFTFQLGTKAHYYGRTLLHGGSKYRSTGRGFVVFHAKFADNYRMYSRSHFVKGLEILILLIVYEVYGSSYRSSHLYLFITISMWFLATSWLFAPFLFNPSGFDWQKTVDDWTDWKRWMGNRGGIGISSDKSWESWWDEENEHLKYSNLRGKIIEIVLAFRFFMYQYGIVYHMDITHHNKDLLVFGLSWAVLVIILIVLKALLFLGFLSVMTVLFVVCGLTIADLFAAIIAFMPSGWAIILIAQACKVCLKGAKLWDSVKELSRAYEYVMGLIIFLPTAILSWFPFVSEFQTRLLFNQAFSRGLQISMILAGKKDTYKSD

SEQ ID NO: 178627 - protein, 98 aa, Glycine max
  Coding DNA Sequence Number=SeqID_61849
MMNPTQFQAKEEKVHAANDSLSERTASPPSEVVVSSHAQRAHSRLAKIHLLSLSKQCSLSEPCSLSEPSEAERSGETTSSRDTSFGATEVLSPENIET

SEQ ID NO: 178628 - protein, 108 aa, Glycine max
  Coding DNA Sequence Number=SeqID_61850
MKERIASLFSIESLRWIMRISLRSKRSSPYGGWWQATVAHGGHRWSWVVEKKISLNELISLSENPLLALSVSFCTKRNSSRVGIALSVSVIGKKSSYFSNPNGQIMKN

SEQ ID NO: 178629 - protein, 309 aa, Glycine max
  Coding DNA Sequence Number=SeqID_61851
MGYVGVRELSWRWATGDGGFMRDLWMWKNLLCTIARPPPSTTCDGVVPGDMSRGSGDLGDVRRAPGSQQIKGTKTTKQGGLCGGWPAVNLEARGASGNRLPGDVIDYQASKGNWKTVEASGNRLPVCLIDYTEEWVTGNRLPGMCNRLHSAFFRFSCPEAIVMAAQLIHDRVEMECLDGTWETLEGNTRCRFRGTIRFTATSLVHPDEPVCTLQRTVEWILPTPTPYRLVEPVQVIEVTSSEEDPEEDLEELPPEPAVDALDFLEGDEDPLPEVDSPEDVMSASEADSTEDRWVYLGLTVRFTLLFLYG

SEQ ID NO: 178630 - protein, 139 aa, Glycine max
  Coding DNA Sequence Number=SeqID_61852
MPGLGRDWSSLVLGNSTPPDVPKDYGVPITCGTRWRSGDGAQQVFPHPQIAHKPTIPCCPPPTELTYSHVAHILVSLNTGSPSILPSFPNIQRRASRLRKCPPFAIWSRNGHQRLKLCWATMVDERKEEEGCVRERESF

SEQ ID NO: 178631 - protein, 241 aa, Glycine max
  Coding DNA Sequence Number=SeqID_61853
  Gene Ontology: Mol. function=helicase activity; Cellular component =membrane; Biological process=viral genome replication
  Homolog annotation: Hit_ID=Q9LTU4; Match level="QueryCoverage=99%, HitCoverage=19%, E-value=1e-63, Identity=56%"; Hit description =Helicase-like protein
  Pfam annotation: Domain name=DUF889; Domain location=9-157; Score =93.8; E_value=5.3e-25; Accession=PF05970.5; Description=Eukaryotic protein of unknown function (DUF889)
MDSSNWRWDFRLGKRWIWQHYKDLEFLQSRAILASTNEIVDHINDYVLSLIPEEYLSSDSIEKSDTIESEGFSIITIEFLNSLSTSGLPNPKIKLKVGSPIMLLRNLDQNEGLCNGTRLIITRLANHIIEAKIMSGKGQGNTVYIPRLSMSPSQSPWPFKLIRRQFPIIVSYAMTINKSQGQSFASVGLYLPTTVFSHGQLYVALSRVQNKNGQKVMIHDKDKKPLSTTTNVVFKEEFQNL

SEQ ID NO: 178632 - protein, 201 aa, Glycine max
  Coding DNA Sequence Number=SeqID_61854
MVRSMIDATSGGALGDMTPAEARNLIEKMASNSQKFSARNDAIVLRGVHEVATDSSSFAENKKLEGKLNALVNLVTQLAMNQKSASAPVARVWGLCSSTDLLCSNLESMSNLKLMLQTFIIDPLSSKSNNNRIIMTFQATDTIQNACGPSRPYFPPPMQQQQQQQQRQQATKALPQPSLEELVRQMTIQNMQFQHETSASI

SEQ ID NO: 178633 - protein, 111 aa, Glycine max
  Coding DNA Sequence Number=SeqID_61855
  Homolog annotation: Hit_ID=Q00M75; Match level="QueryCoverage=27%, HitCoverage=5%, E-value=3e-09, Identity=96%"; Hit description=PPR -repeat containing protein
MKGESEKNKERVGMGKGGVLSVVLITELRDNGFDKWQQQKPYPCICKEAVSGFESMTNKSPRHNFTAAPGLALILVPHCPEALRYAKVWGRDIVRSLTLAYAKRLFPDSNP

SEQ ID NO: 178634 - protein, 142 aa, Glycine max
  Coding DNA Sequence Number=SeqID_61856
MPLTKWQVLERNWLALAYVPLTKWQVLEANRLAFAYVPLTKRHIVGGMYWGLGSMRLHICHPSWVAYTGVMAVCSCAHVVDGMYWRLGSGKYWSHRGDSLLHVCQSTWVAHIGVIMLKEGLTKGRPWILRTSKVRQWMLLSG

SEQ ID NO: 178635 - protein, 536 aa, Glycine max
  Coding DNA Sequence Number=SeqID_61857
  Subcellular localization annotation: CTP_CleavageSite=44; ConfidenceScore=5.36e-01
SMWLAKPPSLDKCCLSFFCQVVRDGCVFGVSGKSALRTDVTSVYCNRRVQRTRNTLGTSLALASYRRVCLPFKWSGNLILDQCSLSSCFLAFLILCFLAFGFPSSSSNFQRKGEGLTLNRWGHFSPRGGVRPSVVAGEPILVIVMLPPSTFGGVRRVSGGGDVRASPHVQHSLSARSPLSTLAVASYEWVRDEVWKYKSFLTSLVSVIALQCQVKCPFTLYHFSVCFAGALECGPFPTSLEQLGDNAGLRIFVSFLQHPAECAGVDKEILEQLLALSDARATLSLPSASDPLAALDDECLTLPSLVSEVGIMGDFAWRPLVKQVGPAVGTMKSSTIASSPGERSQLVGEVSPIVVATEVTPNPPSSILAKRKRDDAAGSSGHKKSKAFMSLRALGQVAGLLPTVAPAVVEVVVPATQADSIVASSSTVAAPFVKCCDVDSLWGTTYKPEQKTPVDFVFTFNKNLIRRMDYDTKRWCRRWCPWRCRSPSGGPLLELFSEWSALRSNRQLSAKVVGVLAKLLCTRLDGDELFRHCKDL

SEQ ID NO: 178636 - protein, 192 aa, Glycine max
  Coding DNA Sequence Number=SeqID_61858
MGEKLATQLAQASKVASSRSNSLLEESSGGPKWAWLLFAPPFLLSAPPFLFFAFEEVTETHGLRKNTSFRLPPHYGIPQIAQAYFLLISETSRYFIYCATKDAKYLKAANQSDASSIGACRPRIFFINGFLCFLKDEWQRNGERNRERRRHFKEKMSLEEAHHHRRPWIRAWRKKEMNEGRGREEHEILCSK

SEQ ID NO: 178637 - protein, 319 aa, Glycine max
  Coding DNA Sequence Number=SeqID_61859
  Gene Ontology: Mol. function=nucleic acid binding; Cellular component= intracellular; Biological process=regulation of transcription
  Homolog annotation: Hit_ID=Q1SHX5; Match level="QueryCoverage=70%, HitCoverage=65%, E-value=2e-87, Identity=64%"; Hit description=Zinc finger, C2H2-type
  Pfam annotation: Domain name=zf-C2H2; Domain location=155-177; Score =21.1; E_value=0.004; Accession=PF00096.16; Description=Zinc finger, C2H2 type
  Pfam annotation: Domain name=zf-C2H2; Domain location=239-261; Score =21.1; E_value=0.0039; Accession=PF00096.16; Description=Zinc finger, C2H2 type
  Pfam annotation: Domain name=zf-C2H2; Domain location=265-290; Score =8.7; E_value=1.2; Accession=PF00096.16; Description=Zinc finger, C2H2 type
  Pfam module annotation: Pfam domain module=zf-C2H2::zf-C2H2::zf-C2H2; Domain location=155-177::239-261::265-290
MSFRECNNVENKNLCLQTPTFIEWLKPSSSSSQTSSISSSPPSYSLIQHEQLVQDQTIQFLPFKEDQHIGVQKEGLEVKEEKKVEQVTVALHIGLPNTRGHEPDDDHDADEKKLFHVKEEEEPLKKSFQGNCSFNQERRFWIPTPAQILVGPMQFACSICSKSFNRYNNMQMHMWGHGSEFRKGPESLKGTQPAAMLRLPCYCCAQGCKNNINHPRAKPLKDFRTLQTHYKRKHGAKPFMCRKCSKSFAVKGDWRTHEKNCGKLWYCTCGSDFKHKRSLKDHIRSFGKGHSPHPSLEGFVEDEKECVTGSDDEDDVAHA

SEQ ID NO: 178638 - protein, 55 aa, Glycine max
  Coding DNA Sequence Number=SeqID_61860
MDNYLKGIINKSVLFFNVFALALLNNINILMFLVFNSALKGLDDTPQPKSKAGAR

SEQ ID NO: 178639 - protein, 805 aa, Glycine max
  Coding DNA Sequence Number=SeqID_61861
  Gene Ontology: Mol. function=hydrolase activity; Cellular component =nucleus; Biological process=protein amino acid phosphorylation
  Homolog annotation: Hit_ID=Q9FM64; Match level="QueryCoverage=98%, HitCoverage=96%, E-value=0.0, Identity=52%"; Hit description =Selenium-binding protein-like
  Pfam annotation: Domain name=PPR; Domain location=120-154; Score =22.7; E_value=0.0013; Accession=PF01535.11; Description=PPR repeat
  Pfam annotation: Domain name=PPR; Domain location=222-256; Score =39.1; E_value=1.5e-08; Accession=PF01535.11; Description=PPR repeat
  Pfam annotation: Domain name=PPR; Domain location=323-357; Score =39.7; E_value=1e-08; Accession=PF01535.11; Description=PPR repeat
  Pfam annotation: Domain name=PPR; Domain location=424-458; Score =37.5; E_value=4.7e-08; Accession=PF01535.11; Description=PPR repeat
  Pfam annotation: Domain name=PPR; Domain location=459-493; Score =45.8; E_value=1.5e-10; Accession=PF01535.11; Description=PPR repeat
  Pfam annotation: Domain name=PPR; Domain location=494-528; Score =47.0; E_value=6.4e-11; Accession=PF01535.11; Description=PPR repeat
  Pfam annotation: Domain name=PPR; Domain location=595-629; Score =52.4; E_value=1.5e-12; Accession=PF01535.11; Description=PPR repeat
  Pfam annotation: Domain name=PPR; Domain location=630-664; Score =14.3; E_value=0.15; Accession=PF01535.11; Description=PPR repeat
  Pfam annotation: Domain name=PPR; Domain location=666-700; Score=0.2; E_value=7.2; Accession=PF01535.11; Description=PPR repeat
  Pfam annotation: Domain name=PPR; Domain location=732-766; Score=9.2; E_value=0.61; Accession=PF01535.11; Description=PPR repeat
  Pfam module annotation: Pfam domain module=PPR::PPR::PPR::PPR::PPR::PP R::PPR::PPR::PPR::PPR; Domain location=120-154::222-256::323-357::424- 458::459-493::494-528::595-629::630-664::666-700::732-766
  Subcellular localization annotation: CTP_CleavageSite=33; ConfidenceScore=5.10e-01
MACLAPSHPPQTLTPNQFSLTHFSSLCKHGRIREAVNSLTQMHSLNLHVGPAIYGTLLQGCVYERALPLALQLHADVIKRGPTFALNDFVISKLVILYAKCGASEPATRLFRDSPSPNVFSWAAIIGLHTRTGFCEEALFGYIKMQQDGLPPDNFVLPNVLKACGVLKWVRFGKGVHAFVVKTIGLKECVYVATSLVDMYGKCGAVEDAGKVFDEMSERNDVTWNSMVVTYAQNGMNQEAIRVFREMRLQGVEVTLVALSGFFTACANSEAVGEGRQGHGLAVVGGLELDNVLGSSIMNFYFKVGLIEEAEVVFRNMAVKDVVTWNLVVAGYAQFGMVEKALEMCCVMREEGLRFDCVTLSALLAVAADTRDLVLGMKAHAYCVKNDFEGDVVVSSGIIDMYAKCGRMDCARRVFSCVRKKDIVLWNTMLAACAEQGLSGEALKLFFQMQLESVPPNVVSWNSLIFGFFKNGQVAEARNMFAEMCSSGVMPNLITWTTMMSGLVQNGFGSGAMMVFREMQDVGIRPNSMSITSALSGCTSMALLKHGRAIHGYVMRRDLSQSIHIITSIMDMYAKCGSLDGAKCVFKMCSTKELYVYNAMISAYASHGQAREALVLFKQMEKEGIVPDHITLTSVLSACSHGGLMKEGIKVFKYMVSELQMKPSEEHYGCLVKLLANDGQLDEALRTILTMPSHPDAHILGSLLTACGQNNDIELADYIAKWLLKLDPDNSGNYVALSNVYAAVGKWDKVSNLRGLMKEKGLRKIPGCSWIEVGQELHVFIASDRSHPKTEEIYVTLDLLGFEMH

SEQ ID NO: 178640 - protein, 246 aa, Glycine max
  Coding DNA Sequence Number=SeqID_61862
  Gene Ontology: Mol. function=metal ion binding; Cellular component =integral to membrane; Biological process=defense response to bacterium
  Homolog annotation: Hit_ID=Q2TE73; Match level="QueryCoverage=99%, HitCoverage=51%, E-value=4e-80, Identity=64%"; Hit description=Ring zinc finger protein
  Pfam annotation: Domain name=Ank; Domain location=131-163; Score =20.0; E_value=0.0083; Accession=PF00023.20; Description=Ankyrin repeat
  Pfam annotation: Domain name=Ank; Domain location=176-208; Score =34.5; E_value=3.8e-07; Accession=PF00023.20; Description=Ankyrin repeat
  Pfam annotation: Domain name=Ank; Domain location=213-245; Score =34.3; E_value=4.1e-07; Accession=PF00023.20; Description=Ankyrin repeat
  Pfam annotation: Domain name=Ank; Domain location=47-78; Score=12.9; E_value=0.43; Accession=PF00023.20; Description=Ankyrin repeat
  Pfam annotation: Domain name=Ank; Domain location=97-129; Score=31.8; E_value=2.4e-06; Accession=PF00023.20; Description=Ankyrin repeat
  Pfam module annotation: Pfam domain module=Ank::Ank::Ank::Ank::Ank; Domain location=131-163::176-208::213-245::47-78::97-129
MGQTLSCVQQHEDHGVLFPALASGELEVVEAMVEEDPTVLEHTIGCDRLSPLHVAAANGRIEVVLDFCCLASLDLNGGVVLSMLLDRSFNVDVLNRHKQTPLMLAVMHGKTGCVEKLIHAGANILMFDSIRRRTCLHYAAYYGHIDCLKAILSAAHSTPVADSWGFARFVNIRDGNGATPLHLAARHRRSECLHALLDNGALVCASTGGYGYPGSTPLHMAARGGSLDCVRMLLAWGADRLQLDSS

SEQ ID NO: 178641 - protein, 113 aa, Glycine max
  Coding DNA Sequence Number=SeqID_61863
MTSTSQQQPGQGSYPRSPKTAFVQWGLNKIYEKEDYEIYGQQAEYSTKLFFDMEIDEFNTLEISFAMEFEKDMNLNSNNHKNEVDLFLMKSLEKKKLGPVSPVDEENSDIEFD

SEQ ID NO: 178642 - protein, 79 aa, Glycine max
  Coding DNA Sequence Number=SeqID_61864
MVGRRRWWLEEDIVRTPQLCKNDDLGFQKDDVEEKKSSPPLLVLDVVDVSILGVDCRGEGKDVGVGGCEVVEYGVLYTL

SEQ ID NO: 178643 - protein, 299 aa, Glycine max
  Coding DNA Sequence Number=SeqID_61865
MIQLATSIRRRDQSSKFRLLKQSSFLKYPALDDEQDVLASQLRFLSANLIFDAFAICKHCSDKHNSRVFIHMDVFSLGPYVPWLRKDDGSKKQVETEKLTSIQILNISLHLIFNEGSSVFTIKQYRHLSPLFLEGVYDQLAGQMSLIGCRMVSNVSTNVGHGLDCLVDVKVQYPPLTGRWLKNPSVEMTITSQRHENDPLHFNAVTLQTDIIPYLKHHDDVAFRKLCDGVLRMLTSCALVGIILSQLSYMNRNVASIPHISLVMVAEQILGYGAELFGDTEILVESSHDLHDNKHMLIP

SEQ ID NO: 178644 - protein, 74 aa, Glycine max
  Coding DNA Sequence Number=SeqID_61866
MPIKRRIDTFVISIDWLEDFLVKAGVVAEAWPKGEYAETNLRVAVEEVEAANVAEASVLDQIKVLSMTTSPCHS

SEQ ID NO: 178645 - protein, 248 aa, Glycine max
  Coding DNA Sequence Number=SeqID_61867
  Gene Ontology: Mol. function=protein binding; Cellular component =intracellular; Biological process=translation
  Homolog annotation: Hit_ID=P49199; Match level="QueryCoverage=86%, HitCoverage=99%, E-value=4e-90, Identity=78%"; Hit description=40S ribosomal protein S8
  Pfam annotation: Domain name=Ribosomal_S8e; Domain location=33-227; Score=348.1; E_value=1.5e-101; Accession=PF01201.12; Description =Ribosomal protein S8e
MSNTQNDPFNKLLGAPAILLVAPSISQSEAVSGISRDSMHKRRATGGKKKAWRKKRKYELGRQAANTKLSSNKTIRRIRVRGGNVKWRALRLDTGNYSWGSEAVTRKTRILDVVYNASNNELVRTQTLVKNAIVQVDAAPFKQWYLQHYGVEIGRKKKVASKKDSTEEGEAAAEETKKSNHVQRKLEKRQKDRKLDSHIEEQFGGGRLLACISSRPGQCGRADGYILEGKELEFYMKKLQRKKGKGAA

SEQ ID NO: 178646 - protein, 71 aa, Glycine max
  Coding DNA Sequence Number=SeqID_61868
  Subcellular localization annotation: CTP_CleavageSite=52; ConfidenceScore=5.33e-01
MASGASGTPDCFWRKQPSSPGRAGRQPPPFFPIKRQKGTVLRVPDSPWLCISAILGEKMISVKKIQAEVLP

SEQ ID NO: 178647 - protein, 91 aa, Glycine max
  Coding DNA Sequence Number=SeqID_61869
MEITTTTVSLLLKKHPHKDVKLHMRGLSLLEGQNEDKEFAALKFGESSYRREEKKSSFKAHKVQMAEYDDLDNDSRGTMDDEMVLMSRKFK

SEQ ID NO: 178648 - protein, 100 aa, Glycine max
  Coding DNA Sequence Number=SeqID_61870
  Homolog annotation: Hit_ID=Q9LME2; Match level="QueryCoverage=85%, HitCoverage=9%, E-value=1e-10, Identity=40%"; Hit description =Synaptonemal complex protein 1
MVLLSCERSLLIDIQNQNLQAINHIKRKYELENMEIVNKEKEKVRYDFLADKAIAEIEAKCGQKIEECKEEQRQQLMRIEDEHTLLVSIEKVLNLKLLAA

SEQ ID NO: 178649 - protein, 195 aa, Glycine max
  Coding DNA Sequence Number=SeqID_61871
  Gene Ontology: Mol. function=protein binding; Cellular component =integral to membrane; Biological process=mitochondrion organization and biogenesis
  Homolog annotation: Hit_ID=Q1RSX3; Match level="QueryCoverage=73%, HitCoverage=34%, E-value=6e-62, Identity=79%"; Hit description=CBS
  Pfam annotation: Domain name=CBS; Domain location=50-175; Score=38.4; E_value=2.5e-08; Accession=PF00571.18; Description=CBS domain
MTNRVFGGYLYAKNFTVWRKAGKGGELTHDETTIIAGALELSEKTSSDAMTPITDIFSIDINAKLDRDLMNLILEKGHSRVPVYYEQPTNIIGLVLVKNLLTIDPEEEIPVKNVTIQRIPRVPETLPLYDILNEFQKSHSHMAVVVRHCEKTRQQSSNNNADDNKELGDLLKELREALREEQTAALDRIEAEYRE

SEQ ID NO: 178650 - protein, 58 aa, Glycine max
  Coding DNA Sequence Number=SeqID_61872
MGKRDNRIQIGDMGKCGVGKLWTMATMTFMLVVMMVVMTTIIMVVMATMAVVVITILT

SEQ ID NO: 178651 - protein, 889 aa, Glycine max
  Coding DNA Sequence Number=SeqID_61873
  Gene Ontology: Mol. function=DNA binding; Cellular component=nucleus
  Homolog annotation: Hit_ID=Q1SBB3; Match level="QueryCoverage=74%, HitCoverage=88%, E-value=0.0, Identity=58%"; Hit description =Homeodomain-like
MESIQQNYNDASMELASNSPPGSPDISDVVGAPQLDPRVGEEYQVEVLDIIKESERLRLLMNTADSEVMCDNSLSFVIGLPISVTWMHNAVEDSRCGGNLADVDGMINAIELAKETNFKKNIISDSEEELKLIAFRFVMTGNESSGQPGKSKNYVLFPGILSNSWSEADAKSFLLGLFIFGKSFIKIKKFLENKGMGEILSFYYGKFYKSEEYHRWSDCRKIKGRKCIVGQKLLTGQRQHELLSRLIPHVSEESKDTLLQVCQSYVEGRTSLEEYILSMKSTVGLGVLVEAVGIGKEKENLTSLAVELGKNNRVFPVPTCKAWSSLGPNDIIKYLTGGLRLSKAKSNDLFWEAVWPRLLARGWHSEQPKNQCYVHSKEYLVFLIPGVKKFLKRKLVKGDHYFDSVSDVLSKVVAEPNLLELEEETKVGSCNDEEPEKGLSKDDQSDYRHQCYLKPRASTTDHIKFMVIDTSLVHRGKSSDLMEIKSAPVKSVGRVEGNAAGITNKGAKLTRKVNHGKDMAENVDKKMTVIDTSMLYEGKLSKVREVRCLPVELGHAYKMTVLPRESKDSSFDEDSPSMMTREKRNISKPDNNANKMVESQKNQKTCVTDDNQIKRTIKHQFCRRARSDHGNPMVLPIKRRRLTACAKAETSRAIENSSGGLESKKVAFSQSSRFPDSHQIVCDSVSSQPNGSSIAYLADRSVEVNNEEIILNEICQSRSNSCFKVEKCESQSAVTFSTPQVPLKSEDGEMVATVEEDGLCEKANDPCLSTDTQGVVEKPQKASCDVGSMEEQPNTNPRRQSTRNRPLTVKALESLGNEFLHVQRRQKKKDILPHIDAFSPCRKARTSKTNLHSHSSDHGTAVLAKEKHFNGDHKVEIVELVEYFQATSL

SEQ ID NO: 178652 - protein, 52 aa, Glycine max
  Coding DNA Sequence Number=SeqID_61874
MPPSHRKGEKKSVDGAVAYWQFKLSDLVLTKVKGFPTWPATAPGGAVEKVRD

SEQ ID NO: 178653 - protein, 207 aa, Glycine max
  Coding DNA Sequence Number=SeqID_61875
MVDTELFATCVNHLEATMAKIVVAQTSITSKLDAIIRILNTMVPKQPSPSSASTKSPPMPPLLPKTTNPTSSSAKPPPTAETTPPPPTAKTTLPPLPMATSHLPVNKHLALSSESLPAASHRSHTKSSSRGILPSDIHFSLFVVCAATVRDTNLNHPFLLLFAIFIAAKGLCLRNHLQALILTPIFIWDPGSIFYTQHLEDKVFLMG

SEQ ID NO: 178654 - protein, 110 aa, Glycine max
  Coding DNA Sequence Number=SeqID_61876
  Subcellular localization annotation: CTP_CleavageSite=16; ConfidenceScore=5.07e-01
MDASTGTPPCPSRSICAWRASAHRRPLWRNPQAIAERRKLQFCKSSTGFFADGENAYSFGSSGFYSLFFDNDNILRLLYDGLEVSAITGHIHGWHLGKLIRTQCMLDGVV

SEQ ID NO: 178655 - protein, 106 aa, Glycine max
  Coding DNA Sequence Number=SeqID_61877
MEIYLIVLCNKLLGKNLCSDLTLNHQCSRAAEVHNLSERTHLKNFVRLWNDDYVNGRWFIYASNDVTSNREIGCDINKDICTQKHKSKTKETSLDSGRQREETRLS

SEQ ID NO: 178656 - protein, 56 aa, Glycine max
  Coding DNA Sequence Number=SeqID_61878
MAFSISPPLLPILTTTVLWHRLMGKKVLVVSSDVHIKDFYLQLENVIFLVVRLQCK

SEQ ID NO: 178657 - protein, 173 aa, Glycine max
  Coding DNA Sequence Number=SeqID_61879
  Gene Ontology: Mol. function=binding; Cellular component=mitochondrion
MGSFIEKQGRLMRTLRPSPASLAQSSWSLLSNALGGAYAKLDMLEKAEELKEHARRRGAKPNGKTLEIFMDYYLQKGNFKSTVDCLDEAISMGRWNEEFLEILKKSMESPGVEVFESLTRTYAATGRISSAMLRRLKMENVQSGMGRVRAACGAIGQGCAHKAPWVYATDYMP

SEQ ID NO: 178658 - protein, 194 aa, Glycine max
  Coding DNA Sequence Number=SeqID_61880
  Gene Ontology: Mol. function=binding; Cellular component=mitochondrion
  Homolog annotation: Hit_ID=Q5JL31; Match level="QueryCoverage=70%, HitCoverage=26%, E-value=3e-27, Identity=45%"; Hit description =Putative DNA-binding protein
  Pfam annotation: Domain name=PPR; Domain location=114-148; Score =12.2; E_value=0.27; Accession=PF01535.11; Description=PPR repeat
  Pfam annotation: Domain name=PPR; Domain location=44-78; Score=18.9; E_value=0.018; Accession=PF01535.11; Description=PPR repeat
  Pfam annotation: Domain name=PPR; Domain location=79-113; Score=31.2; E_value=3.5e-06; Accession=PF01535.11; Description=PPR repeat
  Pfam module annotation: Pfam domain module=PPR::PPR::PPR; Domain location=114-148::44-78::79-113
MAKRNMIKTVRDHAIHLDLLAKARGITAAKNYFVNLPESAKNHLCHGAILNCYCKEPMIEKAEGFMEKMKELSLPLSSMPYNSLIMLYTKVGQPEKVSSLIQEMKTSNIMLDSYTYNVWMRALAAVNDISSVERVHDEMKWHSRNWRREMLSKILLLTTFPKTANISYLNMIRVLVNSKDDGSLLEKLLWRLDL

SEQ ID NO: 178659 - protein, 49 aa, Glycine max
  Coding DNA Sequence Number=SeqID_61881
HTTSTVTCTSVATARGRSTPHTHDGRRDVRHKPIGKTLNKKEAFRARAF

SEQ ID NO: 178660 - protein, 510 aa, Glycine max
  Coding DNA Sequence Number=SeqID_61882
  Gene Ontology: Mol. function=protein serine/threonine kinase activity; Cellular component=membrane; Biological process=protein amino acid phosphorylation
  Homolog annotation: Hit_ID=Q0WPA7; Match level="QueryCoverage=99%, HitCoverage=98%, E-value=0.0, Identity=67%"; Hit description =Receptor-like protein kinase
  Pfam annotation: Domain name=Pkinase; Domain location=188-459; Score =161.1; E_value=2.9e-45; Accession=PF00069.15; Description=Protein kinase domain
  Pfam annotation: Domain name=Pkinase_Tyr; Domain location=188-459; Score=125.2; E_value=1.9e-34; Accession=PF07714.7; Description =Protein tyrosine kinase
  Pfam module annotation: Pfam domain module=Pkinase::Pkinase_Tyr; Domain location=188-459::188-459
MSANSSLHVELSRKTSFLGLRLWVLIGIGVGVFIVVILCVLSVWVMFRRKSKRSLDKYSLSQIPHVSKDIIVDMVGVQISHDQSESVAIPVHDKPSENNSNKLFSHLHKSKSGDADNISQCSSVYHHERGFSSMSGEEGSSGTVKKQSALSFGGMVTASPLVGLPEISHLGWGHWFTLRDLELATNRFSPENVIGEGGYGVVYRGKLINGSEVAVKKILNNLGQAEKEFRVEVEAIGHVRHKNLVRLLGYCVEGVHRLLVYEYVNNGNLEQWLHGAMSQQGTLTWEARMKVITGTAKALAYLHEAIEPKVVHRDIKSSNILIDTEFNAKVSDFGLAKLLDSGESHITTRVMGTFGYVAPEYANTGLLNERSDIYSFGVLLLEAVTGKDPVDYSRPANEVNLVEWLKMMVGTRRAEEVVDSRLEVKPSIRALKRALLVALRCVDPEAEKRPKMSQVVRMLEADEYPFREDRRNRKSRTASMEIESLKDISGPSDAEKLKGSEGHEPETTQG

SEQ ID NO: 178661 - protein, 171 aa, Glycine max
  Coding DNA Sequence Number=SeqID_61883
MSIRTNPMKAVPTLLKRLVTVEKHVNLNDLKSELTKIKDLFSKVKKNEEELLDTLADVKRAVAHPSIPEPEDLEMIKYHVITFFLFFPSSPFPTKITTTADHLVPSPRRPTLLPFFPLSNSKQPTPRHQHKTTHLINTSSLLIDNDNNNKIINNTSELNRVKKVGANLRGH

SEQ ID NO: 178662 - protein, 118 aa, Glycine max
  Coding DNA Sequence Number=SeqID_61884
  Gene Ontology: Mol. function=RNA-directed DNA polymerase activity; Biological process=RNA-dependent DNA replication
MCNLEDMNSACLMKLGWYIQNGNKKLRCDVMRGKHVGRASSKEYLESKSNDYFIYMVLEKIWLELEMQEVWSMDNGNVINMQSDKWITEDLRLKDVVPNIHVQVQNWTMSQFTDIDGT

SEQ ID NO: 178663 - protein, 49 aa, Glycine max
  Coding DNA Sequence Number=SeqID_61885
MHWMSTIILGSFRNNWETYFNDARPLEPERLKALRIHWAQYYLRLRDQT

SEQ ID NO: 178664 - protein, 70 aa, Glycine max
  Coding DNA Sequence Number=SeqID_61886
MLLLRAVLVSSTIKCEASGDWEARYSVVFQIGSFAKRKKEEVEMRVVITERAGRTKSVSYLCFPLISDER

SEQ ID NO: 178665 - protein, 305 aa, Glycine max
  Coding DNA Sequence Number=SeqID_61887
  Gene Ontology: Mol. function=translation elongation factor activity; Cellular component=intracellular; Biological process=translational initiation
  Homolog annotation: Hit_ID=Q9FF87; Match level="QueryCoverage=90%, HitCoverage=59%, E-value=1e-29, Identity=31%"; Hit description =Arabidopsis thaliana genomic DNA, chromosome 5, P1 clone:MRO11
  Pfam annotation: Domain name=mTERF; Domain location=38-303; Score =68.4; E_value=2.3e-17; Accession=PF02536.5; Description=mTERF
VTFTVSYLINSCGLSPELAYKLSNGVSLKTPNGPNAVLDTLKDYGFSKTEVAKLVEKHPRVLVANAEKTLLPKLQFFHSIGVSNTDMSKMIIKNPLILRRSLAKFLVPLCRMIRRVVHDDLEVVKVLRKSPFAFTYADMVNGLVPNIEVLRQSGVPQGSISLLMVHFPSVAYGKHSRFVEAVKRVKKFGFDPLKTAFVMAIQVLYNMRKLALELRFEIYERWGWNREMALQAFVKYPNFIKLSDEMVTKKMNFLVKDMGLSPEYIAAYPTVLGYNLEKRIVPRLSEDLPLLPDVYKGLIHHENVI

SEQ ID NO: 178666 - protein, 210 aa, Glycine max
  Coding DNA Sequence Number=SeqID_61888
  Pfam annotation: Domain name=zf-CCHC; Domain location=161-177; Score =14.9; E_value=0.0035; Accession=PF00098.13; Description=Zinc knuckle
  Subcellular localization annotation: CTP_CleavageSite=55; ConfidenceScore=5.21e-01
MASRVVTLVVSKLVMSFRNKHIWSRMVRPPKTPYPLPPPSGSAQIAHAFKMMAARLAVEANRIVIPQEFQGLTEFRRSDPPQLKGDSDLYETDHWIREGRVLVAWNPTDDESSWGIPNLGELQGMLFRQVTTKAWRCRKFVEGLRFEEKNVERLECSNQGIKCYICGRPHYASQCAQKEVIYYKRQKLRHIARNFQVVVETTPTRSAIRV

SEQ ID NO: 178667 - protein, 95 aa, Glycine max
  Coding DNA Sequence Number=SeqID_61889
MSPPRSCIDATPPILLLLATITLIFVLVLGHERSFVVRWKDELEPTWHLLHFSGNIHSVTYNQDLVSPALLARWTELIEFYGLTENHKVTLTHYG

SEQ ID NO: 178668 - protein, 169 aa, Glycine max
  Coding DNA Sequence Number=SeqID_61890
MGDSDKCGLVYEGLTTVHNVPLGNDQVKVGVKDARDVDDRVLNKQGAKGPAKSVDMPDPDIDPLCMTETSMQARNVDVYGFLEPQSIQKSGQSQFESEDYIKKWMQNSQRDVYLGAYLNGAHWQMIVILPKDNVLSWFCSLHNSPNNYPLYFCFEGTQRQTSKSKAAAR

SEQ ID NO: 178669 - protein, 176 aa, Glycine max
  Coding DNA Sequence Number=SeqID_61891
  Gene Ontology: Mol. function=DNA binding; Cellular component =chromatin; Biological process=DNA integration
MGGIAVDPSKVGTILEWESLKMTTKIRSFVGLLGYYKRLIKVFSKTMTPFTQLTCKDQPFAWTEECEKSFLKLKQRLTTSPILVLPDLDKPLGVYCDASHQGVGCVLMQSKKVMTYASHQLKIHEKNYPSHDLELVAVVFALKIWRHYLYGTKFDMFGDHKSFKYLFDHKELNIRQ

SEQ ID NO: 178670 - protein, 199 aa, Glycine max
  Coding DNA Sequence Number=SeqID_61892
  Gene Ontology: Mol. function=protein binding; Biological process =apoptosis
  Homolog annotation: Hit_ID=Q8LJ95; Match level="QueryCoverage=45%, HitCoverage=14%, E-value=3e-18, Identity=55%"; Hit description=NBS -LRR resistance protein RGH1-like
MSIRTNPMKAVPTLLKRLVTVEKQANLNDLKSELTKIKDLFWMVKKNEEELLDTLTVVDLLPVGDIEASGSSGETFQDVKLKQREEVNRTLPSSPELEDLQMFKRDSPEHHIEVESEEFLKELKHQKDLWYLSLHGMSRISELPLSIVELERLEILDLKAYHNLANDIASSRKFKHLDLSRCYLLERMPKGIEKLTKLQ

SEQ ID NO: 178671 - protein, 139 aa, Glycine max
  Coding DNA Sequence Number=SeqID_61893
  Gene Ontology: Mol. function=structural constituent of ribosome; Cellular component=intracellular; Biological process=translation
  Homolog annotation: Hit_ID=Q1S9V7; Match level="QueryCoverage=47%, HitCoverage=45%, E-value=8e-21, Identity=72%"; Hit description=RNA -binding region RNP-1
  Pfam annotation: Domain name=Ribosomal_L18ae; Domain location=1-100; Score=-63.3; E_value=0.0033; Accession=PF01775.7; Description =Ribosomal L18ae protein family
MKLWSTNEVRAKSKFWYFLRKLKKEKKSNDQVLAINQDTIKMAFCNKVGNVSRQSVAHSTQAPVSSMLNYIRCMSSSKLFNGGLSYGVDDQSLKDAFSGFGDVVDGKFGLLSLLSHGVQFQPPVSLTLPYVLQFPLMSL

SEQ ID NO: 178672 - protein, 180 aa, Glycine max
  Coding DNA Sequence Number=SeqID_61894
  Homolog annotation: Hit_ID=Q75GV0; Match level="QueryCoverage=31%, HitCoverage=11%, E-value=1e-09, Identity=40%"; Hit description =Putative leucine-rich repeat receptor kinase
MMLKLKNIHVARNITGNEKEYIYLDDWMRFMREDEAADIPSLSAEAVKEHPDVSYNVTAPLGLHELFVAQVENRDSKLVGQDICGVIEHVLILVGLRSSTVSFTQKVHRTLVGSTTSICVYGFYCFGKVLLELVTKIVDPSMVVDKDFLEEIWATSIVAKSCLKVVTSEFFRCNSYSSTL

SEQ ID NO: 178673 - protein, 69 aa, Glycine max
  Coding DNA Sequence Number=SeqID_61895
MVQQWPVMSVEEFLQKVAWPGVQPSPLGGVLEASPQPEPEPSTLVFDLPLSQDPSSAPALDLNEHTQDH

SEQ ID NO: 178674 - protein, 193 aa, Glycine max
  Coding DNA Sequence Number=SeqID_61896
  Gene Ontology: Mol. function=transferase activity, transferring pentosyl groups; Cellular component=imidazoleglycerol-phosphate synthase complex; Biological process=amino acid biosynthetic process
  Homolog annotation: Hit_ID=Q9SZ30; Match level="QueryCoverage=87%, HitCoverage=29%, E-value=1e-80, Identity=87%"; Hit description =Imidazole glycerol phosphate synthase hisHF, chloroplast precursor (IGP synthase) (ImGP ...
  Homolog annotation: Hit description=synthase) (IGPS) [Includes: Glutamine amidotransferase (EC 2.4.2.-); Cyclase (EC 4.1.3.-)]
  Pfam annotation: Domain name=His_biosynth; Domain location=14-189; Score=-39.9; E_value=3.5e-08; Accession=PF00977.11; Description =Histidine biosynthesis protein
QKPGEGKASKLAKRVIACLDVRTNDKGDLVVTKGDQYDVREHTKENEVRNLGKPVDLAGQYYKDGADEVSFLNITGFRDFPLGDLPMLQVLRYTSENVFVPLTVGGGIRDFTDSTGSLEVASEYFRSGADKISIGSDAVYAAEEYLKTGVKTGKTSLEQISRVYGNQILVEAGHIFRHLLISLLQGDVKEPHS

SEQ ID NO: 178675 - protein, 217 aa, Glycine max
  Coding DNA Sequence Number=SeqID_61897
MQVMEPGAFPLPMRSALPRDPTVHSSTHFHQLPDTKGYLSLPQNRPYNTTINSQLPFSGYTVYNQSPADMKYNLLQNRNEFLINGFPPATARDAFGFGNLGSSIYSSGSFLSNPSPGHMMPSSNFNEILPSQYNDGCNHGSFSHWDFGAEPRSLIIPERTQSQYVTPGYSDLYHSQTRVLEELQQPVPTELILLNNWGLRFLKVSWEWGPPFDDEKA

SEQ ID NO: 178676 - protein, 59 aa, Glycine max
  Coding DNA Sequence Number=SeqID_61898
  Gene Ontology: Mol. function=hydrolase activity, hydrolyzing O -glycosyl compounds; Cellular component=membrane; Biological process =carbohydrate metabolic process
  Homolog annotation: Hit_ID=Q8RZK0; Match level="QueryCoverage=90%, HitCoverage=19%, E-value=4e-18, Identity=72%"; Hit description=Beta 1,3-glucanase-like
MVALIVLQFNLVEAATSQTLSETMLLMPSISIIRRIPFLIAAILVELLSSLALTQIGKK

SEQ ID NO: 178677 - protein, 142 aa, Glycine max
  Coding DNA Sequence Number=SeqID_61899
  Gene Ontology: Mol. function=ubiquitin-protein ligase activity; Cellular component=ubiquitin ligase complex; Biological process =protein ubiquitination
  Homolog annotation: Hit_ID=Q10NB2; Match level="QueryCoverage=90%, HitCoverage=17%, E-value=8e-15, Identity=36%"; Hit description =Spotted leaf protein 11, putative, expressed
MAEPEAESFRMLRNLTRIVIQISTLSSAASFVPILKPQCCDLARRIRFLAALFQELHDDIVSSRAVHFLALEDALFKAMELLRFATRASQVFTILDREQVMFGFTDVAVRFEHALSMISFGELDVSEEIKEQEIEYILNVQK

SEQ ID NO: 178678 - protein, 122 aa, Glycine max
  Coding DNA Sequence Number=SeqID_61900
MQGNKNPDLVNDPAHAHSGPMLVQMMDPEKEAGLGRTRVAGAGGKGEVEGVDVEGAKVRGVEVDGASDPLALDLRVPQKVTEGSSRDSKVRESDVTPRALHKAIIRAGISSLEESCCAIREI

SEQ ID NO: 178679 - protein, 79 aa, Glycine max
  Coding DNA Sequence Number=SeqID_61901
MRGVVCIVVKTNPVIDPVEVVGQWVSGPTSWRDEFPRSAAMAMTTACSVALVESSVKMKRREESLELSSMKMSVKKRSG

SEQ ID NO: 178680 - protein, 398 aa, Glycine max
  Coding DNA Sequence Number=SeqID_61902
  Gene Ontology: Mol. function=ubiquitin-protein ligase activity; Cellular component=ubiquitin ligase complex; Biological process =protein ubiquitination
  Homolog annotation: Hit_ID=Q64HA9; Match level="QueryCoverage=94%, HitCoverage=48%, E-value=3e-86, Identity=48%"; Hit description =Spotted leaf protein 11
  Pfam annotation: Domain name=Arm; Domain location=164-198; Score =23.0; E_value=0.001; Accession=PF00514.13; Description=Armadillobeta- catenin-like repeat
  Pfam annotation: Domain name=Arm; Domain location=199-239; Score =20.3; E_value=0.0069; Accession=PF00514.13; Description =Armadillobeta-catenin-like repeat
  Pfam annotation: Domain name=Arm; Domain location=240-280; Score =29.0; E_value=1.7e-05; Accession=PF00514.13; Description =Armadillobeta-catenin-like repeat
  Pfam annotation: Domain name=Arm; Domain location=281-321; Score =13.5; E_value=0.25; Accession=PF00514.13; Description=Armadillobeta -catenin-like repeat
  Pfam annotation: Domain name=Arm; Domain location=322-362; Score =21.1; E_value=0.0039; Accession=PF00514.13; Description =Armadillobeta-catenin-like repeat
  Pfam annotation: Domain name=U-box; Domain location=7-63; Score=5.0; E_value=0.00014; Accession=PF04564.6; Description=U-box domain
  Pfam module annotation: Pfam domain module=Arm::Arm::Arm::Arm::Arm::U- box; Domain location=164-198::199-239::240-280::281-321::322-362::7-63
MAEKSVTFGVVMVTYDRSCIKKWLEAGHRTCPMTQQILSTSILIPNHALYGLISSWCEANGVEPPKRSGNLWLCKTTSDGSSEFIDLDILVSKLSSNDIEELRCAVEIGIWKDEGASPGAAVKLCLGDLLVMGSNPETASLHMQGSKYDGTYNWWPGELHCGFNAETAGAIPHLVDLLYAPDAGTQEHVVTALLNLSINVDNKERIMASEAVPGILHVLENGSMEAQENAAATFFSLSGVDENRVAIGASGAIPALVTLFCEGSQRGKVDAAKALFNLCLSQGNKGRAIRAGIVPKLIEMLTEPDGDMRDEAMTIMAVVANHSDGQAAIGSMNVVSTLVELVSNRSPGNKENATSVLLLLCNGDPFYLSIVSSLGLVNPLLDLAGNGSEGPSGKLPSF

SEQ ID NO: 178681 - protein, 145 aa, Glycine max
  Coding DNA Sequence Number=SeqID_61903
MTLDIIVNPQWPEVEGARVMVGCGGGGWTYGGSLCCINKFMLKSTESLKDLKDDSREPFLHSFFQVGLLKVLLRHTSWSNYGQRGYLSWSIGSSDCSPLELVGLGSSSSMDFFASWKMNDSGMKKKERGEMPLQGEDESRRSSPP

SEQ ID NO: 178682 - protein, 109 aa, Glycine max
  Coding DNA Sequence Number=SeqID_61904
  Subcellular localization annotation: CTP_CleavageSite=61; ConfidenceScore=5.45e-01
MASSGSSFWEKNAKDSEGVDTNTTTSQAKKRTKKKMGTSSSKVALVPRYPPPTLIAPKATSAMAHVTRRATPKKQQPLCIVDRLRELSETKDDEDGLVFKKRRVAPPSD

SEQ ID NO: 178683 - protein, 107 aa, Glycine max
  Coding DNA Sequence Number=SeqID_61905
MLCGIHHFFEDPKVVVPEPIRKFWRTAKVYRNEFIGGYFIEKVLGIIVKLTIETIAQAICCEHRGTKFMNSQGNKLEDHIGNFLWGPNWANMPKKYGTLLSKAKIFQ

SEQ ID NO: 178684 - protein, 115 aa, Glycine max
  Coding DNA Sequence Number=SeqID_61906
MTIAQHLQASSKVCKLKGELKKVEISLDSALNANITLARENLNLKECISTLEKELKAALAKTEKEKDFEREKKQQIKQKAYNEIYRAHESGFNQCLYQVMCFCEILDNSIFDIDK

SEQ ID NO: 178685 - protein, 154 aa, Glycine max
  Coding DNA Sequence Number=SeqID_61907
MTRFFNITISSIARNNHFFDSAKKFLFPLYWQQVPCRYGEHLKSLLTKEELSDLAYLETLPQQLLAKAIVTLLKSINLVRDLKALQNYILLNVSNTILAASINQILRVGTFRLVQFPSPKEPKEKDSCKGKRQNCDHKNRSAEPSSHKEAKKMK

SEQ ID NO: 178686 - protein, 71 aa, Glycine max
  Coding DNA Sequence Number=SeqID_61908
  Gene Ontology: Mol. function=hydroxyethylthiazole kinase activity; Biological process=thiamin biosynthetic process
  Homolog annotation: Hit_ID=Q9LIQ4; Match level="QueryCoverage=97%, HitCoverage=28%, E-value=2e-14, Identity=55%"; Hit description =Hydoxyethylthiazole kinase-like protein
MMQKITATGCSVTALIAAFVALDKSHALDAAVSALAVFGVAGELGMKMAKDARYGLDEAALNSPVNVTSLY

SEQ ID NO: 178687 - protein, 65 aa, Glycine max
  Coding DNA Sequence Number=SeqID_61909
MPQPHGINMGLKEHSNRVSLPPRPRLRRIHLGLTFLIQVHTGTHQFYNKLATEHQLIHQIRSVRD

SEQ ID NO: 178688 - protein, 315 aa, Glycine max
  Coding DNA Sequence Number=SeqID_61910
  Gene Ontology: Mol. function=protein dimerization activity; Cellular component=nucleus; Biological process=regulation of transcription, DNA-dependent
  Homolog annotation: Hit_ID=Q1SR56; Match level="QueryCoverage=54%, HitCoverage=79%, E-value=2e-46, Identity=56%"; Hit description=HAT dimerisation
  Pfam annotation: Domain name=hATC; Domain location=206-291; Score =114.1; E_value=3.9e-31; Accession=PF05699.5; Description=hAT family dimerisation domain
MLSTTLKFKTAFSAYSERDPHYTYAPSHEDWEKVQKVCTLLEVFNVATHIISGSEYPTANLYLLEVWRVKQVIDNALEDTTFFMREMAGSMKVKFDKYWGECNMLMSIASVLDPRCKFHVVNICFPLIYKSEEISKENIEKVRNSLQQLYDEYVTFSINESSLNEMNDTVINSSTTSASKSSIVTGFDQIMNIVRANEAIPPMKSGLEDYLKENVYIPETSNSSFSVLEWWRNNSLKYKVLSKMAGDILAIPISTVASESTFSAGGRVIDEYRSKLNEESIEALICGGDWLRHNYNLKKNSKVNEKLEEIILKIT

SEQ ID NO: 178689 - protein, 66 aa, Glycine max
  Coding DNA Sequence Number=SeqID_61911
MEDNRHHHHQELGLPRQFLGVNNNPNTNEQYWSGGGGATSTWTDLSAFSSSSTTSLGCFVWEGLLK

SEQ ID NO: 178690 - protein, 92 aa, Glycine max
  Coding DNA Sequence Number=SeqID_61912
MNRAINALQLKRKVTKPTGGGGDIIIVTRFWSDHRHQTSLQTNTDDLLRLLGTSDIHVSEFVWRLRCMDGGIALLYNNKRSRIKLLHLHGMN

SEQ ID NO: 178691 - protein, 110 aa, Glycine max
  Coding DNA Sequence Number=SeqID_61913
MMKCFSPLRSRTSCRVNLASLSNDDNHRTMVHSSADSRPFKCGKSRWQSALSIIKEDHVCMAEDHQNIIDRKLDKKSLVAILPPIDDYLTNRPEKPKRVLMVAPFSFSMF

SEQ ID NO: 178692 - protein, 39 aa, Glycine max
  Coding DNA Sequence Number=SeqID_61914
MTSRRSLFFITRADGVPQTSANHIGNTSISLDESPRQVN

SEQ ID NO: 178693 - protein, 334 aa, Glycine max
  Coding DNA Sequence Number=SeqID_61915
  Pfam annotation: Domain name=BSP; Domain location=91-321; Score=78.9; E_value=1.6e-20; Accession=PF04450.3; Description=Plant Basic Secretory Protein
MMMTITITILIVGGGDGGDDNDSDSWVNVSVGGGEPDGDEIDNDDGLTTILQHFADKNAKHFTSDSNNIVLRILSILLLALISLWANYEASKTFHITVVNDAKDSPAGRRFALSYVSNDEASRILLNTSSYVEHFLYPNSNNNDSNYPKKHIDSVTLQLPRRNLNVTDIVAVYTAAGNHLQRGGGKCFSYVIEISPTLLEDQRYDKIAIVGAILRGMAKVWIWEGAPQGLVDGMAEYVAEMAGFRRGMVSGGGEMPQCREGGGGWWWEDKDPSHVARLLHYCEKFKKGFIQRLNEAMRDTWHDRVVDEVLGMPVMELCGRLYNDNNASWVGSIS

SEQ ID NO: 178694 - protein, 79 aa, Glycine max
  Coding DNA Sequence Number=SeqID_61916
MERLCKQSFFMSMPNHAMSPIYEARGHMLGGIPCLRYCTRIATGMGWIRPGNVVDLLGTTNQDGDDNFICGDVLGTSVF

SEQ ID NO: 178695 - protein, 103 aa, Glycine max
  Coding DNA Sequence Number=SeqID_61917
  Gene Ontology: Mol. function=zinc ion binding
  Homolog annotation: Hit_ID=Q1S818; Match level="QueryCoverage=72%, HitCoverage=75%, E-value=3e-15, Identity=46%"; Hit description=Zinc finger, GRF-type
  Pfam annotation: Domain name=zf-GRF; Domain location=12-56; Score =29.6; E_value=7.6e-06; Accession=PF06839.3; Description=GRF zinc finger
MSSYTFDPQTRMMCLCSVEAPLVTSWTEDNPVRHFYGCGSYKVEKGCSFFEWHDSLVNSREKRIIVALMKKVDELKVREKGLQNKISDMKMKGKFLGIGLVLS
